United States Patent 8,067,671 (METHODS FOR GENETIC CONTROL OF PLANT PEST INFESTATION AND COMPOSITIONS THEREOF) - sequence listing, part 43

SEQ ID NO: 88066 - DNA, 676 bp, Heterodera glycines
  SCN-specific regions: Sequence locations=1-1,23-193,215-513,555-676
tgggtgaaaaccgccctggtacaattagcactgaaaatgcgcgaaatgcaaatgcgacaaccgcctacaagcgaccgcgtactggtctttcgatatccgaacacaactgttagacaatggggcagaactgggctcgcaattggaaccaaacaaaattcaccagcaatcgcccagtaaatacagcatttccaacaagaagttattgaaactttgtcgtgttgtttacgtgtcggcttgtccccaggaatttagtgaaaaattaattcttcatatggaacgatttggagaacttttcgattacgatatcaatgcaacgcctcaaattttcacatacaaagagccacttgatgcgcaaagagctgtgaatgaagcggtgggcagttttgaactggcaaaattgaaagtggaatgggcaccagtggcgaagggagtgaaggatgacaagaacatagtgccagacggggagaggaaaccatcggagcaggtcgctgcaaaggatttgatcgctttgctggaatacgatgaggaagaggaagatgacaagaaggagggagacgaggaacagttgtcggaaaaggagggaaatgactgattcatccagaccaaaccgactttaacatccaatgatgggtagtgtcgttcagttcaagctatcatgacattaaattcttcccaa

SEQ ID NO: 88067 - DNA, 697 bp, Heterodera glycines
  SCN-specific regions: Sequence locations=1-697
cgaattgttaaccaaaaaacggctgaaatgctaattgcttatatccccaaacgaattcatctcaatttgaatgtggtcggtgctgcatttcgtcagcgtatgccgttttctgcggctgtgcttgaccctcacgatcagctgaaagattcagacaagccgatgtcggagcagatgaacccttcattctttaagatggtcgattactacttcgacaaaggcgctgctgccattgagccgaaattggttgagaacttcaaagcttcgcatgggaaatcgaaagaagagagggtcagctctgtcaaagggattcttgcggcgattaaacccgttaacaaggttctttacgtgaccttcccgcttcgacgcgatgacggatcttatgagatgattgaagcatggagggctatgcactcagagcatcgtactccaacaaagggagggattcgcttttcgatggatgtgaatgaagatgaggtgaaagcgctgtctgctctgatgaccgccaaatgtgcagttgtcgacgttccattcggtggagcaaagggaggagtgaaaatcgacccgaagaaatactccgcttatgaaattgaggaaatcactcgcagttttaccatcgagttagcgaaaaaaggatttctcgggccaggtgtttgatgttccggcgcctgacatgggaaccggagaacgagaaatggct

SEQ ID NO: 88068 - DNA, 769 bp, Heterodera glycines
  misc_feature (462)..(462): n is a, c, g, or t
  SCN-specific regions: Sequence locations=1-122,144-769
tggatatttgacacatgaccaatgcaaatccgactaactgtgaacagactttggcgaatgaaccagtgccgtggcactttcgtcggcaatccccggcaatgatgaaaattcctcgtcgcccgccgttccctctgaacgaagtttagaattgctgaagaaatatttcggttattcgcgctttcgccccttgcaatacgaagtgatcgaagcggctctaagcaaacgcgaccaattggtcgttatgtccaccggttatgggaaaagtgtgtgctaccaattgccctctctcattcaaaataatctcactttggtcgtttcgccactaatttctttgatggaggaccaagtgaatgctctcgaaaatgtcggagttgaagctgcgtatttgggcggcaatcagtcgcgggaagcaattttcgactcaatcaaaaggggccggcttcgaatcctttacataacacnctgaggcttaccagtcaaccccagatttcatacagaacattcacgaatacgttggactgttggccgtagacgaggctcattgcatttcccaatggggccacgagttcaggccgggctatcgccaaattgccgatattcgcaatgttttgaccggtgttcctgtcattgctttaactgctacagccaccgacccggtgagaaatgacatcgtccaaaatttgcgactgagaaacccaaaagtgactttgtccgcatttgacaggaagaatttgttcattgaagtgcaaaaacgaactcaatcgctgag

SEQ ID NO: 88069 - DNA, 285 bp, Heterodera glycines
  SCN-specific regions: Sequence locations=1-285
agtggaaacatctcatcggctgggattgttacgaccatcacaataattgtcgcccgtagactgttttatccttccctagcgacgggtggggcggaacccattggtggaaaaagtgcttaggtcggaaatgccctctgtttgcagccatctcttgctaccagatcgctcaacgcttacacctcctgctgctggccaatttgaaaggtgtggcgaaatcgattgaaaagaatgagggcacacctacgcgaacttgctgagaaaatgcctgtccatctatctaatcgt

SEQ ID NO: 88070 - DNA, 707 bp, Heterodera glycines
  SCN-specific regions: Sequence locations=1-336,358-707
caaatggaagagccagcggagggatcgaaatcggcacgaggggcgacagctgctcaataagtgccaactcttccgcttctttgatttccgtgcccgattttgtgagggttgaagaaattcccgaggaatgtgccataaaacgcgtcccctcggctctatgttcatttgtcgacccattctgtgaccctaagaaacccgtcaaaacaacattttcggacatttccactgctgcatttaatatccgtgacggaatccttcggacgcccacaattaagtcagacgctctgtcgtcaatgtttggcgtcgatttgttcttcaaacaggagtatttgcaagtgaccggcagcttcaaagagcgaggggcgcgctttgcccttctgcgacttacggaagagcaacggcgaatcggagtgatcgctgcgtcggctggcaatcacgcactttccctggcttaccatggcagcaaattgggcatcccggtgactgtggtgatgccgaagttcgcccctctaatgaagatttcctgctgtgaatcttacaaggccaaagtcattctccatgggcttaacattcaggagtcaaagatattcgcttatgagttggccaaagagaaaaacctcaaatacgtcaacggattcgacaaccccgacgtaattgcaggccaaggaacaattggactggaaatactggaccaagtgggcgatgtg

SEQ ID NO: 88071 - DNA, 313 bp, Heterodera glycines
  misc_feature (175)..(176): n is a, c, g, or t
  SCN-specific regions: Sequence locations=1-119,141-313
acctcgtaatttctgagaaaccgacagttttgctcacgttcacaacagcgccattctcagcaacatcgcacaaaaatggcacgccgacgaagaaagaaggagccgcgaaagcagtcgtacaagctgtacgttcgacgtgtgctgaaggaagttcatccgggcaaggaaatctcannatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactggg

SEQ ID NO: 88072 - DNA, 736 bp, Heterodera glycines
  SCN-specific regions: Sequence locations=1-5,28-655,677-677,711-736
gcctgaacatggtggaggaggaggagcggggacatcggcgaccaatgatggcatcggcacgggcaatggcgtgccatccgatcaacggaacatccggcgcttcgtcgccgagttggagcagcgcctggtggagagtgaggcggagattgcggcgctctgctccgagaagcgtgagttggccaaacgcgttggacacatggccaacaaattggacacggaacgcgtccaaaatgcgtcggcgatggaaagcgtgcggagggaccggcaattgttggtggaggaaaacgagcgggaacgcgcactgcacgcggtgatgcgcgacaaatttgacgagttgaagcgcaaatttgacaccattgccaaaacggtgttggacaaacagtccgagttggagaaaatgaccaaaatgaacacggagttgagccaacagcttcatgaacaagcggaagcattggaaaggcaccgtgccgagttggaaacggcaacaaaaatggtcgccgaacgggacaccgaactgaaaggaagcgaatgcgagttggccaagtgcagggaggagaacaccaagttggacgagctcaggcaacaaatggtccatttgctggaagaatttggtgccaatttggacaaataaataatttttatatgtggcggaggacaaatgcaattacaatacaatgtataaaatattttttatttttatacaaataaaaccggtatttctaaaaaaaaaaaaaaa

SEQ ID NO: 88073 - DNA, 337 bp, Heterodera glycines
  misc_feature (333)..(333): n is a, c, g, or t
  SCN-specific regions: Sequence locations=1-337
taagctgcttattctagggaacgaattgttaaaccaacaaacggctgaaatgctaattgcttatatccccaaacgaattcatctcaatttgaatgtggtcggtgctgcatttcgtcagcgtatgccgttttctgcggctgtgcttgaccctcacgatcagctgaaagattcagacaagccgatgtcggagcagatgaacccttcattctttaagatggtcgattactacttcgacaaaggcgctgctgtcattgagccgaaattggttgagaacttcaaagcttcgcatgggaaatcgaaagaagagagggtcagctctgtcaaagggattcnttgc

SEQ ID NO: 88074 - DNA, 343 bp, Heterodera glycines
  SCN-specific regions: Sequence locations=1-188,210-218,243-278,300-305
tctttgttttcgttctttcttttatttgcactgtccgacggattggaaaatgatcaccgatatgcaattgggtatcatggccaatgttctcggcgtctccattttcattttggtcattttctaccattacatcgtcgccaaccaaaagaaacagtcgccgcagtgagcgaaagaagcgaagaaaacgccgaagaaagtcaaatgatttgatgggttatgattaattaattaatttatgtattaattgagagggacggcgcataaatttgtaattgattcattgtaaagagaaaacaaagttaattaaaaaaaataaaaaaaaaaaaaaaaaaaaaaaaaaaaa

SEQ ID NO: 88075 - DNA, 664 bp, Heterodera glycines
  SCN-specific regions: Sequence locations=1-421,443-513,535-664
tggattccctggagaatttccgttcgcagggctcgcgaactttactcggagatgacttccattggcttaatccccttcgaggaagtgttcaattcgctgctttcggctcaaattcccttaatagttcgtcgtcctctttcgacgtgactcattggctgcatgaaatgtctcgcctcggagtgcgcccatcggttaaaacgttcaatgccgctttgtcatcccttttgcaaatcaaagaaaagggagcaaattcatttgactatgggacggaagaaatggcagcagctgtaactccttcgactgaagaatcatcatacgataaagaacacctgtggaaaaccgcgtctgatttagtccatgaaatgcgttcgcttggaattgaaccgactttggcgacattttcttacactttgaaattggcaccaacaaaaatgagtttggatgctctgcttaatgagattttgacacgattggagtacaagctttcacgctccgaaccgatcgaacgtgttggggatgatgatgcaattttctaccgaaatgccatttcaatggcgcgcatactgaacaacgaattacagatggatcgtctggttaaaatttacagatccgaacacaacaaagtctttttccagaactatgataacgagcagagattctacgc

SEQ ID NO: 88076 - DNA, 502 bp, Heterodera glycines
  misc_feature (476)..(480): n is a, c, g, or t
  SCN-specific regions: Sequence locations=1-5,27-41,63-347,374-422,444- 480
caaatttttatttttccttcatttttgtatcttaattaaggcaatttcggggctccattgttggaattcgaacatgattttgctgagtgaaatgccggaaaagggcagtgtcactgtacgccaatgtccgtccgggcatcaatgcgtgacggcaaattgttggcttggagtcggcaattacattgtccaaaaatgcgtgccggaccagccaggggccagaaactattgcaaagacttcaacaacatttgccaaatgggctttttcggcatgccaattcattgctcatcttgtaagggtgatctgtgcaacgaagcgcgtaattaacaaatgatgagcaaattagtcaaattaataaactaattaattaattaaactggaataaagaaccgattttcaaattttatgtttgataaattattttatggctattgttgtattcaaattcaattcaattagaataaaaaaattgcccgcnnnnnaaaaaaaaaaaaaaaaaaaaaa

SEQ ID NO: 88077 - DNA, 395 bp, Heterodera glycines
  SCN-specific regions: Sequence locations=1-89,112-306,359-368
cctactgaccggcacagagaaaggcttaaacgacacgttcggcgcaacttgccacggggcggggagggcaatgtcacgtgcaaagtctcggagggcactgggctttgagcaagttctgaacagactgaaacagcagggcattgccattcgggtggcatctccaaaactcgtcatgttttaggctccggaatcctacaaaaatgtttgtgatgttgtggacacgtgtcatatcgccggaatttcgaaaaaggctgtgaaacttcggcccatcgctgtcatcaaagggtgaaggaaaattatgaattgtttatataatttatttaatttgttgattttaacaaaatttaatgaataaaatcttcatttcgaaaaaaaaaaaaaaaaaaaaaaaaaaa

SEQ ID NO: 88078 - DNA, 708 bp, Heterodera glycines
  SCN-specific regions: Sequence locations=1-708
tgaaggaggacccgacggtcgccgtttattgttattcgtccttttccgacattcgttccatcgattcattcgtcgacaaaattctcatcgccgtaaaagcgccttttgagccccaaccgcgttcttcgatcgaagtgcccgacccttgtgaaaccgggcgatacgaaatgaccgttcgtaatgaaaatggcggtcctctccaagcgtacctttgccgtgagcccacgcagaaaaacgcctcggaactcgcaccaaacaattgcaaagcggaaacggaggagaccaaagcgattgactctttggggacacaaagcttttgcgggcccaaaattccgtcgaatgagcttcggtcgccctccaaacagcagaaaatgctttcgccgttgaaattgctcttcgccaattctcagccgcaccccgacgccgtctcctcaaattccgtgggccccggcggcgttttcttcccgcccccgggcgattctttcctttcgttggaccccccttttgaggagaatgacccgtactgtccgctcttcatgaacgaccaaaacacttcactgaattcgctgttcggctgatcattcgctgcggcggagaaacgaaaggaaaaggcaaaagaaataacggaaagtgccaaaaaaaaagagagaaaagtgcacacatttaacattttctcatcagatgttctacttgcttctcataataaac

SEQ ID NO: 88079 - DNA, 784 bp, Heterodera glycines
  SCN-specific regions: Sequence locations=1-784
ccgtacccgccgttcctttttcttcgtcccctctctctcctgcgccgaatgtcgcctctccgatcgcgtcactgtgccgaatattttgttccagaaaattgtcgaaatcacacaaaaaggaccaaaatggacaccattcatcgaaatgatagtcaaaggtcgtgaaaatgtgttcatctccgtttcggttgatgagctcctcttcaacggttaccaggacccgctgatcagtgaaatttgcagcaatgttttattcaaaatgatgtgcaaattggcgaatattccggacagaattggcctcttttacgggcaaaataacacggacgatggccaatatgcggtggacactggactgaacgaccccgattttttggaccgcgtgtactccttcaaagggatagagggaaaactgagcgacgaccattggtacggcgaaagggcgcggatgatcaacgggacggacgcggaactgtttggaccgaatttgatggatgcgccgaaattgcaaatattcattggccaactttgccgttccttcgatttggaagttcgtcagcccgctctcaccgccgatctccccgtcttccgatacgcccaacccgactcggcgttggacatcgctgtgcagcggtcgcaaggcttttgcaacccgaattccccgcttttcttcaacgagagcgtccaacccggttggctgtgctccgtccggtcttctcgacatgtcctcctgtttccccggctctcccccattttcttttcggcctcccattttcgaaatgcccac

SEQ ID NO: 88080 - DNA, 519 bp, Heterodera glycines
  SCN-specific regions: Sequence locations=1-519
gaaatcgacaaaaaattcgttctctgtgtacaaaacgcatacgtctctttatttaattaatttgcttataagcaaagtttcctaaaatctgataactgaattgtcgttgctccgcatttgacaaaaaagaagaaaatgactctccagtggaccgtggttgcgttcattctttacgcagaaatagccacaattattgtgcttcttttgccatgggttcggccgacaatgtggaaaaaagtgtttaacagtcgcgttgtgcacaaactcaaacagttttccaatgtttacgcctacgctttcatttttgtgctcattcttttgttcgttgatgccacccgtgaggtgcgtaagtacagccacgtggacacgactagagagatggtgggacgagtggccgaggcggacgccgtcgttcacatgcgtctcttcagagctcagcgaaacctttatttgagtgggttttctctgcttatggcactgattatcagtcgcatcgtcactttgctcgcccgttgtgcc

SEQ ID NO: 88081 - DNA, 593 bp, Heterodera glycines
  SCN-specific regions: Sequence locations=1-142,164-517,539-593
ttgggataacggaccatttatatgtgaatatgtgtggaattaacaagtttcgacagaatgttcgcagcactcgtcaaattggagtcgaaagagagttgcgtgtcgcaatacatttaccacaaattaatgggtcacgacgtggacgacatcctcttcaagctgatcatgccgaaaaagttctccgcccctggccttcccgaactcaaccacagtcaaatatcagcgattaaagccgctcttcagagacccctttcacttattcaaggtccgcctgggacaggaaaaactgtgacttcggccactttggtttaccatttggtaaagttgaccaatggacaagtgttggtttgtgctccttccaatattgctgttgatcaattggctgaaaagatccacagaacgggtttgaaagtattgcgattctgtgctaaggggcgagagactgtggacagttctgtcgcctttctttcactgcataatcagctgaaggcgcttcagtcgggagacctttttaaactgatgaaattaaaggaagaaataggcgaactttctcaagccgaccaaaatcgtttcatggcactgagaagacagaa

SEQ ID NO: 88082 - DNA, 350 bp, Heterodera glycines
  SCN-specific regions: Sequence locations=1-350
caattggccgacctcgcaaagaaaacgctcatcctttttcgggatgccaacgaatcattcagcgaccaaaatgccgtctccgattggctccgccattccttcgatttgcctgctaattcgatttgcgaactctcctccccctcattggtcactaactcccaagtgtttttcattgttttcgacgaaattgggacagccgaaaggattttggaaatgagcaaatccgaggagagggctcagaaaacttttctgacttcagccaccgaatttttgcagtcgaattcccctggcaaatttacggacgccgccttttccgatgaaaatgcctggcgaaatttggcagcggcgtc

SEQ ID NO: 88083 - DNA, 450 bp, Heterodera glycines
  SCN-specific regions: Sequence locations=1-450
caatcgcggacaaagaagtgctcaacggatttgaggatttgtacgaggcgtttgtgcacttttttacgcgtggtgcgcctgccgagcgatgtatggtcaatgacgcggcctttgaccggatggtccacaccgttgaagacaaacatctccgtgcacagcattatattggtggcaatgccgcattaatggctcagaaaatcgcctcttcgttccccgctgcaacggcttatttggttggtccgattggcccgcgaagccacgcgctgttacacccggccatcgttcgaaacaattccacacgaattgcggaggacgaattgcacctcattttggagtacaaacagggcgaaatcctcggggagtacgtttcgcccgcctcttctcgtttcattgtttcccatgaccaattcagtggcagtgcgatgatcatcgaaatgtttttcaaggcaa

SEQ ID NO: 88084 - DNA, 140 bp, Heterodera glycines
  SCN-specific regions: Sequence locations=1-25,47-140
tatcggcgcaacagaggttaccatcacagcacacacaccaaaacaattcattgctcgtgaacgatgacgctaccaacgcaaggctaagtcggatgaagcagcaaatggcacttggaaaactcgacaaagtcggcattcag

SEQ ID NO: 88085 - DNA, 602 bp, Heterodera glycines
  misc_feature (65)..(65): n is a, c, g, or t
  misc_feature (509)..(509): n is a, c, g, or t
  SCN-specific regions: Sequence locations=1-29,51-299,321-602
taaaaggggacgcccatggagagcagcgacgccaacaataacatcaacaacagcgagggggaggnccgaaaataccaccaaaaacggcggagaggagggcgtcgagaagaagatcttgagcaaaggcgtcagcggggtggtcaaatggtttaacgtcatgaatggatacggcttcatttgccgtgatgacaccaacgacgacatttttgtgcacaattcggcaattacagcgaataatccatccaaaattcagcgatcattgggcgatggtgaaaaggttatgttcgacattgttgatggtgctaaagggccagaggcggccaacgtgactggtccggacggagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgaagtgccggtgggcgaaaagaaagaaggcgcanaagaaaacaatggaaaagaggctaagaaggaagaggttgcaaaggacgccaacggaggacgtggcggtgggcagcgtccaggccggggcgttc

SEQ ID NO: 88086 - DNA, 724 bp, Heterodera glycines
  SCN-specific regions: Sequence locations=1-724
ggaagaatgtgaacaggaatgtgaactccgtcgaggtgatgacatccgcttgcaaatcgcaattgaagagagcaagcgtgaattggctcgttcttcaagtctttcgtctccgtctggtggaattgaccctgtcgaaaaacagggcacctccaagtcgcacggagctttggatgatttgctttcattgggactggatgacgtgttcaggagtaatattccaaatgcgactgcgccgggtagttctgcacaaacacaacaacagccacctcaactgggcgttttcaacgacccctggtcgccacggccttccacaactattccaatggttgaaactgcgccgcctgtctccgctcaccagacaattattcaaaacgacccatgggcacctgcggcttcttcctcggatccaagctttgtgtcctttggttcttcgtcgacgactcgaacaataaatcccgatgggggccacgttctcggtcctctcatgcaggcatcttcaaccaaaaatgacccatgggcatcatttgaaacacaaagttttgctgcatccgaaccaacgaaacaatcatcggatgatttctttggaaacattggtgaacctgcacaaacgacgaaccaaccgacaagtcagggacagcaaagagccggtgtaaagacacccgagtcctttcttggagagaattctgctcttgtaatcttgatatctgcttggccttccaccatt

SEQ ID NO: 88087 - DNA, 512 bp, Heterodera glycines
  SCN-specific regions: Sequence locations=1-24,46-512
tgtcgtgttcctgtcgctaactgtcctcccttttcccttttttatcctcatcgttgtcctgaaccaaaaatgctttatcctgcacaagctaacattgtcaaccgtctgctgtctcgtccgagtccatcctaccgttgcaccatggacacacttcgtcgagctgatcgacgattagtgttcagtagattcagacattggaagtcattcagcgaagagtctgaagcacttacatgctgtgctttttcgcccacagataatcatgcttttctgggaacatatgctggtgacattttcgtcttcaacattcacactggaacagtcgaaacgaattacaatgcacagcattccgcgatcaggacaattcagccatcgaaggaccggttgatgctaacatcgtcagcctatgtaaagccttattgtattctttggaaaatggacgaaaagggaatttccatccatgagcgcttgattgatttcaatgaggaagaatcggtcgaatttgctaatttgtc

SEQ ID NO: 88088 - DNA, 771 bp, Heterodera glycines
  SCN-specific regions: Sequence locations=1-771
ctattattttttgattatttttaatgccgaataattttgtagttacatcgcattgtcggttattatcagggcatacgtccattgacaaatgatcaagccaagaagttgacccatcttatcctggcattttcaacccctgactctcaaggcaatttgagtccattgttttctgtgcttaaacaagcgctaaaagcgggtaaatccgctaatggtgcgctcaaagtgatgattgccattggaggaggtggctttgatccggccatatttacttcgttagcatcaaacagtggcacacgtaaaagctttattaataacattgtttcttatctgaaaaccaatgagctggacggttgcgacatcgactgggagttcccaacttctagtgacaaggcaatctttgtgacatttctgcgcgacttaaaaaaggcgatggcacccagcggcgctgtgcttagcatggcatcggcagcaagtgccttctatttggaccctggttacgatttgccaggcattgagagtgccgtcgatttcattaacgtgatgtgctatgactattatggaagctggaccaaaacatcgactgggccaaactcgccactgtttaagggtggcagtgccgacccatcggacacattgaacagcaattggacaatgaattatcacttaatgaaagtgtataatcgagcaaagctgaacatgggcgtgccattctacggaaaatcttggaccaatgttggagcaccactaaacggtgacggactttggcgtcag

SEQ ID NO: 88089 - DNA, 665 bp, Heterodera glycines
  misc_feature (660)..(660): n is a, c, g, or t
  SCN-specific regions: Sequence locations=1-665
caaaatgggtgccatgccttgcggacaccggcacttccctgcttgctgggcccaaaaatgacattgaaaagattcagaaatacattggggcaattccgctcttccatggcgagtatatgatatcatgtgaacgtattcccacactgcccgatgtgacgatcaacatcggtggcaaggcgtacacgttgaagggcaaggactatgtgctgaaaatgaccagcatgggcaaaagcatatgcctttccggttttatgggcattgatttgccggaacgtgtcggagaactttggattcttggcgatgtgtttattggtcgttactacacggtgtttgatgtgggccaaagtcgtgttggttttgcgcaggccaaagacggaaatgaaattccaattgagcctcaagtgcgcgattgcgtaaggggaggcgcactttgcttcgatcattccaacggagttgacgattctgatcagcagatggttgagggcgattttgtaatgacggactgaagaaaattgattttatttatgcaattttcagttttatacaatttttaatccatgacgaagcctatgagtaaactatttttcctagtctgataattgtaatcaccatgtaattatcaatcgatgtgataaataaatcattatttttccaaaaaanaaaaa

SEQ ID NO: 88090 - DNA, 587 bp, Heterodera glycines
  SCN-specific regions: Sequence locations=1-265,287-587
cccattcttacaagaacatgaagcatgtgttgaagcatctgattgtaattaaacgtggtgacgccatttgcccgtgaggatgagaccgaattcatgtacggatgacaagaaagactgtccaaggaacggcaaacaggacggaatcgcatctattgttggacaacacagaaccgataggtggtgcagacatactgatggcgagctctgttcttgccattgttctacaacaatttgctctttttcgtgctgctcgtctttctctcattcttcattctctactccattttgcccatcttaactgtcttgtctcgatgtatggcgctgcgggcattgttttgctattctcaacttcaaagaagtaaaatgatgactatcattccgatacatgtataatttgttattctggagtgaacaattaaagattgtggtgatttattttaaaaagaatagcatatacatcatttgaaaatgagttacattcgttcgttcaatggaatatagtctggggtatatcctactatttcgtaagacaaaaaatgataactggaagacgagattaatcgtttgaaagcactcataaattcaaa

SEQ ID NO: 88091 - DNA, 509 bp, Heterodera glycines
  SCN-specific regions: Sequence locations=1-89,115-199,223-258,283-483
aaattggccgtgtgggcattgtcggacatcgcgaacggcacccgggttcctttgacattgtgcacatcaaagacaaagttgtgaagggcagtacaaactgtgcaaggttaagaagcaggcggtcggtgacaagcaagtgccgtacattgtcgcgcagacgcgcgaacaccattcgctacccggacccgcacatcaaggcccaatgtgcgatttgctgtggtccgacccggacgattggagctggacgacgagctcaactactccttcctgcagtttgacccgccggccgcgcgtcggggcgagccgcacgtgacacgccgtacgcccgactatttcctctaggcaaggaccagggaccgacatacaaccaccgactgactgaccgaccaccaagaatgatgatggtgtatttgatggataatggaatatattctttttttgttttttaattgaatacagcaacaaaacaaacaattaattgccaaaaaaaaaaaaaaaaaaaaaaaaaa

SEQ ID NO: 88092 - DNA, 754 bp, Heterodera glycines
  misc_feature (716)..(716): n is a, c, g, or t
  SCN-specific regions: Sequence locations=1-729,752-754
accggagtcgtcactcccttggagcgttttggcgatatttgcaatgcatatgacgttcttttcctcgtggacaccgtcgcctccatttgtggtgcccctttccatgccgatgcgctgaaagttgattgtgtgtatgccgcaactcaaaaagtgttaaactgcccgcccgggttggctcccatttcattcagcgaaaaagcactggagaaaataacgaagcggaaaacgcgagtgccctcattttatttcgacgcgttagagttgggcaattattggggctgtttcgacgagccgagaagataccatcacacggcgcccatttcgttggtttatgcgctacgcgaaggtctttcagcagttgcccaggaaggaattgggcacatggtaaaccgacacaaaatcaatgcaaaacttttgtatgacgcttttgaccaattgggactggaattgtttgtccaaaaagagaataatcgtttgccatgtctcaccaccgtacgcgttcccgaaggtgtcgactggaaggcggtgcaagacaaactgatggcccaaggatttgaaattgccggcggattgggaccaacggcgggtaaaatatggcgcatcggaacattcggaatcaattcgaacccggaggacattgagtcacttaaacaagcattgaaaggagcactttacgaacaagaggaggagggacagtcggaccatttcaaggcggncatctgatgacagagggaaaaaatggcaaataaattaa

SEQ ID NO: 88093 - DNA, 129 bp, Heterodera glycines
  SCN-specific regions: Sequence locations=1-44,66-129
tccgagctgtactctcatacaaagccgctttccccgaagcgtgcccttccattaggaaaatggaggccgaatgtatccggattttgtgcagtctttttcacggaggtgccaaaagttgtggagtggtta

SEQ ID NO: 88094 - DNA, 268 bp, Heterodera glycines
  SCN-specific regions: Sequence locations=1-130,154-239
ccaaaacggaggggatcgcgataatttcggatattctccaaattacaccgattagcaatgctcggatggaacggacaacaatttgctcaagaatgcgactgtggcgcaggtgcagcaatcggctctcgtccctggcggtgtcttggcttcggctgtttagaattgatgctttttgcctttgagaattcgtacgaatgcaagacgaaattgacgatttgctgtaaaataaaaaattaactaaaaaaaaaaaaaaaaaaaaaaaaaaaaa

SEQ ID NO: 88095 - DNA, 189 bp, Heterodera glycines
  SCN-specific regions: Sequence locations=1-189
cctacacagagttgaggcttcggatacccaccgctatacggatgaaatgacggacaaggaactcccacttctctgcgtgggggcgacggacgcattcagaagggtgtgaactgtccgacggacatactcgcccgacgtcaaacaacagcgacatttatggacctttcactgacctgcagaggatcttcc

SEQ ID NO: 88096 - DNA, 512 bp, Heterodera glycines
  SCN-specific regions: Sequence locations=1-171,193-287,310-512
ttaaaagatccgaaaaaatgccagacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgtttagttttcaaattctattctatcctctcttatttatt

SEQ ID NO: 88097 - DNA, 526 bp, Heterodera glycines
  SCN-specific regions: Sequence locations=1-526
ccgtcaccttcgccttattatccatcccgacatcatcaaaggctgcgcttttgacactatacgaaggagacgatgacaacaacaaatctccgtcaaagccgttcagttcatgcaccagcaccaatggataaccgtggcatggcaattttattgtcccatgaggaggaatagccacagggggaggagactgattggttgtggctctgttctccaaccattccaaatagttgtccaacaaacgaacaaatgctcccgcgccagccttccttcccggtgcgacggtaagcttggatttcaaatctctgaagttttcgaatgggcgattggcgagcacaaaagcaacgaatttgtcgttgaatttctcgcaagcgttcagttctgtcacatcagactcattcagaaattccacacatttctgctccaattcgcgcatcaatttcaattgacgggcggaaatttgttcgttcgcatcgctgtcctcactgtcgtaactgtctgcgcgcatatcgacgtctccgtcgttgga

SEQ ID NO: 88098 - DNA, 191 bp, Heterodera glycines
  SCN-specific regions: Sequence locations=1-191
taattcctgcgtattattgcggctgctgttctctgtccgtgccatcatcaaatcaaatcaacgaaagctgagccatcggaagtgtgcacaaatcgactaccaaacgaaactgggcaccacaaatcaacaaaatcatcattatcatcagcagtaaaagtggtgcagaaggaaacgcatggaccaaatcggcg

SEQ ID NO: 88099 - DNA, 247 bp, Heterodera glycines
  SCN-specific regions: Sequence locations=1-247
gggagcgaaactttgccgcgctggcagaaatacaatggccgaatcgaaccaattgcacgctgcctgcatggacacgagcccaccgcttaattatctgaacgtcacttcgcatgcactcatcgaatttgtgcacgacttcaacacgcgctacggcacgcgactcgcgtacacttttgacgccgggcccaactgctgtctgctgttcgaattggaaaccttcgacctgcttcgccatgcgttaccaaat

SEQ ID NO: 88100 - DNA, 237 bp, Heterodera glycines
  SCN-specific regions: Sequence locations=1-126,149-237
ggcgcccctttacttgtatttgaaatacctccgccgatcattacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgacgacgacacagggagggggagggacatcgatgac

SEQ ID NO: 88101 - DNA, 494 bp, Heterodera glycines
  SCN-specific regions: Sequence locations=1-349,371-428,451-494
gaatactaaactgacatacattttttttcctttctatccttaattttgaaaatttgaattgattgaaaataatcgtgtccattcattcccgcttttcccattaaaatgtcccaatttggcccggcattcgctgtcaatgccaacaatccgtacgctcacttcaaatgctgctgtgcaacatttaatatcaaagaccatgcccagttttgcggtgtgctcagtttcgcgctgttcctctgcctcgtgctcatttccatgatgcttttcgggtcgctttctctgttttacattttcgttggtgtcgtcgtttacattcttttgatgaaaactctctttggcgtcgtcaacaaattgtcccttctcttttacatctttttcgaggccattcaaattggcttttacttggctttgatgctttacataattgtaccgttgctttttcttgaaattccccgtcgcaactgtcggaatgttgagataacagtgaaatttgc

SEQ ID NO: 88102 - DNA, 509 bp, Heterodera glycines
  SCN-specific regions: Sequence locations=1-75,102-509
attgaaaatggctggcaaattcatcggcggaagaatgccttttcgtcaatcactttgggctccttcctttctcacagtttctcccctttggccttttcccttacgtcccaattccgctttttcccatgctcgtgtcttcaattccgaattcccttcttctcattctccgaaattgcgctgtgttttgtcggctaataataagacaaattctcgggcccggcgttaccaccacccgcggcctcatctggtcatcttcgacaaggacggcactctgatctgttttcattctctgtgggtcccgtgggtgcgaagctttgcccaaaaagttgatgaggcgggcatcgatggcattgccccgaacgtgttccatgctctcggcttttgtccagttctcaaaaaggtaaagcgtggtcttctcgctgagggaacgatgcgccaaattctggaccgagttgtccacctattggttcaaaacggtctccaaaggcgcgagtcactgaacgtcgatg

SEQ ID NO: 88103 - DNA, 165 bp, Heterodera glycines
  SCN-specific regions: Sequence locations=1-125,147-165
catttcgacctgaatgtcagctgcggtttcttcttcgcgtccgatggaagattggaaatctgagttagctatgccagacaaggaccttcgatacaaaacatctgatgtgactgcgactaagggcgttgaatttgaggaatttgggctcactcgcgaccctcttaa

SEQ ID NO: 88104 - DNA, 283 bp, Heterodera glycines
  misc_feature (156)..(156): n is a, c, g, or t
  SCN-specific regions: Sequence locations=1-283
ggactagtgatagtccaattagagcattcttatattctagttttttttctgaagaaatgaagcagccagaaccaataattaacaaagaaaatcttcgcccagccaatcagccaagcaataaaatgcatgaaggaataaattattcggagttcgganaggaatggaacgaaaaacaatggaaccctttctgactttgccatggacctcccctcggaaagggaaattccgaaaatttttttgggcgcccccccaaatttttcttttcgcgggggggctaaaaaat

SEQ ID NO: 88105 - DNA, 254 bp, Heterodera glycines
  SCN-specific regions: Sequence locations=1-254
gtgattcgggatacgttgtaaggactgctcgaacgagtggagattgagccgaaatcttcttccgacacaatggccttttaaagacaatactgctggatatttcccaacttggccactttggacaagggcggccaatacaaaactgtcaaacaccgccacactgtccaagtccacccaaattcttgtttgtttgaagaccgacttcgttgggtgatttactacgaattggtattcacttccaaagagttcatgcg

SEQ ID NO: 88106 - DNA, 90 bp, Heterodera glycines
  SCN-specific regions: Sequence locations=1-9,32-90
ggacgcgcccctttcctttctttgaaatcctccgccgatcttccaaaagctcaaaatatcccccgtaaagcgaacacaaatgagatgacc

SEQ ID NO: 88107 - DNA, 310 bp, Heterodera glycines
  SCN-specific regions: Sequence locations=1-86,126-277,300-310
gaggtaagaagaagaaaagaagtcgaaggaagaagagggcgaaataatgttcgacgagaagtcgaagtcggaggatgatgagttggaggagaagaagaagtagaaggataggatggaaggatgaaaagcggtggtgaagaaaacaaacggacggatcagagaaaaacccaaaaaaatgcacccctcccaagcccattttaatcatcatttgtgtacccctccaattcctcgtcccgccccaaatttcattagccaattgcccccatcaacctgtatcatcatcaccaacccaattcaaaattagccattg

SEQ ID NO: 88108 - DNA, 396 bp, Heterodera glycines
  SCN-specific regions: Sequence locations=1-396
attgcagtgcgcgggagattcggcagggttgtggcagagttacgtcacgagatccgcattcagttcgcaaatgttgaacaactcacaaaacatcgaggaattgcggcataacactgagggctttgccaaagcgcttggcttttcgtcgactgcgcaccaccgaatttcttccaaaatggccgggagtccccaaactgtccgcgtctttgtcgacgaactttccaggcgctttcgtcccgtgtttttctcccgactcgaaggcgcttggaaaacgtatgccgaagaacaggaagaaagggtgatttccgatttggaagcctttgatctcttttacatttgccgtaaagaggcagaacataaccaaaatgttgactctcttgagctgatggaacattt

SEQ ID NO: 88109 - DNA, 626 bp, Heterodera glycines
  SCN-specific regions: Sequence locations=1-356,382-540,572-626
ccgtcgatgttggagacgcgccgcacatgatgttgacgcgggcaaagcgtgccagcggcggccgatggaccacgcagcagatcatcgagtgcattttcgcaattttcatcccgcccgttgctgtgctgatccatggcggccacgaatgggtgctccatctgatcatcaacatcgtgctttggattctcggctggattcccggcaccatccacgccttctggtactgtttcttccgctagatcgatgaaggatgatgatcaacaccgatcgagacccccatcattgttgaagaaccggcccaagaaatgagaatcctgccgccttatttttccgatcattttatgctttttatacatcaaccacaaaatacaacaacaaatcgccaacatattttccatatttggataacaaaaaaaaagcccgatgatgatttcgatcagccccatcaattttttaattgtttttttctccaatttttaaatttgttcaaagaatttgcttgctttttcgcacctccctcgtcgcccccccccccactcatttatttggtttatatgcttttatagaaaattttttaatctcatttaatgaataaagttctacaccccaaaaaaaaaaaaaaaaaa

SEQ ID NO: 88110 - DNA, 771 bp, Heterodera glycines
  misc_feature (4)..(4): n is a, c, g, or t
  SCN-specific regions: Sequence locations=1-192,215-771
gcangaaaatggagacgacaaaagcgcaattgctcggcattttctgggactttttctccgaggcagcaaaagcgaatttattatggaagagattgcgatttgcggaccagcaaattgtcgagttggtagaccaattttgcagaattgacaagcaatatttgttgtcacattcccaaataacactggcattacgaaatgtggataatgcaatggcattttgccaaaattggcttgttgcgtgtgctaaagcagcaaatgccatgcaaacgaccattgtgatggacgcattttcgcattggatttacagcggaagaccaccattaaatggggctattgaaattgttcatttttggattgaactgttcagcaaaagaacggcaacaaatgacatcagacgaatgtgccgatggcccgaaatcgataagaatcttttccggcgaatcggcattctctttgtcgaagccaatgaaaaatatgtactcaaattgaaaatattagaaaaaatcaaaggagtcagacaattgttggacgaaatttgtgccaatgtaaatcatttgtcattgacatgttgtgcacataattctttgcaaattgcgatggaccaatggaaaacgacggtttgcccaaatggccaatttcgatatttacttcaaccaaaaaacaaaaaaaacaaacaaagcgcagaaatggtgctgtaccaaaatcgacaattaccgccggcacatgcaaatcaacaattaagtacaaataaatgtgcgatttgtttgtcgg

SEQ ID NO: 88111 - DNA, 732 bp, Heterodera glycines
  SCN-specific regions: Sequence locations=1-526,548-732
accgcaccgccggtgctcgaccttacagccctcgtcacggtgacgacgttcctcgtgccgagccatgcccatcgcgaccgtgtggtgacgatctcgtcgcctgaaaactcgaactttattcagtgcgcccctagctatgcattccgcaagacgggtgttcttgaaatcgccaacttcgagcctcgttgggagcaaatgctgtacacgcttttcctggcggaaggctggatcgtgaatgcccctgaccacgaaggtcccgagagcgctttctcggctggccgctttggtggtcacatggtgcttgactcgatgcgcgctgcgaacaactttaagccgctccaactctcgaagcgccctatgcacattggtcacggctactcgggtggctcgacgcccaacggctgggctgcgagtctgcacgagacgtacgccaacgagctgaacgtggtgggctggtcgctgggtggctcaatgactgacccgctgtacacgctcaactccctcgacggtaaacctacttcgtcgctggtggtggccggtgccattggcttgatggacgcctacagggacgaagtcggcaacctgctcgatgacgaggtctggaccgaagaaggtaagattgccgaaaaggtcatgcgcaactcgtgtgtctacgaagctgttatccgctactttggtgccacgttccagtcggagcgctacatcaagggtggtcgcaacctgtcctcgtgg

SEQ ID NO: 88112 - DNA, 600 bp, Heterodera glycines
  SCN-specific regions: Sequence locations=1-20,42-286,308-600
caagaaattgtcactttaagaatgaatgtccaacctcctcctaccgccactcattcgcagccgacaattttgccgatgccaattcagaattggtcccatgaattgggcattgaatttggggacgtgctcatcgctgatttgctgcgtcgtatgtgcagtcccgatttttcctcgcctttggcgccctcagctcgttggcatgacatcccattcttcgagcagttccgcagcgatctccaattccaatggactctgctccgatcggtgctcgtcgggggcaatcgtgggaaattaaatgccaaactgttgtccatccttttttggactgtgtcggatcgcgaggaatggcaaaaacgaacggttgcccgactcatttatgcggcaaaagacgacaaagagctggccaacctggtctccctcgtcattgctgtgttgccccaactttgccaacaccgacaacagtcgtcgggtgaacttggtctgatgagtgctgccattttgcttgctttggccgatgcccgtcgctttggcaccgaatgggaccaatttgtgatggccaccgatgccagtggaagcaccgaccccaaaaatggcagcaaa

SEQ ID NO: 88113 - DNA, 176 bp, Heterodera glycines
  SCN-specific regions: Sequence locations=1-115,137-176
ggagttgaaaattttttttataacaaaatgatgaacaaaatttataccaccattcatttcttattgcttttgactgttattgctaacaaatcgactaattgtgctacaaatgttcaaggaactcaaactgttaaaacagcagatgcaacctatgatgaagctggaaaaattttcgc

SEQ ID NO: 88114 - DNA, 640 bp, Heterodera glycines
  misc_feature (638)..(638): n is a, c, g, or t
  SCN-specific regions: Sequence locations=1-521,551-640
actcttatgtgcgtcggagcagctgccggactgaccccatccactccagggcatcatccattgcgacatcgccgccagaaattgtctctactcgaacggcgtggtaaaaatctcggacttcggcatggcgcacagaggaccagtgaagaaaatggagcccaatgcgcgcgtccccgtcaaatggctgtcaccggaagcactcgccgagcgctgcttcaccgcgaagagcgacacgtgggcctacggagtgatgtgctgggagatcttcaccaacggagaagtgccgtactcacaaatggcgggaagcgacgtggcggtatcgctgatcaacggacagaggctcgacttcccaagagatgcaccgtcaaaatttgtcgagttcatcttgcagcacacttgggatgcggagacgagcggcagatactcaatggctgcggtccacgactggctgaagcgacacacgtaaggagcctagtggtgaacggattcaaagccatcagaagagccagccgaagcaaacgtcattgtgtgtgtgtatatatatgtgataaccctatgcttgttgtatttttacatattgcttactcattgttgtataactactattatgatatgtataaatgactgatgtcctgaanaa

SEQ ID NO: 88115 - DNA, 247 bp, Heterodera glycines
  SCN-specific regions: Sequence locations=1-247
tgatgttaaaatgcgacgaattctgttgagattgaggagagctcaggaaatgccttaactgacaatgaaaaaaaaatagacaacaccgacaaatcggtgcggcacattgaaaaagattctggcatttcatccactaatacttccgtagcggtgtccggaatttcttccgacgatggacgatataatgtcagaaggaaaacaaacaccgcaaattcgcccacaaaaacgacaaacaacggaaacgcca

SEQ ID NO: 88116 - DNA, 370 bp, Heterodera glycines
  SCN-specific regions: Sequence locations=1-46,68-370
tattttttggtgtgatttaaaagtttatttgagtaaaaaaaaaaagtgaaaaataaatgaaaatggtggagaaagagaacgacatcgctgccgctgtgccaaacaacgctgcaaacaacggtcatgttgaagctgtcgacccatcggcatcgaagagcgctaaggaggtgccgaacaacaccgagaagcatagtgccgaagatctaatggggttggcccgtctcttcctgaaggaatattacaccaagcttagcgaccttcctagcgaagctgggattttctacggcgatgactcgcattttgtccatgctgatgtggaggagacgggccgcgagaacattcaacgcgctatcggcaacatggggcttcg

SEQ ID NO: 88117 - DNA, 550 bp, Heterodera glycines
  SCN-specific regions: Sequence locations=1-550
cctttgcttctgcttgcttcccctattcatctgctttgtgctgcctttctcctccccgactcggcttcttccagaagtgatcaaattgccgctgctgcgcttatatctcgctgcgtttccactccgacgaagggccgcttggctggtgaaagcctccacaaggcggaacgcgtgtacaggatctaccacaatatggagccggtctatctgctccctacatataccttgggactgcgtccgatcattacgaataggaatactttgcgctcattaccatcggctcttctccccaatagtttgaagttgacatggacaccgggtctgacaacctttgggtgccagacacaacgtgcaattccacttctcacccaaaaatgctactgatggtgtcaaatttcattttactgcagcgccaactgtgacgaatactgtagcggccaaagcagcaaagtgaccacgtgtgatcaaaatagcgaatctaacagcggcatagtcgagcacatatgagcagcataggaaaagcattccagattatgtacggcaccggatc

SEQ ID NO: 88118 - DNA, 257 bp, Heterodera glycines
  SCN-specific regions: Sequence locations=1-2,28-55,128-139,162-230
taatttgcttttaaatacttaaaatgcgcgccgttctcttcctggccatggtttgcttggtgatggctgttattcttgagacagccaattcaaaggcagcgaaaaaagaaaataagaaaggagcagtcgcaacgtcagcaaaaggaaaagcggcgccaaaaggagcagcgaaaggaggaattaaaaaagacgcaaaatcaaagggaaaaggaaaaaaggacgccaaaggcaaaaaaaaaaaaaaaaaaaaaaaaaaa

SEQ ID NO: 88119 - DNA, 615 bp, Heterodera glycines
  SCN-specific regions: Sequence locations=1-615
ttattctgctctttgagacatcattcgaaataagccaaattgttttttaatcgcccccaaaatgaaccgacgctggctgtgtaatgacgtttggatggacattctgccgttttttgaccgtcctcagctcggcctcaaattggcaatgctttcgccccgtttcgatgctcttgtgggcatccatttcgatggcaaaacggaattgacgctttggagaccaatcgcaattcgcaacagtgccgcagcagtgccagaattacatgtgtttttcgacggtgccaacaattccgtgccatttccattgcccgacgtccattcgccgccgatgccaaacaacattcgttttaaggaccttcgaattaattgcattgaccattccgtgatcgcatttcttcgtgccaatcaactcattttccagaagggcaccaatttgcgtctgtcggttccttttggtccattcaacattgatgatgtgcagccaattttggatgattttgcgcgtcaaatttggcccatttttgcgtcaaccattcgccatttttggtttcccgattgccgtattttggacacattagcttcatcttctttcgccgacaattctcaccgatgatcaga

SEQ ID NO: 88120 - DNA, 132 bp, Heterodera glycines
  SCN-specific regions: Sequence locations=1-132
gtgattcgaatttgctggtcggaatgaatggcacaacggaggacaaaacggcgcccggggccaatgccaatggggcatttttgtgctgtaaggcaacccaaggaaccgcaacacttttcatcgtcggcgtgg

SEQ ID NO: 88121 - DNA, 434 bp, Heterodera glycines
  misc_feature (433)..(433): n is a, c, g, or t
  SCN-specific regions: Sequence locations=1-273,297-301,433-434
gtgatggacatgatgatgagtatggattcgccgcttgggattgacaagaccgacaaaatggaacgtgaggaggacgaatttgacgctctctcgtcattggaacgcgacgtgcagagacgaacacaacaggcgcaacagacactgcgtcaacgccagtgggtggtgcaacagcagacgccgagcgcaacgacgggacaccattgaaatacctaataaagcaatgttgctgcatacaaagcattcgtcattataattcactgtttattttctgagaaattcatctttaaaaagtaatttgcgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaang

SEQ ID NO: 88122 - DNA, 781 bp, Heterodera glycines
  SCN-specific regions: Sequence locations=1-459,498-781
gaggggaaagtgtgcgaaccaattaaccaagttgaggcgctaactgcggaaaagagacgaatggagaagacactccaaacgacgagcagagaacgcgaagaattggctcaggaaaacaagaaattggcagcaaaactgatgaacagaaaggcacaggatcgaataatcggagagcgagagaggggacttgaggaagagctgagacaggaaagactcaaaagcgagtccgccaatgcgcggatccgcgagttggagcagcgcatcgaatgcattcaggacatgaacagagacattgcagttgaaatatcaaacgcaaattcacctctgctcatcacaatttcttctttggaagagaaactgcttggattggagcgtgaaaatgacattttgacgcgttcgacgagacaaatgtccgccgaattgggggcaatgaaacggaggcacgaagccgaaatgggaacaatcgaacggagtttggaagaagaaaaacaacaaaatgcacaaaaaacggaggaattggcgaaggcgttcagcgaaagagcgaatattcaaactcgtatagaaaaactcgaagacgaattgttgcagtcgaaaagagagcactcggaaagggtaaaccgaatggagaagagaatggaacaattggagacagatatccaagcgaagaggaatgagttaaccgaatcgcaacgtaaaaactgcgaattccaacagaaaatcattgcatcgactgtggagcgaagaaaccatgccaattcactactcattgtgaacccattgg

SEQ ID NO: 88123 - DNA, 165 bp, Heterodera glycines
  SCN-specific regions: Sequence locations=1-165
acaactccgaaaaaatctctgacgcctacgaaagcttcaaaatcgaaatcgctgaagacggccaagccgaaggcaatgaaggcctctaagccaaagttgccaaaagcttccaagcccaagtctccgaaggtttccaaatcgaaagctccgaaggtcaaaactgct

SEQ ID NO: 88124 - DNA, 203 bp, Heterodera glycines
  SCN-specific regions: Sequence locations=1-203
ctccgacgttcgctactgattccattctgaccggactgaataaggaggaactgctccaattggtgcccaagtttgtgctctagcaaaaaacgcaattcggtgcccgcatttttaaaaaacttttgttcggtcggcacattgaaaacggcgagccattgatcacagctcaagaacttctgttggagttgcacagaatacggcca

SEQ ID NO: 88125 - DNA, 212 bp, Heterodera glycines
  SCN-specific regions: Sequence locations=1-179,203-212
ttgataaaaattacatccctcaaattacctcaacatcctcaccaaccatgaacattctgctgaagtctgtcctattcatctctcttctgtcactgtttggtgattgcatgaaaaactcagatcaaattggagtcaaaagaaaatcagcaggaataagaattgaggaaccaaatgatgtaaaaggcaaaggaaaagtcgtcgaaacaagcata

SEQ ID NO: 88126 - DNA, 97 bp, Heterodera glycines
  SCN-specific regions: Sequence locations=1-97
tggacgtaattgtcaaacactcagcttgttggccgttttctcgagaatgatcgtgggcctcaagcaatggctgagtttcttgctttgtttgaccggt

SEQ ID NO: 88127 - DNA, 646 bp, Heterodera glycines
  SCN-specific regions: Sequence locations=1-92,115-646
gtggacgtattgtaaaacactaagcttgttggccgttttctcgagaatgatcgtgggcctcaagcaatggctgagtttcttgctttgtttgaccggtccattcaggaaacgacgactgaccaattgagcgagccggcgagggaaaaagtgcgatgtttgttcaatttgcgcgagaacaaatggggcgttgtcgcggaaccaaatgtcggcgatggtccgctgaccactgcttcgacttcggtgggtatcattggcccggacgatgttccgttaacggaggacgaatgcgcctttatggaagaaaacttggacaattttgtcgacaattctcccggcgaatctcaatgcttgaatgcatttgacgaggacaacgttgaggacgacttcgagaagttcctacaggcaacggccattcgtgctgctgagaaggcgttggaaaaggtgtccattgacgaggatgacgacgcctcttccattgtgtcatcgcacaaattctcgacaagcaaatgacgaaaagtggagaaagacatcggaacacaaagagaaggaagaaagaaaaggaaaaaagagctgacaatgagccagtcaaaaaagtaaactccgaaaattcgtttccgcacctccgcttcatgttttaaattaaaat

SEQ ID NO: 88128 - DNA, 187 bp, Heterodera glycines
  SCN-specific regions: Sequence locations=1-187
aaggacctttaccgcagcaaaggagatacataatggaagatgtacaacatttctcagctcctcttcaacaaatacggcgttggcttttggcaccccggcgccggcattatccaccaagttatcctggaacactacgcttttcccggtctgttgctaattggcacggactcgcacacgccaaaacgga

SEQ ID NO: 88129 - DNA, 283 bp, Heterodera glycines
  SCN-specific regions: Sequence locations=1-283
cagccggtgcacaaaattttgacactgcgaaccgccgccaatccgagcttaaaaacaaacaaatgcgccattgtgcatcgttctgtcgacgctgcattgaattggctcaactacgacgagcacaacccgttcgtgctgtgctcgcgctccttcgtgccgctgtactggggcaagccgcagaccgtgttccttctgctgcgcccacatttgccggctctgtttgcggtgtgtgcgaagtggcggagattggccgagaagcgtcgtcggatttgatgatttctaa

SEQ ID NO: 88130 - DNA, 295 bp, Heterodera glycines
  misc_feature (284)..(284): n is a, c, g, or t
  SCN-specific regions: Sequence locations=1-38,60-295
actaaatccgaagaaatccctccaaaatgtcttcttccccgtccgtctctgtgctcgccatcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctcgaaaggcggcgatcgaactcttttggccganatcgaagcatc

SEQ ID NO: 88131 - DNA, 592 bp, Heterodera glycines
  SCN-specific regions: Sequence locations=1-235,257-592
atactgaagaaattcccgtcacttacggatgcgtttaagaagaagaggggcaacatactcaatttcgaggaagaggaatttgacgagatcatcagcaatggcaccagcaagcgcgacaacagtccgtacaccgaccacgactacgcaggcacgcgccaattggcgacggcgaagggagcgaccggcaaacaccaacggcagaagggcggcggagggacggcgaaagagccgaaaaagaaaacggcacttgtcaatgggaccgattcggtggtccgttcatcggcacggccgcaccgtccgaccaaacgttttgtagaggaaacaaacgaatcattcattcgtgggacttcgaaagtgcgccgaacatcgccacgcaaacatggcaagaaatcgactgcggagggaggaagcgaaggggaagaatcggaggatgacgggaaggagtacagcgtggaaaaagtgttcaagaagcgtgtgaagggtggaaaaatggaatactttgtcaaatgggctgggtatgacgacggttggaacacttgggaaccgcgtaagagcttgaaacatttggaagtgttcaagcagtacgagaagg

SEQ ID NO: 88132 - DNA, 691 bp, Heterodera glycines
  misc_feature (649)..(649): n is a, c, g, or t
  SCN-specific regions: Sequence locations=1-526,548-691
tgggatttctcccgcagtattcttattttcacatacacgtcacagccgcagcatcgttctgcttcatcggtaatcgtcacgcaccatgaggaagttcgcctacttcaaactgtgccaagccgtgctcacttctgtttttctgtggcaaattctctcaacgcaccaattctgtggcgagtttgacgagcctacggccttcttcaactctgcagtctcctccagccattgcgaacagttcacgctcatcggaatggactccaccactggcgaatacggggccatgcccgacaagcagaagtggcacatgcaactcatggcgagcagcggcagtggccaaccaattgatgaacagcaacagaatcacatggacgagttttcgtcaaaattgccgactgttggccgtcactgtattccgattgcgttttctctcgtcaagccctgggttcgcgacaacaaaagtcatctgcagaaggtcgctgatttgtttgccattcaattgctctgcggattgctgtctctgtttgtcattgccatgcacgttttggaccaaccgcgctcttggggatatgagagcatcgactacgaacggaccactttttgtgctgtgctctggtgctgtcctgccctggtttcatctgttttgctgctncactggacctcctactggcattgcaccaattttcgcgcagat

SEQ ID NO: 88133 - DNA, 292 bp, Heterodera glycines
  SCN-specific regions: Sequence locations=1-292
atcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaattattttagggcgaagaagttcatcgatgcacataatttggcatttgag

SEQ ID NO: 88134 - DNA, 606 bp, Heterodera glycines
  SCN-specific regions: Sequence locations=1-606
ccaaaattgactcgccgtttctaaaacaaaagctagctaaaattgatgaaatcgtcctgagccttgttctcccatttcaattttgtgatactttgacgcgtttctgtcaagggatgaccatctataacctctatttcttcaaccggcacggcgtttgtttggcctacaaagaatggtgccgtgaaaaaaagtcgggcatttcaccggacgaagagcttaaactcgtaaatggcatgttgctttcgttgcgttctttctcgcataaattggcaactcgggcggaccaagtgccaatgatttcctgcttccgaacttcgtcctacaaaatgaattacatggagacggccactggacttaaaatgatattgaacactgacccggatgccgtttcaattcccgaactgttacagtccattttttgtgtatttgttgagactgttctaaaaaacccttttgtggacacatccaaaagaattgactcagaactgttcaacaaaagggtagacgaattggtgcgggctcatttctgtttcacataaatatcaaaacgacgtcacacaaatttcttttatttccatttgacttttttctgcataaaatttcgtc

SEQ ID NO: 88135 - DNA, 564 bp, Heterodera glycines
  SCN-specific regions: Sequence locations=1-564
catgtgaagggtgcccatgcgattcgtttgacccatccccgtcggaatctgtgctaacgtggcctttcatcctcataactttgtgggcgattacttctaccaacaatcccgtaaagagtcggttgacgtgggtcagttggcggaacgcaccacatggattctgcgcatgttggagaccaaccgcgtggtgcacgcacgaccaaaatatatcattgtgttgcgcgacggactgtcagaggcgcaattttccatggccattgatgaggagatgggtgctcttaaaatgggctgcatggattatgacgagagttacaagccaaagtttatgtttgttgtgggagccaagcgccatttcaaaaaattcttcatggttcacgatggtactgttgtcaatctgacgcccgggtcggtgattaacgagaaaatggttcggccggacatacccgagtttttcatgcaatcacactatccaaaaaaggggactggcaagccagtggagtacagtgtgttggtggacgaaatcggcatgacgcaggatgaacttcacggctttctgaatgcatt

SEQ ID NO: 88136 - DNA, 640 bp, Heterodera glycines
  SCN-specific regions: Sequence locations=1-388,411-640
gcacaaaaggacatgcgctgttgtcacattacggtggtgggcatactgctaaggctgaaaaagaactgctcaaaatttacccggaatgccattggatcgatgccgatccgtcggatgaaatcaatgccgatatgactgaatcaatcggtggcacttttgttgatggcccaattggtgctgaggacggccaataaacaaccagtgatctcatggggagcaacgattactgagctgaaattacaaaaacaaatagggatcattgatttcttgaacaatcacacaaattggcaccaccatcccgtggatttgttgctaatggacattgagggagcagagtttcccatagttgaactgtttgcttatcactttgagcgtttcaccggctcaatttgtcagataaatatggaggtgcacgacccgaacactctgatcgccaattacacccaccagcaattcttccaatcatttgacactttggtccgatctggccaatttgctctaatgaacaccgatatgtatactggcagatgtaccactgcatatgtttctcagaatgttctttgtgaatgtggtggacgaaaagtgtacaaagaaattcctgtgctgataacaaattgaaattttccgaattttttcaatt

SEQ ID NO: 88137 - DNA, 646 bp, Heterodera glycines
  SCN-specific regions: Sequence locations=1-646
catttccgaagcatttcccatgaccgattcaatcggcggcatttgccgaagtcacctgtgccgcagtcagtcggccacaaatgtgcccgaaagttgggccgaccgcccgtatccgaagatgacgcgggtccattccacgacggacatcgcacagcgatacgcggagatcaattcttccacgagatactggcccaaaaacaagccctattactggccgatgaccagcaacttgtgcaacatcgtctccaattacaacttttacccattgttccgttcttattggccttcctatcgcagttatttgttggacaccaattggtacaatcgccgcttcgaccgtttccaatttttgccacccgattcttattatagctattggccaatgtcctgcagttatcactattggtaccattatccatatttcaaacgatggtatctcggaggcctcggtggagtttcgcaattccacaaacaatgaaagtgaaaatggatgtatagcacagaaacacaatgacgcgtaccgtaccctttaccgtagttcgcttttctttgacgaaacgaatccctgcaattattgtgacatatttaagcagttttattactttcacagtttagtgtttaaaatcatttttcacaagaaaaaaag

SEQ ID NO: 88138 - DNA, 713 bp, Heterodera glycines
  SCN-specific regions: Sequence locations=1-225,259-269,298-323,358 -659,703-713
tggatttcgtttctttgattttgaagaaaatgttctttccgcgtgcccctggcccaactctttcgcaattcgtatattcatttatttttcctattttgattttccattgctttgggcgtagtttcattagattatttgcataaacttttcgttaacaattttaatgctacttaagttaatttttcaaagaaattttaggaaggaagggactgatgctgcgaaaaattgtcaacaccaataaattttttgtccaaaaaacaattttttgcttattatttttcaaattttaaaaattttggtacttgttgattatttatgcggagattttaaaaaaatatttttttttgtaatattaatcgggttttcaaagggtttttcttattagttgagaatttgtttagacttatttatcagcaaaacatttaaaaaagagagcaaaattataagataaaactgataaaaacaactgaaaaagcataatggtcagagacgaaaattaacgccccaattgtgtgtaaatgtttatttattgagctgatccgttccgctgcatttccttttatggactgaaagtgaattgctgctacttgagctgcttgaatatgtacgtctcaactcttcttcctgatacggctgttgttctccgtttttcatggccgtaaaaataaatttttttaaatataatttaattaatttttattaccttccaacga

SEQ ID NO: 88139 - DNA, 138 bp, Heterodera glycines
  misc_feature (18)..(18): n is a, c, g, or t
  SCN-specific regions: Sequence locations=1-138
tacgccgccttggaacgngcgcctccacaaaatcatggagtaccttctcgaatgtatggacaaacagaatggagacctaacccaaatggttgtcaacgaatttcacaatccgacggtggcggagcctttgccggcgaa

SEQ ID NO: 88140 - DNA, 586 bp, Heterodera glycines
  SCN-specific regions: Sequence locations=1-74,113-173,197-307,341 -448,470-586
gtggcaaaaagtgccgcggaaatggtgttggcggatgacaatttctaacaattgtggcagcggtggaggaaggccgtgccatttacaacaacatgaaacaattcattcgctatctcatctcgtcaaacattggtgaagtcgtctccattttccttgtcgctgcgcttggcattcccgaagctctgatccccgtccaattgctttgggtcaatttggtcaccgatggtcttcccgtcactgcgctcggcttcaatccgcccgacttggacattatggaccgactgccgcgttccgcctccgaatcgctcatttccaaatggcttttcttcagatacatggcaatcggaacttacgtcggcgtcgccactgttgccgcttcgatgtggtggtttttgatttacgaggacggcccgcaagtgtcttattaccagctgacccattggatgcgctgtgaaattgagccggagaactttgaggatttggactgtgccgtttttgttacaaccatccaaacacaatggcattgtcagtgctcgtcacaatcgaaatgctgaatgcgatcaacagtttgtccggagaatcagtc

SEQ ID NO: 88141 - DNA, 410 bp, Heterodera glycines
  SCN-specific regions: Sequence locations=1-410
atcctctcccctctacatctcttgccaagcggtgtccgaagatgttttggtgagcaaactgagcggagtcgcgcgattagaccaattaatggaggaattgattctcgaggacaatgacccgaaggaacccgaaccgcctttagccgcctcctcttcaaaaaatgccgattccgtgggaacgtacgatgaacgaagccatgcagaaccaccatcagcagaaacagatttgtcaatcatcgctccgaacatcggtcgattcctcgtcggtagtctcccattcgccatgggttccaaactttcccattgctgttgatgaacatcgctttccgattgtgctggatgccgcactgcaccaccaacggaatcaccatttgccctcgtcgacttcgccctcggccaattcccggtca

SEQ ID NO: 88142 - DNA, 711 bp, Heterodera glycines
  SCN-specific regions: Sequence locations=1-10,32-108,137-711
tttactttactttcctccttttccgggcaacgacgcagcagtcgaaacaaccgacgcagaagtgggcgcaacggcaccagtcaaacggcacagtgacaacaccattatttatcatcagcaacagcaacagcagcgacgcatgggccaaatcaatctctgcgacgacgtttggttggacacattggcatggatcaatcgtggagaagtcggcatgaagttcgcgctggtcaatgctcggttcaacactttggtggacaggcatttcgagcagaggaagtggtgctttggcgagtttcacatctgtgagcggatgacggaagaatcgggcgcagaaatcatgacatcgatcgacggctccgacttcagcacgttgccattgcccaccactccgctgccggacagtgtcgtcggcttccaatcaatctccatttggtacatcaacgaagaggtcatcaattttctgtgcacaattcgccgtctcctcgccgaagacattgcgctggaattttccacttacttcacagaatatcgcagttggaaagtgatggcacgacacatttggccgctgttgcgggatgggatcagcactttgttcctgaagaagtgtgacttggccatgctccgtaaacacgtgtcgcccaccgtgctgttcgactgtgccggcctgcaccgaatccacacgcaaatgctgcccgagtgtccgtctgctga

SEQ ID NO: 88143 - DNA, 503 bp, Heterodera glycines
  SCN-specific regions: Sequence locations=1-503
atttttcttacattaaagctctgctgaataatttattttgtcgtcacattggcaatctttgggttacgctccaaaatatctttgcttcatgtttgatgtgtccattgatcttgtttggtttgccgtcggcgaagcgatcatttctctgcatccgttgacaaatgctctgatcagctctgttccttcttcggccttatcgcgaggcgttgaaaccaatgctgccgtcgttcgcccaccgaattccgctgatgctctgttccaactcccagcggagtacgacaacagccaaccgaatcgtctactacagtacaggaccaacgaccatcgacgacttggctatttttggaggagtggccaatcgcgacgacactccgccaggtccattgtgacaacgaaacgctatgccttgccacaaatactaacaaaagtgccatcatatgtatcacatcatttcattaattagtcaatatgtttcttcctttcatcgaaaaaaacaagtttat

SEQ ID NO: 88144 - DNA, 773 bp, Heterodera glycines
  SCN-specific regions: Sequence locations=1-46,68-500,522-773
cattctttctccctaacattttccctggtcattttgttgctgcaaatgccttccgaaatgcgctttatctctgccgattgttggcttttggtgttcgatttccttgcgccttctcaacttggcctcggaattgcactgatcagccgtcgatttgacttctacgttgatgaacacttcaagacacgcaaatggatgttgaacaaacaattgctaattacatgggacattgaagaaaatggcacgaagaaaatgcaaattatcgatgccgacagaaaagaaacattgccaatcccgcaaaagccgttgccgaacaaagtgatcggattcagcggacgcattcagatcatttacatcgatcaaaatgtgctcacttttctcggccattttcaccgttttttcgccacttctgcaatggatttggacattgtcattgaaaatggtcgcattttggaatttgttttgctcaacatttggccaatgttccgtgattcaattcgtcgcttgtttttgaacgccatcgcttttcgctgtttgcgtcaattggcgccgtcaatgctcaccgattgtccatccctttgcgctgtcgtcttcaatgacggcatagtgtccgaatttccgatcgatgacagtgccatggcgtcggatgttcaagtgctggcaaaatggctgttcacgcctcatccggacggtgtgccgaagtggctcaaatgctctgttaattcatcggtggaacaatggtcatcaacgattgaacaattcaaatcggcattttc

SEQ ID NO: 88145 - DNA, 696 bp, Heterodera glycines
  misc_feature (603)..(603): n is a, c, g, or t
  misc_feature (615)..(615): n is a, c, g, or t
  SCN-specific regions: Sequence locations=1-117,139-210,236-696
gaccttttgcgaaatgagtgtatttactgcgagaaaacttttgccgaccgaaacgtattaatggaacacatgcgaaagaagaatcaccgagaagtgaacccgaagaataattattacgacaagttctacatcatcaactacttggaattgggcaagcgttggctggacgttttggctgaggactttgaggacacaatgccaacatttgtcgactctgacgatgaggaggaggattcgtggcacgagtggcaggaggacaatgcggacgagggggacctttttgcggtgtgtcttttctgccctcacgcacgggaggaactcgaggaaacgatcaaacacatgaatgagactcacaaattcgaccttatcggttacatccacgacaattccatggacacatacgaccggatgaaattcgtcaacttcatccgaaaacgaactttcaacactcggactaaagaccaacagacaatggaatccaaatgcgttgaaattcccgacaaagagcaatgggacaatgaggagaatttggtgccgctgtttgggaatgaccatttgctttggatgttggagagttggcatttggagcacgaaatggagcanatcggaaaacanaaggcgactgaatgtgatgaaccgatagagaaggctgtcactgaaagtgttgtcgattcaccaaaaattaacatgggcaca

SEQ ID NO: 88146 - DNA, 511 bp, Heterodera glycines
  SCN-specific regions: Sequence locations=1-511
agaaaaacatttgacttcgatggagcctataatcccccgagaacaagctcaatgtctgcaaaatgtcttcaaacatttcgcacactttgaaattaatagcgcaaccaaagattggactcaggaagaattgcgtctttacaaacgcttgtttctcggcctgcggctttgcactttgacttttcctcctcaattgttacgcaatttgcaaattcttttcaaatgcatccgccaattttgtttcaatgccaaattaatgcgagaaaattgttggtcagcaaatttaaggatctcaaatgaagagaattcactctcaatctgtgaaattaatgaccagcgcattgagagagttcttcgagaattattcgttttattttttccgcaaaaaaatttggaatgtccaaaatcattttcgctgtttaaacttttggtggaacatgttacgccgtgtcttatccaaaccccaaaatggttggccgatgaagtgcaaaaagaaatgaaagatttgttaata

SEQ ID NO: 88147 - DNA, 471 bp, Heterodera glycines
  SCN-specific regions: Sequence locations=1-299,321-471
ttccgccgtgcccgccattgtggcatcggtgaccgtccgttgtgtaggcgtcgttgagcatgaggaaaaaattccgagcgttatagtttgtgtcgactcgttcatccgtggtcggggcattgtccgtttacaattgctcatcacaatttggcgcacttatcggcgatacgttcaccatcattcagcccaatctgattcgattccgatggaaagattggggatgggacgacgactacaggaagatgaaggagtgcatcaaaagtacagatggacgaggagcaggagttgacaaaccatccgttgttgttgctgtttctggtgacggatacgacgccgaagccaaaagtgctgctgatgttgccaattcatccgcggaaaatcaccacaatgacgaccactatgccgagcactgtctgttgatgatccgtgccctcaatccctcgcgccaactgctgaagaatgggacgcctg

SEQ ID NO: 88148 - DNA, 255 bp, Heterodera glycines
  misc_feature (36)..(36): n is a, c, g, or t
  SCN-specific regions: Sequence locations=1-255
ctgaagaagcgcaatgtcaaacgcagctgcgaattncggaaatggcaatggaccccaaaagtgcctcgttgatgaagaaaatgtcggaccgcagctatcctcagacagcgcagccgaacatccgccttcttatcgtcgtgccgcgccgccccgctcgccctcgaggaatttccaaaagcgtttgtcgtcgacgcgtccaacacctgcggcgtcaccgacgcgcaaaaagtcattgtccgccattagtgcctcagg

SEQ ID NO: 88149 - DNA, 616 bp, Heterodera glycines
  SCN-specific regions: Sequence locations=1-69,130-616
gtaattaaccccagttaattacacatataattaactccttttatcgtgcattcctccgccgttctttcgtcctttccctttcccttttttctctctttttcactctctcttctgtccctttcccttccccaatcattcaattgcctgccattcttctcacattcattcattgttttttgactgatgaaggtcatcttttcgtcacacagtagaagtgggaaaaaaatttgccacccctcctttgtcggcacatgccattggctgctgcacggcaccgaaacggtgccaaagacggcggagcagcgcacctttacactccgttgtaggcacgtcgtgttggcatgcggacgacaacagcccaaactgttaggggtgcccggcgagtcggccgccgctgctgacggtcgcgtggtgtacagtctcagctcgttgaagcagcgattggaggagacagagggcggcgattcgggcgcgacagagacggcaacgacaatggcaccggcgaccgaagcgacggcgaccacaatggcacgagcgactattgccgccactgcggagacggaagaagtgtccggcgactgtcccgtggtggtggtcggcgacggcatttccgccg

SEQ ID NO: 88150 - DNA, 588 bp, Heterodera glycines
  SCN-specific regions: Sequence locations=1-588
ttttatgctttttctttagccgtcgtccgtttctctgatgacgctctctaactctgaacaccgtcggccatgtccgaaaccccttgacgacttttactgttttaacggagggaaatgttctgtggaatttgaaggacaacgaattgttaacacttccttaagttgtcggtgtccacaaaactttcacggttatcgctgtctgcattcgttcgactcgcatattttcggattcagcaaagtgaacaatggagtggaaagcaaagcaattcccaccattgctgtgatactctttctggtgatcgtcatcttcatttggtgtctgttgttgcatcggaggagtgtgagttcctctgcgcggactttcctcaacaacagacaaacgtccgcctcccagtctcggttcgttcaaccgtcggtcgtctaatgggaagggtgacaccgtcgaacaccaacagacactgaatgccatcatcccaacgactaaatataactgacctaatgcaaataacctgcctgtaccattcctaactattattagcatgttcttttgtacttgataatagctctttgaaaatgaagtttgtcaca

SEQ ID NO: 88151 - DNA, 615 bp, Heterodera glycines
  SCN-specific regions: Sequence locations=1-204,226-615
cattgggctgacaataaagcgcaacaatgtcttctgacgaatcgacgacttcttctgccagtgttgtgagcgttcagctgcgtgaagtgcccatcaaagacttcaaggacgtgcttccggtgctgcagaaaacgctcaacgaattggaacatccgttcatcaagaaggccgaagaaataagcggaatggaacgtgagaagctcttctacatcacttcctctcttgtgctgctcgtgttgatgctctgccctggcaatatgcttctctctactcttatcactgtggcctacccaatgtacgcgagcttgttgaccctcaacactcaaaacacatcggaatacacccagtggctcgtttattggtgcgtgttcgccgagttttgccagttcgactatctctttggctctatcaatggccttctgctgctgtacgtgcctctgaagaccgtctttctgctctacttggcccttccgcaaacttatggcgctcacaacttgtacgtgaagcatatccgcaaagtgcttgccgtgacgaacgtattggacaagatgaagaagatgttctgatcgagcagataatgtatcactgtgtaatgtctaggatgattctttgttg

SEQ ID NO: 88152 - DNA, 659 bp, Heterodera glycines
  SCN-specific regions: Sequence locations=1-388,411-415,437-555,577-659
tattttgttgctgcaaatgtcttcagaaaatgaaatctttatctgcagcgattgttggcttttggtgttcgattttcttgcgccttcccaacttggccttggaattgcactgatcagccgccgctttgacttctacgtggatgaacacttcaagacacgcaaatggaaattgaacaagccatttcttattcaatgggacactcaagaaaatgggaccaagcaaatgcaaattgtcaattctgatgatggaagcccgctgccaattccacaaaatctgttgcccaacaaagtcatcggattcaaatacattgagatcatttacattgatcaaaatgtcatcgcatttctgcgccgttttcaccgttttttcgccgtttgctcaacggatttgttcattatcactgaaaatgatcgaattttggactttgttttgctcaacatttggccaatgtttcgccattctatgcatctgatgattttcaacactatcgtttttcgccgtctgcgccaattggccccgtcattgctcagcgattgtccatccattcgcattgtctctttccttgatgccattttccccgcttttccgcccgatgaaagtgccaatgcgtcggatggccaagcggtgaccaaatggctgttgacgcctcgtccggatg

SEQ ID NO: 88153 - DNA, 179 bp, Heterodera glycines
  SCN-specific regions: Sequence locations=1-179
ggctacggaaacccttgatgacagcgccacaataactgccttcgatgcggccggcactgacaccgacagacccctggtcgcactaccgaacagcctggtccgtgctcggccgcacactatcatatgactactctcagtatagtggtaacgggacacatggccgaggggctgattgaaga

SEQ ID NO: 88154 - DNA, 744 bp, Heterodera glycines
  SCN-specific regions: Sequence locations=1-507,529-744
tagcttcttggcaaaatatgccaccaaacgaacgcgtagtccgtcgcccaatttaactaatcggctaacaaacccgtcgtctgtgccaatcaaacagcgaaaacaggcggaggatgcaacaaaattattaccgaaaaagatggttgtttcacaatcgaaagaaaggatcgaaccacatggttttaaagaacgtgccaaagtcgagacattgtcaaaggaaaccatcaaaactgaaacctcaccgaaaaaggacctgttttacattcccaaaagaaagccgttacagggcgctccatcaatctcaccggcttcaactgctacttctactcccaagacaatttcgccacccatcgtccgtcctccttctgtggaaagcaccctccaacacagttcttcatgctcaccggaagactcatttgggtcaatgactattccaacgaaaccaacaagggactggtctcgggaatttacaatgatcctaaaccaggatgaggccaaacgttatcacaatattttcaaaaatgaatatgcagaatatcgacgctgttatgatgatttaacgcacgtagcccaagatttccttgcacttaagtcaacaatggacaaagcaaacgatgccatagaatgtcaaatggtcgtaaaacgtattcgcgagaagtttacaagcctacagaatgaccaacagttcatgttgaagcgacagcgacacactgatcttcatgcaaaattgaacgccatcaaaaa

SEQ ID NO: 88155 - DNA, 201 bp, Heterodera glycines
  misc_feature (79)..(79): n is a, c, g, or t
  SCN-specific regions: Sequence locations=1-201
attccttcctatgtgaaggcgtgtaagaaatatgacccgaattgggagcccaaattcgtctattgcatcgtcgacaagngaatcacaacaaacgtttcttcgttaagggggcagcaacaagtcgagaacactgctccaggggcggttattgattcgaaagtggtacgcgtcgacatacacgagttttggatgcagtcacat

SEQ ID NO: 88156 - DNA, 304 bp, Heterodera glycines
  SCN-specific regions: Sequence locations=1-264,286-304
ccagggaggaaatcccgaggaaaatattatctgtgcggtgccggaggactgccgacatcgggaatgctgaccggatcactgaatttgaaacgcaagaccatcgctagaaaattcgcggaggaaacccgacagctttatgaggggaaatgatagcgttgctaattcccgactgctatttcgatctgatcctaccttgaacatcactataaccatttgcattgcgccgtcaaaggcatcatcatgagctctaaccccccaattatacataattcatatttggtctgaaatgactggtcattctagt

SEQ ID NO: 88157 - DNA, 336 bp, Heterodera glycines
  SCN-specific regions: Sequence locations=1-336
caaaaactgataaaaaagaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaggaagttcatcgatgcacataatttggcatttgagaacggcgaagtgtcgttcaaagttgcgccaaaccatctgatgcattatacaccct

SEQ ID NO: 88158 - DNA, 355 bp, Heterodera glycines
  SCN-specific regions: Sequence locations=1-333
aactttgacgcgctaaattgcgcccgtggagacggagagctaaatgcatgttgccctcatcaaatgacattgccgtggagaagacgccacagctggccgcggagttcgaccagtccggactgaaacacgtggaaacgacggtgaagaccaacatcgaagtgattgacaaggcggaacaaaactaagccaatggcgtgacataaacaacagatgttttgaagacggatttatgacgattatttttggtgtcttgatttgctttctattttgtaccttctttatttggtgagctttacaaattccagagattatgagataaatcgcgttaattccaaaaaaaaaaaaaaaaaaaaaa

SEQ ID NO: 88159 - DNA, 560 bp, Heterodera glycines
  SCN-specific regions: Sequence locations=1-560
acaaagggactgtcttcgtgcctggaacatttccaccaataaacggattcgcatcgtcgtggtgacttcgggggtgcctgacgaaacgacataaaacaaatcgatgatgcattgctgcgcatgagaagccattccgttcgccgacaacaccgtccgagtgcgctattttcgattcgaatttcctttaatgcgtgggcacatttcgtcggcactggtgacctgttcactgatatgttgatggcatggctcgaggaaagcagggagcgatttgtgccattccgtcaaatgcacaatctcgtcaatgcaatcggtgatccgtcgtactttcgactttgcttttgcaatatagtcggatccaaacatccaactgagggaatctgcgcttgatgcacatccggatggaccttcttgcaccaaatgccgctagaatgaattatgtggaactcaacctttacacacatgagagaggaaatgagaacagtcaatgaagtggagactactaataatgcgtcttgtacatatcaatgaaacattggtattggctgcttatgtgctggaca

SEQ ID NO: 88160 - DNA, 673 bp, Heterodera glycines
  SCN-specific regions: Sequence locations=1-166,197-673
ccgcgtttagtccaatttgccctttattctttcgtccttttcatctttcaaattgttcaacaagttcgtccaacaattgccattccgacatctcttcccgagcacagtaccttttccaataatcacaattcaacggaatgcctttgcgctgaaatggaaaagggccaaaatgcccccgggggaaaaaagacaaaagtttattttgcggtacggacaaattgtgcgaggccatgggagcgaatgttcatctgcggaggaagccgactgctgggaaattggaggcccgaaaaggcattggaaatggcacgagaagcggaggacggcgaagagaattccttcactgaataacgatttaagctcaaacaataagtcaaaaacaggttcatcactacaaagaagcggagaatataagtgagcttgggcagcagcagaaccgcggccaccgattgaccggagaagcggacgaaagagacgaattgcgatcatttcccactttggtcgacgcattgcaaagatatttttagactgtccgtcaaacagaacaagtacccggtgcttttcctttgtgtgggccaaaccgacagatgaacggagcaaagtgacccgagtgggctccaactttgccgcctgctccaaccttttggcaaggctaaaatgccattctttgaaattg

SEQ ID NO: 88161 - DNA, 563 bp, Heterodera glycines
  SCN-specific regions: Sequence locations=1-563
tgtcgccttttaactgcagcgtttttaagctcaggcctcgctctaccggctccttatgatgctgaatcggtggtatcttctgaattaaatgttccactactttcagctgacgcaaatgttgaagcagcaattaccaatgaaagtgatgctgctgctgagatacaagctccatcaattccggtaccaattgaacatcaaactgctgctgacattactcatccaactgaaactggcaatgagtcttctattgcatcatcatcatccacgccgaaaagtgagcagacgccaaaaaaagtgatgaacatgaaaagcgcgctggaaggcgcggtggccaacgtgtacggggggctttcgttagacaagcagaccaagacgatcgctgaagcggcatcaaaagcaaagcagacgcccgccaaacttccggctgactacgacgtgaaccgcgtggcggaacgcgcagcaccccgtgtgtacgggtggcttccggaagacaaacagcctaaggagatctatgacgcggctgagaatgcaaagaacacgcccaaaaccgccgggcgactacg

SEQ ID NO: 88162 - DNA, 361 bp, Heterodera glycines
  SCN-specific regions: Sequence locations=1-361
gcaccgcgttggtcgaactggaagagcgggcaataaaggatgggcctacacctttattttgcccgttgggcaggagaaaattgctggcgaagtttgtcgagcattcgaaacggcagacgcaacaccgccggaagatttgaaaaaattgtgggacgattacaaagcacgaatggcagccgaaggagtcgaagtgtactcgggaggaggtggctattccggctcgggctatcgttaccacgacatggaggacgaaagcgagttgaacaagcggaaaatgaccaaattggtctatggattgtaaagcggcatggaggacgatgttgccaacatcgactcggaattgggaagtatgatgaaaagc

SEQ ID NO: 88163 - DNA, 595 bp, Heterodera glycines
  SCN-specific regions: Sequence locations=1-131,154-595
ttaacaactgcttgatgaggaggcatttctcttgtacatcgcggcttctgttggcgaccaccaccgacaacaaaagcgatgccgcatcggcaaaacagcaacagttcgccaaaatagaattgaagccgaaaacggggagcgacggtgctgtggcggagccggaacggacatatttggaggaaatgctcattgaacgggatgcggagccgaagacggcaggccaaaaagtaaaacgtgcggtggagacaaccttctacatttcgtttggcctcatctcctgcgccgttctgggcgtgatgacctacctcgtgttcaaggagttcttcgccttcaacacgccccagggcgtttaccgcgatgcggtgaaaagggtgaaggcggacgagcgctgtcgggaaatgttcggcaagcgaatcatgacatttggcgaagagtcgggccggggacggcgacggcacattctccacaataaatatgtcaaggacgggcaggagcggttgagcgtgatgttccatgttaagggtgacgcgggcattgggaaaacgtacgcggagatttacaagggcgaggacggcaaatgggactatcgttttgt

SEQ ID NO: 88164 - DNA, 538 bp, Heterodera glycines
  SCN-specific regions: Sequence locations=1-163,329-329,405-417,442 -442,464-464,486-486,523-538
ctgtagtccttaagcgttacacattttgccatctgtcaaccaactcatcatcgtcaacatcgtccgtcaacaagttcaacaacaaaacgttcaaaatgtctgcggaatcgccaacaacatcacaacgccgtgctcgcagtcgcaagacgaagaaacgtgcggtcagcgctggcgagaccaaaccactgcgacgctcggcacggattgcggcacagaaagcggcgaaggaaaaggcagccaaacagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgctgaagaaggcgccgggcccgagcagtcgcactcctggtcgacgcgcgaagaaaccgtcaacgaagaaatcgcctgctcctcgccgtgcaaaaacctccaccaagaagcgcggacgtcctgccaagaaagcggaacaagccga

SEQ ID NO: 88165 - DNA, 284 bp, Heterodera glycines
  SCN-specific regions: Sequence locations=1-284
aagaaaaaactgccgattattgcattttgtgcagaagaaaggcagtgaatcgttggacaacgaacatatgcaaaatgacgaccgagagaacgacaaattgccagcacaaaggcagtgggaaactgacacaacaaaacgaaagtcatggagagccagactcctccggacattgtcagtggggagcccatccgtcggaagagtcatgaaagacaaagaaaagcaaagaggtgaaaagccgactagtcacttcgcgaatttggaccgggaatgggaggtggtgactg

SEQ ID NO: 88166 - DNA, 288 bp, Heterodera glycines
  SCN-specific regions: Sequence locations=1-288
aaatacaatctgaaaccaaaaacggagagcaaccgtgctgagggggatccggaacggacatatactgaggaactgctctttgaacgggatgcagactcgaagactgcttgccaaaaagggaaacttgctgtgcagaccaccttgtacatttaaatcggtctcatctcctgcgccgctctgatgcgagatgacgtacctcttgtcaaggagctgttcggctttccacgccaaattgtcttgtacacggatgctgtgaaaacggtgaacgtggacgaacagctgtcagag

SEQ ID NO: 88167 - DNA, 434 bp, Heterodera glycines
  misc_feature (45)..(45): n is a, c, g, or t
  SCN-specific regions: Sequence locations=1-434
gcactgtaggcctggcgtgcttaacgtgactcactgtttgatacnctgtcataactatcatcgacacgtacacacatcacagtggtgagataccgtcaacgagtcacaatagacacatgtatggtgcttctgcgccgtcatcaatcaagtaccatatgccgtctgtgcgtaacatctgctggtcatttcgaaacgttgtgatcgacatacgaacaacctcaacattactccatcactcctgcctgttcctcattcgccggggtcaatatcggcatatataccgaatacatactggatgcggcccgcaccatgtctactctggtcgaccgcataaaacgtgccctaccgtccttgctactgttcatacaggcattacagcacctacagatacagcggcttttatgtttggccggttatctacgctgttcactttt

SEQ ID NO: 88168 - DNA, 537 bp, Heterodera glycines
  SCN-specific regions: Sequence locations=1-217,239-537
cataagggtattttagcgaaccctatttgctgtttatgtcatcatcaagcgtcattttcacttgtcatttgtgcaagcgtcggaatcccatcactttcgaatccatcgaccatctggaagcacattttgcacaacaacatttccaatgtttgccgtatgtttgtgagcagtgtccgcagtttgccagtggtctttaccctacagaaggcgcaattattgaacatatgaaattggtccatggctctgagagtgaatttgagtttaaaatcatcatccgtgaggacactgaagagaagcgggcaaaagtccgtgctgcacttgagcattgcgtccgtaattctggcgacgtggccacttcgtcgtccgctgccactacaacttcgaacaatgacagcacagcgattgaacttccacggacgcaacagcaagtgcaaacaacgcatcagcctcgcgttgtccaagtggttcctgcgccgacagttgttgtcaggacggaagtggtgcaacagacagcggaaaaacactcgggggcaaaca

SEQ ID NO: 88169 - DNA, 323 bp, Heterodera glycines
  SCN-specific regions: Sequence locations=1-32,54-323
cgaccgcgtgctggactttcgatttccgaacaacaacatgtgtagacaagtggagtgcagaatctgggcgtcgctatatggaaccaaacaattttcaccactatgcgcccagtagatacagcatttacaacattaaggtatagaaactttgtcgcgtagtttaggtgatgggtcggccgcaagactctaaggataaattaatctctttgtatggaacgattgggagaacttttcgattgcgatctcaaagcaacgtctcatgtcttaacatacgaagagccacttgatgcgcaaagagctgtgattgaagctgagggcaattg

SEQ ID NO: 88170 - DNA, 336 bp, Heterodera glycines
  SCN-specific regions: Sequence locations=1-15,37-170,192-286,309-336
ttaaagatccgaaaaaatgccaaacattttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaatcactgctcacggaggaaatgccgccggattggtgccatcgcatgtgaccaatcgttcaatggctccaccacctcctcctgtgcaatttgaagtgggggcaaatcgattaga

SEQ ID NO: 88171 - DNA, 575 bp, Heterodera glycines
  SCN-specific regions: Sequence locations=1-129,151-244,266-575
gctggacatctaacatatgcgaattgactaccgttagaacgacacattgccagcacgggggcagtgggaaactgacacagcaaaacaaaagttgtggaaagccaaactcctccggacattggaagtgaggcgagcccatccgtctgaagatggctgactgacaaaagagaaggcacgacgtgaaaagaccaatctctcacctttgtgaatttggaccgggagatgggaggtggagacggcactccagctgtgtctcaatttgtcagtgcacgatacattgcaaagggcactaaatgtgtgtgcccaagagccatttgcagtcctaaatgaacacagagtggatgcccatacggcataccaattggcagtccacgacaagaaaagaccatatcttgtgtccgctgttggcctcttcctgatagcaatgctttccacgagactacacgaagctagaaagccgggcgaatgtaaaccggatacgtccagaagcctatatgtacgcaatcagcggcgactcaatgttactgttggcgaagcgggatgagtccaatcatcaaaaagagtgtcgagcatag

SEQ ID NO: 88172 - DNA, 541 bp, Heterodera glycines
  SCN-specific regions: Sequence locations=1-541
aacgactgaaaactggcaggaaactccggcttttcaaaagaccagcgaaatgatgtcgggaacggcggagagtgtggcaagcaaagtaaatgactttcgcaatctgtcgcttttcaatcgctcgagcccaaattgggtgctgctgtgaccaatgccaaagaggccgcttccacttccatcgaccatatggcgggcatacgacaggggcagcgcgaccgcccacggctgagacgagcaaaaactaggatagcgatgccaaaagcaacagccaaggccaatcgccactttctggaaagggcggcgtatggaggaaaaagcgtttctaccggacacgacactgtccctgcccgactttttatgcccctaaggcagttgacgatcagaatatggatgatggaagagcaactcgaagtgggtctgacaacggtcggaacccattgccacagccgatattgctgggaaacccaacgcgtaccgtctacaacaaatgtgaagccctttatagcccgacattcgtttcgtctgacctttctcctcatga

SEQ ID NO: 88173 - DNA, 454 bp, Heterodera glycines
  SCN-specific regions: Sequence locations=1-248,275-454
gatctcgtctccgtactcttcctcgtcttgcgccgtttctgacgaacagtccttgtgcactcagcaccagtgccgttcgcaaagacattgacagtgccgcgaaatacgtcggagccggggctgcaactgtcggagtggccggttccggtgccggcattggcaacgtgttcggctcgttggtcatcggttatgcgcgcaatccgtccttgaagcagcagttgttccagtacgcgattctcggctttgcactgtctgaagccatgggactgttctgcctcaccatgggcttcttgatccttttcgctttctgaacattacgaagacgagcacagaggaatagataggaaatctttttttgttttttctcgcttccaataatagtatgtttttctatttttgtgttgccagataaagttggacagatcactacaacaaatcaaattataaccaggta

SEQ ID NO: 88174 - DNA, 155 bp, Heterodera glycines
  SCN-specific regions: Sequence locations=1-155
ccaattgtggacggattatgcgcatacttgatgacgacgacttgcatgttgttcttgccaatgatacaggaggaggcacccaccgattgctaggaggtccacagatgggcttttgagcgacattataacaatggttgattgaagccgaacactgg

SEQ ID NO: 88175 - DNA, 369 bp, Heterodera glycines
  SCN-specific regions: Sequence locations=22-32,190-369
gtgaagaggaaagtgaggaagaaaactacttggaagatgaagaaagaaaatggagaggaaaaggagagagaggaaaacgggggagagatggaaaaacaaaatgcctaaaaggaggaggaagaaagtgccaaacgggggaagaaatggtaaaggaaaatgtctaatagggggaacaaaaggaaaaagaaagtgccaaataacgggacaaaacgggcaacacaaccaataatgaaaatactgggggagaaaacaccaacgaaacagctactaatgggatgaataatgacaaaaaggaatgccgctcgaacaaaaattatgaactaaatgcatatgatatggacgaaaaacattcaacacattcactatacc

SEQ ID NO: 88176 - DNA, 504 bp, Heterodera glycines
  SCN-specific regions: Sequence locations=1-420,443-504
ggatatggaaatgggacgatctccgatttgacgaaaatccgattgtaaattgtgatcaatatcattgatgctctaactgttggataacattaaatacactatgaaatagtaacgtcatcctgtatagtactaaggagaaatagcttatttacaaactcttgttaatcggccagccgcaaaactctaaaactttttacttctctaaagataccccggttggaacatcttttcaaatgcatcacaaaatttaggtccaatgccaaatcattgcaagaacatggttggccaggaaacggtatgatctaaaatgaacagaattcactctctatatgagaaatcaatgaccaccgcaccgagagaagagttggacaagtattcgatttattttttccgcaaaagaatctggaatgttcaagatcattttctgtgcttaaacttttggtggaacatgcaacacccctgccttatccaaacgcccatatggaaggccgatcaagcgcaaca

SEQ ID NO: 88177 - DNA, 627 bp, Heterodera glycines
  SCN-specific regions: Sequence locations=1-113,136-188,210-491,514-627
ttactttgaaatacctccgccgatcattcacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgactactacacagggagggggagggacatcgacgacgacggcaaaaccaaagggaggagggacggcacacgacgaaaaccattccgatgactcatcaattcgcggcaaagcgcgcgagaagcgacagcaaacgaaccaacagcaacagcagccgaacttggagtctttgcccgtatgtgctaccggacagtcgcccattgcgccaattacgcccgccggccccgtccttccgatcggcgccattccgcccaccgtcgtttgtctgaagtgccgaccgcccaacggcccattgtccgggaacaatggcgcaaatggcaacaacggctcttaaaagcatttgccactggacgctttgtgaatggcaaccggtgaagagaaaagagaactaataaatgccatggaaaaaacatttggacgaacgctgactaatcattgctta

SEQ ID NO: 88178 - DNA, 100 bp, Heterodera glycines
  SCN-specific regions: Sequence locations=1-100
aaaatccttctgattgtgcttgtggccgtcgtctcataccgtctgtcggcttccactggtgaccaaaaaactgctcttgatgggagtggaaacaactcct

SEQ ID NO: 88179 - DNA, 643 bp, Heterodera glycines
  SCN-specific regions: Sequence locations=1-185,207-236,258-271,425 -432,548-548,580-590,622-643
caatctgaggaattttttggggttgccttctttcgacgagtcgcttttcccgcccaagtcgatcgcattgctgaaagtgcttgattcggaaaaaaaccgattggaagtgaaaagggaggaaattgtggggagccaagcgaggctgacgggaaaatacaaagcattgtgcgatagggtgggaacaacggcgcgacaaatcgaaggagtgcacgacagaattatgtccgaagatgatttggacaaactcaaaggcgaggtggacgcgctgcatacttttgtcaacaaacggctcgagaaggcacttcagctccaagcggagagcaaacgaatctttgagaccattcgcccgtccatcaatagtttcaatgaagactacctccactttttgcgtgttgacttggacagccaatccaccgtgttatcgtctgactttctgaagaagatggaaacattgaatgaaagactgaaagatcatcacgacttgtgggctaaacaggtcgtcttccgctatgacgagctgctcgttaaattagacgagttgtccgcaaaatgtttccaaccttctacggagtttccagcaaagccaaatttgaaaaatctgagtgagaaggaactgctaaaattggaggaggaagttcgaatt

SEQ ID NO: 88180 - DNA, 627 bp, Heterodera glycines
  SCN-specific regions: Sequence locations=1-165,195-551,573-627
cccatccccggccgcacacaacacgccacaaattgttgttaacatgcacctacctcaatgccacaacggatcagcaccaccagcattccgacgagcactgcttctggtcaacaaacggtgcatttgcaattggtgcctcagcaagggaacagtccgattcctggccaacagcaacaacaacagcagcaacaacacattataatttcggcgcaacccgtccagaccaccaatacgaccacagaatccgcagatgggaatccgattgctgcgtttatggagtactttgtggaacaacagcaacagccgacgtgttccacgaatactttgcccaacgttcagaccattcagcagtacgggtcgccagtgttggactcgaagttcactttgaaaaataaactgttgagcggaatggacaaaagttcggagaaggctgaacgggaagcagtgaaacgggcacggcaagcagaggcagcacgacaacgttaccataaactgacaccggagcagaaaaaggagttgaacttaaaaagaaccgaggcccagaagcggaagaagcaacgggagaaggaagttgctgaactcgagtccattctgcgcgccagcaacgacatcgtcgacgaccccgaa

SEQ ID NO: 88181 - DNA, 641 bp, Heterodera glycines
  SCN-specific regions: Sequence locations=1-102,124-186,208-237,261 -313,335-641
tgggatcgtctccccatttcttctgtactcaccatcgaaaaacgctgcaaaccttttcaacacaaaacaaatggaatgccaattcgatggaactgaagccggaaaatgtgctttttgtgtaaagcttccgtgtaaatttggagcagttaattgtgcagaggaagtgagcatctcttgtgtaaatccgcaagaattggaaaaatgctgcaatgcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctgctggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctctttc

SEQ ID NO: 88182 - DNA, 642 bp, Heterodera glycines
  SCN-specific regions: Sequence locations=1-43,66-391,414-642
aaattggggcaccgcaattgctctaattgtgggcaaaacaacgcaagatgcataactcacattttgatgactcggcggtcaaaatgtgggtctttgaagaggtggttgaaggacccaaacttagcgaaattatcaacgatgaaacaccaaaatgtgaaatatttgcccggaaagaaacttcccactaatgttatcgttgccactgatgttgctgaggcttcaaaaaacgcggatgttctcattttcatcatccctcaccaattcttgcacaaagtttgcgaacagctcaaaggaaacatcaaaaagagcgcaatcgcaatttcgctgatctaagggcttggccacttttcacgaaaaagacattgggctgcgactgatctctaatgaaatcgcgacctctcttggcattgacacttccgtgctaatgggtgctaatctcgcgaacgaagtggcagatgaccacttttgcgaagcaactactggaaccaaaaacccacagcatggaaatgaattgaagaagttgtttcacaccgacaatttccgaataaatgtggtcgaagacgcggcaacggtagatttgtgcggtgctcttaaaacatcgtggcatgccgggccggattctcatttgggctcggttatggc

SEQ ID NO: 88183 - DNA, 592 bp, Heterodera glycines
  SCN-specific regions: Sequence locations=1-592
tcaacctcctatcagcccgatgggcgaaaggtggcaatacagtacggcactggctcaatgaaaggatttgtttccaaagacatatgtttgtatggcaaacagtttgtgtacaaaaacaggaattcactgaagcgaccagtgagcctggcctcaccttcgtggctgcgaaatttgatggcattcttggcatgggattttcggaaatttctgtccaaaaattgccgaccgtgttcgacaacatggtcacgcaacagaaagtgccggagccggtgttcgcattttggcttaaccgtgacccgacctctgaatttggtggtgagatcaccattgggggcactgatcagcgacgctttgtggccccaatcacttacacaccggtcacacacaaagcctactggcaattcaagatggattcgatcagtggaggtaatggcaaacttgcgtgccacaatgggtgccaagccattgcggacaccggcacttccctgcttgctgggcccaaaaatgacattgaaaagattcataaacacattggagcaattccgctcttccatggcgagtatatgatatcatgtgaacgttttcccacact

SEQ ID NO: 88184 - DNA, 403 bp, Heterodera glycines
  SCN-specific regions: Sequence locations=1-403
tcgtgagccggaaacaattccgccatgcgtgggcgcattgagacataagctaggggcgcatccctgcggatgagcattttccattccattggcaaggcgactatacccatgtgattagctgtgttattgcgtgcgtttcgccattcactccctatggtcttgcgccatacaccgggcttaatgacggcaccatggatttggcattgatccccagagtcttccgtttcaccaacttacaaattataagaaaggtggccatgtacggagctcgtttcattaccgatgagtaccccgacgtcaaagtgtaccgggtgtcccgttggaaggtcacgcccggagcgctcatcggtccatcaagggaagacacggaccaagccgcggagcaggggcagcactcgggtgc

SEQ ID NO: 88185 - DNA, 382 bp, Heterodera glycines
  SCN-specific regions: Sequence locations=1-382
gagagcatgaacacaaaatgaacagttcccatagtgcctaacggcaatattcatatgcccggtgatggcgaacgatgccttgccgagactggaattgagagccgtaatgagtgccaaaggggccgcacgcgaatactttgcagtctgtggatccacccaaaacggggacaaacgtagatgttggcgaccttttacacgtttgacggaacggactcctgcactacaacgacttgcaagaaccggacgcgaatatttaccgtctgagacaatttgctcccaacattgataaatagcacggaaggtgacagatctaacagctgaccaatgcaaatcattgcaacgacattagatggtccgattccgtgcaacagagttgtcccaa

SEQ ID NO: 88186 - DNA, 243 bp, Heterodera glycines
  SCN-specific regions: Sequence locations=1-243
atgatggcgagtggaaacaactcatctgctgggatgggtgcgatgatcaaaacatttgtcaccgctggactgttcttttcttccctggagacgggtggggcggcaacgactgggcgaagataagcgtctgcaggaaaagcacaccaggtcggtggcatcggatgtgaccaatcgatcaatggtggcgccacctccggcggcgcacactacgctgggggcaaatcgactgaagatgatgccggc

SEQ ID NO: 88187 - DNA, 543 bp, Heterodera glycines
  SCN-specific regions: Sequence locations=1-11,33-277,300-460,483-543
aatgccaaacatttttaaaatccttctgattgcgcttttggccgtcgtctcattccgtctactcggcttctactggtgacaaaaaaaactgctaatgatgggagtggaaacaactcatcaactgggattggtacgaagatcaaaagaattgtcaccgctggactgctcttcactttcctgtcgacgggtggggcggaagcgattgggctaagcaatgctcacggaggaaatgccgccggattggtggccacttgcactgtgactcaatcgctcaatggctccaccacctcctcctgtgcaatttgaaatgggggcaaatcgattagaaaaaatgaaggcacacctacacgaacttgctgagaaaatgccggtcactgaatcgaagcgtttgtcaccgagtggacccgacccacatcatcattatggccatggatggatctaacggaggaagaaagaatggatgtttagttttcagattttattctatcctcttctattgattagttcctcaaaacaaatttcttccacaactttttaaactat

SEQ ID NO: 88188 - DNA, 369 bp, Heterodera glycines
  SCN-specific regions: Sequence locations=1-369
acgaagcaattgttccatttgacttggtcaccaccagaagcactgatacgattactatgagcaaacataatgccaattgggtgatgaagcgatgccaacttggacaaatggctcagcgggaggacgaaaagccgaacaatgttaacaatgccggccttatttatttcagtcggaacacaacacatgctgcctggaacgactttaataatatctgaattcgtttgtgcgcgcaacaacgagatactattgggccgtctttctccaccatccgccagttgaagcggcgaaaaagatgagaaatgatctggtatgttggacaatattgtatggacaaatagggctgatgatcagtgttgatgctcatttttg

SEQ ID NO: 88189 - DNA, 482 bp, Heterodera glycines
  SCN-specific regions: Sequence locations=1-482
tttttattctgactgcgtacatgaatgaacactaatgtatagatctgctatgcatccggtccgtacgaattggtcaagagcacaaacaatgaaacgatgacaatgatcacacaaaatgccaattgggtgatgaagcgatgccaaattgggcaagtggttcggtgggaggacgaatagccgacgatgtgtacaatgccggcgttgttcatttgaacggagaccgaaaacattctgtttggaacgactttaataatatgtgcatttgtttgtgtggagacaacaaatcctatgggcctttttctccaccataggcatactcaaagcggcgaatatgatgacgatatgatcggctatttcggacaatattgaatggacaaattggtctgctgattacttatgatgctaatttttgctagtgaattatgatgtgttttttttaccaagaaattagtttcttcttgatgatataatgacaaaatgga

SEQ ID NO: 88190 - DNA, 182 bp, Heterodera glycines
  SCN-specific regions: Sequence locations=1-182
acatgctccgatactaacttttcggttccttacccttggtcgcgatcgaacacactgaattactgacagagatcgccaccgacgcccataggggggtggaaggacaccattttccagcgctggagaacgcggagagcgaccaaagaggcgcatttatcaaagccaacgatggaatgtgcgaa

SEQ ID NO: 88191 - DNA, 465 bp, Heterodera glycines
  SCN-specific regions: Sequence locations=1-465
acaaaccgcccgaggatgtcctcggcgttcatgctgagctggaattctggcgcatttccaccagttatattggtgcgtgttgtgccgagtcggtgtctccgctggagcgattgttggagacgagcaaagaggaaaaggtggacgaaatcagcttccacatattgtgttgcggccgattgcggcgccgaatgtggacctttctggagagaccgggctcctcgctgcaggccaagactttccaattgtgctcaacactgttcgtgatggtctccgtgctcggactcagtttcggcaccattcccgactttcaggtgacagaatatattccgacgggcaatcgaagtgtgatcacttcgaatggcacttcgattgagcgcgaggaattctaagcggtgcgcgtggaacaccccgcctttgtgttcacagaacgcattcgcatcgccttcttcaccatcgagtattgcc

SEQ ID NO: 88192 - DNA, 107 bp, Heterodera glycines
  SCN-specific regions: Sequence locations=1-35,60-74,95-107
gggggggggggttttttttttttggggggggggcgcccaccccccccccccccccccccaaaaaaaaaaaaaaattttttttttttttttttttccccccccccccc

SEQ ID NO: 88193 - DNA, 383 bp, Heterodera glycines
  SCN-specific regions: Sequence locations=1-353,375-383
caaaatgccaattgggtgattaagcgatgacaaattgggcatatggattactgggaagagaaataatcgatctattcgaactatgccaggattaattattttagcggacatataacacatcctggtaggaagaactttactgatatgtgtttttgtttgcgtggctgcaactgattgtataggacgcttattcctctatccacgaatctgggtggaatgcatagtaatacgattcctatctttacaaattgtatggaaactattgcgtggtatggcctttgacactcaatgccgaacgttttttcatcaacacaccgtatggtgcaagcactttgtgagttaattgaaacgacgggactttattttggacccggtcccaatgc

SEQ ID NO: 88194 - DNA, 387 bp, Heterodera glycines
  SCN-specific regions: Sequence locations=1-43,66-387
acaaagtgctccaattacgacaaatcgaacgcctgatgccaagggagagagtcttttgtgttataatggacggagcaatggtacggagcatcaaagatttgctcacttgatgaactgaccccatggaattattttaaccaatattgccaatcggacactcgcttcagttccaaacatattcatgctaaaaaaaattctctcgtgatataacacgatcatattctacgacccggtcaatgtttagaggcctgaaagtctgatcatcttgatactatatgaaacattcaatgatcaaccttggtaaaaacatttactactcttgtgactgaaacagacagcgatgtttgaccggctcatttatgatttttatctactaattcgctcatt

SEQ ID NO: 88195 - DNA, 780 bp, Heterodera glycines
  SCN-specific regions: Sequence locations=1-505,527-719,741-780
gcgcaggattggatgcgtcggagacactaaacggacgatgcgcagacgcgtcaatgaggtaattgacgagtttggtctggaagagtgtcgccatgagctcgttggattcagcggagtcgaaaagagcattttgggtggtgagacgcgtcgtttgctgttcgcctccgaattgttgaacaacccacaaatcatttttgccgatgaaccgaccacgggcctcgacttttcaatggcggacagtgtgatcagcgtaatgcgtgccctggctttgtctggccggactatcatttgcaccatcgttcagccgccattggacatttactggatggccgcaggaaataatgcgcgattgactcgtgacgaattgtttcgggcggttgaacgtctcagagaatccattcttctcatggacactgaaagagcccgattccgtcgttcgaacggggctttgctacggatgatcgtgcgattgtcaggtggcatcccgccaaattttaatcatgctcattttgctgctgctgcacagccggtcgtcaatgtgactgcggttctcgccaatgccaatcccactgggcagaattaccaacgccttctgaatttgaacgccgatttgacggagaccatcgcccgtttaactgtagaaatttcccaattgggatatatgaatgagcaattgacggaacagcttgaacatctcaccgaagtgcctccgaatgcgaattttaatctggatgatgttgcgtttcatccgcccctcgaccaacagcaccaagtgcctcc

SEQ ID NO: 88196 - DNA, 677 bp, Heterodera glycines
  SCN-specific regions: Sequence locations=1-512,534-553,581-677
acccgaatttgcgtctcggcgatgtcacgagcgtaaatctgacaaaatcgagggcggagtgcagaccaatgtgatccctgcccaattcgtggcatattttgacatgcgcgtgacgccaaccgacgactttcagcaaatggaagcaatgatcgccaattggtgcaaagaggcgggcccggacgtcacttttgagttcgtccaaaagggaatgtgcaaatcgctgacccccaccgacgcctcatccccgtggtggcacgcgttttcgtcggcgcttagcgaagagaaatgcgctttttccaaggagattttcatcggtggaacggacgcgcgttttctgagagagaagggcatcccggcaattggcttctcaccgatgaataacacgcccattctgttgcacgaccacaacgaatttctcaacgaaggcgtttttctgcgcggagtgaaaatttacaccaaaatgatcccacggctcgccaatttgccgtcattttgagcgaagtgccggcagaacaaagaaaagaaggaatcaaaatgatttctcctctacgccaataaattaattatatttattttaattcacttaaggaattcctttgcccattttattgcctttgttttttaatttatttcattttgaccaaatttatatttcaaattgaaaccgaatttatgat

SEQ ID NO: 88197 - DNA, 241 bp, Heterodera glycines
  misc_feature (15)..(17): n is a, c, g, or t
  misc_feature (39)..(41): n is a, c, g, or t
  misc_feature (143)..(147): n is a, c, g, or t
  misc_feature (151)..(153): n is a, c, g, or t
  SCN-specific regions: Sequence locations=1-83,105-156,180-221
aaaaaaggggggtgnnntccttttccccgggaaaatttnnnaaaagggggggggggtttttcatacccccccccccttttaaccctctttgtttttataaaaaagggttttttttttcccccccaccccgcgggggggggggnnnnnatannnccacaccccccgccgagaaaaaaaccgccccattttttttttttttttttgcgtgttcccccccccccaaaaaaaaaaaaaaaaaaaa

SEQ ID NO: 88198 - DNA, 406 bp, Heterodera glycines
  misc_feature (367)..(368): n is a, c, g, or t
  SCN-specific regions: Sequence locations=1-180,212-275,324-377,399-406
gaggacgggcgcagcagcaactctgaagtgctgttagccgcgctgcaggacgtgcaaaagtacatgaaggagatgggacatgctgcttcacacatgaagcattgggtaccactttgggggatgcaatccccccaacctggggacaacccccccccccccccttttttgtggggagaaaaagcgcccccccccccggggggcccccccccccttggggaaaaaatatgggcgccggggggaaaaaaacccccaaaaaaaaggggcgcgcaaaaagaggggggggggccccccccccccccccccaaaaaaaaaaaaaaaaaaaacccccccccccaaaaagaggggggggggaaaaaaaaaggggggnntttaaacaaccccccccccgggggggggggaaaaaaaa

SEQ ID NO: 88199 - DNA, 102 bp, Heterodera glycines
  SCN-specific regions: Sequence locations=1-102
ggtgttcgccgccaatggcaaatacactttcggcttccgtctctatgggatgtgccaagtgcagaattcgattttttcgcattcaaatttcctcgacgtgca

SEQ ID NO: 88200 - DNA, 79 bp, Heterodera glycines
  SCN-specific regions: Sequence locations=1-79
aagcggaaattactttaatgtattcttggataacgaggcgcttgtcgaagcggtggtgagggtgaacgttttttcggag

SEQ ID NO: 88201 - DNA, 91 bp, Heterodera glycines
  SCN-specific regions: Sequence locations=1-91
aggcggacactgagtccggtgttcagtgccgaggattggcttgagtttgtgctgcccgaaagtgtcggaatggacggggatggggtgccac

SEQ ID NO: 88202 - DNA, 76 bp, Heterodera glycines
  SCN-specific regions: Sequence locations=1-76
gcaaggatttttttgttctttgaatcccattcattttctctcctttttgcttccgactttggagaagacacgacaa

SEQ ID NO: 88203 - DNA, 83 bp, Heterodera glycines
  SCN-specific regions: Sequence locations=1-83
ttgcagcctattttagtgagtctacaccgcttacccatcgaccattggcttaagtcgacttccgctgcaaatggtccgaagaa

SEQ ID NO: 88204 - DNA, 383 bp, Heterodera glycines
  SCN-specific regions: Sequence locations=1-200,231-243,294-330,353-383
cacttctaacgtaattattctgctctttgagacatcattccaaataagccaaatcgtcaaaaatgaaccgacgttaagcactcaaaaataaatctggggctgtgcaatgacgcttggatgggacattttggccgttggtttgaaccgtcctctaagtttggggctttaaaattggggaaagtgtttttccccccccgtttttttaagacttttttgggggggagaaaaccttttttttttttgtcccaaaaaaaaagagaatttaatatttttttttggggaaaaaaacaattctttttttttttttaaaccacggggggggggggggagaaaaaaaaaaaaaaatttttttcccaaaaaaaaaaaaaaaagggggggggggg

SEQ ID NO: 88205 - DNA, 509 bp, Heterodera glycines
  SCN-specific regions: Sequence locations=1-215,237-509
ggtcggtgcgcgtcgttcctcgcggcgcgttatctgctccattgcacagaatactgacggcttggataaaatgcatgagaccgcccaggagtatccggataatgcggctccggagttgcgcgagatctgactcgacgtgctggatttgctagacatttgtctgaccctaagctggaacactctgcataccggtgtttttgctgaagatgacgggacaatcctcccggttcatgtgtgaggtcgtcccctgtgacgacctccgacacttttcgagccaaaagcactatgtgggtgccaaaatgtgtcggccactgccacagacaagaatgcatcaccaccgcatgccatttgtctttggctctgacgctaatgcgttctttgagttctacttgaacttctgaactcacccgacaaggcgtgccaactgcacacacaggcgttcccatgatgcgattgctgtgattgctcgctcaacgaggactcgattcgcgactgcgatcttgtcatgc

SEQ ID NO: 88206 - DNA, 639 bp, Heterodera glycines
  SCN-specific regions: Sequence locations=1-639
tttttgctttgcccatataatggcatcgccgccaaaagcaaatgcgctgatcgaagcggccggcaagttaacaaactgttcattatgccgcccaatcggccgacacgcatcaaaaaagcgatgaacattttgtttggccgcaccgaggaggaaaaacgagtgaccggcaattttgtgtcacgcattgcgggacgcaacccccgtcgtgaggacatgccgaccacgcacgactggccaagtgtttggactaccgcgcagtacttccgttcatcggtggtgccgttgcccgtccgcatgggcttccgccgtaggccggaacggttcgcgccaaaagggccgtacgggaacttggaattgatgaaaattcccaactttttgcatctgacgccggcgcatgtgcagcgccatgggcatgcaatcaaaaaattttgcaccaaatttcccgaagagttgaagcaggccgacgtcaatgagcagtacacgccgttgcggttggtctacagcgactactttcaccacggcaacatcattcgggacaagcgagcgcgtgaagtgaccgccaaaattcagctgaactcgttcgggctcaaggacactcatgcgcacaacaaatgtcgtcagttggttggcgatcgctat

SEQ ID NO: 88207 - DNA, 773 bp, Heterodera glycines
  SCN-specific regions: Sequence locations=1-215,240-773
taaggacgggaaattgtttggccgcggttccccgatgacaagggcccgtgctcggctggctgaatgtcatcgaaaccatgcaagggcttggcattgacatgcccatcaacataaagttcgtgttcgaggggatggaggagtgcggctccgacggattggacgaatgcctcgagcagcgcaaagattttctctccggcgtcgacttcgtgtgcatttcagacaattattggctgggcaaacagaagccgtgcatcacttacggccttcgcggtctttcgccgtttgccatcgaaatcagtgggcccaaccaggacctccattcgggcgtttacggcggcacaatccacgagccaatgaacgacctttgctggttgctcagccaattgactgacacaaaggcgaacattctgatcaaaaacattgacaaaatggtggccaaactcactgaggaggagcgcaacacttacaccaaaattgactttgacttgaatggattcaaaaaagacgttggcgttgagaaactcacttccgaagacccgaaacaaattctgatgagacgctggcgtgagcccgccctgtcaatccatggcattgagggcgcattctccgggaagggctttaagacggtaatcccttccaaagtgacaggcaaattcagcatcagaattgtgccggatatggtgccggaagaagtggacaaaatcgtcgttgattttgtcagcgaagtttggaaaggtcgcggctccccaacaaatgaaaatccttccgttggg

SEQ ID NO: 88208 - DNA, 80 bp, Heterodera glycines
  SCN-specific regions: Sequence locations=1-80
tcttttactgtcgtgccaattcttttttgcttctttttgcctgctctttcgatttataagccaaattgggactcaattga

SEQ ID NO: 88209 - DNA, 92 bp, Heterodera glycines
  SCN-specific regions: Sequence locations=1-28,51-57,79-92
agccgtttcttccgccgtttggtgcacgtccgacagatggactttgaattcgctgcttggcaaatgctttacctgctggtcaatccgcatag

SEQ ID NO: 88210 - DNA, 483 bp, Heterodera glycines
  misc_feature (463)..(463): n is a, c, g, or t
  SCN-specific regions: Sequence locations=1-28,51-57,79-88,128-344,366- 463
tagccgtttcttccgccgtttggtgccgtccgacagatggactttgaattcgctgcttggcaaatgctttacctgctggtcatccgcaaaagaagccaagatcatgggcccgcgatgaccccgcctttctcctccttttggcactttctctgctcggctcgagtgttctgtttgcattagcgctcaatttgtccttttcttcgttttgcgcctttttcctttgggttgtgttcatcgattgcatcggaattggcattgccattgcaaccgcactttggttcatttcaaatcgctttttgcgtcggacgagggattgcgacgtggtcgagggggcctattgcttcgatgtccatttgaatgcttttttcccgttgctcattcttctccacgtcgttttacctttgcttttctacggtccctcttttttttctttttttgaacaaaatattttttaggaccaccnaaaaaaaaaaaaaaaaaaaa

SEQ ID NO: 88211 - DNA, 678 bp, Heterodera glycines
  SCN-specific regions: Sequence locations=1-678
ttaagaatttcgccggtacttgttggactgtgccgtcaatatttaattctcccatatacttttcgacttttttgccctcctttgcctcatccatatgatagactttaaacgagaatgtaatggtcgacttggctacactcttgttgaggatgattcttcactgttgggtggcatcacttttcgctcaattgtgtccggtgacaaattgccgttgttgcgcgattcaccgcccgagtcgcatgttgagccggtggcgcaactgttgcgatctccacgtgaccacatggacaacatcttcaacccagcggacaacaacattgtggacaacaccaatggcttcgctttggcgccttacaccgaacagcgacgtgcgcccagcggagtgttggcacagcaaacgatgcaacggttcggcaatgcgtatttcatgggtaatagtaataatagcactaacaacaccaccacttcctccgcctattcattggcaacaattggcaccaatacgacgacgtacagtggcggggcctgcaacggcagcggcggcacattggtcacaaacgcaactggcacaacaggcggacgtcgtaaagaggtgtacactgacggcattttgctcgattgcgacaccaatcgcattctttccggtggcggtgttgactttcggtccgcaaatgcgcc

SEQ ID NO: 88212 - DNA, 304 bp, Heterodera glycines
  misc_feature (27)..(27): n is a, c, g, or t
  misc_feature (38)..(38): n is a, c, g, or t
  misc_feature (40)..(40): n is a, c, g, or t
  SCN-specific regions: Sequence locations=1-71,95-98,126-211,244-272
ttcctccccaaacgatgtcggtggtgngcggctttctntncggcggtattttttttttgcccccccctcttttttaaaaaacggaaatattttaccaacccttttaaccctggcaatttggctgggggcccggaaaattgcttaaaaaaaaaaattgggaaaaggggccccctttttttttttcccccccggcccaaagggggggggtttttttgggcacccccccggggggaaattttagagtttttttttggggggggggcgggggccccaaaaaaaaaaaaaaaaaaattttttttttttt

SEQ ID NO: 88213 - DNA, 226 bp, Heterodera glycines
  misc_feature (14)..(14): n is a, c, g, or t
  misc_feature (20)..(20): n is a, c, g, or t
  misc_feature (76)..(77): n is a, c, g, or t
  misc_feature (86)..(86): n is a, c, g, or t
  SCN-specific regions: Sequence locations=1-187,213-226
ttttttaaactttntccaantgctcattttaaggattatagtaggattcgtctttatatgaggtttttagactatnncttataatntatatcaatatatggaagaaggattatggagccaactggatttttgacccgaaaaatccatttggaaaaaaaggcccctttataaaaaaaacccccccccctttttttaaaaaaaattttttttttcccccaaaaaaaaa

SEQ ID NO: 88214 - DNA, 338 bp, Heterodera glycines
  misc_feature (88)..(88): n is a, c, g, or t
  misc_feature (90)..(90): n is a, c, g, or t
  misc_feature (92)..(92): n is a, c, g, or t
  misc_feature (98)..(98): n is a, c, g, or t
  SCN-specific regions: Sequence locations=1-146,168-269,296-338
tcccttcctttgtcttgccattgcataaacaaaagcccattgagtgttcttcttgggccagcccggctgtgaaatggactcgcaatgntncngctcanacaaatggcacccatttgcatcaaaaggtttttgcgccggggtccccttttccctttgtttaatcccctgaaacaaaaaaagggttttttggaaagggcccccccaaaaaggtttttttaaaaaaatttggccccggggaaaagtcccccccaaaattttgtcccccccccggggggggttttttaaaaaaaaaccattttttttttgggagaaaaggggggaaaaaaaaaaaaaaaaaa

SEQ ID NO: 88215 - DNA, 88 bp, Heterodera glycines
  SCN-specific regions: Sequence locations=1-88
taggacgaagatacactttgaaatgccatggaagaagtcgaattaataaaagaaatcaaagatggcacagcctttaaagaatacacca

SEQ ID NO: 88216 - DNA, 205 bp, Heterodera glycines
  SCN-specific regions: Sequence locations=1-136,160-168,195-205
gaactcggcagtttttccgttaggccgttgacgtcgaagggaatgaacatttcgactgttcccacgctcgaccattatccggacatttgttgggggaataacccaattgccggaaaaacctccctggacccattttgggggggggcccccccggggcccaaaaattttgcgggggggggcccccccccccccccaaagggggggg

SEQ ID NO: 88217 - DNA, 189 bp, Heterodera glycines
  SCN-specific regions: Sequence locations=1-144,167-189
gatggaggaggacgggctgatcgacctgcacaccttgaagtctgatcgatgaccgcacccgtgccatcgtcgtcaaacaatccgtcccaatccccaccgggaattggttttcccctcgccgaaaaaattttggaaaaaaaaaatccctggaaaaaggggggcccccaaaaaaaaaaaaaaaaaaggggg

SEQ ID NO: 88218 - DNA, 104 bp, Heterodera glycines
  SCN-specific regions: Sequence locations=1-53,75-104
catggtttgcttggtgatggctgtcctaatggaaatggcaaattcaaagctgtcaaaaaagacaacaaaaaaggagcagtggcggcatcaccagcaaaaggaaa

SEQ ID NO: 88219 - DNA, 225 bp, Heterodera glycines
  SCN-specific regions: Sequence locations=1-83,108-165,190-225
aaatgcctttgggaaaaggtttggtccccaaaaacaaaactggaaaaaaaatggcgggggggtaattttgccccaaaaaaagggggaagaaaattgggggggcgtttaaccgcgcccttttttaagggggggggggggggggggaaaaaaagtgttgcaccccctctttatttttttctataaaaaaaagcggggggggggggaaaaaaaagggggggggggttg

SEQ ID NO: 88220 - DNA, 347 bp, Heterodera glycines
  misc_feature (74)..(74): n is a, c, g, or t
  misc_feature (105)..(105): n is a, c, g, or t
  SCN-specific regions: Sequence locations=1-302,324-347
agaaggctgttgaccagtgttcgtcgccaagaccgggcggactcgctttgagacgtcttgagagcacgctgacncttctcccagtagcgcgaaggccacgaccanatgctgtcgtgatgaagacagaaactcactggaggaaaagtgccccattggaggatggcccaccctttgcccgaaaattttcccgaaaaatttctttcccaattttccaaattaaaaaattggggccttttttaaaaaattttcccccctctttccccccgggtttttaagggggtttttttccggggaaaaaaaaagggggaaagggggggcccccctttttttttttcccccccccaaaa

SEQ ID NO: 88221 - DNA, 215 bp, Heterodera glycines
  misc_feature (4)..(5): n is a, c, g, or t
  misc_feature (7)..(7): n is a, c, g, or t
  misc_feature (11)..(11): n is a, c, g, or t
  misc_feature (16)..(16): n is a, c, g, or t
  misc_feature (18)..(18): n is a, c, g, or t
  misc_feature (20)..(21): n is a, c, g, or t
  misc_feature (31)..(31): n is a, c, g, or t
  misc_feature (33)..(33): n is a, c, g, or t
  misc_feature (35)..(35): n is a, c, g, or t
  misc_feature (38)..(38): n is a, c, g, or t
  misc_feature (40)..(41): n is a, c, g, or t
  misc_feature (44)..(44): n is a, c, g, or t
  misc_feature (46)..(47): n is a, c, g, or t
  misc_feature (49)..(49): n is a, c, g, or t
  misc_feature (51)..(52): n is a, c, g, or t
  misc_feature (57)..(58): n is a, c, g, or t
  misc_feature (63)..(65): n is a, c, g, or t
  misc_feature (69)..(69): n is a, c, g, or t
  misc_feature (71)..(71): n is a, c, g, or t
  misc_feature (74)..(76): n is a, c, g, or t
  misc_feature (78)..(78): n is a, c, g, or t
  misc_feature (80)..(80): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (107)..(107): n is a, c, g, or t
  SCN-specific regions: Sequence locations=1-215
tagnncncccnattgntntnncaaagactgnananagntnncgngnntnannaccgnnagggnnnattnanagnnncnanattntntngncngngtcggnanggaanggatactagtctagtggttccgacgaaaatgaaggaaattgcggagtcttcctcgtcacgaagtgaaaaatgccgtcgttactgtgcccggcttactttaacgatgct

SEQ ID NO: 88222 - DNA, 120 bp, Heterodera glycines
  SCN-specific regions: Sequence locations=1-28,52-61,84-120
caatgaatttcctcctgtcctgcctggcggtgcaaaacacactacaaattcatgtgcaaaccatctcatggaaggaatatgaagcgaatgcactgaaatcggacggtgaattggagcgcg

SEQ ID NO: 88223 - DNA, 81 bp, Heterodera glycines
  SCN-specific regions: Sequence locations=1-81
cccaactctgctggggtcactgcttttaattctaatggaagaagtcgcttcgaatttaactccgaatgaggggcccttttt

SEQ ID NO: 88224 - DNA, 86 bp, Heterodera glycines
  SCN-specific regions: Sequence locations=1-86
ccaataagattgacacatcaaaaaaaaataataatgttgagccgtttctctaaaattattgtccgtggatatgcaaaagatctcaa

SEQ ID NO: 88225 - DNA, 75 bp, Heterodera glycines
  SCN-specific regions: Sequence locations=1-75
cagcgaccgtggactgtgcggatcggtgccacttcggttgccagaccgcaaaaaacatttggccacaaaccggcc

SEQ ID NO: 88226 - DNA, 431 bp, Heterodera glycines
  misc_feature (133)..(133): n is a, c, g, or t
  misc_feature (137)..(137): n is a, c, g, or t
  misc_feature (157)..(157): n is a, c, g, or t
  SCN-specific regions: Sequence locations=1-171,194-196,219-245,277 -286,320-392,417-431
ggtccttgaaatcctagactgacttgtgtcaaaaaattgagtttccggatgagcctaatttcttttattcggatatggtggccagatacgaacagtccatgctaattgagacgggacatgtgtatgccccagncggngcgagaacacgctttggggnggaccccccaaaaaggcccccgggcccccccccgggaaattttttgggccctctttgggggacaaacactttttttgttcccacgggagccccccctaaatttttttcccccaaaaaggttttttttttctccccccccacaaaaaaatttttcccttgtggggaaaaaaaaaaacccttttcttttttttgaaaaaaaaaaaaaccgttttttttttctccaaaagaggggaggaggaatttttccccccccttttttggggggggggggggg

SEQ ID NO: 88227 - DNA, 75 bp, Heterodera glycines
  SCN-specific regions: Sequence locations=1-75
gaataagcgtttgtaagacagactgtgctccaatcgcggaatgcttttctcttaaacgcctcgtcagccccgtcc

SEQ ID NO: 88228 - DNA, 166 bp, Heterodera glycines
  SCN-specific regions: Sequence locations=1-166
tattctgctctttgagacatcattccaataagccaaatcgtcaaaaatgaaccgacgttaagcaatcaaaaataaatctggctgtgcatgacgtttggatggacattctgccgttgtttgaccgtcctcagctcggcctcaaattggcaatgctttcgccccgttt

SEQ ID NO: 88229 - DNA, 747 bp, Heterodera glycines
  misc_feature (643)..(643): n is a, c, g, or t
  SCN-specific regions: Sequence locations=1-244,267-595,634-667,691-747
gcgaaagagtgctcgggttttgcgactttcgcttggacccgacaaatttcccaagggatttgaattcgatgttgaaggccccaactttccgatcgaagggttccgttttgtcggtttgatttcaatgattgacccgcctcgtgctgctgttccggacgccgttgcgaagtgccgtagtgcaggcatcaaagtggtgatggtcaccggggatcatccgatcacggccaaagcaattgccaaatcggtgggcatcatttcggagggcatggaaactgtcgaagatatcgccgttcggaaagaaatttctgtggaccaagtcgacccgagagaagccaaggcgattgtaatccatgggagtgatttgcgcgagatgaatgaggaccaattggccgaagtcatcaataaccacgatgaaattgtgttcgccaggacttcgccacagcaaaaactgatgatcgtcgagggatttcagcgtcagggacaaattgtggcagtcaccggcgacggagtgaacgattcgccggcactgaaaaaggctgacatcggagtggcaatgggaattgccgggtcggacgtgtcaaaacaagcggcggatatgattcttctggacgacaactttgcttcaattgtgaccggcgtggangaaagccgtctcattttcgacaatttgaaaaaatccattgcttatacgttaacttctaacattccggagatctcaccgttcctgatgtacattctgttcgggat

SEQ ID NO: 88230 - DNA, 458 bp, Heterodera glycines
  misc_feature (436)..(436): n is a, c, g, or t
  SCN-specific regions: Sequence locations=1-436
atccgactgatgcggtccgccctgcctgagaagccgttcccagcaagcaggcatacactgcgcaccgtaccaacgcggcgcagatgcaagcgcaccagcagttccagccaagacgctttggacacctgaagttccagacacgcgagtacggcccgttgcacaaacagtgagggggaaaatgaatagtgccaccgcgacgaatggatgggagagggatgcataggaaaacgatcgacggatgatgataaaattgggcgagagcaaacgacgacgagatgccgagagttgtttattttgttgttttgattccagtgtctgatggagcactgcttttctctttcttttctctgtcatttccacacttttcccttccttttttcttgacatggtccaaaatgttgatgattgttttcgtaacaaaacttcaaattgtttnaaaaaaaaaaaaaaaaaaaaaa

SEQ ID NO: 88231 - DNA, 80 bp, Heterodera glycines
  SCN-specific regions: Sequence locations=1-80
ttgacaaaaatttacaggcaatttaatgaaatgagcagatgttttttgcatttttatactgtcaaaacggatgaaaaagg

SEQ ID NO: 88232 - DNA, 81 bp, Heterodera glycines
  SCN-specific regions: Sequence locations=1-1,23-81
cctgttcggcccactgtggttggtgacgcattctaaggtgctcccaaaacacacaaccggacctaagctaacttgcgtttg

SEQ ID NO: 88233 - DNA, 118 bp, Heterodera glycines
  SCN-specific regions: Sequence locations=1-118
cccgcgcccctttactttatttgaaatactccgccgatcattcacaaaagctcaaaaataatcccccgtaaagcgaacacaaaatgagaatgacccaagacgcaaatttgagcacttt

SEQ ID NO: 88234 - DNA, 166 bp, Heterodera glycines
  SCN-specific regions: Sequence locations=46-97,164-166
tttttttttttttttttcaaacaaaaaaaaaaaaaaaaattttttcgaaaaaaaaccaccccccccaaaatttgtgggggggggtttttttctccccaaataaaaaaaacaaaatttacatttttttttttttataaaaaaaaaggtttttttttttttttttccc

SEQ ID NO: 88235 - DNA, 125 bp, Heterodera glycines
  SCN-specific regions: Sequence locations=1-125
caatattctccgtcgtctcacagtactcaccgtcgtccccccagtattccccatcatctcctaatactctccgtcctcccctcagtattctccgtcgtctcctcaatattcgccgtcgtcccctc

SEQ ID NO: 88236 - DNA, 520 bp, Heterodera glycines
  misc_feature (472)..(472): n is a, c, g, or t
  SCN-specific regions: Sequence locations=1-169,192-218,242-520
tagagaaaaaagatatgtttttctctggcactctctatttattggtacacatctcgttttttgaaacggtgtgtgtatgtgacattcgtggtgagtcgaagtgataaataggcaaatgtctggtgatcagaaggggacccacgcgtttgggcgctggcattttggcgccaaaaaatataaaaattaaaatacttgagcagtgaaccctctcggagtggtaaatccattttaaaatgaattttgggccaagttttttttcaggtcggtgtcatcagtgcgttcaatttccctgccgccgtttacggttggaatgccgcgttggctctcgtctgtggcaattccgtgctttggaagccgtctcccagcactccgttgacgtccattgccatcactcgactcgttggcgaagtgttgtccaaaaacggactgtcgcccgacatttgctcattgatttgtggcggaggggacgtcngaatgtgccttggtaaggaccctcgggtcaatttggtctcatttaccg

SEQ ID NO: 88237 - DNA, 706 bp, Heterodera glycines
  misc_feature (674)..(674): n is a, c, g, or t
  misc_feature (685)..(685): n is a, c, g, or t
  SCN-specific regions: Sequence locations=1-33,477-706
tgggaaggtacttcttttcgaaggtaagagggagggaaagttggcgaattggtggacgaaacgtgcaaaggcgcagccgcgcatagcggcggagtgttcgcgttgaattggcattcgggtggcataaaattggccaccgcttccggcgacaaaaccatcaaaatttgggatgtgcctggacgaaaactaattgggacggtgtccttcggctcggccatagaagaccaacaattggccgtggtttggcttaggaattggatcgtcagtgtctcattgagcggcttcatcaattacatttgccccgagacactgaaagtctgccgagtgctcagaggacataacaaatccatcaccgcgttgacgctgtccgaagatcgacgaatggcattcactgctgactttgagggacatataacccgttggaatgtctcggatggctcttctgaacgagtgactccccaagtgcacaagtcgcaagtgtccgggctgagtttgaccagcggcggtttgctcatttccatcggatgggacgattcggtcgctttcattgaaaatgccctttccccttccattgaaaatgttcagtcgctttcccaccgtttgtcctcccaaccacgcggtgtggcgagcattgggcaaaacggggaaagagttgcggtcgcatgccatcgctncattttcattntcaccgacaaaaaacaatcaa

SEQ ID NO: 88238 - DNA, 401 bp, Heterodera glycines
  misc_feature (23)..(24): n is a, c, g, or t
  misc_feature (291)..(291): n is a, c, g, or t
  SCN-specific regions: Sequence locations=1-401
ggctttcggaaccaaaaactganngtcttcaagtcccgatcacttctccggacaacatttctcagctttgcactccgtcaaacccctcaccccctcagggcattttaagccttccggaatttgccaattcctaccaattggacattatctccgcgttgcgaggcaatgagcacgatttcctggcaaaggcagccattgcggacgcaattcgagcagttcaaagtgatgaggacaaaatggaactaattgatttcattgcgtcagaagaacacggggccattgccttaactntggagaacaatgcgtgcaaaatgttcaattgttcgccctctgaacttccgctggtttcgtccaattataagacgaaaaagcactttctgtccgaactttgcgagctgttc

SEQ ID NO: 88239 - DNA, 140 bp, Heterodera glycines
  SCN-specific regions: Sequence locations=1-140
ggtgctttttacagaacgacacaaatggagggaaagctgatcaaaaccaaatttctccacccaatttattctcgacaaaattcgccgttcattcgatttggaagaggcgcaaaatgagcaaaaatcaacggaaatggccg

SEQ ID NO: 88240 - DNA, 377 bp, Heterodera glycines
  misc_feature (154)..(154): n is a, c, g, or t
  SCN-specific regions: Sequence locations=1-38,73-95,118-214,243 -256,278-346
aagaaaacctttccccgtccgtgtttttatgaatggcgcctttaaaagtttttaaaaggggccaattgaaaaccttaattggaaaaaaggaaaaaggaaaaggggtttttcccttttgggggggggggggccttttgccccccacatttttttntttttttttttgggggccccacaaatatatgcccccccccacccggggcgttttctttttaaaaaaaaaaaaaaaaaaaaaaaaaaaagaggggccgccccacaccactctctttttttgtgggggaaaaaaaaaaccaaaaaatttttccccccttccttcaaaaaaaaaaaaaaaaaaacccccccgaccaaaaaaaaaaaattttttttttttttttttg

SEQ ID NO: 88241 - DNA, 374 bp, Heterodera glycines
  misc_feature (181)..(181): n is a, c, g, or t
  misc_feature (204)..(204): n is a, c, g, or t
  SCN-specific regions: Sequence locations=1-233,261-318,353-374
ggcatttgcgggcgcaatgaaacagacggacaaaaaaagcgaggacggtaaagaatcgctgagtccgacactgccaccatatgacaaatgggcggccggcgtttgttttgcgatgcgattcacgcaatatttcatctacacgaatctcgagacgattggctccggttacgccatgatgatngtcatgttgggacaagaaagcgntgggtactacaaatcccttggcccatgcttgggcccggggttttttcccattttgcaaatcccggggcttttatttttttgggggttgggggaaaaaaaaaaaaaaaccccaaagggggccttcggggttccctttttttccccccccttttttttttttttttgggggg

SEQ ID NO: 88242 - DNA, 118 bp, Heterodera glycines
  misc_feature (34)..(34): n is a, c, g, or t
  misc_feature (79)..(80): n is a, c, g, or t
  misc_feature (83)..(83): n is a, c, g, or t
  SCN-specific regions: Sequence locations=1-118
gatctccgctgttactcgccattgtacccttccnatttcggctaaaattcgcgtgctgcacaatttgtcttcaaccatnntgnaataccgcacgacggattgaagcggcgggggccag

SEQ ID NO: 88243 - DNA, 75 bp, Heterodera glycines
  SCN-specific regions: Sequence locations=1-75
cagcggacggaacctttacgcactacggcggaatggctactcgaaacggacggaaccgcacttctgagagtgcta

SEQ ID NO: 88244 - DNA, 78 bp, Heterodera glycines
  SCN-specific regions: Sequence locations=1-78
atttcctttgtcccaggcggcggaacaaaagaatttggacgacagaccatccatggatgtgcacggatgactattttc

SEQ ID NO: 88245 - DNA, 85 bp, Heterodera glycines
  SCN-specific regions: Sequence locations=1-85
gacgcaagcggttgatctcctgctttaactgtaccgacaaagcagagccgcggcatatttcggcatgttcgctgtccatcccttt

SEQ ID NO: 88246 - DNA, 425 bp, Heterodera glycines
  misc_feature (74)..(74): n is a, c, g, or t
  misc_feature (423)..(423): n is a, c, g, or t
  SCN-specific regions: Sequence locations=1-79,114-224,266-288,311 -326,348-425
tccttttgagactgaggaagcagcgaacagtgcaattgcaaaagtgaacgggggatgcttttggatgggaaaanagtgttttgttggaaaaattttttgcccacgttttccccgctccgtggaacaagcccaaaattgggtggaatcccgctccccactttcttttttcccccccagtgtttttttttttgggaaaaaaaaattttttggggggggggggcccccaaagagaaattttcggggaaaaaaaactttttcacccaaaaaaaggtttttttttctcccacccgtttgttgggggggagaaaaatatttttttttttctctcccaaaaggggtggttttttggggggggtataaaaaacccaccgccgggggaaatattccaccggaggggggggggggggggggttttttttttcncc

SEQ ID NO: 88247 - DNA, 78 bp, Heterodera glycines
  SCN-specific regions: Sequence locations=1-41,63-78
acattgtttcctatcttagacacttaaatggcactgaaacgtatacaaaaggagctgcaggacctcggccgtgaccca

SEQ ID NO: 88248 - DNA, 96 bp, Heterodera glycines
  misc_feature (55)..(55): n is a, c, g, or t
  SCN-specific regions: Sequence locations=1-63,85-96
tcatttgcgacaaatattgggacagagtgccgtacttttgttttgtctccccttntaattgctttctcttcgccccctcccccgcctttgtccaat

SEQ ID NO: 88249 - DNA, 436 bp, Heterodera glycines
  misc_feature (430)..(431): n is a, c, g, or t
  SCN-specific regions: Sequence locations=1-103,125-148,170-436
tgggatttatgtttttacctgtataatggatgtccatgacgaggaagttgaaattattgggactaggtcaaatgagaggcaaatggaccgggctcatcgacaagaacaacagcaggaaaaattttactcccaacaacaaatgtctgaggaaagtgaagaagcattgttttgcatttctaagcatgacgttaaagaaataagccaagtggtcaaagcaatggcattccgagaccattgcacattaaatgtaagcaatgagggcattcgcttggcagttgacgaccaacacaatcagcaaggcagtgcctacttcagatccgagcacttccaagacttcaactttcgtacccaaacatgcagcattaaaataccgatgaggcctcttatggaagcactgaatatgttttccggtacgatgacaatggtgcannaattt

SEQ ID NO: 88250 - DNA, 211 bp, Heterodera glycines
  SCN-specific regions: Sequence locations=1-161,196-211
accaacaccgccgccctcgccccgctaccacagccgttgaagggacgccgcagcagcaaaaacggacccggtgccaattggtgagaagctgacgaccgacaacacccacgaacgcccaaattggacaaccagcaaattttttttttgggccaaaaattttttcaattggggggccccccaattttaaaaaaaaaaccccccccccccccgg

SEQ ID NO: 88251 - DNA, 342 bp, Heterodera glycines
  SCN-specific regions: Sequence locations=1-17,39-103,128-182,204 -234,256-260,292-312,339-342
tgttgaatttttaagaagggagcgggggaaaggtgggggccacattttttttaaaaaagaaaaaaaaaaccgcccccccccccggggtggtataaaaaaaaaacccttttttatacacgggggggggcgcccaccacaaaaaaaaaaaaatccctttctcttagggggggggcccccaccacttttttcttttttgttggtgggggccgccaccttttttttttctcctatactccggggggggggggcgggcgcactccccttctccttcttttctcttttcctttttgcgaaaagggaagagagagaaatccccccccccccccctcccccccccctcat

SEQ ID NO: 88252 - DNA, 94 bp, Heterodera glycines
  SCN-specific regions: Sequence locations=1-94
cgtagtccttaagacatgagtaaaagaaatgcgtttatggactaagtgtgtgcaactgatcacttatttgctgctgtcctttgtcgccttaact

SEQ ID NO: 88253 - DNA, 442 bp, Heterodera glycines
  SCN-specific regions: Sequence locations=1-249,273-373,395-442
gcactgttcggaacaacgaaaaggaggcgatcggatttctgatgtcggacaagcgtttaacacaataatcactcgtgcggaagagcttttgatcatcgtcggaaatgccaaagtgatgatgagggattcgtcttggaaggagatgatcgactattgccgcaaaaacggtgccacagttgacatgccgtctgaagcggagcttttcccatcgggccaatttcaaaatgatgtgctgacggacagtgacaagagcagcagcagtagcaacagcgaagttgatgagaaggagcgaactgaccaacttgtgaagaagggcacgtcgagtgccgccgctgctgaacaacagaatctcagggccaaggcatcttccgccgaggaagaggatgaagacgattcgagtgttgctggggagacaacgacggaagacgatgacgaggaggaa

SEQ ID NO: 88254 - DNA, 221 bp, Heterodera glycines
  misc_feature (7)..(7): n is a, c, g, or t
  SCN-specific regions: Sequence locations=1-10,32-66,89-125,150-189
acccctnttggaaaaaataacccaattttggcgaatggctttccaaaaattccccccctttttggaggggggccccccccccccgggcaaaaattttttggaaaacaccccccccccttttttttgggggggggggggggcccccccccaacaaaaagaggggggtttttatttttttttttttcgcggaaaaaaaaaatttttttttaaaaaaaaaaaaa

SEQ ID NO: 88255 - DNA, 282 bp, Heterodera glycines
  misc_feature (49)..(49): n is a, c, g, or t
  misc_feature (76)..(76): n is a, c, g, or t
  misc_feature (79)..(79): n is a, c, g, or t
  misc_feature (84)..(84): n is a, c, g, or t
  misc_feature (98)..(98): n is a, c, g, or t
  SCN-specific regions: Sequence locations=1-103,125-199,238-282
cagccgaagaaggagccgtaccacgcgcagcaccaccactttaccaganaaccaattagtttgctattatttgcanaanctganggggtcacgtgttngccggaaatgtgaaaaagaaaaatgtcaaaccggagggcgaagaaagattcgggcgcggaaacaattggccccccggtttgaaattttccattttcgcccacccaaaagggggtttccccccttcttcccgggggaaaaggggggggggggccccctttttttttaacccccaaaggggggggg

SEQ ID NO: 88256 - DNA, 771 bp, Heterodera glycines
  SCN-specific regions: Sequence locations=1-771
attctctgttcgtgttagcaactgacgaccggaattgttgtcctttgtggaacggactgtccaatcgttactcgacaaaaagatgattgttcgacaagaaattgacatgttcgaagcccacaaatcggctcggccactttcaacgcgaattttaacccccaaatggcacttgacatgtgcaacgacctcggcgccaatttgggcaaaggcatcgtgctaatttcgcacttccatttgctttacaattgtgtgccgttggacgtcgccgttcaagtggactggaatttgttctacaacgaatatttggggctgagcagcgaggagcggcagctaattcattcgatgggtctttctgaggctgttcttatccgtcacattcactcgcaccaccaacaaaaggacccgagcaaagggatgcgaatttacgttgtgtttatgcttcgtcaaatttggaatcagaagcccttgtgggaggtggcgcgttatttcggcgtcccccggggttggcttcagtccgttttgcagtccgccgtctgtcagtcgagctcaatcgttcgttttgcggagcgaacgcccgacctttgggcgttgcgttcgctgctgccggaaatggtcaggcgtctctgcgaatgctcccgccaggaattgattccgttgcttcgcattgaatgtgtgaaaattggacgcgctcgtcaactttacgagaacggatttcgcactgtcggatcgatatcgaaagcggagccatgccaactgatcaaagcgctggga

SEQ ID NO: 88257 - DNA, 492 bp, Heterodera glycines
  SCN-specific regions: Sequence locations=24-34,226-405,428-465
ggagaagaagaaggaggaagcagcggcatcgggcgaggaaaagaaggaggaggcgaaggaggagaagaaagaggagaagcgggcagagaaggaggaagcatcagcggaaggagcagagaaagagaagaaggacgcgacaccggaggagaagaaggaggagcaggaggacaagaaggaggagaagaaggaggcggcggcgtcgggcaaggagaagaaggaggaggacaaggagacggccagcaagaaggagaagcgctgggtgctcagagccaaacgggtcgctttctgagaggccaaagacgcgggacgaggcgagacggacgcgcgaccctttgaccggcgaaccatcaaaccctcagactttctctcatcattttcacccatttattctgccattggaattcattttaaatttttcaacattttttgttaaattttcggtaaataaaacaatgatttcttattaaaaaaaaaaaaaaaaaaaaaaaaaaa

SEQ ID NO: 88258 - DNA, 131 bp, Heterodera glycines
  SCN-specific regions: Sequence locations=1-131
ttaaattatcctcccaaatgcgtaccttctcttcatggcatggtttgcttggtgatggctgtcctaatggaaatggcaaattcaaaagcagtcaaaaaagacaataaaaaaggagcagtggcggcatcacc

SEQ ID NO: 88259 - DNA, 111 bp, Heterodera glycines
  SCN-specific regions: Sequence locations=1-111
gaaatggtcggcacttggcattttgctatgttttgtcggttcattcgcatttatttgtctgtttccatccgtaccttaggaggacgtgacagccgttaatggaattgtcca

SEQ ID NO: 88260 - DNA, 224 bp, Heterodera glycines
  SCN-specific regions: Sequence locations=1-188,210-224
ctaaacccgcatgaacagctttctccccttcttggtaatgacatgcagaacatttactagccctataataaacagaacccttagaagaacccatccaaagggggggcgcaagaaggctactctgcctaggtaccactaacttaatggataggggaataacggccaacaaaagggggcacacaaatgggaaaaaatctcccaccccttggacatgcataattcga

SEQ ID NO: 88261 - DNA, 225 bp, Heterodera glycines
  misc_feature (37)..(37): n is a, c, g, or t
  misc_feature (66)..(66): n is a, c, g, or t
  SCN-specific regions: Sequence locations=1-195,217-225
aaccgcagcagccgaccgccaagaagtggtggtgcangccgacacccaattgaaaactgttaactncgcgtgccattgaaaaggcctttgggtttggcaaaaaatttgggggccccccaaaaattttttgggaaaagccgccaaaatttttttgtgaaaaaaaaagttttttttaaaaaaaagcgggggggtgggaaaaaaaaaaaaaaaaaaaaaccccccccc

SEQ ID NO: 88262 - DNA, 240 bp, Heterodera glycines
  misc_feature (2)..(2): n is a, c, g, or t
  SCN-specific regions: Sequence locations=1-113,135-240
tncctctaaaaattcaaatcctctcagaaaatggcttcatctttctgctcctcaatcatttccatcgtcgcaattgtctgtttgctgtgcaaatgctgcttttcgacaccccatccatgctgtcctggcagccaacatgtcgtttcgatgatgaaagatcacaccggcacattctccgcttcgatgccaaagtcttcgctttgtatgagtgccgaaagagtcgccgctgcggtggaaaac

SEQ ID NO: 88263 - DNA, 246 bp, Heterodera glycines
  misc_feature (71)..(71): n is a, c, g, or t
  misc_feature (87)..(87): n is a, c, g, or t
  misc_feature (124)..(124): n is a, c, g, or t
  SCN-specific regions: Sequence locations=1-136,160-166,193-226
ccccgtcgcgcagagagtacgccaaacttttcggggtccatccgaacgatgtgaaaatggaaaagaacggnaacggaggaggaacangacggcggacgacccttaacgcccgaaagaaacattngcccattttttgtgaaccctggttgggaattaacccttttggtgggaaaaacaaaaaccccctctttcccccgttgtttttttttttccgcgggaaaaaaaatttttttttttttttttttt

SEQ ID NO: 88264 - DNA, 250 bp, Heterodera glycines
  misc_feature (120)..(120): n is a, c, g, or t
  SCN-specific regions: Sequence locations=1-88,113-132,179-214,236-250
gtgctatgccggagtttgtctaactgacaaagaaatagtaacacgaaacaagcacgtataacttcacggcgttaagggacaccagtcttttttccagggcttacgaaaagttttccgggnagtggatcggatggaattttgggggccccaaaagggcaaatttcccggggtttggggatcaccaattttttgaaaaaaattgggggggaaacacaaaaaatttttttttttttttgggggcccccccctt

SEQ ID NO: 88265 - DNA, 324 bp, Heterodera glycines
  SCN-specific regions: Sequence locations=1-111,141-201,271-290,312-324
ctatcctttccttccttccaagtaaaccctccttcttcatttattcctgttaactgcattccaaaaaaaacattcttctattctgcaccccatacttttttttttttttttgggggttttttaaaaaaggcccccaaaagaaccacaaaaattttcccccccgtgggttttcccccccaaaaatttttttacccccccccgtttttttttttttttctccgggggtttttttttttttttttttggggggggggggggggggcccccccctccttttttcttaaaaaaaagaggggggggaaaaaaaaaaaccccccccccccc

SEQ ID NO: 88266 - DNA, 105 bp, Heterodera glycines
  SCN-specific regions: Sequence locations=1-105
tgcgcacccgcgagcaatgcatttgtacacaaaatactggcacaccgagaggacatgatggaactgatggtacgcgtcaagaagaaggacgaagacattggggag

SEQ ID NO: 88267 - DNA, 79 bp, Heterodera glycines
  misc_feature (68)..(68): n is a, c, g, or t
  SCN-specific regions: Sequence locations=1-79
gaggttgttgaactgccgctgatcaatccgagttgttcaaacgcgtcggcataacaccgcccaagggnctgtctttttg

SEQ ID NO: 88268 - DNA, 78 bp, Heterodera glycines
  misc_feature (64)..(64): n is a, c, g, or t
  SCN-specific regions: Sequence locations=1-15,38-78
ggaaaagaagtcgaaagcaggaagcgagaaaaaggagaataggagcaaagcctgctggtagaangagaagcgcgccgc

SEQ ID NO: 88269 - DNA, 638 bp, Heterodera glycines
  SCN-specific regions: Sequence locations=1-177,201-369,397-638
tccgaggccacgtgagagatgtgttcgacaggcacgtgcagctgctcctgcgtgctgttttttgatgagctggactcaattgctaaatctcgtggtggaaacgttggcgatgcgggaggggctgccgaccgtgtcattaaccaagtgttgaccgagatggatggaatgggatcgaagaagaatgtgtttatcatcggagcgacaaatcgtcctgacattattgactccgccattctgcgcccgggtcgtctggaccaactcatttacattccgttgccggacgagcccagtcgcctgcaaatctatcgtgcttctctacgcaagactcccattgcaaaggatgcggaattggaatacttggccaaagtcactgttggcttctccggagcagacatcactgagatctgtcaacgcgcttgcaaactcgccattcgcgagtccattgagaaggctgttgccatcgaaaaagatcgccaggccaaggaacagcgtggcgaggaagttatggacgtggccgaggatccggtgccgcagctgactcgcaaacattttgaggatgctatgaagtttgctcgccgcagtattttcgacaatgacatccgcaagtacgaaatgttcgctcaaactcttcaacaaca

SEQ ID NO: 88270 - DNA, 318 bp, Heterodera glycines
  SCN-specific regions: Sequence locations=1-120,159-166,188-215,242-318
ggttgtacgactcctgtcattatcccaaagccgtttgccccttatatttccagaatcgcttttccgataccgtgccagtttggacactcttgcgaccgatatctatgctttgttggggcgctggggttgggggaacctttaaaacaaaatttttggggacccccccagggaaatttgggggggccccttttttttttctgctggggccctccaaaggcggggggggggggccccccccccctttttttttccccccccctcctctcaataaaaaaaccccccccccccccaccccaaaaaaaaaaaccccccccccct

SEQ ID NO: 88271 - DNA, 162 bp, Heterodera glycines
  misc_feature (33)..(33): n is a, c, g, or t
  misc_feature (55)..(55): n is a, c, g, or t
  SCN-specific regions: Sequence locations=1-117,150-162
tgggcgagtggtgcgcgctgacgaagatccaantacctgagcaagagggcacagncgtggtgcagcactgtaaccgcaaccgcgtggaccgtgcccctgggaccgtgcttgttcccgaccaaaaaccccccaaaaaaagggggggttttccccccccccccc

SEQ ID NO: 88272 - DNA, 298 bp, Heterodera glycines
  SCN-specific regions: Sequence locations=1-44,66-108,160-214,236-271
atgccaattggatgaggaattatctgaacaacggaggagaacaaacacaccacagacacagtaaaacagaagctagtcaccactgacccgacaattatgtaattggtcaaataataattaattattcgttaatatttaaattatgtatatttttattttggttcatcgctattttaatcttaacatttgcttcattccttcttcctccattaattaatattttgctaaataatttctaattctgacaaacaaatgataaacaaacaattataaaaaaaaaaaaaaaaaaaaaaaaaaa

SEQ ID NO: 88273 - DNA, 742 bp, Heterodera glycines
  SCN-specific regions: Sequence locations=1-716,738-742
ggaccgcccgttggtcgtgcaccgattgcgccatggactcggaggagaacgacttgggccaggcggtggagtcctcatccgtggacgtacagcaacaaatgacgacaaaaagtgatgaagatgcggacattagcaacaacggcactgtcgtgccatcacgccaaacggtgagcagcggcaacgagcggatgggcggcatggatctgagcggagagccggcactgcttttctccgcggaaaccagttttgaggctataaacgcgtccaacaaatttgcacaacgccttcttcagccattcaaaccgttgccgttggcccaactgttgagcggttcggccaccgttggcaatgtgtacttgctgcagaatggggcacattccaaaattgggggcccgtcaacgccactgccttacaactcactcatttcggcattcactccgtcggctgccggtgggtcaagttcgtcaacatcgggcggcatgatgttctcctcgccgttggacagctgcaaaacggaggaggccaacgagaccggcggggacagcaacagcaccactcaaatgatgccatggaggatgggggggcgacacggcaaaaacgatgggcaacggaccagcagcttggatgccacatcggttggcagcagttcggtggattggagtccgcccgagtcgcgcaagcacagccgacgcaacacagcactcggcggtgggagtagcacagcaacaagcgctcactttgc

SEQ ID NO: 88274 - DNA, 688 bp, Heterodera glycines
  SCN-specific regions: Sequence locations=1-303,325-688
gcaattcacccctttcaaccttaaaatataccaatgtcatcagaaatcgcgaaaaatgcaacggcaaacaaagggaatgactttcgaacagcgagaaaaatctcatctttggaaatggacgaaaataccggcgaagggaataagcagaaaatgcagcaaacgaagggaagggcaggcgaacgaaattggataatagtcactcgcatttccgaccgttcgatgttttacaaaacttttgaattggtctcccaaattggccaaggcaatttctccgacgtttttctcgtatttagctcggagaaaggcgaaaaatacgctgtgaaagaaattgacaaagaacgaatgagaagcaaattgcattttgtggagaatgaagttgcactgctgcagcggtgccggcacagaaacatttgccgactaatcgacgcctttgagtgccgacgggcgttctttcttctgttcgattatgcccagaagggcgaccttttcgagaccatccgacgcattggccgactgtcggaacgttcggccgcgcaaatcactcggcaaatctcttcggcactcgcttttctccaccgccgccgcattgtccaccgggacgtgaggccggaaaacattctgctcggggccgactccaccgccaaactgacggacttcggcctcgcctgtttttttctgggcccgcttt

SEQ ID NO: 88275 - DNA, 484 bp, Heterodera glycines
  misc_feature (460)..(461): n is a, c, g, or t
  misc_feature (463)..(463): n is a, c, g, or t
  SCN-specific regions: Sequence locations=1-85,208-210,238-245,321 -392,460-461
tgttctgaccgtaaacatgccactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcnnanaaaaaaaaaaaaaaaaaaaaa

SEQ ID NO: 88276 - DNA, 511 bp, Heterodera glycines
  SCN-specific regions: Sequence locations=1-146,168-183,292-371,395-511
ggccgccaccgagggcgccctgagcacgccgtccccgggcgaggcggccacccgcggcggatgggggctgccggagcgccggtccgcccgctacctcgccgcgtcgatcgggctcggagtggtcggcgccgcggggatcgcggcgtccggtgccctgggcggacgccgcctcgcgcgccgcctcggcctcccggcgaccggccgggcgcccgggcccgctcccggccgcgccgccgaccggacgggtgacggcgccgccggctgaccggccggctgcgccagactggtcgggtgcacttcacgacgaccgtcgagctcgcccgcaccaccgcgaccggcatggccgtgccgcccgaggtcgtcgaggccctcggcggcgggcggcgccccgcggtgcgggtgaccctcgccgggcacacctaccgcagcaccatcgcctcgatgggcggccggtacctcctgccggtcagcgcggaggtgcgcagcgccaccggcgtcgccgccggggacg

SEQ ID NO: 88277 - DNA, 519 bp, Heterodera glycines
  misc_feature (449)..(449): n is a, c, g, or t
  misc_feature (487)..(487): n is a, c, g, or t
  SCN-specific regions: Sequence locations=1-519
ggcctgagcaacgcgaaggtcggcctcggcctgttaacaaacaaataattggtctctgtcctggtcgcttgtccctccaaagtccgcgcccttttcagccgacttttggccgcgtccaaatccaaccgtttcttctgcaaaacgcggcgctctctctgaatgtttcgcatttcgccctccaaaaagcgtttgattggcaccagcgtttgcccggccgtcgtttggaccatttccctttcggcagcgcccaatttggcttccgtctgcgcaattttttgcaaagcacctccgaatggcgtttcggtgccaaaggattgggcagcctcctgcatcgcctcgctaaggtattccaaagtgtttgagcgattgggggcgggcgaagtgatttccatcttttcatagaacaggtcgcccattcggagggctgggttcggctgcagatacgcctncatggcggacaacagtttcttcgactgttcctccgttntatccgccttggcgagcaattgctcgaaatga

SEQ ID NO: 88278 - DNA, 280 bp, Heterodera glycines
  SCN-specific regions: Sequence locations=1-280
ggccgccaagccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagtcattgccctactgctggaggcggtcaacacggcggaggaggaggaggaggaaattacggtggtggagccccgggcggaaattacggcggttccagcggctcatacaatggccatcgcgcacgcc

SEQ ID NO: 88279 - DNA, 435 bp, Heterodera glycines
  SCN-specific regions: Sequence locations=1-435
ggccgcaaggtttattttaaagcgatgtcaacgtcagaagtgaaaccggaagataaatcaatggatgaaactagcaagaatgaattgcgggctgaggacacttccattaaggacaaaggcattggaagcgttaaaggttttattacttcgttatcaattttctttcgtttttagaaactgaaacaaatggcgcaataactactgacaatgaacctaagattcacgcagaaaagaacgagactggtgatgctgcagttggccaaaaatcaaccgaggaacaattcgacaaaactgacaagaaagcagagcaacaaaatgttcttgatgtaaacaaaacccaacaagaaccaaaggctcctcttgatgaagtgaaagagacgccacaggaagacaactcggaagaagttccaactgaagccattgttgttgatgttg

SEQ ID NO: 88280 - DNA, 300 bp, Heterodera glycines
  misc_feature (274)..(274): n is a, c, g, or t
  SCN-specific regions: Sequence locations=1-300
ggccgccaagatttcatttgtattttatgctttatctctttgtgaaatgacttcgattttgaagaatcaaatcattaagcatctttcggcgtttgcgcgaaatttgaaaccggaacaaattacgatggaattgttacgggggaaaggccaactgcgagacttggaactcaatgaggaagtgttggctgaaaaattagagttgcccccgtggctaaaaattgtcagtgctcgttgcgatagagtcagcattaaaattccaagttggaacaaactngaggagtgctcccatccaattgtatg

SEQ ID NO: 88281 - DNA, 199 bp, Heterodera glycines
  SCN-specific regions: Sequence locations=1-199
ggccgccaggatcttttaataatctactacagaacagattggatatctggagacaatcgtacagaccgttggagtgcccggtgtaagacctgctcactgaaccgaacaattggattgtggaccacctactgtctgaattgtccaatggactggaaaaggtgccctatattgtccaccgtattgtctgggactattattt

SEQ ID NO: 88282 - DNA, 610 bp, Heterodera glycines
  SCN-specific regions: Sequence locations=1-336,359-462,485-486,508-610
tagcttggatccttaacggcgcaaatttaaagtaaattttgtgcaatggacattggaactgtgcatttgcctggtgggtcggtgacaatgggcgtgctgcggcctgcacactttcaccctatgcattagcgcgcactgggccaaatgcgcaggtccgctttgccgtcggcacgccaccgacacgcaaattgtgagaccgaaatacgaaggaagctgccgcgaggcgggcgatttgccaagaaaggccatgcgtgccgcgttagctttttacgaccgcaccgttcgccaccgcttcgccgatggttcgtcgggaggcgaagcacagcgcgaggaattgaaactttgtctcaattcattggtcagcactttggagagcgctgacgcggagagagaggcgaaatgggaacggctgaagcaatttttgagggtgtgcggaacggccgcaatttttgccgttttggcatttctgttcactttgtattggccgttgttctcttctctggcggttggcgttgtgcgcaccgtttggactctgatcagttctctgcgcgatctgttggtcgcccattggcctgatttgctcttcggggtttgctcctcagcactttcg

SEQ ID NO: 88283 - DNA, 327 bp, Heterodera glycines
  SCN-specific regions: Sequence locations=1-91,113-327
ggccgccaaggtttgagatggatttgaatatttcgccaacgcttgaggacccaaacgcttcgttggttgacaatgagcagaccgccgatgaaaaaatggagaagccaaacagttcagcaaacgtttcattctccaatgtcaccgacaaattccgtgcccaccccgtggagaaggtcggtagtccgatcacaatcaatcagtccatttcggacccgaccacggagctgactgaggaggacattttccgcatgaaatcgatgtccattgaacagaacgggtggaaaaacggcccttgtgccagcgaattgcaatccgccgtctcgcagg

SEQ ID NO: 88284 - DNA, 450 bp, Heterodera glycines
  SCN-specific regions: Sequence locations=1-185,207-450
ggccgccaagcaagtttgaggcgaaaatgcgaaaaatcattcctccgaatgcattaatgaacattttacccaaacagggcctcagttggccgctggccgccttttttatggtcactgacatggccatcggcggaatggtcactttgcccggggcgatctgccgaatcggtctctcccgcggattggcccttctccttctctccggtcttttctgctgttgttcggccattttactgggccaatgttggctgtttgtgctcgacaagtcgccccaattacgtcaaaagcattgccgaaggccatacgctgaaattggcttctgtgccctcgggcgttggatgagcattttggtgtccgtcggtgtcaatgtcactcagtttggcattgccacggtgtttttgctcctttgtgccgtcaatttgagccgcatttgttccacgttgttccatg

SEQ ID NO: 88285 - DNA, 241 bp, Heterodera glycines
  SCN-specific regions: Sequence locations=1-135,157-241
ggccgctttcaccgccgtcggcgctgtgcttagtgtgactaaagtgccggccgcctcataacgaacagcgcccgactgcgactgaagtaaattatacacacagcgaatgaagcgattgcgctctcctggattgttatggcaaactttgtaaatcagttccacaattacgagttggaggatatcgccgaattgtgcgacttgttcgatacaacccgacaaataatccaatgcccgctgtcgg

SEQ ID NO: 88286 - DNA, 469 bp, Heterodera glycines
  SCN-specific regions: Sequence locations=1-10,32-155,177-217,239 -381,405-469
ggccgccaagattaaattaaatatattttttgccatgtcttctctgctgctctccatcttcccaattgtgtttttggtctgttgcaatgcaatgccaaatttcccgtgctgcccgggcagtcagcaagtggttgctgtgatgtccaaatacattgacactttctcttctgctgctgacgagtctacagtatgctcaaccgctaaaagtactgtggatggaataaaaaatgaactgtcctctcgcggcggatgccaaaacggaggagaagcacaaattgtggatgaaatcgatcgacagctgaagaacattgcgaaaatggaaatcaattatgaggacgagtgcccgtacaatttgggctttgcccgtgccatgttcgacttggccgctgctgctgctggccatgcggggaacggcacagaatggcaatacatgaaagtacaatttgagcaggaaagccaagcaatcaaa

SEQ ID NO: 88287 - DNA, 782 bp, Heterodera glycines
  SCN-specific regions: Sequence locations=1-782
acttgacgtcgcatgcacgcgtacgtaagcttggatcctctagagcggcccgggaattccggaccggtacctgcaggcgtaccagctttccctatagtgagtcgtattagagcttggcgtaatcatggtcatagctgtttcctgtgtgaaattgttatccgctcacaattccacacaacatacgagccggaagcataaagtgtaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgct

SEQ ID NO: 88288 - DNA, 603 bp, Heterodera glycines
  SCN-specific regions: Sequence locations=1-603
ggccgccgccgggttcttgcgaatggtttcttcctgctgcgcaatcatcttgaacaaaccatccagggcctgctcggtcacgtagttctcaacgttggcgctcttggcatccaccgcgccaaaggccgcggccttaccggccagagcgttgtactgctgggccacgccgactttgtcggtggcggccttgacgataggcaggaacttggcgcgaatctcttcacggctgcttttgttcaggtactgggtggcggagtcctggccaccgctgagaatgcccttggcatcggtcacgctcatgttcttcacggcgttgaccaggatcggctgggcctgggtcacggcggtttctgcggccttgttcatgctggtttccagctgcgtaacctggtcacccataccgaacattttcagcttgtcggcgactttgccgagtttgcccggcaggccgatcttcacgtccgggttgttgctgaaaccaccgggcgtcccgagttgtttcacagcaatctgtgcaccttgggtcaaggcatccttgaggccgccgctggcgtcgccctgggacaggctgccaaggtccagggccatggcattggcgccgaa

SEQ ID NO: 88289 - DNA, 553 bp, Heterodera glycines
  SCN-specific regions: Sequence locations=1-553
ggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggcgctacagagttcttgaagtg

SEQ ID NO: 88290 - DNA, 459 bp, Heterodera glycines
  SCN-specific regions: Sequence locations=1-82,104-459
ggccgctcgatgtcgcagaagagaatgatgcggttgtgttcggtggcgttttccgcgtagtggatgaaggtttcatcgaacaccaccgcctcgccgtcgcgccagtggtagcgctcgccgtccacctcgatgaagcaggccgggtcgttgggggtgaacagtcccaggtggaagcgcagcgagccggcgtagggatcgcggtgtcgcaccagcttcgagcccggcggcagttcggcgaacatcgccgccttgaccgagggaatctgccgcaacagggcggtggtctgcgggcagagttgtccggcggagggatgggcctcgtcgtaccatttcaggtagaagcgcttccagccgctcttgaagaacgagttgaaaccgatatcgtcgtactgttcggaacgcttgatgttgccggcgccgtgcaggtgcagcgcctcgctgcggatggcctgccagttg

SEQ ID NO: 88291 - DNA, 275 bp, Heterodera glycines
  SCN-specific regions: Sequence locations=1-226,248-275
ggccgccaaggtttgagaaaaaacaatgtcttcctccctcataatgaactgcttaattgcccttaccattctggctgtgtttgtgtccaccatcgatgccattggcatgccaatgcaatgttgcggtcagcagcaacagtcatgctgtgggggcggcggtggcggctgtggtcgtagaaagcgcgacacggaagcggttcagccccacttcaaatcggacgaaacgccgtgcccacagacagagtggagacaagtcattgacgagagtatccgcg

SEQ ID NO: 88292 - DNA, 263 bp, Heterodera glycines
  SCN-specific regions: Sequence locations=1-263
ggccgccaagaaagcataagcgacaagcgcagggagaagagaaccgaaagacaaaggaccgacgcgaaagcgaagctgaagatgatataattgggtggaagttgttgtcggaatttgtgttcatcagcgcatttccccaaaaataacattgagaattgtccatcagcgttttggaagtgccaaaatgatcgggaaaatggtgagagacgaaaggacagcagcctcgtggatcatcagtgggggttcttctccaattccgatgg

SEQ ID NO: 88293 - DNA, 101 bp, Heterodera glycines
  SCN-specific regions: Sequence locations=1-101
ggccgccaaaatgcgtcggaatgcctcttcatcgtatcgccatgggcgagagccgattgatttagactgtgcaaagattgacgatattggtgacaatgcgg

SEQ ID NO: 88294 - DNA, 101 bp, Heterodera glycines; identical to SEQ ID NO: 88293
  SCN-specific regions: Sequence locations=1-101

SEQ ID NO: 88295 - DNA, 535 bp, Heterodera glycines
  SCN-specific regions: Sequence locations=1-535
ggcctgagcaacgcgaaggtcggcctcggcctgttcaacaaacaaataattggtctctgtcctggtcgcttgtccctccaaagtccgcgcccttttcagccgacttttggccgcgtccaaatccaaccgtttcttctgcaaaacgcggcgctctctctgaatgtttcgcatttcgccctccaaaaagcgtttgattggcaccagcgtttgcccggccgtcgtttggaccatttccctttcggcagcgcccaatttggcttccgtctgcgcaattttttgcaaagcacctccgaatggcgtttcggtgccaaaggattgggcagcctcctgcatcgcctcgctaaggtattccaaagtgtttgagcgattgggggcgggcgaagtgatttccatcttttcatagaacaggtcgcccattcggagggctgggttcggctgcagatacgcctccatggcggacaacagtttcttcgactgttcctccgttttatccgccttggcgagcaattgctcgaaatgagggtttttaccaagt

SEQ ID NO: 88296 - DNA, 93 bp, Heterodera glycines
  SCN-specific regions: Sequence locations=1-93
ggccgccaaggtaaaattctaaatttgcttttgtgatgtctcgtatcgctctattggtccttttggtcgcgctgttctgcgcttgcgctttgg

SEQ ID NO: 88297 - DNA, 344 bp, Heterodera glycines
  SCN-specific regions: Sequence locations=1-344
ggccgccaagccagcactcaagtcaagctccacacgcacacacacacacaccatgaagaccgcctgcttcgtcgctgccgccgttgtgctcgccaccgccaacgcacagatcttccgctccgccgacttcgaggccgacaagtgcaacacgcaggatctgctcgccaaggcatacccactgctcgtcaacccaaactacagcgtgtgccagaaggacgccgacttccagttctacccgatcacgggtctcccaagcgatgagaagctggccaagatgtgcgccagcccggcgtgccaggagctgctcaaggtcattgctgccgccgacttgccagactgcgacg

SEQ ID NO: 88298 - DNA, 186 bp, Heterodera glycines
  SCN-specific regions: Sequence locations=1-186
ggccgccaagccgtcgccgagggcactttccgtcctccttatttccaccgaaattgtatgagcgaatttatgggtctgatcgttggccgatacgaagcgaaggagggtgggttcagcgcaggaggcgcgtctctccattcgatgatgacgccgcacgggccggacgcggcgtgcttcgaaaaggcg

SEQ ID NO: 88299 - DNA, 712 bp, Heterodera glycines
  SCN-specific regions: Sequence locations=1-317,339-389,411-493,521 -666,689-712
acagcttggtaccgagctcggatccctagtaacggccgccagtgtgctggaattcgcccttcgcgagctcaattaaccctcactaaagggagtcgactcgatcatgcccattcatcaagaatctagatcatgaagtgcataactatttatgctaaggagtggacaaaagtattgtaatatattgacacatgttttgtatcaatgtaaaaaataggagtttgcagaaattccattattataggcaggttgcatatgcttttgatcatttactatctcggctttcaacattcacctaataaacacatgaggaatacgaatgtgcaattagcttaagttgggaaagaaaacatgaagcattacgccgtaggcctaaaggactgatagcttatccatttttcttttctttcattctcgtctttccgatatacaatgacaacctacatgttctttgtactgtcagcttaatttaacatgtgatattaagttaattacgtataattattattaaaattaatttttagatttagtgacttgattgtgttaataatttttaaactgtcagtgaatatatcttttaaattcattagtaaacttgctaatccttaaataaaaaatataaaaaggccattgaaaaatcaaatggtagaatacttctctgatttaataaatatatgggaaaagaagtaattaaaaagagtctattaatcttcaa

SEQ ID NO: 88300 - DNA, 354 bp, Heterodera glycines
  SCN-specific regions: Sequence locations=1-249,284-354
ggccgccaaggttattgtggaccaaaatgccgagcaaactgacaccgaaagcgacccggaagattatgaatatgatgccgacccatcctcgccacgggaaatgtgcaaattcaaacgacgacggatgacatactcttcaggaacagcgaagccacccaaattggagaaccggcgaacttctcacgtggagttcggttcttcaatgttcgactacgatgcgcaagtgatggacatcggtttgccactgccgacaattcaaaaagtggaaaacgtggaaattgtcattccatcgttccgtaagaagtgcggcctgttgtccgacttttccctctcccccacggaatgtgaacggtg

SEQ ID NO: 88301 - DNA, 665 bp, Heterodera glycines
  SCN-specific regions: Sequence locations=1-665
tcgtacgtaagcttggatcctctagagcggccgccgactagtgagctcgtcgacccgggaattccggaccggtacctgcaggcgtaccagctttccctatagtgagtcgtattagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgccagggtggtttttcttttcaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttga

SEQ ID NO: 88302 - DNA, 461 bp, Heterodera glycines
  SCN-specific regions: Sequence locations=1-68,90-199,221-461
ggccgccaagctttattaaccaaaaataaaagaaaagtgaaccaaataaaacgaaaaagcattctttttaaatatttgtattttcaaaaacttccaaaatgcaccagtctctgccattgtttctgccgcttttcatcttcttcgtctacacgaccgattgtctaacggtctgaactgccaacaaggagcagaaatcaagccaaatggtcaaaaatttaacaacacggatcaaaaatgcccacaaaaggacgcgaagtattgtgtgacaagcatctgcacaaccgatgagattccgaattacacaaacattgcatggttttgtgacgtcataaaaaatgccgaaaaatgtgccaatcgtagaaaagaaaagtttaccggtttgaaaaatatttcgtgcaaatgcctttatggtgaagagggagaagatcatggcaacgcacaattcacgcctccgccgctgg

SEQ ID NO: 88303 - DNA, 247 bp, Heterodera glycines
  SCN-specific regions: Sequence locations=1-247
ggccgccaaggtgcaacggcgcacttcaaattcgcgcactcgccaccgtttgccgccgcttccgaagaagcgatccttcgcagcaagcagaacaaacacactgccgacgagcaaaacgacggagagattaccacaagcaacagtgacaaaaccgatccgaaaaactccaccggacccgcgtcgtgtgccgccaccatcgacggcacagaagaaaacgcccacggacagtcggcccgggtcgaagggg

SEQ ID NO: 88304 - DNA, 440 bp, Heterodera glycines
  SCN-specific regions: Sequence locations=1-440
cgccatttccgcctgtgagcagctcgcggccggcacgctgaaaatcaaccgcgagcgaccgctgatggagcgcattcagaacgtgttgctgacacgaaaaccgttgctggacgcggtggtgatgcgaatggcacgggacaaagtgatgaagcaaacccatggcaattacccggcaccgttgcgcattttggacgttgtccgcaccgggctggtggacggccagcaggagggctacgaggaggagacaaaggagtttggctatcttactcaaaccacacagtcggaggcgctcatcggactcttcaaaggacaaaccgagtgcaaaaagaacaaacacggcgaggcgcgcaaaacggagcgtttgggcgtcatcggtgccggtctgatgggcgctggcatcgcaaatgtcagcattgacaagggcattcatacgactcttg

SEQ ID NO: 88305 - DNA, 310 bp, Heterodera glycines
  SCN-specific regions: Sequence locations=1-11,33-40,67-141,163-310
ggccgcaagtgggaagaacaacatattcagagatgcaatattgttcatcatcatcttcatcttctgcttctcctccttggcccaagtcctcccatttgttcgcctcgatgggcattctctgcagcacttgtgccctgctcgttctggtgttcctcgtgccgataattgtgcataaggcaaacattttgcgtgcagaacttgaggaaatgtccgttcgattcaagcaaaactcggacagggcgtggcaccaaatgatgcaaatggagccaattaatgataacccaacgatgcatacaacaattgttgcaag

SEQ ID NO: 88306 - DNA, 449 bp, Heterodera glycines
  SCN-specific regions: Sequence locations=1-449
ggccgctgccgaactttgtgaaagcggtccaaaagccgtgcaattccccgggcacagcgatggacctgtatccgatgaccgagtcgcgtggcgtgccaacgtacatcgtcgaattggtgcccagcggcgcagtctctcgcgcgtcaattgtcgtgcacctctgcgtgctggtgttgtacaatgtcattatgaagccaccgccgaggcccgacgactgcggattgacgacgccaatgcacagcaaactggcgatcatcgaatcaacagaatttccgccctccagcaaaacatcccttccgatttcgctacaaagaccgtggtccgttgccactgcggccctccgatattgcgcgtgcatacttccggtgggacttggccatttcagatggacacgggcggagtgcgcccgtgggggaagcgcggcactgttgttgccattgtcgctgtct

SEQ ID NO: 88307 - DNA, 545 bp, Heterodera glycines
  SCN-specific regions: Sequence locations=1-545
ggccgccagcactttgttccccttttgactgcacttcagcaacaatgctcatcagagaatatcgcatcgtcatgccgttgaccattgaggagtatcaaattggccaattgttttctgtggccgaggcatcgcgacaggagacgggcggtggtgaaggcgttcatgtggtgcgcaacgagcccttcgaaggccaaagtctgttcaatggccgcttcacgtccggacagttcacgcacaaaattatccacttagatacaaaagtgcctgcttttctgaggacgattatgccaagaggttcgacaacgctgcatgaacggtcgtggaacgcctttccgtactgcaaaacggaggtgaccaacccggactatatgaaggacgactttctgattcggattgaaacaatgcacttgagcgaccgcggcaccacaaaaaatgcactcggtctgaccaaggatgtgctgaaggaacgcaaggtggtgcgcatcgacatcgccaacgacaacgagtttctgcgtgcagccgacatccttgacaacaccagaccg

SEQ ID NO: 88308 - DNA, 512 bp, Heterodera glycines
  SCN-specific regions: Sequence locations=1-124,307-441,467-512
ggccgccaagagaaaatgaattcccaattgctttgcatctttctgctggtcatttgcaccgtttccattggcacactgacacaagcaaagccaattccggaagaagctgcggcaaccgaaaccaaagcggacgaaggcaaaaaagaggagccgaaaaaggaaaagccgaagcgaaaaaggaagaagcgacgaaggaggagccgaaaaaggaagaaacaaagaaaggagagggcaaaacggaagaagctaagaaagatgaagccaaaaaggaggagccgaaaacggaagaggccaaaaaggaagaagcaaagcccagtgccccggccgtcttaactgaagctgccgataatgtgaacaaagcggtcgatgacttaagcgttaaacaggcaaaagcattgaaaaacgcggccgaagcaacggcagagaaaacgccggaagagcaggaaaaagcattgaaagaagcggcagaaaaaggaggaaacgaacagctgaagacggctgtcaacaaaatt

SEQ ID NO: 88309 - DNA, 253 bp, Heterodera glycines
  SCN-specific regions: Sequence locations=1-253
ggccgccaagccttccttcaccgttcgctgctgatgaatttgccgccttcgtcttcttcttcccccgtcctgtttaatcggctgaccaatcgtcaaactttggctttttctgccattgtccgtcgtgtaactcgcggtttttctactcgtcaacgcaatctgtacaaagtgttgggcgtttctccttccgcctcacaaagcgacatcaaaaaagcgtattatacagattgcgttgacgagtaaaaaaacttgg

SEQ ID NO: 88310 - DNA, 375 bp, Heterodera glycines
  SCN-specific regions: Sequence locations=1-46,68-375
ggccgccaagtacaaagattcaaaattccatcgcgtaatccggaacttcatgatccaaggtggtgattttacgcgaggtgacggcactggtgggaagtccatttttgagggcaaatcatttgaggacgagaatttcaaactgcaccactatggcgccggatggcttattatggccaatgcgggccccgacaccaacggatcccagtttttcattaccacggtccatactccatggttggatggacgccacgttgttttcggtaaagtgctcgagggcatgaacattgttagagaaatcgaagacggcgaaactgctggcggagaccgtcccaaaaaagacgtcgtgatcgttgacagtggagagctaacagtcag

SEQ ID NO: 88311 - DNA, 532 bp, Heterodera glycines
  SCN-specific regions: Sequence locations=1-248,271-532
ggccgccattgtgttgtcgccataaccgagcccaactgagaatccggcgccgcatgccacgatgtttttaagagcaccgcacaactcaaccgttgccgcgtcttcgaccacatttattcggaaattgtcggtgtgaaacaacttcttcaattcatttccatgctgtgggtttttggttccaatagttgcttcacaaaagtggtcatctgccacttcgttcgcgagattagcacccattagcacggaagtgtcaatgccaagagaggtcgcgatttcattagagatcagtcgcagcccaatgtctttttcgtgaaaagtggccaagcccttaatcagcgaaattgcgattgcgctctttttgatgtttcctttgagctgttcgcaaactttgtgcaagaattggtgagggatgatgaaaatgagaacatccgcgttttttgaagcctcaacaacatcagtgacagcgataacattagtgggaagtttctttccgggcaaatatttcacattttcgtgtttctcgttgataatt

SEQ ID NO: 88312 - DNA, 310 bp, Heterodera glycines
  SCN-specific regions: Sequence locations=1-310
ggccgccgttcctccgccgctttgtccgcgccctctccgccgcctcagtgcctttccatccttagcctttgtccgcttttctccgccgccgtgccaatgtccgccgctgcttccgctggccaaacgcaccgatggggcggaatggccgcaccgcaccgcagccgaccgccgctgcgctttgaccgcacctttcttgaggagcgcgacaatcagttgaagctcatccaaatgctgtgcggtctggtcgcccttctgctgacagtccaatgctggccaaatccgcttttccccttctgtttgggccgtgtcg

SEQ ID NO: 88313 - DNA, 154 bp, Heterodera glycines
  SCN-specific regions: Sequence locations=1-89,113-154
ggccgccaagtgttcatcagcggaatgaaaacggctgacaaaggcggacgaaccattcccattgaaatgaagaagaaggcggccgtggaccagcagaaggaggaggagaagcagtagaaaaggacggcggaagtgaagacggactgactgtcgg

SEQ ID NO: 88314 - DNA, 310 bp, Heterodera glycines
  SCN-specific regions: Sequence locations=1-11,33-40,67-141,163-310
ggccgcaagtgggaagaacaacatattcagagatgcaatattgttcatcatcatcttcatcttctgcttctcctccttggcccaagtcctcccatttgttcgcctcgatgggcattctctgcagcacttgtgccctgctcgttctggtgttcctcgtgccgattattgtgcataaggcaaacattttgcgtgcagaacttgaggaaatgtccgttcgattcaagcaaaactcggacagggcgtggcaccaaatgatgcaaatggagccaattaatgataacccaacgatgcatacaacaattgttgcaag

SEQ ID NO: 88315 - DNA, 230 bp, Heterodera glycines
  SCN-specific regions: Sequence locations=1-90,217-230
ggccgcaaggcgcagtgttgatgaccatcacttatgggcagacgcaatggaagagacgccaatttctctgttgcgcatggcgcgcgaggcggagaaggagcagaaggaagagaaaaaggaggaaaagaaagaagagaagccagaggagggaaagaaggaagagaaaaaggaggaaaagaaagaagagggaaagcaggaagagaaaaaagaggaaaaaactgaagagaaaa

SEQ ID NO: 88316 - DNA, 214 bp, Heterodera glycines
  SCN-specific regions: Sequence locations=1-132,154-214
ggccgccaagattaattggaaatccaattcaatttttgagtataaaatgaactgctccttcttcctctgtctcttcactgttcagctgattctgctcaatttcgcagtcgaaggaagagaagacgatgaactgaagagaaagaaacgcaacacggacgtggacgtgtctcggcactggtaaatattcacgcgccgtcgcgaaagaatgtgaacg

SEQ ID NO: 88317 - DNA, 480 bp, Heterodera glycines
  SCN-specific regions: Sequence locations=1-31,53-480
ggccgccaagccaagtttgagtttttcgtttatcactttaattgacttccaatgtcggctaaagcagtgaatgaatattcgggcaaagagcttctttaccgctcactgaaccatgtccaagcactcgtcaagccaaatgctgtccaattggatgagaaccatttttccaagatgccataattaattgcgattggatcagcaaagaggggcaaggtgttctcaagcccgatcaattgatcaagcgcaggggaaagcacggattagtcaaaatcggaacgaccgacgaactcgccaaatggttcgatgaaaaaaaggggcaaaatgttcagatcggaaagaccacggggcgtctttcgaaattcattttggagccgctttgcaaacacggggccaaagatgagctttacatcgccatttatagcaaaatgaatgaggatgtgattctgttttacgaggagggcggcgttgaggttggggacg

SEQ ID NO: 88318 - DNA, 296 bp, Heterodera glycines
  SCN-specific regions: Sequence locations=1-91,150-296
ggccgccaagcctggcgagccaagcgagctcaaagggcggaggagccagcgaggcggagccaaccacgccaaagttggcgaaaccgacgccggaggaggcggaggaagaggaagagcctgaggttggcgacgaggaggaggacgaggagtgaaagatgggccttttaacgaatgaacgaatgactcattgtccatccgatgatcagtcctttctcttctgatcagcggtggatgagagaagaaaaactcaccaaattgtcccaattggcttctcccattctctgtctgcgaatgcg

SEQ ID NO: 88319 - DNA, 229 bp, Heterodera glycines
  misc_feature (166)..(166): n is a, c, g, or t
  SCN-specific regions: Sequence locations=1-229
ggccgccaagaatttgcttcctgcccctttggtcggctccattttgctgttagggcattttgtgtttgtttctgtcggttccaatttccacgtgctcaaaaaacggggatacgacgaaagcgaaagttacagcagtgaagaagagccacgacaagcgccccgtcanggcgggcgctttggtggcaaacgccaccgttacccaccggcgcatggcaagggacaccgcccg

SEQ ID NO: 88320 - DNA, 270 bp, Heterodera glycines
  SCN-specific regions: Sequence locations=1-270
ggccgccaatcgttggcacagctgaaactgtcctattaccccaaaaatgccgatttcgacgacacttccagcatggtgtgccaatggatgttttggcttctctcttggcttctccttctgttcactttccccgtctccgtgtgcttttgcattaaaatagcaaggagtacgaacgagctgtgatctttcgattggggcgactgatcggcggaggcgccaaagggccgggtcttttctgggtgatgccgtgcattgagtcgtttgtacgtg

SEQ ID NO: 88321 - DNA, 622 bp, Heterodera glycines
  misc_feature (552)..(552): n is a, c, g, or t
  SCN-specific regions: Sequence locations=1-32,55-622
ggccgccaaggagcatcaaacaggaccatgagcaacagcagtcccaacaacagcagcaggacccgatgctggtgggcgaggatggcattgtcgccggactgtccgtcggcgggacggagccgaggccgccgacgctgcaggtggagccgacttacagtgacaattacgtgttggatggccaacatatgatctccgagtcgcggatgcgcgacattctgatggaactgcagcagcggtggttgaaggagtacgagcagagcagggagaaactgttggtggaactcactgagaaacttcaccaggaatatctgaccgaccttcagcggaaacagaccgaatatatggcacagtgcagagaggaaatggaggccgaaagggtgcgtcaggatgagcttttccagcggcgtctccaggaggaagtgcaacggttgacggagaagcaaaggcgggaaatacaactgatcaaaaagaaacagtggtgctggcaatgcgaaaaggtgggcagggaacggagaacgcagtttcagtaggcggcgatgtaacaattcattntaggaggccatctaccactgttgctggaacacggcctattgcacggtggagtgccaacaggcgcattggc

SEQ ID NO: 88322 - DNA, 289 bp, Heterodera glycines
  SCN-specific regions: Sequence locations=1-289
ggccgccaagcaaaatgtccttccttcgtctgatcacttttgttcttctgaaactctgtgctctttgccttctctggtcgaaagcggcctcattggcattgacggcactcccgttgaagccgattggtgcggtgttttgggcaaagaatccagtcattgccctactgctggaggcggtcaacacggcggaggaggaggaggaggaaattacggtggtggagccccgggcggaaattacggcggttccagcggctcatacaatggccatcgcgcacgccgattcgcttga

SEQ ID NO: 88323 - DNA, 405 bp, Heterodera glycines
  SCN-specific regions: Sequence locations=1-405
ggccgcctcctggaggagggtgtgctgtgcgtacactgcgcggctgtgacattgacgcatcgctgcgctacagtgtcgagcgcgcactgcaggcggcggtctgtctgcgcaaattggcacggaccgaaactgcgattgagctgaatgtgctgtcggatgatggcggcgcatttgccgcctgtttggtcgccgccggtgtcgcaattgcgtcggctaacattgaaatgctcgacgttctgttggcttgtaatgtgttgctgattccgtccaattcgttgactgcaccgcttcgaattgtgttcgacccggacaaggccacaattgctgcacacgttggcaaagcatccgccctaacaatgggcgtcataccaaccattggccaggtggtctgtgccgaactgagtg

SEQ ID NO: 88324 - DNA, 111 bp, Heterodera glycines
  SCN-specific regions: Sequence locations=1-1,23-111
ccctctagagcggccgccaaggtttgaggtaaaattctaaatttgcttttgtgatgtctcgtatcgctctattggtccttttggtcgcgctgttctgcgcttgcgctttgg

SEQ ID NO: 88325 - DNA, 225 bp, Heterodera glycines
  SCN-specific regions: Sequence locations=1-80,103-119,141-170,192-225
caaggaaggaattgctgcttctgttctatgtccgttccccgggctttaccacttgttaatacgcttgtccttccactgactcgttgtttgtttgttaatttctgtaaaatttgtgtttgtttttttataattttaataaacagaatttctcttgttctctaccattctcccttttcctcacactctttcctccttttttttgtttctctgtaactctgtgactat

SEQ ID NO: 88326 - DNA, 204 bp, Heterodera glycines
  SCN-specific regions: Sequence locations=1-204
ggccgccaagcggcgagaacggacagcccggccagcctggaaaccccggcccgcaaggataccctggcgacggcggaagccccggccaacccggcaaccccggaggcagcggcgagcccggacagcccggagcacagggatccagcggccaatgctaccactgcccaccgccccgcaccgcccccggctactgagtgtgatcag

SEQ ID NO: 88327 - DNA, 469 bp, Heterodera glycines
  SCN-specific regions: Sequence locations=1-311,335-399,421-469
ggccgccaggaattttccccaacactgtgttcaaatcgaagggcgagcggaagcgcattttcgtcgccgacgaattggaccagtgcaccgaccgatcggcactgtttttcgtcttgccattcgaacggggatatcttggcagaaatgcagctgttgatggcgcggaacattgtgctgaccggcgggaacgccctcttcccgggctatcgcaaaagaattgagcaggaattgcgttccatgatgcccgaacagttcactcttggtgttcagcaaccgtccgacccgatttgccacgcgtgggaatgtgcacgcgacgcaatccaacaacaacagcacgatgccgagacttctgcatcatccgctgctcatgttggtgctgccacacaattctcgcctcggttgaccgccaaatttgacaaactcggcctggccggcgacattgaggcggaacacaagggcctgctgctgg

SEQ ID NO: 88328 - DNA, 628 bp, Heterodera glycines
  SCN-specific regions: Sequence locations=1-185,209-261,283-628
ggccgccaagtgaaattgatgttttcctcgacttttcgcactgccgtccgagtgatcaggagcgtgccctcttctttgagttggaagcggtccttcagtttgcccagcgttccgccgattgtttggccatttacggcgctggtgctagtgccgaagttcgtgcagcactgcaaaattgtgatgatgctgacatacaaaatgcttctttcgccatcgtccgtcaattcgtccgtcgcattcgcaaatattttgaaacggcgcaaagaattgaaaaggtggtccctgagctgttgtgggagctctgttccggccctttgcctcccgttgagcagctcgactcggcccaggccctctgcaaacaactcgcccgactcatcgatttcgtctttcattttgacacaatgaaaatgaatacacccgcgatgcagaacgacttcagttttttcaggcgagtgatttcgcggagcgaagcggcggcgcgcgaagcggagaccgactgttccctcgagttggccaacaccattttcgctgttcctcgcctcgcccactccgatgctaaacgcactgacaaacgcaacagccgggttttgtccgagaccatcccgatttgccggtgtctaacacaaca

SEQ ID NO: 88329 - DNA, 116 bp, Heterodera glycines
  SCN-specific regions: Sequence locations=1-116
ggccgccaagaaagcatagaaaatgccggaacgtttgacttatcgtagaaggctttgctacaacacaaagtccaataaaacgaaagtggtgaagacgcccgggggacggaatgtgt

SEQ ID NO: 88330 - DNA, 508 bp, Heterodera glycines
  SCN-specific regions: Sequence locations=1-156,185-217,248-508
ggccgccagctcttaatattatttgctgctcgatgacttccgccggttttcttaaattttgcgcttgctgctcgctgtttcgctcctcgtcacctgttgccatggtcagaaggagagaaagcctaaaacgggaacgaccaaaacgagcacaacaacgacgactaccaccaccaccactacgaccactttgccaaaaatgactgcgccaaacaacaccgctgcaaacggaggcggcggcagcggcaacactctcctgttcattttgttaggagttggcgtatttgtggccttggcggttgctgtggttgtggcggtcgttgtgtggcgtcggcgacaagcgcgcactgattcctacgccgtcgatggtggtgatgcagcgaagggggcggcgtcgtccgatggtgccaatggcgcgaagaaagatgcggcaaagggcggatcatcttcatcacaaacggcgagtgtcgagaagttttcggcggtgtcgagcgtgccgtccagtctgaag

SEQ ID NO: 88331 - DNA, 707 bp, Heterodera glycines
  misc_feature (460)..(462): n is a, c, g, or t
  SCN-specific regions: Sequence locations=1-46,86-348,370-462,485-707
ccctctagagcggccgcagcaacggcagagaaaacgccggaagagcaggaaaaagcattgaaagaagtggcagaaaaaggaggaaacgaacagctgaagacggctgtcaacaaaattttggaggcaaaagcgaaaaacgacgcggaattggaaagcgaagtgaaaacgaaaacggcaactccttctgaggacagcaaaaaggccagcgcagagttgactttgataattgaagacaaaaagacgactttggacgagaaggtgaagcggacggaggagctgacagccaaaatgtcggacaacacgaagaaggagctgaatctgaacaacagtgccgacgtcgtcgccttcgtcaagtcgtactccgccgtcgccgtgccggcggtggccacggagggcaaagcatgatcaatcagtctgatcggaggattcggcattgttgtgtgatgaaatgtagccaagnnnttttttttttttttttttttttcaaaattcatttttattccaaattcggttttatgtgagttcactttcattggggggggctacaaacaaacattgaagataatatatcattgagtaaaatccgtgaggaatgaagtaaagtgccgtctcaaactctcaaattatgtctatgcccttttaatcgtcgaagttcagtttcccgtcgtcgtcatgggtccgttccaacactttctcctcctcttcct

SEQ ID NO: 88332 - DNA, 201 bp, Heterodera glycines
  SCN-specific regions: Sequence locations=1-170,197-201
ggccgcaaagcgaaactcagaaaagaagcaaacatcacgtgaagagagaaagagcgaagaccgacagaaccctaacaattaatagagtgatcaatccaccgatcgtcccatttctttgggtaattaatgttcgggccaatgacagagagatgataaagcttcgactgaccaaaaaaaaaaaaaaaaaaaaaaaaaactggg

SEQ ID NO: 88333 - DNA, 294 bp, Heterodera glycines
  SCN-specific regions: Sequence locations=1-83,106-149,171-198,224 -262,289-294
ggccgccaagcaaagaaattgcacagctggaggaagtgcaaatcagtgacaagcaaattggcacgctgtttgtaagcattgctttgaccactgctaacaatgaagtagagaaattggaggacgaaatcgttggcactcagctcacttggccactgttcaaaggtgttggcgatgtgtccaaagctgcgcaaatgctccaacagatgaaaatttgagcaaaaaagaatcgaaaatttgtggaaaaacaagggcaaaattggcgaaaaaaaaaaaaaaaaaaaaaaaaaaccttgg

SEQ ID NO: 88334 - DNA, 243 bp, Heterodera glycines
  SCN-specific regions: Sequence locations=1-243
ggccgccaagagcaaacgcttcttctccctccaaccgtgcgatggccaaaatgggcttccactcgacaaagatggaagctgatctgtcaaaagagcagcagggcaaacgcgaggccgactcgatgcgcatgttggcattcttcggcgtttgcctgtccactgttgccacgatgatttgtgtggtgtcggtgccgggggcttatgaacactttcagcaggtgggcaccaaaatgcagggcgaag

SEQ ID NO: 88335 - DNA, 170 bp, Heterodera glycines
  misc_feature (52)..(52): n is a, c, g, or t
  SCN-specific regions: Sequence locations=1-67,93-114,136-170
ggccgccagcgtaacaccgactccactttgctgggcatgggggtgatctccnagtacagagatggcggagtgacgactgtggcgatgatagccaacagagagcacaccgaggcgatcccgagaacaatgtgagtctcttgcgttttagcgctcaaacttgaaaaacttgg

SEQ ID NO: 88336 - DNA, 389 bp, Heterodera glycines
  SCN-specific regions: Sequence locations=1-1,26-259,285-389
ggccgccggcgcttttgcgcccgccgcggcgatggcgcgccgccggcatggctttgctttttccacggattggtcaaacggcggggcgccgccgcgatttgggtgcgaatttttgcgggggaaacaacgccgggagcggaccaccttctcacgcgcccaattggacgtgttggagggcgttttcaagaacacgcgggacccggacattttcgtgcgcgaagaaatggcgacgaagatcaatctgcccgagtcgcgagttcaggtttggttcaaaaaccgaaggggaaaggcgcgcagccaaaagaaagcccagcagatcacccaccaccaccagtccgcttcttcctcctccggttcctctgtcgccggctccaatccgtcctcagccg

SEQ ID NO: 88337 - DNA, 272 bp, Heterodera glycines
  SCN-specific regions: Sequence locations=1-108,130-272
ggccgccaagcattattcttcctatatcccccgggcactttggtggtgcaaatgtcttcaaaaattctttggtctactgtgttttcttctattggtcgattgtgccaccattcttttttggttcttttttggccatgtcaaaaaacgacgacgcccacataaaaacgaaatctttatctgcggcgactgttggcttttggtgttcgattttcttgcgccttctcaactcggcctcgaaattgcactggtcaaccgccgctttaactgcatcg

SEQ ID NO: 88338 - DNA, 402 bp, Heterodera glycines
  SCN-specific regions: Sequence locations=1-402
ggccgccaaggaatgggtgctaaaggtggacgatgacattgcggggcatgtccgacggatggtcgaatggacggagaaaaaatttggaaaaatggctacagaacatccgttgatttattttggagtcccggcagatagaggactatctcgggacaagaacagcaaatggtacgtcccttatgaaatgttcccgggggaacatttcccaccgtttttgtgcggtgggtgctatttgacaactccaagcaccatcaaagccgtcttggaacaagctcacaaaaccaacagcttttatttggaggacgtgcttgctgtacacgggcattttggccgagttggccaatgtcaccgtatcggaccaattgagccatttttatgggaatggattgcagtttgaatgtg

SEQ ID NO: 88339 - DNA, 137 bp, Heterodera glycines
  SCN-specific regions: Sequence locations=1-91,116-137
ggccgccagaaggagtccacttcgcccgggccgtcgccgttggggccggaagcagaagggcttcggcgggcagacgaagccgatcttccgcaagaaggcgaagaccacgaagaagatcgtgctgaggatggagtgtg

SEQ ID NO: 88340 - DNA, 254 bp, Heterodera glycines
  SCN-specific regions: Sequence locations=1-6,28-40,62-205,253-254
ggccgccaataatttttaaaaatataacaaacatttttttgtgagaaatgggtcaagcatttggccaccaattgctgcaccgttttcgtcgtccagcattatttgcattatcatcatcaaagttttgtccattgtttcgtgccaccgccgccttcgcaacggatggagcagcagcaaaacaacaaccaactgcaagtgctgctgcacaacaccaacatcaacaagttgaacagcaacaaaaacagcaacaaccg

SEQ ID NO: 88341 - DNA, 532 bp, Heterodera glycines
  SCN-specific regions: Sequence locations=1-500,522-532
ggccgcgtcgggcgtagtcaccaccaggcttatgcgtgcctgctgaggccaccgcgccagcagatcacttccgatgcggaaaaacgcctggaggcgatcgccaatacccaggacctcggcgctggctttgtactggccaccaacgacctggaaatccggggtgccggcgagttgcttggcgacggccagagcgggcggatccaggcggtgggtttcacgctgtacatggagatgctcgaacgcgcggtgaaagccatccgcaaaggcgagcaaccgaacctcgaccaacccttgggcggcggcccggagatcaacctgcgcttgccggcgttgattcccgaagactacctgccggatgtgcatgcacggctgatcctgtacaagcgcattgcctcggcggccgatgaagaaggcctcaaggacttgcaggtggagatgatcgaccgcttcggcctgctgccggagccgaccaagaacctggtgcgcctgaccctgctcaagttgcaggccgagcagttgggcatcaagaaag

SEQ ID NO: 88342 - DNA, 182 bp, Heterodera glycines
  SCN-specific regions: Sequence locations=1-11,33-137,170-182
ggccgccaagtatttgttgattcatttttggtctttgtctgcgtgggtgcgacttgttcagcttctccatttggcactgcttgttcatcttttgctggcgcctgttcttttggccgttggccaaaccgattaaaaagttaaactaattcaaaagagagaggggccccccgacgcgaatttgg

SEQ ID NO: 88343 - DNA, 191 bp, Heterodera glycines
  misc_feature (92)..(92): n is a, c, g, or t
  SCN-specific regions: Sequence locations=1-191
ggccgccaaggatgttttcaattttgcatttatataaaaatgtggtgtcaaaaatggcgaatgttgatttggcattggatgaaattatctcnaagtctcgccctcctcctcctcctcccgcaccacaacaaagaaactttgggggggagcgaccatttcgaatgagtgcgtaccaatcgtcccggggtcgg

SEQ ID NO: 88344 - DNA, 576 bp, Heterodera glycines
  misc_feature (430)..(430): n is a, c, g, or t
  misc_feature (484)..(484): n is a, c, g, or t
  misc_feature (507)..(507): n is a, c, g, or t
  SCN-specific regions: Sequence locations=1-576
ccaggtttgcctatagtgagtcgtattagagcttggcgtaatcatgggcatagctgtttcctgtgtgaaattgttatccgctcacaattccacacaacatacgagcgcggaagcataaagtgtgaagcctggggtgcctaatgagtgagctaactcacagtaattgcgttgcgctcactgcccgctttccagtcgggaaacctgtggtgccagctgcattaatgaatcggccaacgcgcggggagaggcggtttgcgtattgggcgccagggtggggtttcttttcaccagtgagacgggcaacagctgattgcgcttcaccgcctgggcctgagagagttgcagcaagcggtgcacgctgggttgccccagcaggcgaaaatcctgtttgatggtgggtaacggcgggatataacatgagctgtgttcngtgtcgtggtatcccactaccgagatatccgcaccaacgcgcagcccggactcngtaatggcgcgcattgcgcccancgccatctgatcggtgggaaccagcatcgcagtgggaacgatgccctcattcaccatttgcgtgggttg

SEQ ID NO: 88345 - DNA, 173 bp, Heterodera glycines
  SCN-specific regions: Sequence locations=1-12,34-173
ggccgccaagaagtttgagactgaaatggacaattatgctgaagaaagagtcaaaatattcaattttgaaaaacaaaaacgacgtgagcgtccgattcggcgtcgggcgccggagaatttgctgcgaagagcgggcgggttgaagaaatgtacggacttaaggtgtgagcagt

SEQ ID NO: 88346 - DNA, 206 bp, Heterodera glycines
  SCN-specific regions: Sequence locations=1-126,148-206
ggccgccaagggaaatccaattcaatttttgagtataaaatgagcgggggccttcttcctctgtctcttcactgttcagctgattctgctcaatttcgcagtcgaaggaagagaagacgatgaactgaagagaaagaaacgcaacacggacgtggacgtgctcggcctggtaaatattcacgcgccgtcgcgaaagagtgtgaacg

SEQ ID NO: 88347 - DNA, 238 bp, Heterodera glycines
  SCN-specific regions: Sequence locations=1-238
ggccgccaagatcgtttcacaatggttgatgtttcccgcacatcagattttcgacactccttaaacgcgcgactgtcaacagctcctattatgtctcatacgctgcctatggtgcctctgcttttcttgtgttggtttacgttacggaatggaagcgtttcgcccgttatattcccggactccgttcgcagatcaaatcggacgaatgaatgaatgtctcgtggggtgtgcggaacgg

SEQ ID NO: 88348 - DNA, 350 bp, Heterodera glycines
  SCN-specific regions: Sequence locations=1-350
ggccgcaagacttaatctttgctttgtgccattcccagcccattcattccttttttgggcgatggcacctcccaatccgtcgttgcaccgcgtccatccgttgagtccaccggcggtgcctccccaccacgggaggcaacaatcgctgctcaacccacaaaaagggcatatgccaacattcagtgcagtgcccaatgaccaaaaggagcatccgaagcgccgccgctcgctccgtctaatggcatttgcgtcggtggcatttgccactgtgtcggtgttggccagtgccatcacattgccaattgtgtacagccatgtgcagagcatccaggcatttatgcagaacgaag

SEQ ID NO: 88349 - DNA, 263 bp, Heterodera glycines
  SCN-specific regions: Sequence locations=1-75,98-198,222-263
ggccgccaagcgcgagcagaacgacagcgaatcgggccaccgtgagggctcgcgccgtgtgctcatcccggagggcatccaaaaggagagcatcaagtgcgagctggacggcggtcgtttgttcatcagcggaatgaaaacggctgacaaaggcggacgaaccattcccattgaaatgaagaagaaggcggccgtggaccagcagaaggaggaggagaagcagtagaaaaggacggcggaagtgaagacggactgactgtcgg

SEQ ID NO: 88350 - DNA, 113 bp, Heterodera glycines
  SCN-specific regions: Sequence locations=1-113
ggccgccaagcgacattcgtttcgtctgtcctttctccttatggggggcattttcctcacttccgtgcattgtattaagccttggctcgggcgtatatatttatttggatgag

SEQ ID NO: 88351 - DNA, 179 bp, Heterodera glycines
  SCN-specific regions: Sequence locations=1-179
ggccgccaaaggactgaatgtcccatccttcccacgccgtccctcttttgtttgaccgggacaatgaggcacaactgaacttgcccacctatgaaaaactcgtcaatgatcaacaaaaaccttccattggtcaaaattcacgcttccaatatatacccaatcgatgtgccttggaggcg

SEQ ID NO: 88352 - DNA, 226 bp, Heterodera glycines
  SCN-specific regions: Sequence locations=1-226
ggccgccaagcactttcgtaattttttttccgccttgcgtcgggcgatgaccatcaccatttccactccgtatccctgcttctgtcttctgttaccaatccgtctacaatttggccgaaatgactgtggacatcgtcacgccgggcaccacccaaacagcgacaaggacgagaacgaggaggactgcttcacgccgtcgcttgtccgcagcgcgttcgagaactcg

SEQ ID NO: 88353 - DNA, 211 bp, Heterodera glycines
  SCN-specific regions: Sequence locations=1-111,153-211
ggccgccaagattaattggaaatccaattcaatttttgagtgtaagggaactgctccttcttcctctgtctcttcactgtgcagctgattctgctcaatttcgcagtcgaaggaggagaagacgatgaactgaagagaaagaaacgcaacacggacgtggacgtgctcggcctggtaaatattcacgcgccgtggcgaaagaatgtgaacg

SEQ ID NO: 88354 - DNA, 443 bp, Heterodera glycines
  SCN-specific regions: Sequence locations=1-405,437-443
ggccgaaagaaatttacactgaaaatgtcttcttcgtgtaccgtttttgttgttctgctggtaattgccatctgctgctgttcattaacaattgccatgccagcagcgggcaatgaaattgatagtgtgccacttcggcaaaagcgtgggtatggctatggtgggtacgggtatggggggtatggctacggggggggaatgggcggcggcggatttggcggtggaatgggcggcggaatgggcatgggcggcggaatgggcatgggtggcggaatgggcatgggtagcggaatgggcatgggcatgggcagcggaatgggcatgggatttggacgctgatccgtgaaattaattgcgccaataatcggattgtgaataaaaagataatgggataaaaggaataataaaaaaaaaaaaaaaaaaaaaaaaaaaaaaaccttggg

SEQ ID NO: 88355 - DNA, 341 bp, Heterodera glycines
  misc_feature (59)..(59): n is a, c, g, or t
  SCN-specific regions: Sequence locations=1-190,214-341
ggccgccaaggactttatggcgaacgcgtcggtggcgtagcagctgtgcggctgccacnaccaggacgagggtgcccgagtgatgtcccaactcaaaattctaatccgcccgatgatttccaatccacccattcatggggcgcgaattgcgtccaaaattttgtgcgacccgaaattgcgccaacaatggctgggggaggggaaggggatgggcgaccgaatcatcacaatgcgctcccaactccgcgatttgtggggcaagggggggtccaagcgcaattgggaccacattgtgaaccaaatcggcgtgtgctgtgtcacgggaatcaggccggaacaag

SEQ ID NO: 88356 - DNA, 269 bp, Heterodera glycines
  SCN-specific regions: Sequence locations=1-269
ggccgccaaggcaaaacggatcagattttggacatggacatgtggcctgtacgacacacaaccagctaatctgtccggactgaatgaagaattcatttccggcgctcggctggacaatttggtctccacgtacactgccatcaaaggggtggtcgaaagtttggaggacaccgacgcttttgacgcggacccaaatgtgggcagtcgcagtgcccagggggcccagtcgcactgtttcgagtggcttttgcgccgcgttttgtccaccg

SEQ ID NO: 88357 - DNA, 215 bp, Heterodera glycines
  SCN-specific regions: Sequence locations=1-115,157-215
ggccgccaagaaaaattaattggaaatccaattcaatgtttgagtgtaaatgaactgctccttcttcctctgtctcttcactgtgcagctgattctgctcaatttcgcagtcgaaggaggagaagacgatgaactgaagagaaagaaacgcaacacggacgtggacgtgctcggcctgggaaatattcacgcgcgcgggcgaaagaatgtgaacg

SEQ ID NO: 88358 - DNA, 242 bp, Heterodera glycines
  SCN-specific regions: Sequence locations=1-242
ggccgccaagcaaatttggggaggggtggttcgcaaggagtgccgagggtgaacagacaacgaaagggcgcgatatcacgccgctgttttgcaactgaagcgtggcaccggttcgtacgagtacaaccgaatcgcttacctgcacttcgacctgcgcgcgatgccaggtgctcactccgggccgactttccttccttggggtcgcgaatatttgaaacgttatgaaatcggtctgcgtgccg

SEQ ID NO: 88359 - DNA, 209 bp, Heterodera glycines
  SCN-specific regions: Sequence locations=1-209
ggccgccaagtgcttagagcccattttttaagcgaagagcggcttcgcgtgctttcccgacccactgaactcgtaagtttggggcgctgatttttggcagacaatacattcaacggtgacccgaacggcgtgatgccgaaacaccttgtgtggctcgactttgttcgtttggtgtgccaaaatagatgcgtgtgtgcatatgtaatttg

SEQ ID NO: 88360 - DNA, 581 bp, Heterodera glycines
  misc_feature (456)..(456): n is a, c, g, or t
  SCN-specific regions: Sequence locations=1-136,158-581
ggccgctggagttttccaggtcgggcagtggacgctgttgcgctgccgccaaagtctgcaagacccgcggtttgaaggttggctacgtcaggtacaggaggggcgggcatgaaagcgttaggtgaggcgtgtacgccacaagagtgtcagctggaagcggcggtgcgcggggttgccagttggggcggcaccggcgttcgttatgaaccggtcagcggcgggatttccaacaccaactggcgggtggaagtggccgggatcgacactgcgtatttcttcaaggtgccgggcgtgggcaccgagatgttcatcgaccgccgcacggcccacgacgccagcctcaaggcggcgcaaaccggctatggcgcgccggtgttcgcattccttgaagagttcggcgtggaagtcttcgagttatggagggctggcgcgcctcctccaaccacgacttcctcnaccgcgacgtgcgccacaacgcgctgcacgccctcaaggcgttcaacgaccagccgccactggtgcagaccaagaccgtgttcgacatgattgccgagcaccagcggcaggtggagcaactcaac

SEQ ID NO: 88361 - DNA, 418 bp, Heterodera glycines
  SCN-specific regions: Sequence locations=1-133,155-418
ggccgccaagggtggagccatttttttccgttttgtgccttcggtgcaatttttggcgaatgattcccatcttttgcccctaatcggtcagttgtcgtccacaaatcgcgcctccgttcctccgccgctttgtgcgcgccctctccgccgcctcagtgcctttccatccttagcctttgtgcgcttttctccgccgccgtgccaatgtccgccgctgcttccgctggccaaacgcaccgatggggcggaatggccgcaccgcaccgcagccgaccgccgctgcgctttgaccgcacctttcttgaggagcgcgacaatcaggtgaagctcatccaaatgctgtgcggtctggtcgcccttctgctgacagtccaatgctggccaaatccgcttttccccttctgtgtgggccgtgtcg

SEQ ID NO: 88362 - DNA, 228 bp, Heterodera glycines
  SCN-specific regions: Sequence locations=1-228
cggccgccatccatttgccatttcgtcctccggcgggtacaaggcgatggtccatttttaggggtgaaaatcagttacgtccagccctgcacccaatgggaccaattataagcacacttgctgagtcagaagaacaaagcccaaattcgatggagaagaaatagagcttggggaaaaggttaggaaaaaagagcggaagagagataccgtagccaattgtggccttgg

SEQ ID NO: 88363 - DNA, 271 bp, Heterodera glycines
  SCN-specific regions: Sequence locations=1-29,51-80,109-240,262-271
ggccgccaagcaacaattggtgcgtgtttctttgccgcgagtgggcggtgtatccccatcccccgccgtgtttctcccatcgatgccctcctcctcctcgtggttttgggggacctccgccgttgggagccgcctgtgaccatgagccgaaggggcacgactaccagctgtgcttccaactgagcacgagttctgtgggtgtgcttcttccgcttgcgctgcgcgggagcttctgcgccaacacttgcgcattgatttgtctgtgcactcc

SEQ ID NO: 88364 - DNA, 262 bp, Heterodera glycines
  misc_feature (110)..(110): n is a, c, g, or t
  misc_feature (166)..(166): n is a, c, g, or t
  misc_feature (205)..(205): n is a, c, g, or t
  misc_feature (208)..(208): n is a, c, g, or t
  SCN-specific regions: Sequence locations=1-173,195-262
ggccgccaaggaggatttcaatcaatttctttactaggtgtggcgtggaatctgtgaattttatcaatcatctacccgaaaaactttattttttggagtctgatggacangtttttcacaatttgaatgatatcgacgacggagagctcatccaattgcgttttcnagcatgtggaggaaaaggagggggtggggtcgggcttcntancttccgaattcacaagtcaagcaaccaattgatgtgtggaaatttgcaaggggg

SEQ ID NO: 88365 - DNA, 268 bp, Heterodera glycines
  SCN-specific regions: Sequence locations=1-268
ggccgctttgctgatcactggcggtgttgtgggcgcaacgggggcgagtatttttgttgatcgtaccaaattctacgaagagacgatgaaggtgtcaatgggacttgcggttgtcttcggtcttgcgttcttacagtttgtgctccatgttggcatgaaaccgtggctgttggtgacctgcttcatttttggcgtgtgcggcttggctgcctaccccgtgggacttcaactgtcagcagagtgcactttccccgtctctgaaacaacg

SEQ ID NO: 88366 - DNA, 139 bp, Heterodera glycines
  SCN-specific regions: Sequence locations=1-139
ggccgccaagctccgccaccgcaatgtcaacattgggcacaacaagtgtgagcgcatttgggtcttgcggttgctgctcttcctcaaccgactgttgctggggcggtgccgcttgttgcggctgctgtttggcttgcgg

SEQ ID NO: 88367 - DNA, 648 bp, Heterodera glycines
  SCN-specific regions: Sequence locations=1-648
gtcttatgggagaaaataatactgttgatgggtgtgtgggcagaggcgataagaaataacgccggaacattagtgcaggcggcttccacagcaatggcgtcctggtcatccagcggatagttaatgatcagcccactgacccgttgcgcgagaagattgtgcaccgccgctttacaggcttcgacgccgcttcgtgctaccatcgacaccaccacgctggcacccagttgatcggcgcgagatttaatcgccgcgacaatttgcgacggcgcgtgcagggccagactggaggtggcaacgccaatcagcaacgactgtgtgcccgccagttgttgtgccacgcggttgggaatgtaattcagctccgccatcgccgcttccactttttcccgcgttttcgcagaaacgtggctggcctgggtcaccacgcgggaaacggtctgataagagacaccggcatactctgcgacatcgtataacgttactggtttcacattcaccaccctgaattgactctcttccgggcgctatcatgccataccgcgaaagggtttgcgccattcgatggtgtcaacgtaaatgccgcttcgccttcgcgcgcgaattgcaagctctgcattaatgaatcggccaacgcgcggggagagg

SEQ ID NO: 88368 - DNA, 277 bp, Heterodera glycines
  SCN-specific regions: Sequence locations=1-277
cgccagagacattggggacggagacccggagagaatgtgcccaggggggtggcggaatacgtcaaaaaaacttttgagaattcgtcggtccgcgtttcgattatcgacgacgttgaccaaattcgccgtgactatccgcttatgtcggccgtttcgcgttgtgccaatgccatcgaggagcacaaagctcgtgtcatttggctcgaatacgacgggggagaagagacggagactctgtttttagtggggaagggcgtcaccctcgacacgggagggg

SEQ ID NO: 88369 - DNA, 282 bp, Heterodera glycines
  SCN-specific regions: Sequence locations=1-111,133-282
ggccgccaaggccaggacagccaggaggccaaggaccgcccggacctcctggcgcgcccggtcagcccggccagcctggaaactctggccagcctggacagcccggagcaccgggacagcccggcaaggacagcggctactgtgcgtgcccgccccgctcttccgtgttggcagtcaaaaagaagatggcgggggcgaagaaagcataagcgacaagcgcagggggaagagaaccgaaagacaaaggaccgacgcgaaagcgaagctgaagatgatcataat

SEQ ID NO: 88370 - DNA, 463 bp, Heterodera glycines
  SCN-specific regions: Sequence locations=1-48,88-360,382-463
ggccgccaaggtcggttccattcgtccacgacttcctcaatgcaggggcatcaccaccaccaccacaacagccaccatcaacgccacaaacgttcttattcttccgcccgccatgtgttgatcaatttcggcttccaatttccgcatgatttcaaacttggcagtggtcgttacagcaaagtgtacaaaggattttaccgcgaagcaaatcgttattttgcaatcaaaattaccgacttggaagccgtttctgacagattcaagcataagtttgtgccccgtgaactcaaagtctggcgcgagttgagtcacccgaaccacgtccgtttgtacaaggatttcatgaagaatgactttctgttcgagatcatcgacttggctgttggcggtgatatgctcaattatttgcggaaccatggaccagtcaaagaagcggtctgttctggctggatgcttcagctcg

SEQ ID NO: 88371 - DNA, 426 bp, Heterodera glycines
  SCN-specific regions: Sequence locations=1-426
ggccgcatgccttttgctggccgacgacacacacacgttgtgctgaggacgttcgaccgactacgacacgacgcgtacgatgaacgaggaatactgcttctctacttcgactgctgttgcacagagctgggcccaaacaaacttccgaccagtggacgagcaaccgaacagccttgtggacacgctcatcgcgaaactttcgcgcacgactttcgagcagttcacttccgaagtcagtgctcaggacattcacaagctttgcgatatcaccgtgcagtgtgctccagcaacagtcaatgctcatccgtctgcagcctcctgtggtcctttgcggcgacatccatgggcaatttcgcgacttgctgagaatcttcacgacgatgggctttccgccggacaagaagcacctcttcctcggggattacg

SEQ ID NO: 88372 - DNA, 108 bp, Heterodera glycines
  SCN-specific regions: Sequence locations=1-12,36-108
ggccgccaagaattttttgcattgttttgaactgatgcagcaggaggatctacaaggacgcgttcacagacgatgagctcgcctctgactcgttcccgatgaagttgg

SEQ ID NO: 88373 - DNA, 643 bp, Heterodera glycines
  misc_feature (391)..(391): n is a, c, g, or t
  misc_feature (454)..(454): n is a, c, g, or t
  SCN-specific regions: Sequence locations=1-643
ggccgcgttgctggcgtttttcctaggctccgcccccctgacgggcgtacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaggcgtggcgctttctcatagctcacgctgtaggtgtctcagttcggtgtaggtggttcgctccaagctgggctgtgtgcacgaaccccccgttcagcccgaccgctgcgccttatccggtgactatcgtcttgagtccaacccggtgagacacgacttatcgccactggcagcagccactggtaacaggattagcanagcgaggtgtgtaggcggtgctacagagttcttgaagtggtggcctaactacggcgtcactanaagaacagtatttggtatctgcgctctgctgaagccagttaccttcggaaaaagagttggtagctcttgatccggcaaacaaaccaccgctggtagcggtgggttttttgtgtgcaagcagcagattacgcgcagaaaaaaaggatctcaagaagatcctttgatcttttctacggggtctgacgctca

SEQ ID NO: 88374 - DNA, 268 bp, Heterodera glycines
  SCN-specific regions: Sequence locations=1-268
ggccgctttgctgatcactggcggtgttgtgggcgcaacgggggcgagtatttttgttgaccgtaccaaattctacgaggagacaatgaaggtgtcaatgggacttgcggttgtcttcggtcttgcgttcttacagtttgtgctccatgttggcatgaaaccgtggctgttggtgacctgcttcatttttggggtgtgcggcttggctgcctaccccgtgggacttcaactgtcagcagagtgcactttccccgtctctgagacaacg

SEQ ID NO: 88375 - DNA, 245 bp, Heterodera glycines
  SCN-specific regions: Sequence locations=1-72,94-117,139-245
caacaaaatgtggaaataaaaaaaaaaacttcataaaccccgtaattcgggagcggtaccttcactcgtaccaattttgcctatacatattgcccttagaacttacaatcctcatagcaataactgcttcctttgataaattcttctcctctcaccattttacataacatactaccctcaattataaaacataaaacccttagtgcctaataactgatctaactcacattaatttttttcccctc

SEQ ID NO: 88376 - DNA, 346 bp, Heterodera glycines
  SCN-specific regions: Sequence locations=1-346
ggccgccaagaacagacgcgcgacgagggaaagttcgttgagtgggatggtgccgagatgggaaaggtggtggtgcgttttccacccgaagcaagcggttatttgcacattggacatgccaaggccgcactgctcaatcagttctaccggcaccaattcgaaggtgggctgattctgcgcttcgatgacacaaacccggccaaagaggacgcacacttcgagaaggtgatcgaagaagacctgcgcctgttgcaagtcgagtgggacaaaatgagtcggacttcggaccattttgacgcccttttggacttttgtcaacaattgctggtcgctgggaaggcctacg

SEQ ID NO: 88377 - DNA, 749 bp, Heterodera glycines
  misc_feature (475)..(475): n is a, c, g, or t
  SCN-specific regions: Sequence locations=1-248,270-537,583-639,661-749
gcatcaagcttggtaccgagctcggatccctagtaacggccgccagtgtgctggaattcgcccttcgcggatcctatactttttttgatttgctaaagtataaaatggcttatttagagttagttatggcgttgattaaaacattgacaaatgacccctttatataggggcttggggaatccaatcacagcaacgcaaattaaggctttccaatcaagtgtctttttctttattgtcattccctttagaaaaaatatttaatttaatttccatttgagtaaacatgtactctatcgaaatacacgaaaaggtagtccatgcctaaaggtagcggcttctaatctcttagaactagtttaggttgaccaagaatttcgagatgagtgaacaaaagactaaaagcaaatcaaagtgtttgaagactatagagaaaatggaatggagggaaaacacatgactcccaaaaatactttanaaatatgttcgagctttaaatatatgcacttatgatataagaaatatttatacaatcaaatcatttaaaagataattacaaataattttatttaataaatattaattcataacctacaataaatagtacgtgatttgctatataatttaaactatagtgatgatgtaaaaagttttcactatcagtatttgtatacgcttaaatgttaaatccgatatttccacttgcatctcaccaaatatctttgagttttcttcacaactactaacttcta

SEQ ID NO: 88378 - DNA, 318 bp, Heterodera glycines
  misc_feature (273)..(273): n is a, c, g, or t
  SCN-specific regions: Sequence locations=1-318
ggccgccaaggagagaaaaataacttataaaatgatggcacgacgttgggctccaaccgaacaacctcccgtctattcgatatttgacaacttctgcgttttccaaagctcgctatggtttccggccttccggtggagcaggacaatatgcatttcgctttaaagaagcttttgctgcgcgtcaggtggcgccgactcttcgtgaacgccttctcggccctaccactggcaaaccatttatcgtcggaacttacgcacttgccggggcttcantttttggcattggaatgttgtgctactacggacttaccacgactg

SEQ ID NO: 88379 - DNA, 684 bp, Heterodera glycines
  SCN-specific regions: Sequence locations=1-684
gcttccactttttcccgcgttttcgcagaaacgtgggtgggcgtggggaccacgcgggaaacggtctgataagagacaccggcatactctgcgacatcgtataacgttactggtttcacattcaccaccctgaattgactctcttccgggcgctatcatgccataccgcgaaaggtgttgcgccattcgatggggtgaacgtaaatgccgcttcgccttcgcgcgcgaattgcaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtgatacggttatccacagaatcaggggataacgcaggaaagaacatgtgagcaaaaggccagcaaaaggccaggaaccgtaaaaaggcggcgttgctggcgtttttccataggctccgcccccctgacgagcatcacaaaaatcgacgctcaagtcagaggtggcgaaacccgacaggagtataaagataccaggcgtttccccctggaagctccctcgtgcgctctcctgttccgaccctgccgcttaccggatacctgtgcccctttctcccttcgggaagcgtggggctttctcatagctcacgctgtag

SEQ ID NO: 88380 - DNA, 371 bp, Heterodera glycines
  SCN-specific regions: Sequence locations=1-90,113-116,139-330,352-371
ggccgccaagcttttttcctaatgaatttaaatttgattaattacactaattactgccattagttaatctatgccttttattattggcaatttcagtcacaaagcaattatttgattttccaaaaatggggaagggccgaactaccggtaatagcggaggaggcaaaggcggaagcggtggaggcggagacgaaaaaagcggcggaagcggagcggggaaaggaacggtggctgccggaagcggaggtgtacgcggaaagggtgccggacagagcggaccagcagcagcagcagcaggcactgacaaaacgcgtgctgcaaaagccgctgccgctgcgcgcggtgctcctgcggaagaaagtgtaaaatcg

SEQ ID NO: 88381 - DNA, 636 bp, Heterodera glycines
  misc_feature (480)..(480): n is a, c, g, or t
  misc_feature (543)..(543): n is a, c, g, or t
  SCN-specific regions: Sequence locations=1-636
ggtgatacggttgtccacagaatcaggggataacgcaggagagaagcatgtgagcaaaaggccggcaaaaggccgggaaccgtaaaaaggccgcgttgctggcgtttttcctaggctccgcccccctgacgagcatcacaaaaatcgacgctcaagtcagaggtggcgaaacccgacaggactataaagataccaggcgtgtccccctggaagctccctcgtgcgctctcctgttccgaccctgccgcttaccggatacctgtccgcctttctcccttcgggaagcgtggcgctttctcatagctcacgctgtaggtgtctcagttcggtgtaggtcgttcgctccaagctgggctgtgtgcacgaaccccccgttcagcccgaccgctgcgccttatccggtgactatcgtcttgagtccaacccggtgagacacgacttatcgccactggcagcagccactgggaacaggattagcanagcgaggtgtgtaggcggtgctacagagttcttgaagtggtggcctaactacggctacactanaagaacagtatttggtatctgcgctctgctgaagccagttaccttccgaaaaagagttggtagctcttgatccggcaaacaaaccaccgctgg

SEQ ID NO: 88382 - DNA, 280 bp, Heterodera glycines
  SCN-specific regions: Sequence locations=1-142,169-280
ggccgccaaggcagaaatcacctattattgcggacaatttgggttcgttcagcgatttggacggcaaaaagaacatcgaagagattttggcagcgaaaagggaggcgatcaaaagggcgacggcggtgttggagatggaagtgccagcggaggaggaggaggacaacgccaaattgataaggtggccacaacgctggagatggacaaaattcgagcgcgaggctttctgaagttcacctacaattacgacccattgctggacattggaaggaaagtcgag

SEQ ID NO: 88383 - DNA, 494 bp, Heterodera glycines
  misc_feature (446)..(446): n is a, c, g, or t
  misc_feature (462)..(462): n is a, c, g, or t
  misc_feature (486)..(486): n is a, c, g, or t
  SCN-specific regions: Sequence locations=1-215,238-393,415-494
ggccgccaaggaacaagtccgaagcgacagcctcaaaggcacagagcggctccacacacgcagccatgacgttcgaactgccaaagctcagctacaactacgatgcgttggagccattcgtggacacgaccaccatgaacatccaccacaccaagcaccaccaggcgtacatcaacaacatcaacaactacattgggggggacaagggtgctgccctcaaggggaagtccatcctcgaggtggtgcagagcgccacggaggcgccagtgcgcaacaacggtggcggtcactacaaccacacgctgttctggacgttcatgaccaagccaggatcgaccaacacggcgccacacggtgccctaaaggagcgcattgagaaggagttcggctctttggatgccatgaaggagaagttcaacgccgctgcatcgactcgcttcggctcnggctgggcgtggctcngcgtgaaggccgacggcacgctcnccatcacg

SEQ ID NO: 88384 - DNA, 174 bp, Heterodera glycines
  SCN-specific regions: Sequence locations=1-174
ggccgccaagccgtgctcacatccgcattttaactggtatgcgtgcgggctctcgcctccaatccgtcggccatcgccgtaggatggaaaaggagcggcgttccgtttggctgctcatttccatcgttttgctatttttcctctgtgataccggcggtgtgattatccgattca

SEQ ID NO: 88385 - DNA, 345 bp, Heterodera glycines
  misc_feature (62)..(62): n is a, c, g, or t
  SCN-specific regions: Sequence locations=1-345
ggccgccttctcggtgccgtattgttcttgactttcgtcgcgcccggggtaattttacttcntctccttcacgcccgcctttcctttctttccagtatgaggacattcatttgtcctctgaggaaggaagatgtttacggcctgcttgccaacacccgggatctctcccactggttgcaacgtttctttctgcagcttcggcggcataacatcaatcttttcacgaggtgctctggagtttaatgttcctcagagtgccgccatattctatgggcatctgcagatcctctgggcctttgtgcccacatcttgacctccgcgtgcgtgcacctgcacaccccttgg

SEQ ID NO: 88386 - DNA, 532 bp, Heterodera glycines
  SCN-specific regions: Sequence locations=1-532
ggccgccagcggagggacaccaatgattctggggcgatgtttgcggttatttttgcctttattcgtttttctccaacacttagattcatcggtgggaggagaacaacggagttcgaacgacgaggaccgagtggaagcggaaatcactcacaaagatccccgtttcaaagtgcaaattgaagatcgaggcgggcgaggagttggatcagttcttcaagctgacggactaagagggcaaactgatccgatccaatttccgacagaatccctataaatttgtgcttggccatgggcatgccatccctcccatggacaacgcaatgctcagaatgtgcgtgggcgaacagcgcccggtgaccattcctgcggaaacgtttgcggaaaaccaacgggccagggggtgggcgaggaccaagccatgcattactttgtggagcctcaagtccatctttcacgcattgccccgctagaaatggatggaggacgacagactgagcattgaggtcactctcaaaatacacgaagacaaatg

SEQ ID NO: 88387 - DNA, 328 bp, Heterodera glycines
  SCN-specific regions: Sequence locations=1-47,74-227,251-300,323-328
ggccgccagttctccctatttaaagttttacaaaataatggggacagaatttttttaattaaaaaaataatttcgtcggctaaagcatgctgacaacctaaatttgaactgggtgcactataacggacgctttctgaaacgattgggccgaaagcgacggacagagcgcagcaaaattggcaaagtgtggtgctttctgttccgctgtacgcacccggccaccactgaccaccaccacaaccaccgccacttcaacaactttcgctcgtcacttttggccgcgacgcccgcgaagggccaacaacagaagcaaaatcagcaacacaac

SEQ ID NO: 88388 - DNA, 142 bp, Heterodera glycines
  SCN-specific regions: Sequence locations=1-57,79-105,127-142
ggccgccaaggcggaagccccggccaacccggcgaccccggaggcgacggcgagcaaggacagcctggagcacagggatcaagcggccaatgctaccactgcccaccgccccgcaccgcccccgggtactgagtgtgatcag

SEQ ID NO: 88389 - DNA, 107 bp, Heterodera glycines
  SCN-specific regions: Sequence locations=1-107
ggccgccaaggacttgcaaagtgaaccgtgcattgaagacttggggcccgatgacagtaccgttgccgaaaaattcaggtggccgataaatgccacttatgtcaatg

SEQ ID NO: 88390 - DNA, 220 bp, Heterodera glycines
  SCN-specific regions: Sequence locations=1-25,47-220
ggccgccaagaaaatttgttatacctaagtcttgaaatgtcttgggtgttttggcatcaaacctcagccatcgtcgattcctgcgcctccggacgaccccaacagaaaccctcccacgcccgccgatgagaagcagcagaaaattggggcacagagtgcctacacatttgactcaactgcgctggaacgggcggcacaagcagcaaaaacgctggaaaag

SEQ ID NO: 88391 - DNA, 463 bp, Heterodera glycines
  misc_feature (385)..(385): n is a, c, g, or t
  misc_feature (421)..(421): n is a, c, g, or t
  SCN-specific regions: Sequence locations=1-359,444-463
ggccgccaaaattgcgaaaaatgccgcgtcaaacgcgcagatttaatgtcaaaaaccaggcccctgagcaaggcggacaagttgcggggcaggcaaaatcggctgctcgcgcaaagccatcccgactttttggaggagcggcgcagtaagcggaagcagtacttggacgaagggtttgagccaacattttttgacgacgcggcggaggagggcgaggcgcaaaacggagcggcactgaccaacggcgccaccggcgccggcaaaaaggcgtcgtcgcggcggaagcgcggcacggcggaggagcaggcggacgcactcttccgcaacattcaaggggaccaattggacaatttgacgacggatgatgaggaggaggagggagcanaaatggcggatgaagaggaggagggaagatgttcancaggagggggagggagaagggggcttggacaggatgcagagg

SEQ ID NO: 88392 - DNA, 473 bp, Heterodera glycines
  misc_feature (212)..(212): n is a, c, g, or t
  SCN-specific regions: Sequence locations=1-9,41-81,108-109,196 -232,265-268,314-318,438-438,470-473
ggccgccaagctcaaacttattcaaaatggacttcgacgggcggggagggcttaccgcttcgtgggttactccacggtgtgcttctccatcatctctctgctttcggggtgcttcacgctgccgatgctgaagagctacgtgtccaacgttgggctgaagatggactctgagctcagctcatgccaaagcaatgcgaaggacatctggtcanaagtgagtcagctgaaggggctgccgttgatcgtcagcggaaaccgtacggcgcgtcaagtgtgcggtggcagcggcggctacggaagctgccaagactgtggctcaggcggaggacctggcccggctggcccgcccggacagcccggacgccccggaaaccctggagctcccggatcgcccggacagcccggacactccgtccagactccctgtgagcaagtgcgcccgccaccatgcacaccttgccccggcggtgagc

SEQ ID NO: 88393 - DNA, 145 bp, Heterodera glycines
  SCN-specific regions: Sequence locations=1-145
cacgaaattttgccaaataaaaaatacattgagaattgtgcgatcagcgttttggaaatgccaaaatgatcgggaaaatggtgagagacgaaaggacagcagcctcgtggatcatcagtgggggtgcttctccaattctcgatgg

SEQ ID NO: 88394 - DNA, 383 bp, Heterodera glycines
  SCN-specific regions: Sequence locations=1-383
ggccgccaagatttgttcgtctccaagtctcgtcgaacgtgtgcggggattgttcatcaatccttcatcggttgacacccgcgcgcacttcaaaatggacgccctcaaaagacttgcgagccgtgcacggcagaagtcggcggagatcatcctgagcgcggagaagaccgaaaatcggcgccgagcttgaacaattgcggaccaagaccgacaagacggaggagcacatgaagaagctggtgcatgccatcgaggtgtacctgcagccgaaccctgcagtccgagcgctggacccgcgaaaggacaaatccggccgacagaatacgctggacggtcttggggaggcgatgaaggaagcagcatcgaaagcggtgggcgccgag

SEQ ID NO: 88395 - DNA, 201 bp, Heterodera glycines
  SCN-specific regions: Sequence locations=1-167,189-201
ggccgccaaggttgtaaataattccgctaatatttgttgattgatggtgggcctttctctgctaaatgcgactcgttcagcttctccatttggcactgcttgttcagcttttgctggcgcctgttcttttggccgttggccaaaccgatgaaaaagtcaaacgaattcaaaagagagaggggccccccgaggcgaatgtgg

SEQ ID NO: 88396 - DNA, 178 bp, Heterodera glycines
  SCN-specific regions: Sequence locations=1-140,162-178
ggccgcctccgccgtttccgccccatccgccgccattgcctcccgggttgtatccgccgtagccgcgctttaaacgtaaagtgtcagatggagccgcagaatttgttgacgtgaaaatcagaagcaaagtaatgacaaaagaaaggaacaaaagggggaaagaaaaaaaaaaacttgg

SEQ ID NO: 88397 - DNA, 163 bp, Heterodera glycines
  SCN-specific regions: Sequence locations=1-163
ggccgcgctccagaaaaatggctattttacattattgtggaggagcgaaatcacgctaaccttatggaaaagcttgaagactacgctaagatagaaaagtttattatggaccattacaattcgggcaatgaaattctgaatgaggctgagataccccaaaatg

SEQ ID NO: 88398 - DNA, 311 bp, Heterodera glycines
  SCN-specific regions: Sequence locations=1-262,285-311
ggccgccaagtatgcattgatcaaatggtgctttcgggtgtgcatatattctctgtccgtctccccgtttctctcgctctctcctctacgttttttagtaattctcctcgtcgctgtccttcgccgccctttcgtcctcaaatgggtcaatcggccgcaacagaaatggacgccgcatgcatttgacgggttccgtaggcgagccgtacacatcgttcagcagcgtgtcgtccaggtccaattcgcccagcgaaaactgcacatttaaattgtgtgagtgttttggcgcatattttcgccaattcattacg

SEQ ID NO: 88399 - DNA, 207 bp, Heterodera glycines
  SCN-specific regions: Sequence locations=1-175,203-207
ggccgccaagcgctgaccaactgcagaaaatggaaggcgaaacgggccttctgaagaacgatgtggcggaacgaaatgaaggttcgttgtccgcactgtaaacagccgaacggcgaattgcgcaatgacagcggacgcacttttcttctcgatttcagcaaacagacgggcacagaaaaaaaaaaaaaaaaaaaaaaaaaaacttgg

SEQ ID NO: 88400 - DNA, 242 bp, Heterodera glycines
  SCN-specific regions: Sequence locations=1-217,238-242
ggccgccaagcactcgagcactgggagaaatttggaagcgaaacgaagggatcggaatgagattaatgattgccgaagcactgacaatgagacgaaaaagagaattgatgcttaatgcccgacaaaaatttatgatgatgaccaaatttctattatatctaacaagtcccattaatttctatatcggtaatcgattcacaaattaaattattacttgaaaaaaaaaaaaaaaaaaaacttgg

SEQ ID NO: 88401 - DNA, 320 bp, Heterodera glycines
  SCN-specific regions: Sequence locations=1-320
ggccgccaagtttttattgtgctcgccaaattgacactagcagagaagtgttcggatatcagcagactcagttcaattacggcgcttacgcttcagcaaacggtcagcagcaaagtttcatcaattatgctcagcaacaaaacaattcggcgactgctccggtggcgggaaatgccacaacaaatgcatatgctgcctcccaatattcgttggctgcttcggcttacgcacaatacagccaagccgcaacacaacagcagtccgttgctgcaacttacggagttcagcctccgccaccacctcctgactattcagcttcg

SEQ ID NO: 88402 - DNA, 495 bp, Heterodera glycines
  SCN-specific regions: Sequence locations=1-115,137-148,171-495
ggccgccaagggttttacattttttgtcttgtttttatcaacaacagatgcaggaaaaggctttttctgttcgatcgcaggaaggcgtccttcagcagcagggaacagctcaaaatgggaataaagaggaggaagccaagagacaagcggaacagcaggaaatggcaaagaactccattttgacacagattatcgacgaggaggggatgtcccggctgagcaatttgagggcggcaaaacccgaaaaagcgcgcgcagtcgaaggaatgcttatcgaaatggcgaggtccggtcgtattcgtgggagaatgtcggacagtgaattacgaacacttctcgaccgggtgtctgcagcgggcggaacgaaaagcaccaaagtgaagtacgacaggaggagagctgcaattgattcggacgaagagttagacaaaatggacgagaagggagcatcatccactgacgacgacgattagtgacctaagagccaatggatcg

SEQ ID NO: 88403 - DNA, 343 bp, Heterodera glycines
  SCN-specific regions: Sequence locations=1-298,321-343
ggccgcattctcaggtgccgtattgttgttgacgttcgtcggcgccggtgtcgttgtcgtcgtacattcgcgcccgccgttccattcgttgcagcaggaggacgttcagttggcctaggaggaaggaagatgtttaggtcgagcatgccaaaagtcgggatttcgcccagtggttgcagcgtttcattcggcagctccggtggcagaacatcgaacgtctcaaaagtagtcgggagttcaatgttcctcagagtgccgccgtattctatgggcgtatgcggattttctgggcgtctgtagccacgccttgacctccgcgggcgtgcacgtccacgccgcttgg

SEQ ID NO: 88404 - DNA, 242 bp, Heterodera glycines
  SCN-specific regions: Sequence locations=1-242
ggccgccaagcagcaaacgcttcttctccctccaccgtgcgagcgggaaatgggcttccactcgacaaagatggaagctgatctgtcaaaagagcagcaggggaaacgcgaggccgactcgatgcgcatgttggcattcttcggcgtttgcctgtccactgttgccacgatgatttgtgtggtgtcggtgccgggggcttatgaacactttcagcaggtgggcgccaaaatgcagggggaag

SEQ ID NO: 88405 - DNA, 472 bp, Heterodera glycines
  SCN-specific regions: Sequence locations=1-46
ggccgccagctcaacttattcaaatggacttcgacgggcgcaggagaggcttaccgcttcgtggcttactccacggtgtccttctccatcatctctctgctttcggtttgcttcacgctgccgatgctgaagagctacgtgtccaacgttgggctgaagatggactctgagctcagctcatgccaaagcaatgccaaggacatctggtcagaagtgagtcagctgaagggtctgccgttgatcgtcagcggaaaccgtacggcacgtcaagtgtacggtggcagcggcggctacggaagctgccaagactgttgctcaggcggaggacctggcccggctggcccgcccggacagcccggacgccccggaaaccctggagctcccggatcgcccggacagcccggacactccgtccagactccctgtgagcaagtgcacccgccaccatgcacaccttgccccggcggtcagc

SEQ ID NO: 88406 - DNA, 379 bp, Heterodera glycines
  SCN-specific regions: Sequence locations=1-159,182-311,333-379
ggccgccaagtcttcccaaagtcttctacgttgtgttcgaaacttcgatgggcgcaatgtccattgagttgtattggcaacacgcgccgcggacttgcatgaacttccaggaattggccaggaaaggttattacaacaacacaattttccaccggataattgctgattttatggttcagggcggtgatccgacacggacgggcagaggtggcacgtccatttacggcagtcgatttgcagacgaaatcagtgacgatttgcgacacacgggggccggcattatttccatggcgaattcgggtcccaacaccaatggttctcagtttttcattaccctcggcccaactcagcatttggacggaaagcatacaatttttgg

SEQ ID NO: 88407 - DNA, 498 bp, Heterodera glycines
  SCN-specific regions: Sequence locations=1-498
ggtggtttttcttttaccagtgagacgggcaacagctgattgcccttcaccgcctggccctgagagagttgcagcaagcggtccacgctggtttgccccagcaggcgaaaatcctgtttgatggtggttaacggcgggatataacatgagctgtcttcggtatcgtcgtatcccactaccgagatatccgcaccaacgcgcagcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttct

SEQ ID NO: 88408 - DNA, 300 bp, Heterodera glycines
  SCN-specific regions: Sequence locations=1-245
ggccgccaagatggtttctttctgtgttgccattttcatttttggtctgcttttctctctgtctctgtgtgaatggacttcaaagagttggtcaaccaagcggaacgaaatgcgaagcggcaagagcgcaaagtgcacgaggcggaacgcgagatgaaggcgcgtcagcagagccaaatggaacgcctcgcttatgaaaaggcgcgcgaaaagttggtgttgaaacgacgcgctgtcgccacaatgcaacagcaaaaggaacagcaacaacagcagcagctacaacagtcacaaaagcag

SEQ ID NO: 88409 - DNA, 272 bp, Heterodera glycines
  misc_feature (61)..(61): n is a, c, g, or t
  SCN-specific regions: Sequence locations=1-18,44-108,130-272
ggccgccaagcattattcttcctatatcccccggtcactttgttgctgcaaatgtcttcanaaattctttggtctactgttttttcttctattggtcgattgtgccaccattcttttttggttcttttttggccatgtcaaaaaacgacgacgcccacataaaaacgaaatctttatctgcggcgactgttggcttttggtgttcgattttcttgcgccttctcaactcggcctcgaaattgcactggtcaaccgccgctttaactgcatcg

SEQ ID NO: 88410 - DNA, 344 bp, Heterodera glycines
  SCN-specific regions: Sequence locations=1-300,322-344
ggccgcattctcaggtgccgtattgttgttgacattggtcgtggccggtgtcgttgtcgtcgtcaccttcgcgcccgccgttccattcgttgcagcaggaggacgttcagttggcctacgaggaaggaagatgtttaggtcgagcatgccaaaagtcgggatttcgcccagtggttgcagcgtctcattcggcggcggcggtggcagaacatctaacgtctcaaaagtactcgggagttcaatgttcctcacagtgccgccgtattctatgggcgtatgcggattttctgggcgtctgtggccacgccttgacctccgcgggcgtgcacgtccacgccgcttgg

SEQ ID NO: 88411 - DNA, 279 bp, Heterodera glycines
  SCN-specific regions: Sequence locations=1-43,65-279
ggccgccaggcttcgttggttgacatgagcagaccgccgatgaaaaaatggagaagccaaacagttcagcaaacgtttcattctccaatgtgaccgacaaattccgtgcccaccccgtggagaaggtcggtagtccgatcacaatcaatcagtccatttcggacccgaccacggagctgactgaggaggacattttccgcatgaaatcgatgtccattgaacagaacgggtggaaaaacggcccttgtgccagcgaattgcaatccgccgtctcgcagg

SEQ ID NO: 88412 - DNA, 417 bp, Heterodera glycines
  SCN-specific regions: Sequence locations=1-284,306-339,361-417
ggccgccaagatttggatgggcatgttcaaatacacgatgaacttgggcattgcctttgccgacctaaattaaatggttgggccgtaaattgtcccatttgctctccgaagtgctcgtcctcgctgcgcttggtctctttgttacgctgcgtttgacaggtttcgatgccaactttacctttttgtccaacggctctttggtcgctgcggttggcttttgtggcattttgttcaactcggacaaattggccggcagcgaactgttccccaccggagtgcgcaatttgtcctgctcctttggccaaatttgcagccgaattggcgtcgtcggcgccccaatgcttttctttttggatgtgtgcgatcaccgctattgttctgtcttcccccatttcactatgattgctttggcacttg

SEQ ID NO: 88413 - DNA, 472 bp, Heterodera glycines
  SCN-specific regions: Sequence locations=1-77,99-472
ggccgcaagcaacagtacaacaacaatcgccacagcagcaaccgtgggcgccaaagccgaaaccgccgccgaagaaagcggacacaacacacacaacgctgagcagaacaacaaatgtgctcatgaacaagcaaaattgcattatttcccgtgtgtgcgattataataccaacacgctgacaaaaaaatgaagaaaaaaaaaaacgattattcaaaattgggaatgaatgtagtgtgctgaagtcaatccaagtttatatatctgtacaatctgcgggcttagacattatgatgttttatttgaccggaaaacaattagtcgctgatgggacacagcacaaagtacaccactgggaaggtgcgcgaaaaattggcggttaaccgtccccctgctagtgattgatcgtccttagatcggcgattgaacaagcatttattcatttacggaagctgtgtggtgcctcaaacttgg

SEQ ID NO: 88414 - DNA, 538 bp, Heterodera glycines
  SCN-specific regions: Sequence locations=1-538
ggccgccaaggtccttaagggtgtttccctgtgcttccgccccgggtccttcgtccgtttcgttagcttcgtcttcccaaatcccctcccccacgcatccaaaattcattctgtttgaccgattgttgcccaatgaattggtttgagccgcgcgtgttgcgttccgcccgtccctttgtgcccagcggcggcgaacggcgggacgaagtcggaaaaacgggcgatgaccaggcagtggttcagatgatgtgcgatttggtgttgggcgagattcaggcggagatcagccgagtggagaaggaaatggaacgacgacgacaggacgagcggagactgaccaatcagccagactattcctggcttatggactggcgactgcgtgcaaaacgacccctcagcttcagagaaagctccgaagtggaattgttatgttcaaaagtcagagccgaggaatggcggcgactgctcaaagaatggcacataaaagttcgctttgcggaaagtcgggacgaagttttggacacatttcgggcattgg

SEQ ID NO: 88415 - DNA, 146 bp, Heterodera glycines
  SCN-specific regions: Sequence locations=1-146
ggccgccaagagaagcgctgggtgctcagagccaaacgggtcgctttctgagaggccaaagacgcgggacgaggcgagacggacgcgcgaccctttgaccggcgaaccatcaaaccctcagactttctctcatcattttcacccat

SEQ ID NO: 88416 - DNA, 146 bp, Heterodera glycines
  SCN-specific regions: Sequence locations=1-146
ggccgccagaataagctaactcttcgagtatcatgctgtcgagcatttcgtacattgcagtggcggcctcgctcgctgcgctttcggtgcatggcgcgccgcttccggacctgacgtgctccaacatcctgcggcccgggatcatg

SEQ ID NO: 88417 - DNA, 245 bp, Heterodera glycines
  SCN-specific regions: Sequence locations=1-195,241-245
ggccgccaaggaaagacggaggcactggtggacgcaaactgaccaaacagggccagaaggatctggaccgcattgcgtcacagctgcgttacggaaccgaagaatgaggatttcgacagatagatggggagaacaattttacttttctgttgttgttgcttgtttttttgtcatcaaagaaacatgaaaggagttaaaaaaaaaaaaaaaaaaaaaaaaaaaaaaaaaaaaaaaaaaaaacttgg

SEQ ID NO: 88418 - DNA, 410 bp, Heterodera glycines
  SCN-specific regions: Sequence locations=1-51,119-259,297-373,406-410
ggccgccaagcgcggacggagcgacggtgaccaacgccaacgaacccgttgcgactacgacgacgacggctgcgacgaccaatactgaggcgaccgctccgacgacaacgacgacgaccgcggatggagcggcggcgactaacactgatgcaaccggagcggcgactactccgacgaccaatgcggcgaccaatactgaggcgcccgctgcgactactccagcgacaaccgcggatgtggcgttggattagcatcatggcacaacaacagaagaaggagaagaaattgacatttatccgattgagcctttgaattgtgcatatgtatttcgttgatgtgtgtgtgtcatgtatcaatcaatatctgatcacttaaaaaaaaaaaaaaaagaaaaaaaaaaaaaaacttgg

SEQ ID NO: 88419 - DNA, 113 bp, Heterodera glycines
  SCN-specific regions: Sequence locations=1-113
aggtgggagttgttttcgttcgtttaaattacagagggtctccaaatgctcctttcttccactttgttggcgttggccgtgtcgcgtctcgtgccgttcaccgtttcttcctg

SEQ ID NO: 88420 - DNA, 332 bp, Heterodera glycines
  SCN-specific regions: Sequence locations=1-213,235-332
ggccgccaagagtggatcatccgatccatccttttggctctgaggggttccgcgtgaacacggattccgcgtggactgagctgatggaggtgcagatcagtgtcactccaccgacccgtccgcgagagaatcccttcaactccattttcctacgccaaaagcgccagggattgcctccccaatgcgtttgccaactgcggcagccaagctgtgctcctgggcctcctgggccgcctgggccccccggaacacccggcgagcccggcggcgccgggcagccgggaagcccatgacagcccggacaacaagcaccgccatgccctccgcccgtg

SEQ ID NO: 88421 - DNA, 183 bp, Heterodera glycines
  SCN-specific regions: Sequence locations=1-183
ggccgcaaagcatcaattgctgagcaaattgaaagaatttgtcggtggggtgaattcgacgaattgacggcactctgtgaggggttggccatcgtccaaacatttgacgaggcacagaaactgctggtggaatgtgcaattaaaaaagatttcgccgatggaaaggccggtttttaagggccg

SEQ ID NO: 88422 - DNA, 196 bp, Heterodera glycines
  SCN-specific regions: Sequence locations=1-162,184-196
ggccgccaagaaataattccgctaatatttgttaatttatttttgggctttctctgctaaatgcgactcgttcagcttctccatttggcactgcttgttcagcttttgctggcgcctgttcttttggccgttggccaaaccgatgaaaaagtcaaacgaattcaaaagagagaggggccccccgaggcgaatttgg

SEQ ID NO: 88423 - DNA, 402 bp, Heterodera glycines
  misc_feature (54)..(54): n is a, c, g, or t
  SCN-specific regions: Sequence locations=1-402
ggccgccaaggaatgggtgctaaaggtggacgatgacattgcggggcatgtccnacggatggtcgaatggacggagaaaaaatttggaaaaatggcgtcagaacatccgttgatttattttggagtcccgggggatagaggactatctcgggacaagaacagcaaatggtgcgtcccttatgaaatgtgcccgggggagcatttcccaccgtgtttgtgcggtgggggctatttgacaactccaagcaccatcaaagccgtcttggaacaagctcacaaaaccaacagcttttatttggaggacgtgcttgctgtacacgggcattttggccgagtggggcaatgtgaccgtatcggaccaattgagccatttttatgggaatggattgcagtttgaatgtg

SEQ ID NO: 88424 - DNA, 197 bp, Heterodera glycines
  SCN-specific regions: Sequence locations=1-197
ggccgccaccataatggttgccaccaccataattgttgttgtcatgatgatagccaccagaagcaggcggacgagcaccatatttgccatcgtgctcgtccgacttatcgtatttgccagaaatgccaatgtgaacaagtgccaagaaaagaattgacaaaagtgtaaatttcatttttaaatttgctcaaacttgg

SEQ ID NO: 88425 - DNA, 108 bp, Heterodera glycines
  SCN-specific regions: Sequence locations=1-73,104-108
ggccgcaaagaagagtcacaagagacatcgcagcgactcggacagtggggacgaacgtaagaagaagaagcacaaaaaaaaaaaaaaaaaaaaaaaaaaaaaacttgg

SEQ ID NO: 88426 - DNA, 154 bp, Heterodera glycines
  SCN-specific regions: Sequence locations=1-8,37-47
ggccgccaggtcgtcctagtcgctcgccgaagaagtgaggggcgaggagtcgtcgctcgcccgccggtcgtggaggaggacgttctcagacgccgcgcaagaagaaacaaccgctgaagaagaaggcgccgggcccgcgcagtcgcactcctgg

SEQ ID NO: 88427 - DNA, 235 bp, Heterodera glycines
  SCN-specific regions: Sequence locations=1-235
ggccgccaaggttggaggtgcaaattattttttaatactattcaagatggtgcgcggactaatcaacaaatcgcgtgacgaacaaattgaacaacaaaatgctcgcattgccgaacagcaacaagtcattcgagagtgtaaaacattgtttcgtcatgtcagtgcgcacagcaataccatcagttcggccttgctaatgttcacagaagatcacccggagttcgccgcgaattgc

SEQ ID NO: 88428 - DNA, 565 bp, Heterodera glycines
  SCN-specific regions: Sequence locations=1-565
ggccgccaagagccattctttcacttttgctcactctcatttttcactgaaaaaaaccatcgccaaaaagtaacatggaaaccaagcgcaacaactacaacaacatcgactcgttgtggagcactttgtgtgacctcggctaccaaacctcgcagggattggcctactccgtcggcatgcccaacttctcattcggcgccttcattttgctgtccgtcatgacttggtgctgctttttcatgccgcccgtggctgtgttcttccgcggctatctgcgcgacgggaacgcgtgcactgagcatgtcatttacaacatcattttgtgctttttcctgtgggtgcccggcatggggcacgccttttggtactgcttcagcgacatgttcagcgggccgaagaaggagggcgccgggtacagcaaaaatgcctgagcagaagagcactggcgggcggacgaacgcagaaatgagcattctttgaaaaatgacgtcatcgatcttattaatttttgacacctaattaagcgataattaattatctctctcacccttttttcatcttgtaa

SEQ ID NO: 88429 - DNA, 184 bp, Heterodera glycines
  SCN-specific regions: Sequence locations=1-184
ggccgcaaagcatcaatatgctgagacaattgaaagactttgtctgtggggtgaattctacgaatagacggcactctgtgaggggttggccatcgtccaaacatttgacgaggcacaaaaactgctggtggaatgtgcaattaaaaaagatttcctctatggaaaggccttcggcgaagggccg

SEQ ID NO: 88430 - DNA, 170 bp, Heterodera glycines
  SCN-specific regions: Sequence locations=1-170
ggccgcgcaacaacttagcacctcactgcataataacaataaaacctctgccgtcgcatatggaaaaacgtcaaatttggaagtgaatttgccggcacttcctccgattgtttgtggacaatttgtcatcgcactgcttgaactacccgaacgggtgtttcccatttatg

SEQ ID NO: 88431 - DNA, 244 bp, Heterodera glycines
  SCN-specific regions: Sequence locations=1-244
ggccgcccaatccaaacttggaatttaagtttttgtggtagctgctccacattaaagccatagtcggaatcgtcgtcaccacttcgcccacctgcagcctgtgaagaatggtcgttttgccagcaccgtcgaggcccaatattagtattcgcatttcccgatgaccaaacaaagacttgaaataagagaataggtgccccatccgcaaaaaaataaatcaggaataatcaaacctcaaacttgg

SEQ ID NO: 88432 - DNA, 246 bp, Heterodera glycines
  SCN-specific regions: Sequence locations=1-246
ggccgcccaaatcccaaacttggaatttaagtttttgggggggctgctccacattaaagccatagtcggaatcgtcgtcaccacttcgcccacctgcagcctgtgaagaatgggcgttttgccagcaccgtggaggcccaatattagtattcgcatttcccgatgaccaaacaaagacttgaaataagagaatgggtgccccatccgcaaaaaaataaatcaggaataatcaaacctcaaacttgg

SEQ ID NO: 88433 - DNA, 456 bp, Heterodera glycines
  misc_feature (381)..(381): n is a, c, g, or t
  misc_feature (416)..(416): n is a, c, g, or t
  misc_feature (453)..(453): n is a, c, g, or t
  SCN-specific regions: Sequence locations=1-355,438-456
ggccgccagcagaaaaatgccgcgtcaaacgcgcagatttaatggaaaaaaccaggcccctgagcaaggcggacaagttgcggggcaggcaaaatcggctgctcgcgcaaagccatcccgactttttggaggagcggcgcagtaagcggaagcagtacttggacgaaggggttgagccaacattttttgacgacgcggcggaggagggcgaggcgcaaaacggagcggcactgaccaacggcgccaccgccgccggcaaaaaggcgtcgtcgcggcggaagcgcggcacggcggaggagcaggcggacgcactcttccgcaacattcaaggggaccaattggacaatttgacgacggatgatgaggaggaggagggagcanaaatggcggatgaagaggaggaggaagatgttcancaggagggggaggagaaggggcttggacaggatgcanagg

SEQ ID NO: 88434 - DNA, 428 bp, Heterodera glycines
  misc_feature (176)..(176): n is a, c, g, or t
  SCN-specific regions: Sequence locations=1-88,110-428
ggccgccaagtgtggagcttaaattaaatcttgcaccagtgctgttttcgtaaaatgctttctcccttctcctacgacccgttctatcgccacgtcgttgtgggctatgggcactcatgtgggcaacgtcctttcgcccttccgccagtgggagcgtgaactcgaccacttcttcnaggggatgcagcccatgcgtcgtgaccatgtcgctcagctgaacgtctcggacaagggggacctcacttacaaaggcgatgtgagcggcttccgccccgaggaaatcaacgtggaggtgattggtgatgagatcatcgtgaacggggaacaccgcgagcagaacgacagcgaatcggtccaccgtcagttctcgcgccgtgtgcgtcatcccggagggggtccaaaaggagagcatcaagtgcgagctggac

SEQ ID NO: 88435 - DNA, 327 bp, Heterodera glycines
  SCN-specific regions: Sequence locations=1-295,322-327
ggccgccaagcccttttcctaaaattaatttacaaaatggggtccaagcttcttccgggcattctctgctgcttgtttttggcttctttcgccctctgctcgcccaaggctgctgatgtgctgaaattcaaacgagaagctgcgatcagcagttgtggagctggacagtttgaatacgggggcggctgttgtgcgacatgcacaagcgatgctgattgtgcgggcgggaagctttgtgtgcccatcctcaacttgctcagcgtcagtctgtgctttgccccatgcggaaattaagacagaaaagaaagcagcaaatgagggtgttga

SEQ ID NO: 88436 - DNA, 532 bp, Heterodera glycines
  SCN-specific regions: Sequence locations=1-308,330-532
ggccgccaaggtgggagccatgttgtccaaaaagagtgaaggggggcagcaattgcacttgaagaaggactaattgacgtaacacgaaccgactccgaatcgaagccaatttgggacgatgccatccccctaaaccacgtggtcgtcgtcaggcgaagccgcgtcaaattgcgctccggcgtgccaacggggaatgtgtcctccattgagtcggcaaatagcaactcgctgttcctttactactcatacagacgaaatgcatacgcatggggaattagggagtgcgtcatcaaattcgagacgaatacggacgttgaaaaatggtgaactttgctgggaaatgcactcaccgcccaaaaacaccgaccgaaacgtctgtgggggtgcatcaacccattcggtggcgaaggagacgcaatttccatttgggagaaggaggtggagccaattttcaaattgggcaacatccaatacgaagtgcgcaagaccgaaaggggcgaccacgcgttggaaattgtgcgcgagttcagcg

SEQ ID NO: 88437 - DNA, 205 bp, Heterodera glycines
  SCN-specific regions: Sequence locations=1-125,147-205
ggccgccaagtggaaatccaattcaatttttgagttaaaatgagctgctccttcttcctctgtctcttcactgttcagctgattctgctcaatttcgcagtcgaaggaagagaagacgatgaactgaagagaaagaaacgcaacacggacgtggacgtgctcggcctggtaaatattcacgcgccgtcgcgaaagagtgtgaacg

SEQ ID NO: 88438 - DNA, 216 bp, Heterodera glycines
  SCN-specific regions: Sequence locations=1-179,201-216
ggccgccaagagcccggacagcccggcgagaacggacagcccgggcagcctggaaaccccggcccgaaggataccctggcgacggcggaagccctggccaacccggcaaccccggaggcagcggcgagcccggacagcccggagcacagggatccagcggccaatgctaccattgcccaccgccccgcaccgcccccgggtactgagtgtgatcag

SEQ ID NO: 88439 - DNA, 224 bp, Heterodera glycines
  SCN-specific regions: Sequence locations=1-224
ggccgccaagggcgaagatgcgcagtactgtccttgccctccacgaacccaaggcgtggacaagcagccaacttatgagacgggcgcgtcagttcccgtggccaaaccgtacgaaacaaagccatacgaagtgcccaagcagcaaacgacgtacgacgtgaaggcggcggtggcgcccggagggtacgaatcattggggggggtcaaagcggcggcggcgcccg

SEQ ID NO: 88440 - DNA, 228 bp, Heterodera glycines
  misc_feature (31)..(31): n is a, c, g, or t
  misc_feature (216)..(216): n is a, c, g, or t
  SCN-specific regions: Sequence locations=1-115,137-194,216-228
ggccgcgaattgctttcttctctccctttantgagggggggagggagtggcgctgatatttgtgaatttatttttgggctttctctgctcaaatgcgactcgttcagcttctccatttggggctgcttgtgcagcttttgcgggggcctgtgcttttgggcgtggggcaaaccgatgaaaaagtcaaacgaatgggggagagagagggggcccccnaggggaatttgg

SEQ ID NO: 88441 - DNA, 167 bp, Heterodera glycines
  SCN-specific regions: Sequence locations=1-167
ggccgccaagaacgtcctaatttctgaaaccccattctccgaggggggctccctccattcgtctcatcaccacgtccaaggcgcctcctgcgacggggcacagccaggcagtgctcctcaacaaccagacgctgtacatcagtggccagaccgggatcgcggcgggg

SEQ ID NO: 88442 - DNA, 137 bp, Heterodera glycines
  SCN-specific regions: Sequence locations=1-57,79-137
ggccgccaggctgattctgctcaatttcgcagtcgaaggaagagaggacgatgaactgaagagaaagaaacgcaacacggacgtggacgtgctcggcctggtaaatattcacgcgccgtcgcgaaagaatgtgaacg

SEQ ID NO: 88443 - DNA, 138 bp, Heterodera glycines
  SCN-specific regions: Sequence locations=1-58,80-138
ggccgccgaggctgattctgctcaatttcgcagtcgaaggaggagaggacgatgaactgaagagaaagaaacgcaacacggacgtggacgtgctcgggctggtgaatattcacgcgccgtcgcgaaagaatgtgaacg

SEQ ID NO: 88444 - DNA, 273 bp, Heterodera glycines
  SCN-specific regions: Sequence locations=1-273
ggccgccaagaaaaaaaaaaaacttttccaattttccctcaaatgtggtttcgaattaaaaaatgggccctctcttccatcgcttctcatctctctttgtgcttctgatgccgtgcctttccgtggtgcttctcccgtcaactgtgtgtaccggctctgacagtgccgccgcgccgttcgaccgaaagaattatccgaaaatcgatttgcgactgtgcgagtgggccattgcttcacattcgggctcgtccgctgaggtgtcttttatcgccg

SEQ ID NO: 88445 - DNA, 405 bp, Heterodera glycines
  SCN-specific regions: Sequence locations=1-405
ggccgccaagcgctcagcgtcccacgacccgaagggagagaaagcgcgatttctcagaactgtgccaccgggagcaacaacaaattgttgctgttgcggagttgtgaacagttggacgaaagcaaccgaatacgcacttgtgcagtgcccagaaaaaggatgcacatgaatctcaccggactgccaaggcccagggtggagcgtggacgccgtctcttcaaatgacagtctcagcccggaagagctgaccgatcgattcaaacaaatcgaggccaagtcgggccagctcagcatcggtggccaagtgttcaatgtgcagcccaaagaccttgaacggatggaccagcaggggggtcaggtgggcaccggtgccagcggaagtgtgtgcaaatatcggttcagaag

SEQ ID NO: 88446 - DNA, 382 bp, Heterodera glycines
  SCN-specific regions: Sequence locations=1-162,186-314,336-382
ggccgccaagtcttccacaaagtcttctcacgttgtgttgcgaaacttcgatgggcgcaatgtccattgagttgtattggcaacacgcgccgcggacttgcatgaacttccaggaattggccaggaaaggtgattacaacaacacaattttccaccggataattgctgattttatggttcaggggggtgatccgacacggacgggcagaggtggcacgtccatttacggcggtcgatttgcagacgaaatcagtgacgatttgcgacacacgggggccggcattatttccatggcgaattcgggtcccaacaccaatggttctcagtttttcattaccctcggcccaactcagcatttggacggagagcatacaatttttgg

SEQ ID NO: 88447 - DNA, 450 bp, Heterodera glycines
  SCN-specific regions: Sequence locations=1-390,412-450
ggccgcgaattgctgtcttctctccctttagtgaggcgggatgtggggaaagtgaaagtttatagaatctttcaaaattcatggtgtaaggagactcacaaaatgaatcccaaagtccctatactctattaagcggaattacggagattctcattgtattttctttttggtgtctataaattccagcagactttgtggtgtggacgcgtgaactgcgctaaagcctgtgtttaattaccatggagactgaacccataaaatcaacagcggaaaccgctgaaccggacgtctgtgacactggtcaacatggcgacgcataacttccagagcgctctgttcatttccttcagttgttgcccggcagatcattggatgtgaaattgtatggcgacattcaaggtggtggcaaatttgatgcggcggagccaaggaggttcaagtgttatcttg

SEQ ID NO: 88448 - DNA, 177 bp, Heterodera glycines
  SCN-specific regions: Sequence locations=1-177
ctgtttgatccttgcggcaacgcgttggagttaaggcgtgaagggtattgggcagttgtttgccaagtgagggcgctttgatgaatggcctcgatgcagcgggcatcgccgaggcggtgggctctggtgcaattacgcctgctttgggtgctgaacactttcttgggctgatcggtg

SEQ ID NO: 88449 - DNA, 503 bp, Heterodera glycines
  SCN-specific regions: Sequence locations=1-4,38-503
ggccgccaaggttttatttctgaaatgaaaacttcaaagagcattagaaagcagaaaaactgcttcacaaatgaagtgaaaaaggaatgcccagaaggcagcagagaaccgcgaaaatgttgggacgtcgagcaggttaattgtgaagaatttgccgtgtggcaaaaagacgcgatgggacgaggccaaagttcgagcgcgcttctccaaatttggcactttgacggacgttcggctgaaactcagcgaaaagaccggagcttgcaaatttgcctttgtcggcttttcatctgccgaacattgccaaaatgccatcaaagcgttggacggcgcgtacattggcggctcaaaacttacggtcgaagagtgtgaagcattgacaactgaccgaacggcgatcaccaaacaactttcgttgaacaaacgcaaaaaactgaggcgaaaaggcgaatgcgaagttgatgaggaggaggacaaagaagaagctgccgaagaggcggacg

SEQ ID NO: 88450 - DNA, 267 bp, Heterodera glycines
  SCN-specific regions: Sequence locations=1-90,142-267
ggccgccagggccgattacacatttccttctctccgttgctggcgggaactgctgccactttcaattgcccttcacgggaatggctgacactcctcctcctcctccgcctcctcctcctgctgctgctgctgccgctggtgggggtgatgaagccgttgatttggagcaacgtgttcgccaactcatcatgtgcatcgggctgggaaacgaagacgcagtgcgcgagatttccattctgatcgagtcattcaaccgggagcagttcg

SEQ ID NO: 88451 - DNA, 329 bp, Heterodera glycines
  SCN-specific regions: Sequence locations=1-329
ggccgccaaattggtgttctccaaaagtcgaaccaataagctgcggaggcctcctgcagagctgcaaaggccaccgcctgaaagcgcatctccaagttgttgtgctgtgcaatttcgcgcaccaaacgattgaacggcaacttgcgcagcagaagttcagtggtgctctggtaacggcgaatctcgcgacggggaacggtgcctggacggtgacggtgcggcttcctcgtgccggtggcattcgatctgcgggccattgaaacaatgtgtttgcagagatggattattgtgtaatatgtgtatatgtgttcggtaacgctcaaacttgg

SEQ ID NO: 88452 - DNA, 488 bp, Heterodera glycines
  misc_feature (337)..(337): n is a, c, g, or t
  misc_feature (339)..(341): n is a, c, g, or t
  misc_feature (348)..(349): n is a, c, g, or t
  misc_feature (352)..(353): n is a, c, g, or t
  misc_feature (359)..(359): n is a, c, g, or t
  SCN-specific regions: Sequence locations=304-359,404-407,439-488
ggccgcggctcatcacgttgatgcgcctgcgaacgacttgcggagaaacccatgaaactgcgtacgttaatgctcggtgctgcactggccctgacggctgtaacggggatggcgcaggctgacaccgcccccgtcgtcacgccttatcactacggcgagaagatggatgtgcaaaaggtacttgccatgcacgaacccgacaccaatgtctgcaaagtgatcaacgccgatatcaagttcgtggatagtcaagggaaagtccaggacgtgggttatcgcaaactgtcggaagcctgcgattgggagaactgatcccgtgcacttgtggggaggagcnannncttctcnncanngaaacncgggagttctgaattgacgccgtgactttgcgttcttcgcgagcgaggtcgctcctacatgggtatccttgagcgctcgctacgggtgaaaggattccccatgcaattggacttccgtcccctcgctac

SEQ ID NO: 88453 - DNA, 716 bp, Heterodera glycines
  SCN-specific regions: Sequence locations=1-454,477-716
ggccgcgaattgctttcttggccgcactgtctcaccgtgacgcatgtgtgatcgcatccactgatgagcagaaacaaatggccaacacagtgagggacgaattctccaagatggattacagtgaccatttgatgcttatccgtgcgtccaatgccttttcgagggttaacggctcctgcagagaacaatggtgtggggcccgactgatcagcgagtcggcgatgcgaatgatttgtggaattcggcatcaattgttcattgagcttcgtcgtcttcatcttctgccttctcgcatgacgaatcctgatgacaacatgaacaatctcaatttgttcgcctccagttggcccatggtccagggatgcattgtggcgggcgcttacccaaacattggcttcgtccgatttggttcgaaactgaatcgaattcgcaccatgggctccaagaattgcgtccttcatcccagctcttgcctcaggcgtcaaactgccaacccatccaaacgatctgcgaagctcaatgaagtttttagccagaagggatccgagcctatgcttcagtatcttatttatcaggaattggtcggtgatacgcaccagcaacacatggtcccaactgtgactgctgtcacatcgctacacattctgttatttgcagggcctgtgcgaatggacctcaaatgcgtgaaatattttgaacttgttgatccacacggt

SEQ ID NO: 88454 - DNA, 153 bp, Heterodera glycines
  SCN-specific regions: Sequence locations=1-153
tcaggtgcgcccaacaacaacacaatgacttctcactttctcgtcggcgctgcagccttcggggcggaatctgcttcgcgaagacgtacatggagaaaccgaagagcgaagacgacaaagaagcgcccaagaaggaagaagccacgaccgggg

SEQ ID NO: 88455 - DNA, 330 bp, Heterodera glycines
  SCN-specific regions: Sequence locations=1-205,227-285,307-330
ggccgccaaattggtgttctccaaaagtcgaaccaaataagcttcggaagcctcctgcagagctgcaaaggccaccgcctgaaagcgcatctccaagttgttgtcctgtgcaatttcgcgcaccaaacgattgaacggcaacttgcgcagcagaagttcagtggtgctctggtaacggcgaatctcgcgacgggcaacggtgcctggacggtaacggtgcggcttcctcgtgccggtggcattcgatctgcgggccattgaaacaatgtgtttgcagagatggattattgtataatatgtgtatatgtgttcggtaacgctcaaacttgg

SEQ ID NO: 88456 - DNA, 218 bp, Heterodera glycines
  SCN-specific regions: Sequence locations=1-218
ggccgccaagtttgagctgctgatatatttattctgaagaatgcctgtcgtaaaaccacaaacggacagcgaatttacaaaatttcttttaaacgttgggactgctccgtgtattgttgatttttttgctacttggtgccaaccatgcagtgcgatcgctccggtttttgacgaattatccaacaattatcttaatttgaaatttgttaaagtggatg

SEQ ID NO: 88457 - DNA, 130 bp, Heterodera glycines
  SCN-specific regions: Sequence locations=1-130
cacgcgagccgccgcctccccaccaccggtgcgaccgggcggacactcacgagagaaatgtcccggtttgttgcagttgtggcagacattgtcaccgcctcccccgcgcgaccctccggacaaaagttgg

SEQ ID NO: 88458 - DNA, 372 bp, Heterodera glycines
  SCN-specific regions: Sequence locations=1-372
ggccgccaagcaaaaggtacaccgagttgaccggtgccgacattgaaatgcgttccgcttcgctgttcaacatcaaaacgttgacttcataccaggagttgcacccgttcttccatgcgttgaccatgcaaaatggcactggacgaaagcagcgacacatttgcaatggacaaatggacgacagaagcagcaccattagcaacggtgttggaactgatgcgggcgaacgggaggaggacgaatttggcagcgaaagaagcaattcggaacggaaaaagaaaacaatggccccacggcttcgcgacgccgagctgctgaacggctcgcactcgttgaagagtgccgtggctcgcattgaacactcgctgtacg

SEQ ID NO: 88459 - DNA, 240 bp, Heterodera glycines
  SCN-specific regions: Sequence locations=1-199,225-240
ggccgccaagtggcccatcaggaccccctggccagcccgggcagggcggggagaacggacagcccggccagcctggaaaccccggcccgcaaggataccctggcgacggcggaagccccgggcaacccggcaaccccggaggcaacggcgagcaaggacaggctggagcacagggatcaagcggccaatgctaccactgcgcaccgccccgcaccgcccccgggtactgagtgtgatcag

SEQ ID NO: 88460 - DNA, 163 bp, Heterodera glycines
  misc_feature (118)..(118): n is a, c, g, or t
  SCN-specific regions: Sequence locations=1-163
ccccccccacttaatcggccgtgtgtccgtacttgaaacagtgccaaaacaattattgttgttaggacatttttttcttcatttcttctcccgggttttgttgaatgcgtgtgtttgnttcccatgaataggacacaaacaaacgcactcaaaaaaaacttgg

SEQ ID NO: 88461 - DNA, 240 bp, Heterodera glycines
  SCN-specific regions: Sequence locations=1-240
ggccgccattgtaaattttgctaacacctcctacattccttgtgcgatttgttctcataaagccaccgggggctttcgggcagaaaccaaagccacaaattggacaacactcggaattgcagcaaatccgaccattagtctccagccccaattcaacggatcaatgtaggaaaacgcgaacgcaaaaatatgtgctgctactaagccaaaagtgatcatcagctggaagctggtgatcag

SEQ ID NO: 88462 - DNA, 169 bp, Heterodera glycines
  SCN-specific regions: Sequence locations=1-95,117-169
ggccgccaagcttggcggtggtgacgagacagttggacagacgagggagcggacgtcgtttagcatttaaatgaaagtttggtgtgcctctggctttgcatttgctgcaacaattacctagcaataccaagccgatttcttacattttcaaaaaaaaaaaaaaacttgg

SEQ ID NO: 88463 - DNA, 207 bp, Heterodera glycines
  SCN-specific regions: Sequence locations=1-207
ggccgcaaaggtttgaggagaaaatgctagcactcgttttggcggtgttgtcttcatttttgcattgcttattctggaaattgatggttgttatcggcgtcggaaaaaggacaaggacagtaacgagagcggagagaaaaagcacgcaaaaaaagaggataaggagtcgaacaagtcaagcaaacgcggaccgcgagggccgcctgg

SEQ ID NO: 88464 - DNA, 556 bp, Heterodera glycines
  SCN-specific regions: Sequence locations=1-44,81-385,409-556
aggttggagttcgttccttttcctgcgtgtgtcttggttgtcctccccttttctccccctctttttcctttctttgccaattgcgtttgttttgtccggccgaactttgccgttcaccggttcgcaattggccaatgaagtggccagggcattttttaattccgtcaacacttgggacatgtgaattttcggagccgggactaagcagggggaggaccgttacaagatcagcttggacggcctggacagaatgaagaacagattcagagtgccgttgccggcggggcaggggttggaaaagctgctcaaatcgtacagagttgagcctctcagagaggattaccttggggtgaacaaagccagagaaagagtgtgggcaccgagtaaactgatggaactgatggaaaagctgggcaatgtgctggttacggacccaaaaatgcgccaaaagatcgacaaatacgacaaaaaaagagcggatgaggcggcgcgaatggcggcgatgatgccaccaaggcgagacccacaagcgattgcaaaacgcatgacgtggccg

SEQ ID NO: 88465 - DNA, 119 bp, Heterodera glycines
  SCN-specific regions: Sequence locations=1-119
ggccgacaagattctttcccccatcggtcgaatcttcatcctggtgtaccgatggtcagagcaacaacggccaggacaagggcatcagcagcgcgagcacggagcatcaaaaccaatcg

SEQ ID NO: 88466 - DNA, 139 bp, Heterodera glycines
  SCN-specific regions: Sequence locations=1-55,77-139
ggccgccaggccttgttccgttttccttcttctgatgtcagagtgtgccaggctttgctttctgaggaagcggagtatccgtgccaaaatgtcaaagccaatgaacgcgtcgtggctttggctgttttgtccgcgttcg

SEQ ID NO: 88467 - DNA, 210 bp, Heterodera glycines
  SCN-specific regions: Sequence locations=1-90,113-210
ggccgcgaacaattggccaatgccggcgggcggtcaccgaattcatgcattttgtgattgaggcgaaggctttgcgaaaggtgttcatctccatcaagggagtgtattaccaagcggagattttgggcgaacgcgtcacttgggtggttggccacgaaagggccgtcggacgcgccaacgaattggacttttcggtgatggccaactttg

SEQ ID NO: 88468 - DNA, 204 bp, Heterodera glycines
  SCN-specific regions: Sequence locations=1-49,71-204
ggccgccaagatttcggagaaatgaccgtatatgaagttatgaacattttaataatcagtagataatttcaatcaattctcatatttttcattgtctacagtctgatcttacgcgtcttcgtcgaaactttacaccgatggaaattcagcgtgatagccatttacgaagtatgaaagagcttctcagcacgatggacccgcaag

SEQ ID NO: 88469 - DNA, 171 bp, Heterodera glycines
  SCN-specific regions: Sequence locations=1-171
ggccgccaagcttccatattcatcataaaatggaattacgacttttatttgcttccctatttgccctctgggcagtgacagcggcgatgcgcaagcagggggttgccatcagcggaaaattcgtgtgcggccacgcgccggccatgagcaattcgaccaaagttcgcattg

SEQ ID NO: 88470 - DNA, 130 bp, Heterodera glycines
  SCN-specific regions: Sequence locations=1-130
ggccgccaagaggatttgcgccactcctcgattctttcgaagcgatgttacgccctaaattgttacatgcgtgtccgcgatgtttttgagcggccaattggcggtgtgccaggggcgaaagataaattgg

SEQ ID NO: 88471 - DNA, 221 bp, Heterodera glycines
  SCN-specific regions: Sequence locations=1-49,79-79,101-180,207-221
ggccgccaaggtttctacaaaaatcaaagcacaaatcaaggtcactgtgagagatggcaaagtctaagaaccacaccagtcataatcaaaacagaaaggaccaccgaaacggcattcacaagcctaaaaaggagcgttacatgtcgatgaagggagtggacccgaaattcttgcgcaatttgcgttttgccaagaaacacaacaagcggaatgtgaaagcg

SEQ ID NO: 88472 - DNA, 174 bp, Heterodera glycines
  SCN-specific regions: Sequence locations=1-13,35-174
ggccgccaagctctttgtttcgtgatttgttctcatcggtcccttaaaagcgtatatgttgatgtaccgacaaattgatcacagccaaaacgaacatttcgtcaggagcaccgaacttcctgagcatttgattctgctcaaggacaaattggaggcggaggaggaagaacgaag

SEQ ID NO: 88473 - DNA, 247 bp, Heterodera glycines
  SCN-specific regions: Sequence locations=1-33,55-247
ggccgccaaggtttgagataaaaatgcgcttcttctttcttctgacgcttgctcttctctccgttgttcttctcctttccccaagtgcactcgcaaagaaaagagcccgccgttcgatgcccgttaacgctgccatgccggaatggaaaattttgtccgctgaagtggaaaacgatggcacagcataagaaggaggaggcgaactttggatcatcggcatgatcgaagaaggaatttgccaaaatga

SEQ ID NO: 88474 - DNA, 509 bp, Heterodera glycines
  SCN-specific regions: Sequence locations=1-27,49-104,126-413,436-509
ggccgccgagaaggcggctgctcgcaaggctgctgccaagaagggccgcgagcatgccgcgaccgaggccgaccagaggaccgccgcgcgcaaggccgccgccaagaaggcagccgcgacccgcgcggcgaacaagacgtcagcggccaaggccagctgaccctggggggagctcccaggctgatatgagaagcgactgcccgctctccggaacgccggggagcgggtagtcctacgttcgatccggaagatcggatggagcttgcgggctacacgaacaaggccaagcagtggctgggtcctttcgggcaggcgtcagctgcggtagaccacgaccttgtcgccgacgtggacccgctggtagatccaggcgatcttcgaccagctgcggatgttgacacaaccgtggctgcagccgtagtacccgcgacgggcgaagtcgctggagtagtgcacagcctggccgccgctgaagaacatcgagtacggcatggacgagtggtagatcg

SEQ ID NO: 88475 - DNA, 145 bp, Heterodera glycines
  SCN-specific regions: Sequence locations=1-80,104-145
ggccgccaagagcggaatgaaaacggctgacaaggcggacgaaccattcccattgaaatgaagaagaaggcggccgtggaccagcagaaggaggaggagaagcagtagaaaaggacggcggaagtgaagacggactgactgtcgg

SEQ ID NO: 88476 - DNA, 145 bp, Heterodera glycines
  SCN-specific regions: Sequence locations=1-145
ggccgccaaggtccttaagagcgtctaagtcgcattcgcgcatttatggaggcattggagaagtacagacaaaaacagatggactcactgcatgaaacgtacagtcgccgcgtttcggccatccgcgacaattaccattcccaag

SEQ ID NO: 88477 - DNA, 126 bp, Heterodera glycines
  SCN-specific regions: Sequence locations=1-126
ggccgccaggaggatttgcgcactcgtcgattctttcaagcgggtacgcccgaaattgttacatgcgtgtccgcgatgtttttgagcggccaattggcggtgtgccaggggcgaaagtcaaattgg

SEQ ID NO: 88478 - DNA, 268 bp, Heterodera glycines
  SCN-specific regions: Sequence locations=1-268
ttcgaaaatgcatagtttagtataacatttaaaggtctgtataattttacaaggatcgcaaaagtttcttgatagaatatttggtctctttcagcgctttcatttcaattgtcaatccaatgaatccgtaccaaaaggaaaagccaatgaacaaagcgagcataaagcgaaataaagcaacggcagcgtaaacgtatggcactgtcaaatcgatgtttgcggtggcaacagtcagcgcaattaaaaccacgcagagaccaaggaaaag

SEQ ID NO: 88479 - DNA, 328 bp, Heterodera glycines
  SCN-specific regions: Sequence locations=1-328
ggccgccgattccgcacgggttccggctccacgaagatctaggagaatctagaggggcctccccccctgccttccctattagcccgggtgccgcgcggaacaagcgccggccccgggctaatgtgctgcttcgtcccagttggtgccggttccggcggagacttccagcgggacgcgcagtgtgatggcgcggggcatttcctcctcgacgatcgcttgaacctgctcgagctcgccgggggcgatttcgacgacgagttcgtcgtggacttggaggaggacgcgggattggaaaggttggtcgcgggaggcgtcgttaagcgcggcg

SEQ ID NO: 88480 - DNA, 171 bp, Heterodera glycines; identical to SEQ ID NO: 88469
  SCN-specific regions: Sequence locations=1-171

SEQ ID NO: 88481 - DNA, 298 bp, Heterodera glycines
  SCN-specific regions: Sequence locations=1-298
ggccgccaagattctgaccacgcatcgctgaagagagagttgaaaagtttgctgaaaaaactacgaaaacaaaaatgtctggacgaattaaaaaaagcaatcattgctgagggcaaatacgtcaaatgtgtggtgtacaaaattccagagaagcagcaaacaccctatggtggacagatgaagtcatttccgcatttcatttgctgtaaaatttgcagatttcctgatttgctaactcatcaccaacttcgtccggttgctcaatgtttgcatcccttcaacaaagcccagaaaatgg

SEQ ID NO: 88482 - DNA, 280 bp, Heterodera glycines; identical to SEQ ID NO: 88278
  SCN-specific regions: Sequence locations=1-280

SEQ ID NO: 88483 - DNA, 267 bp, Heterodera glycines
  SCN-specific regions: Sequence locations=1-267
ggccgcaaagctcaaaatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtacggcggcggaatgggcggcggcggaccatggggaggaaatttcggaaagaaatgagaagggagcaaaatgtggtgatcaagacgaacagaacaagccatttgattgaatat

SEQ ID NO: 88484 - DNA, 196 bp, Heterodera glycines
  SCN-specific regions: Sequence locations=1-196
ggccgccttcacttttccgttcgccttcgctttgccgccctttccgctagccgtcgtcttcgtagtcgcttttccggctttcactggagacgccacttgagactcctgactgttggtcgtaccggtcgaagcagcggaggcaccacggttgtcagacattgagttgttgttgttggttgagaaaaaaaaaacttgg

SEQ ID NO: 88485 - DNA, 456 bp, Heterodera glycines
  SCN-specific regions: Sequence locations=1-40,62-456
ggccgcaaagctgacatataagcgtctgtctccttcttcattttgttccccttttgactgcacttcagcaacaatgctcatcagagaatatcgcatcgtcatgccgttcgccattgaggagtatcaaattggccaattgttttctgtgaccgaggcatcgcgacaggagaccggcggtggcgaaggcgttcaaatggtgcgcaacgagcccttcgaaggccaaagtctgttcaatggccgcttcacgtccggacagttcacgcacaaaatcatccacctagatacaaaagtgcctgctcttctgagggcgattatgccaagaggttcgacgacgctgcatgaacggtcgtggaacgccttcccgtactgcaaaacggaggtgaccaacccggactatatgaaggacaactttctgatccggattgaaacaatgcacttgagcgaccgcggcaccac

SEQ ID NO: 88486 - DNA, 495 bp, Heterodera glycines
  SCN-specific regions: Sequence locations=1-218,240-495
actgtaacggccgccagtgtgctggaattcgcccttcgcggatcctatactttttttgatttgctaaagtaaaaatggcttatttagagttagttatggcgttgattaaaacattgacaaatgacccctttatataggggcttggggaatccaatcacagcaacgcaaattaaggctttccaatcaagtgtctttttctttattgtcattccctttagaaaaaatatttaatttaatttccatttgagtaaacatgtactctatcgaaatacacgaaaaggtagtccatgcctaaaggtagcggcttctaatctcttagaactagtttaggttgaccaagaatttcgagatgagtgaacaaaagactaaaagcaaatcaaagtgtttgaagactatagagaaaatggaatggagggaaaacacatgactcccaaaaatactttagaaatatgttcgagctttaaatatatgcacttatgatataagaaatattta

SEQ ID NO: 88487 - DNA, 209 bp, Heterodera glycines
  SCN-specific regions: Sequence locations=1-209
ggccgcctcataagagcaaactgagcaaaatggacgaacggacgcggctggcacacattcggctggtggacaccatggaacataacgtaaagcatgcggaggagctgaaggcggacaatgcgaacaacgaaaacaaagcgttgggcgaactgcgcaagagacaaaaaagcgggaaaatccgcgacggtcggcacatggaagggatgccg

SEQ ID NO: 88488 - DNA, 375 bp, Heterodera glycines
  SCN-specific regions: Sequence locations=1-18,42-375
ggccgccaaggttcgatgcattttccaaattgtttttgcttttgcctattttgcttctccatctccaacaatcccaagcttgcttttcacgtggcaacagtggcgaaccgtcggatggcaatcccgaggcccaggggctaaaatcggaaaacgatgttcggactgttcagttgaagaaggaaaaacaaacggatgaaacggaagaggagaaagacgaggaaagttcggcagaacaaaaattgccatctgaattggacccggaatttgtgaaaacttatctgcgagaatttggtcatctgaagcacaatgagaatggcctttcccatggcgttaagcatttccaacgctttttgggctaccggcagacgggcaatg

SEQ ID NO: 88489 - DNA, 695 bp, Heterodera glycines
  SCN-specific regions: Sequence locations=1-695
ggccgccaaggtttgaggaattaatttcttctcctaaacatgtcccgtccaactccttccgaattaacagtcgaaatgttgaaaaagcgtatcagtggcggacggatggacctcagttccttgcgattgaacaaagtaccaattgagctgatgtgtcgttctcttgcaggacaacgaattacttgtgtggacctgtcggacaatttgctgacttctttttctgctcaattcctccaatttttcccagacatacaagaactcgacttacactccaacaaaattaaacgattacccgaaaattttggtgttttgagtagcctgcgccggttggacctgtctgaaaatcaaataaagaaactaccgatcagttttgctgaactcgataatttgcggtggctaaatttggtcaataatccactcgaaaatgatttggcggaggttatcgggagttgctcaaacgatgaagaatgctcattcgctgctaaaagtgcagtgcaatacgtccaattcttttccacggtttcctccgaatcgacggcaattgcggacacagcatttttgcaaaatgagacttcgtcaacttctaacaattcagacaacataaatgtatcggcacttcgacaagcggacaatgcaaaaaacggcaaaggttttggcagtccgaatgccaaaccccagcagaaacaaattcccgg

SEQ ID NO: 88490 - DNA, 247 bp, Heterodera glycines
  SCN-specific regions: Sequence locations=1-201,223-247
ggccgccaacagacattgcaaaacgaattaaaccgggaaaaggaccatcacatgaaagtgatggtgaacgcgcagaagcaagtcggagagttgagccaagagttggagaaggcattggtggcttatggcaatttggcaaaacagcagagcaatgacagcgcaaagtgtgtggaactgaacgcacggaaccaaaagatgggcgaggaaatcagtcaattgaaaaacgaagcgaaatgcgcctcagagg

SEQ ID NO: 88491 - DNA, 757 bp, Heterodera glycines
  misc_feature (756)..(756): n is a, c, g, or t
  SCN-specific regions: Sequence locations=1-296,318-368,390-472,500 -645,668-757
actgtaacggccgccagtgtgctggaattcgcccttcgcgagctcaattaaccctcactaaagggagtcgactcgatcatgcccattcatcaagaatctagatcatgaagtgcataactatttatgctaaggagtggactaaaagttattgtcaattatattgacacatgttttgtatcaatgtaaaaaataggagtttgcagaaattccattattataggcaggttgcatatgcttttgatcatttactatctcggctttcaacattcacctaataaacacatgaggaatacgaatgtgcaattagcttaagttgggaaagaaaacatgaagcattacgccgtaggcctaaaggactgatagcttatccatttttcttttctttcattctcgtctttccgatatacaatgacaacctacatgttctttgtactgtcagcttaatttaacatgtgatattaagttaattacgtataattattattaaaattaatttttagatttagtgacttgattgtgttaataatttttaaactgtcagtgaatatatcttttaaattcattagtaaacttgctaatccttaaataaaaaatataaaaaggccattgaaaaatcaaatggtagaatacttctctgatttaataaatatatgggaaaagaagtaattaaaaagagtctattaatcttcaacaccacaagtcagataaagatgtcactctgcagtagagggtaaatatcacatcgcattggtactnc

SEQ ID NO: 88492 - DNA, 212 bp, Heterodera glycines
  SCN-specific regions: Sequence locations=1-132,154-212
ggccgcaagaattaattggaaatccaattcaatttttgagtataaaatgaactgctccttcttcctctgtctcttcactgttcagctgattctgctcaatttcgcagtcgaaggaagagaagacgatgaactgaagagaaagaaacgcaacacggacgtggacgtgctcggcctggtaaatattcacgcgccgtcgcgaaagaatgtgaacg

SEQ ID NO: 88493 - DNA, 348 bp, Heterodera glycines
  SCN-specific regions: Sequence locations=1-222,245-348
ggccgccaagcaattatttgttcgtctccaagtctcgtccaacgtctgcatttattgttcatcaatccttcatcggttggcatccgcgcgcatttcaaaatggacgctctcaaaaagcttgcgagccgtgcacgacagaggtcggcggagatcatgctgaacgcggagaagaccgaaattggcgccgagcttgaagcgctgctgaccaagacagacaagacggaggaggacatgaagaagctggtgcatgccatcgaggtgtacctgcagccgaactctgcagtccgagctctggacggtcttggggaggcgatgaagggagcagcatcgagagtggtgggggccgag

SEQ ID NO: 88494 - DNA, 320 bp, Heterodera glycines
  SCN-specific regions: Sequence locations=1-50,77-151,173-320
ggccgccaagaaaaaaggaatgggaagaacacatattcagagatgcaatattgttcatcatcatcttcatcttctgcttctcctccttggcccaagtcctcccatttgttcgcctcgatgggcattctctgcagcacttgtgccctgctcgttctggtgttcctcgtgccgataattgtgcataaggcaaacattttgcgtgcagaacttgaggaaatgtccgttcgattcaagcaaaactcggacagggcgtggcaccaaatgatgcaaatggagccaattaatgataacccaacgatgcatacaacaattgttgcaag

SEQ ID NO: 88495 - DNA, 276 bp, Heterodera glycines
  SCN-specific regions: Sequence locations=1-276
ggccgccaagtttgagaataatcgtattgttcaaaaatgctttcttcttccgcctgctgtactctgttggccgcgctcatttcggcggcgtttttcgccatggcaaacgcacaaacggtgaagcagtgcctgtgctccgaaattcagccctgttccgaaaagtacatgaacacatggaagacatgtatgcagcagtgtaagggccatttttccagcgtgggcggcgacgtggaaaaattgggccactgtttggacagcaaccaggcactgctccag

SEQ ID NO: 88496 - DNA, 395 bp, Heterodera glycines
  SCN-specific regions: Sequence locations=1-128,150-395
ggccgccaagcaagtttgagcgatgtcaacgtcagaagtgaaaccggaagataaatcaatggatgaaactagcaagaatgaattgcgggctgaggacacttccattaaggacaaaggcattggaagcgttaaagaaactgaaacaaatggcgcaataactactgacaatgaacctaagattcacgcagaaaagaacgagactggtgatgctgcagttggccaaaaatcaaccgaggaacaattcgacaaaactgacaagaaagcagagcaacaaaatgttcttgatgtaaacaaaacccaacaagaaccaaaggctcctcttgatgaagtgaaagagacgccacagggagacaactcggaagaagttccaactgaagccattgttgttgatgttg

SEQ ID NO: 88497 - DNA, 727 bp, Heterodera glycines
  SCN-specific regions: Sequence locations=1-727
ggccgccaagtgaaatgtggcggaaaagaacaccagcaaaagcgcgagaaacaaattacccactggacaatgcgcaatgcgcaagtccccagcatttctctgccggaccaatgcatccgttccagccttggcagaacattgacggattggtgaacaaatacacggacaacatgtacgaatttgcgccccgtccgagctgctcaatgggcccggactgtggatcgaagtatttgttctgcgaccgttcccatggcaagccccgatgtgcggccaaagtccgaccgaatggcaattgtgccggattcaccaatggtgaagatgtttgtctgaatggcgaatgccaatatgggaaatgtgtgaaaaagtccccaccgccaaccacgccaaaaccaccgccaattgtgacagtgtcacccattgagtcgccctgctttaatgagcacgaatgttgcgcgaaatgggcagccgacggacagtgcgaatcgaacagcgaatacatgagccaattttgcaaagccagctgcaaaaaatgccaatattcgtacaacatgcaagaggaatgtgctgatcgtcataaaaattgcaaagctttgtcctaccaaatgaaatgcgattcaagctggatggctgaaaactgtcgaaaatattgcaacaaatgcaatgtaaaacgtatgcaaacatgcgctggcggttccccgggggggagaaaaacccacgctttcatatg

SEQ ID NO: 88498 - DNA, 263 bp, Heterodera glycines
  SCN-specific regions: Sequence locations=1-263
ggccgccaaggtttgagcaatgattgattgccattgccatttggcggatgaaagctttaatgaggacattagtcaggtgattgaccgagcgaagcaaaatggtgtcaaagctgctttagtggtcgcagaatttaaggatgattttgagcgaattttggaattgacccatcaatttcccgattttctctttccatgtcttggaatgcatcctgtgcaacgtggacacatttcatgcagtgaagaaatgtacaaaaatttcgaag

SEQ ID NO: 88499 - DNA, 579 bp, Heterodera glycines
  SCN-specific regions: Sequence locations=1-172,343-400,422-433,461 -481,522-529,577-579
ggccgcccaagggcgcacgcttcgttcctcgaccaccgcagcggcaaaccgacaggcggcaatccgcccgcgcttgtgacgatgcagcagcccgtgttggtttgcacctcaagtcgagcggcggaccagcctgagccgttccacatccgaccgagacgcatcgacagcctccatccgcttccctcccggcaatttcaagcactctttaactctcttttcaaagtccttttcatctttccctcgcggtacttgttcgctatcggtctctcgcccgtatttagccttggacggaatttaccacccaattagggctgcattcccaaacaacccgactcgccgacaacgcctcgtggtgcggcagggtcccgggccgacggggctgtcaccctctcaggcacccccttccaagggacttggcccaggtccgccgctgaggacgcttctacagactacaattcaggcgacgctgccgcccgattttcatgctgggctcttcccggttcgctcgccgctactaggggaatcctcgtaagtttcttttcctccgcttaattatatgcttaaactcagcgggtgttc

SEQ ID NO: 88500 - DNA, 139 bp, Heterodera glycines
  SCN-specific regions: Sequence locations=1-139
ggccgccaagcaaatccttccgaattgcccgcaatgtaaaatcgaatgccaaagatgggtttaccacacgtacaattcgtacaccgaagcatttgtccgcaaaccaaaggacaaatggaggcgaaaagctgaacaatgg

SEQ ID NO: 88501 - DNA, 221 bp, Heterodera glycines
  SCN-specific regions: Sequence locations=1-221
ggccgccaagggtctacgaccgaatgatcgcctttctgttggacaataaaaattccgcgaaaatttgcgaggagcttaaattgcgcagaatcgacacgaccaatctgtgggatgtgctgttcgacatgatcattttggacgcatttgaagacatgcaaaaattgccgtcagctgttaccgctctactcagaaacgggttcatctccacatcaatgaaacag

SEQ ID NO: 88502 - DNA, 174 bp, Heterodera glycines
  SCN-specific regions: Sequence locations=1-29
ggccgccaagtttgaggctaaacttattcaaatggacttcgacggccgcatcaaggcttaccgcttcgtggcttactccacggtgtccttctccatcatctctctgctttcggtttgcttcacgctgccgatgctgaagagctacgtgtccaacgttgggctgaagatggactc

SEQ ID NO: 88503 - DNA, 189 bp, Heterodera glycines
  SCN-specific regions: Sequence locations=1-189
ggccgccaaggcccggccagcctggaaaccccggcccgcaaggataccctggcgacggcggaagccctggccaacccggcaaccccggaggcagcggcgagcccggacagcccggagcacagggatccagcggccaatgctaccattgcccaccgccccgcaccgcccccggctactgagtgtgatcag

SEQ ID NO: 88504 - DNA, 196 bp, Heterodera glycines
  SCN-specific regions: Sequence locations=1-196
ggccgccagttcttggacgaagcggaaatgtcgctggtggagtgcaaatcgccaagtgtgccgtcattgtcacgcaatgtacgccaagacgaaaccaacggcacaacattgacggcattgttgacaaacatgacgacagttacaccgcaacaaacagctgcaacagcagcaggtggaaattgtgataaagacccgg

SEQ ID NO: 88505 - DNA, 210 bp, Heterodera glycines
  SCN-specific regions: Sequence locations=1-210
ggccgccaagcgccaaaatgggcttccactcgacaaagatggaagctgatctgtcaaaagagcagcagggcaaacgcgaggccgactcgatgcgcatgttggcattcttcggcgtttgcctgtccactgttgccacgatgatttgtgtggtgtcggtgccggtggcttatgaacactttcagcaggtcggcaccaaaatgcagggcgaag

SEQ ID NO: 88506 - DNA, 124 bp, Heterodera glycines
  SCN-specific regions: Sequence locations=1-124
ggccgccaaggtccatgcttcgtccgccgaataatgagggccctcggggcattcatcggaatgcgttgcgatcggctaaagccccattttgagcccattcagctcaccaattggctccgaagcg

SEQ ID NO: 88507 - DNA, 142 bp, Heterodera glycines
  SCN-specific regions: Sequence locations=1-142
ggccgccgaaaaatcaaaaataacattgagaattgtccgatcagcgttttgtaaatgccaaaatgatcgggaaaatggtgagagacgaaaggacagcagcctcgtggatcatcagtgggggttcttctccaattgtcgatgg

SEQ ID NO: 88508 - DNA, 343 bp, Heterodera glycines
  SCN-specific regions: Sequence locations=1-257,282-285,309-343
ggccgccaagctgaactccggctcaatgtcaagctggtggagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattg

SEQ ID NO: 88509 - DNA, 679 bp, Heterodera glycines
  SCN-specific regions: Sequence locations=1-200,222-489,535-591,613-679
tacagcttggtaccgagctcggatcctatactttttttgatttgctcaaagtataaaatggcttatttagagttagttatggcgttgattaaaacattgacaatgacccctttatataggggcttggggaatccaatcacagcaacgcaaattaaggctttccaatcaagtgtctttttctttattgtcattccctttagaaaaaatatttaatttaatttccatttgagtaaacatgtactctatcgaaatacacgaaaaggtagtccatgcctaaaggtagcggcttctaatctcttagaactagtttaggttgaccaagaatttcgagatgagtgaacaaaagactaaaagcaaatcaaagtgtttgaagactatagagaaaatggaatggagggaaaacacatgactcccaaaaatactttagaaatatgttcgagctttaaatatatgcacttatgatataagaaatatttatacaatcaaatcatttaaaagataattacaaataattttatttaataaatattaattcataacctacaataaatagtacgtgatttgctatataatttaaactatagtgatgatgtaaaaagttttcactatcagtatttgtatacgcttaaatgttaaatccgatatttccacttgcatctcaccaaatatctttgagttt

SEQ ID NO: 88510 - DNA, 759 bp, Heterodera glycines
  misc_feature (541)..(541): n is a, c, g, or t
  SCN-specific regions: Sequence locations=1-229,253-759
ggccgccgctcgagccacctcacgagcaacctcatgacgagcggcggacaacgtggatgacacgtgctgcatcaggcacaacacaacaacaaacacacaacaacgccaacaccacagcaatcacaccagttgaaaaaaacaaacactgaacacacagcgcggacaaggtggacgacacgtgctgcgtgactctccgctccagccccattctgagccccaccagcgccatagccatcgccatcgccatcgccagccccaatgaggctctcctctccgttcccccccccccccccttggtgtgtgaatcccgtgcagttgtaaagcaacactcaagacataatggaaagccccccctgatggtggaaagataatggaaaacaaaataaataatactgtgcaacatggtcctacgtgtgcatcaatgctgcatgagttgtgtcatgtccgtgtttgaggtgacaacataagtacgtaataggatacgtgcttcattgggaatgattgaaatatgggtgagtagagtggataacaatgataggantggttgttatttgtgatattgttgataatacgttgcaatcgtgttgttataattatgatggtatgatgagcatgtgttgatgtacccattattaataatgatgttatgataacattacccctttggatgttgacataatttaataatccatgtgaaccacaataaatgttgtgattgatagtatatgatgaatattattttttaatacccaactgtta

SEQ ID NO: 88511 - DNA, 779 bp, Heterodera glycines
  misc_feature (724)..(724): n is a, c, g, or t
  SCN-specific regions: Sequence locations=1-779
ggcccggactcggtaatggcgcgcattgcgcccagcgccatctgatcgttggcaaccagcatcgcagtgggaacgatgccctcattcagcatttgcatggtttgttgaaaaccggacatggcactccagtcgccttcccgttccgctatcggctgaatttgattgcgagtgagatatttatgccagccagccagacgcagacgcgccgagacagaacttaatgggcccgctaacagcgcgatttgctggtgacccaatgcgaccagatgctccacgcccagtcgcgtaccgtcttcatgggagaaaataatactgttgatgggtgtctggtcagagacatcaagaaataacgccggaacattagtgcaggcagcttccacagcaatggcatcctggtcatccagcggatagttaatgatcagcccactgacccgttgcgcgagaagattgtgcaccgccgctttacaggcttcgacgccgcttcgttctaccatcgacaccaccacgctggcacccagttgatcggcgcgagatttaatcgccgcgacaatttgcgacggcgcgtgcagggccagactggaggtggcaacgccaatcagcaacgactgtttgcccgccagttgttgtgccacgcggttgggaatgtaattcagctccgccatcgccgcttccactttttcccgcgttttcgcagaaacgtggctggcctggttcaccacgcggngaaacgtctgataagagacaccggcatactctgcgacatcgtataacgttactgg

SEQ ID NO: 88512 - DNA, 319 bp, Heterodera glycines
  SCN-specific regions: Sequence locations=1-319
ggccgccaagtttttattgtgctcgccaaattgacactagcagagaatgttcggatatcagcagactcagttcaattacggcgcttacgcttcagcaaacggtcagcagcaaagtttcatcaattatgctcagcaacaaaacaattcggcgactgctccggtggcgggaaatgccacaacaaatgcatatgctgcctcccaatattcgttggctgcttcggcttacgcacaatacagccaagccgcaacacaacagcagtccgttgctgcaacttacggagttcagcctccgccaccacctcctgactattcagcttcg

SEQ ID NO: 88513 - DNA, 197 bp, Heterodera glycines
  SCN-specific regions: Sequence locations=1-197
ggccgccaaggcatcaactcacccccgcaaagcgacatggcggacggtctcatgacgcttgctccaggaacgcgtgtctcaggccgctggatcatcataaagaagcttggtgccggatcatttggagccgtttacttatgccaagatgagcgagtgggaacaattgcagcactgaagacagagccattcaacacacg

SEQ ID NO: 88514 - DNA, 374 bp, Heterodera glycines
  SCN-specific regions: Sequence locations=1-374
ggccgccaaggttcgatgcattttacaaattgtttttgcttttgcctattttgcttctcctctccaacaatcccaagcttgcttttcacgtggcaacagtggcgaaccgtcggatggcaatcccgaggcccaggggctaaaatcggaaaacgatgttcggactgttcagttgaagaaggaaaaacaaacggatgaaacggaagaggagaaagacgaggaaagttcggcagaacaaaaattgccatctgaattggacccggaatttgtgaaaacttatctgcgagaatttggtcatctgaagcacaatgagaatggcctttcccatggcgttaagcatttccaacgctttttgggctaccggcagacgggcaatg

SEQ ID NO: 88515 - DNA, 327 bp, Heterodera glycines
  SCN-specific regions: Sequence locations=1-33,55-295,322-327
ggccgccaagcccttttcctaaaattaatttaaaaaatggtttccaagcttcttccggtcattctctgctgcttgtttttggcttctttcgccctctgctcgcccaaggctgctgatgtgctgaaattcaaacgagaagctgcgatcagcagttgtggagctggacagtttgaatacgggggcggctgttgtacgacatgcacaagcgatgctgattgtacgggcgggaagctttgtgtgcccatcctcaacttgctcagcgtcagtctgtgctttgccccatgcggaaattaagacagaaaagaaagcagcaaatgagggtgttga

SEQ ID NO: 88516 - DNA, 425 bp, Heterodera glycines
  SCN-specific regions: Sequence locations=1-327,349-425
ggccgccaagcgttaatttatttctgtcactttccgttttttattctcttgaattgaaaatggttctgttgggtgccattgaccaggggacttccagcagtcgttttctcgtcttcgattccgaaaatggcaatttggtcgccggccaccaattggaagtgcagcagcaattcccgaatcccggctttgtggagatgtgtcccgagcaaatatttaagacgaccgtccgatgcatcaaaagcacttgcgaggaactgaacagacgcggcattgacccgaagaaagaaatcaaagccatcggcataaccaatcaaagggaaacaacaatcgtttgggaccgagagacggggtgccatctgagtaatgccatcgtttggttggactgccgaacgcatgagctttgtgacgaatacattcagaggacg

SEQ ID NO: 88517 - DNA, 197 bp, Heterodera glycines; identical to SEQ ID NO: 88513
  SCN-specific regions: Sequence locations=1-197

SEQ ID NO: 88518 - DNA, 208 bp, Heterodera glycines
  SCN-specific regions: Sequence locations=1-41,63-174,196-208
ggccgccaaggtttgaggtttaaataattccgctaatatttgttaatttatttttggcctttctctgctcaaatgcgactcgttcagcttctccatttggcactgcttgttcagcttttgctggcgcctgttcttttggccgttggccaaaccgatgaaaaagtcaaacgaattcaaaagagagaggggccccccgaggcgaatttgg

SEQ ID NO: 88519 - DNA, 585 bp, Heterodera glycines
  SCN-specific regions: Sequence locations=1-585
ggccagcaaaaggccatgaaccgtaaaaaggccgcgttgctggagtgttcctatgctccggccccctgactagcatacaaaaatcgacgctaagtcagaggtggagaaacccgacaggactctgaagataccaaagcgtttccccctggaagctccctcgtgcgctctcctgttccgaccctgccgcttaccggatgcctgcccgcctttctcccttccggaagcgtggcgctttgtcatacatcacgctgtatgtatatcagtttggtgtatggcggtcgctccaagctgggctgtgtgcacgaacccaccgttcagccctaccgctgccccttatacgggaactatgcggcttgagtccgacccggtgagacaccacttatcgccactggcatcacatcactggtcacaggattacctgaccgatgtatgtaggcggagctacagagtccttgaagtggaggactaactacagctacactagaaaagcagtatgtggtatgtgcgctctggtggagccagtttccttcagaaaaacaggcggcagctgttgatccggcaaacaaaccaccggtggtagcggcg

SEQ ID NO: 88520 - DNA, 726 bp, Heterodera glycines
  misc_feature (668)..(668): n is a, c, g, or t
  SCN-specific regions: Sequence locations=1-726
ggccgccaaggtttgagacattcaaaatgtcccgtgatgtcagttcggcagagaaattgccccttttacagtcgtccaatcctcgcacttacagtcgcacttcgtcgcgtgaggaggcgcggcccattgaccacaatgacccgctcaccggtgaagaaggggaggtccagggcggttttgtgtcctaccaacacggggatgccaacccaagaacaccgatgggacagggccaagcgcgcaatgtcaaccaaaatgggtctccatcggatgtcgcggaggaggacgacgaagactcgccgctaatgaaccgaggtccaatggttgtgtgccgggtttgtgaggccgaaattgctcttgacggcaaaacgacgctccatgtcgtccgatgccaaaactgcaacgaggtgacgcccatccgtgccgcaccgcccggaaaaaagtacgtgcgctgcccctgcaactgtctgctcgtgtgcaaggcgtcctccgcgcgcattgcgtgccctcggcagaactgtcgtcgggtgatcactttggccgcctcttctcccgtcggcacggcggtgcgggcgccggccggcacgtgccgcgtgcagtgcgcgcactgcgctgaggtgataatcttcaacacgctgtccaacacggtggcccattgtccgcactgcaanagcgtttcgtccgttggcgttcgcttcgctcgtgcccgttccactttgttttgcattg

SEQ ID NO: 88521 - DNA, 319 bp, Heterodera glycines
  SCN-specific regions: Sequence locations=1-319
ggccgcaaaggtttgagcaataaaattatcgatgcgatcactgcagaaataccatattattgcggacaatttgggctggttcagcgatttggacggcaaaaagaacatcgaagagattttggcagcgaaaggggaggcgatcaaaagggggacggcggtgttggagatggaagtgccagcggaggaggagggggacaacgccaaattgataaggtggccacaacgctggagatggacaaaattcgagcgcgaggtatttagctttctgaagttcacctacaattacgacccattgctggacattggaaggaaagtcgag

SEQ ID NO: 88522 - DNA, 367 bp, Heterodera glycines
  SCN-specific regions: Sequence locations=1-367
ggccgccaagcaaaaagtccgattgtggtcgcaggtggtggattggttggtctgtcagtggcctacggcttggccaagcgtggtgcgaaggaagtctttctttttgaacgccattgcatcggtgctcacaattcgacacgcatcagcacgggaatgatcaacaacccatgcttttacacggatcgctctctccaatccgtcgtacgcaaatcgcacgaattatacgcagaattggacagccgcgggacattagggttcactcgctgcggtcgtgtctatttggcgtccagcgacgacacggccatccaagcgcggcgtatgttcagccgactcagcgccgacccggccaattcggcagccgaactgg

SEQ ID NO: 88523 - DNA, 188 bp, Heterodera glycines
  SCN-specific regions: Sequence locations=1-23,53-136,158-188
ggccgccaaggttttgaccgggaccgggaaattcccggcttttttcccggttttcccagccaaaaagtcccggtcccggtcttgcccaaatttcccggtcccactgcactctagtgtttacgaaaatggcaatccctccatttttagaatcgaatttctaattgcccaaatagtcaattttacatatg

SEQ ID NO: 88524 - DNA, 264 bp, Heterodera glycines
  SCN-specific regions: Sequence locations=1-264
ggccgccaggtttgagttgatttgttgagctcttttcgggaattgctgaatacgagtgctactccctccacgcacacattccctcgcctattcttcgcgctgctaattaattaattaatcgcccttttgtcaattgctcattcatttgacggatcaaacggtcgccccccaccaacaaaatctctgccccaccgaagcacaacgaataattgacactgctcaaaaccacacaatccgaagctatgaacccatccattgaagaag

SEQ ID NO: 88525 - DNA, 154 bp, Heterodera glycines
  SCN-specific regions: Sequence locations=1-154
ggccgccaggaacagaactatttgcgttagtatcatcatcccttcattatgcaataacaacaacacttcaaaagcgacctcatcgccgtttctcatcgttctttcgtccgtccgttcttcacatcaattcgctcgccgttttcgcaatggcacg

SEQ ID NO: 88526 - DNA, 226 bp, Heterodera glycines
  SCN-specific regions: Sequence locations=1-54,84-84,106-185,212-226
ggccgccaagtttgagtttctacaaaaatcaaagcacaaatcaaggtcactgtgagagatggcaaagtctaagaaccacaccagtcataatcaaaacagaaaggaccaccgaaacggcattcacaagcctaaaaaggagcgttacatgtcgatgaagggagtggacccgaaattcttgcgcaatttgcgttttgccaagaaacacaacaagcggaatgtgaaagcg

SEQ ID NO: 88527 - DNA, 226 bp, Heterodera glycines
  SCN-specific regions: Sequence locations=1-53,76-226
ggccgccaagcaagtttgaggttcggttaaattacgtgctataccatcggcaattaaaagagaagattgagaagctcagacgcttggcaagagaatgggaagaggtggaaagagcgttagacgaattgattgagcaacgccgccagcggggcgtactgcccgaggtaaccgaatgggtaccgcccgctggcggagggaggaggagagggaggaggtggaggggaag

SEQ ID NO: 88528 - DNA, 186 bp, Heterodera glycines
  SCN-specific regions: Sequence locations=1-186
ggccgccaagcggccagcctggaaaccccggcccgcaaggataccctggcgacggcggaagccccggccaacccggcaaccccggaggcagcggcgagcccggacagcccggagcacagggatccagcggccaatgctaccactgcccaccgccccgcaccgcccccggctactgagtgtgatcag

SEQ ID NO: 88529 - DNA, 480 bp, Heterodera glycines
  SCN-specific regions: Sequence locations=1-480
ggccgccaagggtaatcctccccccccccccccgagcgccccaaacagacgctctgtcgtcgtcggcgaagaaataatcgatgggcaaacgaagtgcggcagtgtccgccctgctgccgacccggacaaaagtaactcccgccggggttcaggtcggtaactgataaactactgttattatgataaactataatatgtgtatgactgagcaaacaccactcactcactcgtcatcattattatggtggtgattaatcattttaacctaatgagaaacgatctatcacatggtcggcagaaagtgatcaatgaaacgtaggcaatgtgattggacaagtgattactgatcagaataagtgcgtctccctttttgattgatcaatcaattcagccggtcggttgatcgtttatcctccgcccatcgtctgattcgttgtgttcgtcgctttgtcccctgggactgactttaccgggctcaag

SEQ ID NO: 88530 - DNA, 401 bp, Heterodera glycines
  SCN-specific regions: Sequence locations=1-58,80-231,273-313,335-401
ggccgccaatgttccgccgatgaccgacccattgcagctgtgtctgagggcgttggtgaatctgctgagctgtgcatggattcaacgggaagtgatgcgcgacgtgcgtgtgcccatcgaaatcgccaacattctttacaaaattgtgctgactcgggacagcattcagacgcatcgaatttgcgtggaactgatcacgacattggtgaccaaagcagcaaaagacgcggtcaaagcaaaggaggagaaaaatgaattggacgaacagaacggaaatgccgttgatttggtgaatgggcatgaggaacatcgtgacactgactttggccagggacagcggcgggatttcggaatgaatgacggtgttttatcgtcctcgtcctcctccgatgcgacgcttg

SEQ ID NO: 88531 - DNA, 115 bp, Heterodera glycines
  SCN-specific regions: Sequence locations=1-115
ggccgccaagtcgaaattggctcgttgaaacggtttcgccttctctgcacgacggacagtcgaagtgcgacgaacagtcacatttcgggacttgacgaagcatgaaaatgatttg

SEQ ID NO: 88532 - DNA, 436 bp, Heterodera glycines
  SCN-specific regions: Sequence locations=1-166,332-332,399-436
ggccgccaaggtccaaataagcgttacacattttgcctctgtaaccacatcatatcgtaacatcgtccgtcaacaagatcaacaacaaaacgttcaaaatgtctgcggaatcgccaacaacatcacaacgccgtgctcgcagtcgcaagacgaagaaacgtgcggtcagcgctggcgagaccaaaccactgcgacgctcggcacggattgcggcacagaaagcggcgaaggaaaaggcagccaaacagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgatgaagaaggcgccgggcccgagcagtcgcactcctgg

SEQ ID NO: 88533 - DNA, 226 bp, Heterodera glycines; identical to SEQ ID NO: 88526
  SCN-specific regions: Sequence locations=1-54,84-84,106-185,212-226

SEQ ID NO: 88534 - DNA, 195 bp, Heterodera glycines
  SCN-specific regions: Sequence locations=1-13,157-195
ggccgccaggagctctctctctctatttctccttttctcccactctttcccattctccgcttttccatgctattttcgtcctctgcttcttcttcttcttaactgccgcttctcttatcgtcccctttcttccgcttctcttctgctgttgtctctgtgttcccccctccggcgccattctgtgccgcaccggcg

SEQ ID NO: 88535 - DNA, 188 bp, Heterodera glycines
  SCN-specific regions: Sequence locations=1-188
ggccgccaagggaaaggcgagtgcgagcgaaaccaagcttacatgagttcatggtgtaaagcaagttgcagacaatgcgattttgactatgacattgacaaagaatgtggaaatcgtcacccgaactgttggcaatgggcaaacgaaggccaatgccaacggaaccttttttggatgaatgaaaattg

SEQ ID NO: 88536 - DNA, 312 bp, Heterodera glycines
  SCN-specific regions: Sequence locations=1-205,228-312
ggccgccaagcgtatttcaattttattacaccaccgacgcgtgcgcaccggctccaagcacaatggacgttgacatgtggcaactgccctactaccacggactgctgccgcgcgaggacgtagtggagctgctgccgaacgacggggacttcctggtgcgcatgacagaagaaatttcgggcacggagcgtgtgtatgcactgtcggtgaacgtcggcggcttcctgaaccacgtcatcttccgccgacacaagggaatgttcaccgtggacctcaactccgacaagggcttccgaacaatcgaacgattcg

SEQ ID NO: 88537 - DNA, 213 bp, Heterodera glycines
  SCN-specific regions: Sequence locations=1-133,155-213
ggccgccaagaattaattggaaatccaattcaatttttgagtataaaatgaactgctccttcttcctctgtctcttcactgttcagctgattctgctcaatttcgcagtcgaaggaagagaagacgatgaactgaagagaaagaaacgcaacacggacgtggacgtgctcggcctggtaaatattcacgcgccgtcgcgaaagaatgtgaacg

SEQ ID NO: 88538 - DNA, 167 bp, Heterodera glycines
  SCN-specific regions: Sequence locations=1-167
ggccgccaatggtggacaatgagccgaaggaggtgaaccgcttggcacggttggccggctgctccacgttattggcgacaaccagttgccaaacaatgcagaaggcaatgagaacaaagtgcattttaatggtggaaatcagttaaaagtattttcctcaaacttgg

SEQ ID NO: 88539 - DNA, 309 bp, Heterodera glycines
  SCN-specific regions: Sequence locations=1-309
ggcccagatatccccagggaaacacgggggatttgaggaagttcccgtgcccacggttgctcagccatcatatgtgctcggctttcgtggcacaattcatttcaacggcacactcagcgacaacgcactcgccttcttccgtcacgcgttgcccccgcccacaactttgtaccgcttctcggtgctggacgaattttatcgtgccaacggactgctgagcccgttcaaaacaacggaacgcatcaacatctttctggctcggcagttcgctcagcggacagtgtgtggtgttggtggagcgtcggccgg

SEQ ID NO: 88540 - DNA, 223 bp, Heterodera glycines
  SCN-specific regions: Sequence locations=1-223
ggccgcctaggaaaaatttgttatacctaagtcttgaaatgtcttggatttttggcatcaaacctcagccgtcgtcgattcctgcgcctccggacgaccccaacagaaaccctcccacgcccgccgatgagaagcagcagaaaatatggggcacaggagtgcctacacatttgactcaactgcgctggaacgggcggcacaagcagcaaaaacgctggaaaag

SEQ ID NO: 88541 - DNA, 201 bp, Heterodera glycines
  SCN-specific regions: Sequence locations=1-201
ggccgccaagcaagtttgaggggttttgagccgcccccggacgtcgaagttccgtcagaaccaccggtggaatggcgcgcgtggctcaacaaaagcaggcgtttccctccgtcggaagaagaaattcagctgaacctactcaaacaacaagctcaattggtacaaaacacagatacggaaaagaaagcgccaatgattgtg

SEQ ID NO: 88542 - DNA, 392 bp, Heterodera glycines
  SCN-specific regions: Sequence locations=1-7,350-358
ggccgcagagaaggaggaaaagaagtcagaaagcaaggaagcagagaaaaaggagaatgaggagcaaaagcctgctggcaagaaggagaaacgcgccgcagagaaagaggaaaagaagacggaaagcaaggaagcagagaaaaaggagaatgaggagcaaaagcctgctggtaagaaggagaagcgcgccgcagagaaggaggaaaagaagtcagaaagcaaggaagcagagaaaaaggagaatgaggagcaaaagcctgctggcaagaaggagaagcgcgccgcagagaaggaggaaaagaagacggaaagcaaggaagcagagaaaaaggagaatgaggagcaaaagcctgctggtaagaaggagaaacgcgccgcagagaaagaggaaa

SEQ ID NO: 88543 - DNA, 710 bp, Heterodera glycines
  SCN-specific regions: Sequence locations=1-609,632-710
ggccgccctgcacgagtcataccagcgcgcccaatgggctttcggagagattttccaggactgcgtcagcggactcgcgtttctgcatgtgggggacgccacgcgggcgcgaagtctgtacgaacgctccctcgagtcggcggttgcattgcatgggcagttgtctccttttgcttcaatgccagcgctactgctcgcggaaatcctctatgagcagaacgatttggatcgggcgcggcagctcgtcgccgactacctcgatgtcgcccatggtctggggtacgtggacaagttgatcgccgcgtacctcgtgaaggcccggctcgaagccggcggcggtcagatcgagaccgctcaaaggactctggatgaaggcgaccgctgcgcgcgggtcactggatttgcccggctgcatgccaacatctcgtgcgagcgaatgcggcttctctcggccaactctgccgcagtgctcgatctcgcacggacagcaggcctgcttggaagctgctcggcgctgcaaccgaacgtgggcgtcacgtcctccaccgaaaagctcgccatctcgtgggcatacgccgcgcgcgcgaatggcgacatcgacggcgcgatcagactcctgaagagctggtaccggttcgtcatggcaaggcggtgcttgcgttccggcctgcgtcttgcggtggagctcggcacgctgttctatcttcgcg

SEQ ID NO: 88544 - DNA, 124 bp, Heterodera glycines
  SCN-specific regions: Sequence locations=1-124
ggccgccagaaaaaggcactttctttgcgaagcaaattttccgttttgaaaggagacatcaccaaaatgactacggattgcattgtgaacgcggccaacagctcactgcttgggggcggcggtg

SEQ ID NO: 88545 - DNA, 187 bp, Heterodera glycines
  SCN-specific regions: Sequence locations=1-187
ggccgccgcttcgccgccctttccgcccgttttaatttcgaacatttccttgaacatgtcccgggcgcgcgacttgcaaaagtcgaggtccaactgaacgttggcctccaatgtttggatgtaatggacaatcagcgggaaaatgatcagacaggaggtgatcgccaccgtcgcgcagcacgtggcg

SEQ ID NO: 88546 - DNA, 377 bp, Heterodera glycines
  SCN-specific regions: Sequence locations=1-31,53-377
tagacggccgccaaggttaaatttaggtcactgcatttacaattgtcatataaatgtctcatgctttcgtttcacaaccgcacaaaaattcggtgtgccttatgggatggccaaccacaaatcccgtgattatcagacaaaggcacggtgctcaaactgaacaggcacgcatttattggccagcaagtgcgctcacaacgacagagccaaattgaggacgagctcaaatgtgcccgcgactgagaatacccagaagagaattcggaagattggtgaatcacaggccacaccgctttcactcacaacgcactttcacattacacctgacccgccggccgccccaacgctattcccactttgccaccaccctttcacta

SEQ ID NO: 88547 - DNA, 209 bp, Heterodera glycines
  SCN-specific regions: Sequence locations=1-209
ggccgccaagcggttctctccagcatcaactcacccccgcaaagcgacatggcggacggtctcatgacgcttgctccaggaacgcgtgtctcaggccgctggatcatcataaagaagcttggtgccggatcatttggagccgtttacttatgccaagatgagcgagtgggaacaattgcagcactgaagacagagccattcaacacacg

SEQ ID NO: 88548 - DNA, 710 bp, Heterodera glycines
  SCN-specific regions: Sequence locations=1-710
ggccgccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcgg

SEQ ID NO: 88549 - DNA, 248 bp, Heterodera glycines
  SCN-specific regions: Sequence locations=1-248
ggccgccaaggtgcaacggcgcacttcaaattcgcgcactcgccaccgtttgccgccgcttccgaagaagcgatccttcgcagcaagcagaacaaacacactgccgacgagcaaaacgacggagagattaccacaagcaacagtgacaaaaccgatccgaaaaactccatccttacccgcgtcgtgtgccgccaccatcgacggcacagaagaaaacgcccacggacagtcggcccgggtcgaagggg

SEQ ID NO: 88550 - DNA, 157 bp, Heterodera glycines
  SCN-specific regions: Sequence locations=1-157
ggccgcaaagcaaatcgaaggtgcaaatgggaatgtgacattggcactcgttttgccacggaatgcgtcgccagggttttttttttgcgccgtgcgattgttttcgattcattggtacgccccgtcggctgttcctgcgcctcctccgtactgaacg

SEQ ID NO: 88551 - DNA, 266 bp, Heterodera glycines
  SCN-specific regions: Sequence locations=1-237,262-266
ggccgccaagaatttgcaaagggaacaaaaggtgccggtggtccatcagccggaggcggcagacctaacagggcggacgaccgggcggtgggccgtcacgaggggcgtacagaggcggggcacatccgtcgggaggccagccaaggagaaactgacaatgcattattttcgccatgttttgttgtttgctagatctccatttggaaccaattaacgctggaataaatttccaaagacaaaaaaaaaaaaaaaaaaaaaaaacttgg

SEQ ID NO: 88552 - DNA, 656 bp, Heterodera glycines
  SCN-specific regions: Sequence locations=1-494,516-541,563-656
ggccgcaataatttacaataaaatggaaaatgaaggacagctcagtcccgcggaagagcaaatgctaatcgaacatgcgcaaattgtgcaacgcaattcgaccagcccttacagcaaattcgccgtcggcgctgccattttgaacaacgacggacagattttcagaggagcaaatgtggaaaatgcttcttacggggcgacaatttgtgccgaaaggagcgcaatttgttccgcaattgccgcaattgggcccaccaaattttgcccaaaagcaatttgtcgtcaaactttggtcgaattcggtgacatggcggtccttctctattcgcgtcccagcaaaaaattgttaaaaacgcgcgtccaaaatctgatcccaatggcattcactcccaacgcattgaacactttcaaaagtgacgcatcgatgagcaattaaccgaatgaatggacgcgcatttgaacagtgattgatcaaaccaattagagagttaatgatttaattcaatttaatttaaaagcaccaatccaatccccgaaatgcactaaaagcaattgtttaaattagagcatgaaaatgtttgttaaaaattcactaatttttagccatttatttttggttttattgtatatttctttttccaataatatgcataaat

SEQ ID NO: 88553 - DNA, 205 bp, Heterodera glycines
  SCN-specific regions: Sequence locations=1-164,201-205
ggccgcctggcgaccagggcaagcagggcgggtgcgatcactgctcaccgccacggacagcgccgggctattgatggcatttttcgaatttattcattttatgtaaataccaactttttatttcaaattgaaaatcttttggcaataaagatgcattcagttacaaaaaaaaaaaaaaaaaaaaaaaaaaaaaaaaaaaacttgg

SEQ ID NO: 88554 - DNA, 398 bp, Heterodera glycines
  SCN-specific regions: Sequence locations=1-43,65-310,332-398
ggccgccaagcactcaaaaggggacgcccatggagagcagcgacgccaacaataacatcaacaacagcgagggggaggccgaaaataccaccaaaaacggcggagaggagggcgtcgagaagaagatcttgagcaaaggcgtcagcggggtggcaaatggttaacgtcatgaatggatacggcttcatttgccgtgatgacaccaacgacgacatttttgtgcacaattcggcaattacagcaaataatccatccaaaattcagcgatcattgggcgatggtgaaaaggttatgttcgacattgttgatggtgctaaagggccagaggcggccaacgtgactggtccggacggagtgcccgtgcaggggtccaaatatgctgcagatttgagccagcg

SEQ ID NO: 88555 - DNA, 276 bp, Heterodera glycines
  SCN-specific regions: Sequence locations=1-242,272-276
ggccgccaagctgtcgctgcacggaccgctgataaggaacgcccaagacacaacctgccgcggtaaaaactgcagagaagaagccgccgaaatcaaaaacggaaactgtgggcaaaagggaaactgttggtcccaagaaaaagaaaggaggcaagtaaatgacaacaagcggacgatcggatttgagacaatcgatcgcattcattgttttgccacatcatatttgttgaagaattgttattaaaaaaaaaaaaaaaaaaaaaaaaaaaaacttgg

SEQ ID NO: 88556 - DNA, 173 bp, Heterodera glycines
  SCN-specific regions: Sequence locations=1-173
ggccgccaagtgccgccattgccaatagccatcaatgatcaaccgcaccgcggtttcccatcgccgcaaacagcagcaaggcggtcatactcaatgccaatctatgcacttccttctggcaaacaaaagcagcagcaacaggcgcaggacgacgacaaggagcagcagcgtgg

SEQ ID NO: 88557 - DNA, 371 bp, Heterodera glycines
  SCN-specific regions: Sequence locations=1-371
ggccgccaaggttttttttaattgaatcaacaaaatgtctaccgaccgatatgatattgtgttgtacggtgcttcaggctttaccggccaacatgttcttgaatcattcgtaaagaatggtcatttggaccaatttaatttcgccgtcgcgggaagaagtgagaaaaaactcaaacaaacactcgaagacatcgaattcatcactgggaaagttttgaccaaaattccaattatcatcgccgattcgtccgatgctcagcagctcgcagaaatggccaaacaagccaaagttattgtcaatgttgttggaccataccggttgtatggtgaagcggtggtaaaagctgcggttgaaaatggtgcaagtcatg

SEQ ID NO: 88558 - DNA, 428 bp, Heterodera glycines
  SCN-specific regions: Sequence locations=1-144,321-321
ggccgccaagccttaagcgttacacattttgccatctgtcaaccaatcatcatcatcgtcaacaagttcaacaacaaaacgttcaaaatgtctgcggaatcgccaacaacatcacaacgccgtgctcgcagtcgcaagacgaagaaacgtgcggccagcgctggcgagaccaaaccactgcgacgctcggcacggattgcggcacagaaagcggcgaaggaaaaggcagccaaacagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgctgaagaagaaggcgccgggcccgcgcagtcgcactcctgg

SEQ ID NO: 88559 - DNA, 353 bp, Heterodera glycines
  SCN-specific regions: Sequence locations=1-353
ggccgccaagcttcttctgctgctggatttgcattgtaccggtgccaacaccggcctcggcttgcattttgttaaatctctatatgcttccggcacttattccgccattgtgttggcctgtcgaagtgaacagcgcgcgaagagcgcaattgaacaaatttgctgtggccaatcatcgccggcggaaaatggcaacggcacccaaacaaaattagaatttgcgaagttggatttgacctgcaatgattcggtccgcactttcgtctcccaactcgacgagcgtccctatcaaaagggcagtttgcgattgctcgtcaacaatgccggcattatgggccatccctttcaattgg

SEQ ID NO: 88560 - DNA, 501 bp, Heterodera glycines
  SCN-specific regions: Sequence locations=1-501
ggccgcctgatctcggcgctgcggttcgaccgcgtgctggcgtgcaagtcgcgcaatatcgacctttcggcctccggcgccgagctcgacctgatcggcatcgagttcagccccactgatccgccgggtggcagcgcgctgatcctgttcgccggcggcggcgcgttgcggctcgatctcgaatgcctcgaatgcgagctcgccgacctcggtcgcgataggggctgatcgcaagggcagcggggcgccgttgatggtcgctcacgcaatcccttgtaaaatcaagcgaaagtctgttttgagtcgccccgcgggactttgcacttcacgaactggccggggcagggcatagctgcgggaagaaacctcggcttacccggcccccgcgacagcccttgtatccggaccccgccatgccgatccgtatcgacagccagagtgccgacttcgcggcgcgctttacggccttcctcgccatgaagcgcgaggttgcggccgacg

SEQ ID NO: 88561 - DNA, 265 bp, Heterodera glycines
  SCN-specific regions: Sequence locations=1-265
ggccgccaagccttaagatggaaacaggccctcttaaattattgcgcaagaaattttccatcgaatggcgacagatcgaagcgattgagaaaatgaaaaagaaagggtcgcctaatgtgcgagtttttgcctttgaggatccaagttttaagcctggctgtaggaaattcgttgtctctgggcttcgcaatttttacctttggtacagagagtgtccgatccgtgcgcgacatttttacgagttgatcattgaacggatgccatg

SEQ ID NO: 88562 - DNA, 418 bp, Heterodera glycines
  SCN-specific regions: Sequence locations=1-418
ggccgccaaggcaaaaatgacttccaattctactgatggttggggatgtaacaacagtgggtggggtcaaagccaagcaaaaatgacttccaattctgctgctgatggttggggatgtaacaacagtgcgttgcgtccgaaccaagcaaaaatgacttccaattctactgacggttggggatgtaacaacaatggctgggctccgagccaagcaaaaatgaccaattctactgatggttcgggatgtaacaacagtgtgaggggtccgcgcgaattttctcggagtttcagtggacgcccaggatttaatcgccaacctgtggttttcttttgtgttgtaaatttcggcacttcatcttatttctttagcctctaatgaacaagttgcctccaattcctccgtccacaatacttttcg

SEQ ID NO: 88563 - DNA, 283 bp, Heterodera glycines
  SCN-specific regions: Sequence locations=1-283
ggccgcaaagaataaatgtcagacgaaggtcagcagttgttggagtccaccttgcgcaatgtgttggaccagcagtcgcttcgatggattttcgttggcggaaagggcggcgtcggaaagaccacgtgcagttgctctttggccgttcagttggccaaatatcgtcgcaatgtgctgatcatttccaccgatccggcccataacatttcggacgcgttcaaccaaaaattcacacggagtcccaccaaagtgaacggcttcgacaatttgttcgcgatggaag

SEQ ID NO: 88564 - DNA, 335 bp, Heterodera glycines
  SCN-specific regions: Sequence locations=1-335
ggccgcctccgttgcaatgcgatccaaggcgtcgatgacgaaggagttcatgatgttcaacgcacgcattgagatttccttgcccggatgaacttccttcagcacccgtcgaacgtacaacttgtacgacacctttcgcggctccttttttcttcgtcggcgtgccattttggtgcgatgttgttgagaatggcgctgttgttgaacgtgagcaactgtcggttttctcagaaattacgcgtgcacacaattggtggcgatggcaaaaatgaacttggcggcctcgaattgctttcttctctccctttagtgagggttaattgaaaaaaacttgg

SEQ ID NO: 88565 - DNA, 267 bp, Heterodera glycines
  SCN-specific regions: Sequence locations=1-267
ggccgccattttctcatcgacggtggcacgtacttggacttctgaggctgctgctgcgactgtgctgcctgttgctgttgttcgtcctccttcgccttcttgggctgttgctgtgtctgtggcgtttgctgctgctcgacttccctcggcttttgtggctgttgcgtctgtctttgctccttcgccttttgcgtctgcgcctgtgctgcctgttgctgttcggcctcccgcgcctcttttttgcgttgttccttcctgcgctccgcg

SEQ ID NO: 88566 - DNA, 187 bp, Heterodera glycines
  misc_feature (46)..(46): n is a, c, g, or t
  SCN-specific regions: Sequence locations=1-111,133-187
ggccgcctttagtgcaacgcgcgtcatgaagccaaacgcttcattnaagtctcggaaagtgaagctctttttgatggcatcccttccctgctccatttgccacccgccctccttcagcaaaggctccaaaagttgctttcgttgcgcctcgccgagtctcgcgctgcccatcgtcgtaaatttgtag

SEQ ID NO: 88567 - DNA, 129 bp, Heterodera glycines
  SCN-specific regions: Sequence locations=1-129
ggccgccagcgccggagaagtccccggatcagagcgcctacatgtgagaagatgcaacaacgaccggcggatggatggacgaaacctgaagagcgagcgacctgtcagaagatgcaaagataaagaaga

SEQ ID NO: 88568 - DNA, 417 bp, Heterodera glycines
  SCN-specific regions: Sequence locations=1-133,310-310
ggccgaaaggttacacattttgccatctgtcaaccaatcatcatcatcgtaacaagttcacaacaaaacgttcaaaatgtctgcggaatcgccaacaacatcacaacgccgtgctcgcagtcgcaagacgaagaaacgtgcggccagcgctggcgagaccaaaccactgcgacgctcggcacggattgcggcacagaaagcggcgaaggaaaaggcagccaaacagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgctgaagaagaaggcgccgggcccgcgcagtcgcactcctgg

SEQ ID NO: 88569 - DNA, 182 bp, Heterodera glycines
  SCN-specific regions: Sequence locations=1-182
ggccgcgctggcagtcggctgtacggtggtggtgaaaccggcggaggacactccgctgacggcactcgcacttgctcagacttcccaagaggcgggcgttccctccggcgttttcaatgtcattccatccgaccgagaggagactgccgaagtttccaaattcctttgcgagtcgcaagacg

SEQ ID NO: 88570 - DNA, 256 bp, Heterodera glycines
  SCN-specific regions: Sequence locations=1-256
ggccgccaagatatttctgccttccgtcggctgatgcccaacacctttgccttccttcgttatattttgtcgccactccgttttttgaattactccgtatccctgcttctgtcttctgtataccaatccgtctacaatttggccgaaatgactgtggacatcgtacgccgggcaccacccaaacagcgaccaggacaaggacgaggaggactgcttcacgccgtcgcgcgtcaacagcagcgcgttcgagagctcg

SEQ ID NO: 88571 - DNA, 167 bp, Heterodera glycines
  SCN-specific regions: Sequence locations=1-167
ggccgccaagagggcaagaccaatttttttgagaagcgagtgtcggagtaccaaaagatgggagttatttcaacagaagagcagcgtgaattccgtcttgacgctgatttttgagtgttttaaattaatttgatattgtaacttctcaccgatactcatcctattgg

SEQ ID NO: 88572 - DNA, 100 bp, Heterodera glycines
  SCN-specific regions: Sequence locations=1-100
ggccgccaaggtttgaggtaaaattctaaatttgcttttgtgatgtctcgtatcgctctattggtccttttggtcgcgctgttctgcgcttgcgctttgg

SEQ ID NO: 88573 - DNA, 176 bp, Heterodera glycines
  SCN-specific regions: Sequence locations=1-119,141-176
ggccgccaagctgttttattatctatttgcttttggttgattaccttggcctatttttgcaaaaatgcctcgctatgatgcgaccgatgacttgtcaggagcggaatatttggccagcatttacggcacagaaaaggacaaagtgaattgttcctttttcttaagattggcgcatg

SEQ ID NO: 88574 - DNA, 420 bp, Heterodera glycines
  SCN-specific regions: Sequence locations=1-136,313-313
ggccgcaaaggttacacattttgccatctgtcaaccaatcatcatcatcgtcaacaagttcaacaacaaaacgttcaaaatgtctgcggaatcgccaacaacatcacaacgccgtgctcgcagtcgcaagacgaagaaacgtgcggccagcgctggcgagaccaaaccactgcgacgctcggcacggattgcggcacagaaagcggcgaaggaaaaggcagccaaacagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgctgaagaagaaggcgccgggcccgcgcagtcgcactcctgg

SEQ ID NO: 88575 - DNA, 145 bp, Heterodera glycines
  SCN-specific regions: Sequence locations=1-60,82-145
ggccgccaagacggcggaagccccggccaacccggcaaccccggaggcaacggcgagcaaggacagcctggagcacagggatcaagcggccaatgctaccactgcccaccgccccgcaccgcccccggctactgagtgtgatcag

SEQ ID NO: 88576 - DNA, 214 bp, Heterodera glycines
  SCN-specific regions: Sequence locations=1-214
ggccgccaagaattaattggaaatacattcagtttttgagataaaatgaactgctccttcttcctctgtctcttcactgttcagatgagtctgctcaatttggcatttcaaggatgagaagacgatgaactgaagagaaagaggcgcaggcaccggacgtggacgtgctctgtctgttaaatattcacgcgcacgccgcgaaagagtgtgaacg

SEQ ID NO: 88577 - DNA, 419 bp, Heterodera glycines
  SCN-specific regions: Sequence locations=1-50,72-135,312-312
ggccgcaaaggttacacattttgccatctgtcaaccaatcatcatcatcgtaacaagttcaacaacaaaacgttcaaaatgtctgcggaatcgccaacaacatcacaacgccgtgctcgcagtcgcaagacgaagaaacgtgcggccagcgctggcgagaccaaaccactgcgacgctcggcacggattgcggcacagaaagcggcgaaggaaaaggcagccaaacagaaagctcgtgacggctccaccgcgtcaacgaagtctgctggtcgtggtcgtcctagtcgctcgccgaagaagtcaggcccgaagagtcgtcgctcgcccgccggtcgtggaggaggacgttctcagacgccgcgcaagaagaaacaaccgctgaagaagaaggcgccgggcccgcgcagtcgcactcctgg

SEQ ID NO: 88578 - DNA, 290 bp, Heterodera glycines
  SCN-specific regions: Sequence locations=1-112,134-290
ggccgccaagcaattacctaacttgccaaatcagtttaatgtgtggcagggcgaacagcaaatgttcccgccgaatattggtctagcatcgaacatgatggtgaacagtccatacatgatcaatgccatacaaccgaatctgcccggcattgccaatcaacgtaccatcaacatcgacggtattccgcgcgatattcgtttctatgacgaagtgaccattgcatttatgaaagagaatggaggcgaaccaatggaaatcggtttccattccggggagcgtctcattctcg

SEQ ID NO: 88579 - DNA, 213 bp, Heterodera glycines; identical to SEQ ID NO: 88537
  SCN-specific regions: Sequence locations=1-133,155-213

SEQ ID NO: 88580 - DNA, 532 bp, Heterodera glycines
  SCN-specific regions: Sequence locations=1-36,62-278,300-532
ggccgccagcagagggacaccaaatgatttgtggtcaatctttgcttttatttttgcctttattcgtttttctccaacacttcgattcatcggcgggaggagaacaacggagttggaaggacgaggacggagtggaagtggaaatcatcaaaaagatcccggattcaaagtgcaaagtgaagagcgaggcgggcgacgagttggagcagtttttcaagctgacggacaaagagggcaaactgatcggatccaatttcggacagaaaccctataaatttgtgcttggccatgggcaggccatccgtccgatggacaacgcaatgcgcggaatgtgcgtgggcgaacagcgccgggtgaccattccggcggaagcgttggcggaaaacgaacggccccagggggtgggcgaggaccaagcgatgcattactttgtggagctgaagtccatctttcgcgcagtgcccggcgagaaatggatggaggacgacggactgagcattgaggtcactcacaaaatagaggaagacaaatg

SEQ ID NO: 88581 - DNA, 454 bp, Heterodera glycines
  SCN-specific regions: Sequence locations=1-454
ggccgccaaggctaaatgtatgtgatcgcattgacaatcgacatataaatgtcttatgcttatgtgctacaaccgcacaaaaattcggtgtgccttatgggatggccaacgacacattcggtgattatcagacaaaggcaccgggctgaaactgaacaggcgcgcatttattggccaggaagtgggctcagaacgaagagcgaaattgaggaggagtttaaatgtgcccgcgacggcaaatacccagaagagaatttggaagattggtcaatcacaggcaaacggagtttgactcagaaggcgcttttccattacacggaccgtcgggcgggcaaaggctattccgactttgccaccaccctttactacggtcgcccttacatttggccgcccgttcgcgaaattaaccgatggcactttttcatttgtgtgacctttgccctggttattctcg

SEQ ID NO: 88582 - DNA, 193 bp, Heterodera glycines
  SCN-specific regions: Sequence locations=1-193
ggccgccaagaaagcataagcgacaagcgcagggagaagagaaccgaaatacaaaggaccgacgcgaaagcgaagctgaagatgatcataattgggtggaagttgttgtcggaatttgtgttcatcaccgcatttccccaaaaataacattgataattgtcctatcatcgctttgcaagtgccaaaatcatcc

SEQ ID NO: 88583 - DNA, 201 bp, Heterodera glycines
  SCN-specific regions: Sequence locations=1-201
ggccgccgagcaaccaatgcaccgccatggtcgaggcggacattctgtgcccgaccaaacatttcccagagttggcgtgggctcgtgaattgcctaaggctgactcccattacgtcacgaatgtcgaatttacggaaaaggacgaacttgggatggaagtgcggcgcaacggacggccaatgcccgtggagtatttactcg

SEQ ID NO: 88584 - DNA, 142 bp, Heterodera glycines
  SCN-specific regions: Sequence locations=1-142
ggccgccaaggcgacggcggaaaccccggcgcacccggcaacccgggaggcgttggcgagcccggacagctcggagcacagggagccagtggccaatgctaccactgcccaccgccccgcaccgcccccggctactgatcag

SEQ ID NO: 88585 - DNA, 328 bp, Heterodera glycines
  SCN-specific regions: Sequence locations=1-292,324-328
ggccgccaagcaaaatgtttccgttccgttttctcttcgttttcgctttcgctttgctcactttgtgcggcttttctcacatgacattggcacagcccggaagcaatgggccaattggcgaacctaacaaaatgttgcgcatccgccgggaaaatgaacgcaaggaaaattgacgttttccatggaacgaaccaaagaggatgaaaatgaccgaagaacaaaaaaaacactattagcaattaaattccgttttcattgttactttttagggtggtgttttggtataaaatccaaaaagaaaaaaaaaaaaaaaataaaaaaaacttgg

SEQ ID NO: 88586 - DNA, 266 bp, Heterodera glycines; identical to SEQ ID NO: 88551
  SCN-specific regions: Sequence locations=1-237,262-266

SEQ ID NO: 88587 - DNA, 788 bp, Heterodera glycines
  SCN-specific regions: Sequence locations=1-320,342-392,414-496,524 -669,692-788
cagtttggtaccgagctcggatccctagtaacggccgccagtgtgctggaattcgcccttcgcgagctcaattaaccctcactaaagggagtcgactcgatcatgcccattcatcaagaatctagatcatgaagtgcataactatttatgctaaggagtggactaaaagttattgtcaattatattgacacatgttttgtatcaatgtaaaaaataggagtttgcagaaattccattattataggcaggttgcatatgcttttgatcatttactatctcggctttcaacattcacctaataaacacatgaggaatacgaatgtgcaattagcttaagttgggaaagaaaacatgaagcattacgccgtaggcctaaaggactgatagcttatccatttttcttttctttcattctcgtctttccgatatacaatgacaacctacatgttctttgtactgtcagcttaatttaacatgtgatattaagttaattacgtataattattattaaaattaatttttagatttagtgacttgattgtgttaataatttttaaactgtcagtgaatatatcttttaaattcattagtaaacttgctaatccttaaataaaaaatataaaaaggccattgaaaaatcaaatggtagaatacttctctgatttaataaatatatgggaaaagaagtaattaaaaagagtctattaatcttcaacaccacaagtcagataaagatgtcactctgcagtagaaggtaaatatcacatcgcattggtactccaaaaaag

SEQ ID NO: 88588 - DNA, 492 bp, Heterodera glycines
  SCN-specific regions: Sequence locations=1-492
ggccgccaaggagaatggagccgtctctgctcagatatttctgtccccgtcagtttcgccgattggccaccacttccttttgcactttgagcccacggcaccgaataattgccgagggcggaatgccaccgttggagtacgaatttgagcgcgaaaagtgggcgatgggttaacggtttggccgctacggactgcgcggaggggtggacattagcaaactgtggctaaccgttgaggaaattgaagaggtcaaagcggtgcgaaggttcagaacggcgaaggaggcgcaacacattgcgaaaatggagtcagaaaaggagcaaatccgacgcaaaaacagactcgaccgtatcgagcgcaattgggcgacgtacgacgctcagttggccgagttcaatcagcgcgaagtgcagacggaggcggagaaggaaacggccgaccaggagctgaagcgacaggtggaggaggtgcgcaactatttcggctattggg

SEQ ID NO: 88589 - DNA, 349 bp, Heterodera glycines
  SCN-specific regions: Sequence locations=1-349
ggccgccaagattcttcctatttcaatttctcgtcaaatattagacgacgaccgctcgacgacacgcgcacgcattgtccacaagacacaatgaaccctgatgagcggcaaatgtggagactgccgtaccaccacggattgctaccgcgcgaggacgtgacggagttgctgccgaacgacggggacttcctggtgcgcacgacagaagaaacttcgggcacagagcgcgtctttgcattgtctgtgaacgtcggaggcctggtcaaccacgtcatcttccgccgacacaacgggatgtacaccgtggacaaaaactccgacaaggtcttccgaacaatcgaacgattcg

SEQ ID NO: 88590 - DNA, 266 bp, Heterodera glycines
  SCN-specific regions: Sequence locations=1-266
ggccgcaaagctaaaatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtacggcggcggaatgggcggcggcggaccatggggaggaaatttcggaaagaaatgagaagggagcaaaatgtggtgatcaagacgaacagaacaagccatttgattgaatat

SEQ ID NO: 88591 - DNA, 377 bp, Heterodera glycines
  SCN-specific regions: Sequence locations=1-377
ggccgccaagttcgtctccaagtctcgtcaaacgtctgcatttattgttcatcaatccttcatcggttgacacccgcgcgcacttcaaaatggacgccctcaaaagacttgcgagccgtgcacggcagaagtcggcggagatcatcctgagcgcggagaagaccgaaatcggcgccgagcttgaacaattgctgaccaagaccgacaagacggaggagcacatgaagaagctggtgcatgccatcgaggtgtacctgcagccgaaccctgcagtccgagcgctggacccgcgaaaggacaaatccggccgacagaatacgctggacggtcttggggaggcgatgaaggaagcagcatcgaaagcggtgggcgccgag

SEQ ID NO: 88592 - DNA, 312 bp, Heterodera glycines
  SCN-specific regions: Sequence locations=1-312
ggccgccaagggacaacggaagtaaaaaatgccaactcgcatatgaccaaaatcagtgtcacctcgagctcatttcgttagcaaatggagaacctttggaccgaaagacggcattcggtcgaattgcttttgccacggcgacggaaaatttgaggccactcgaagagaaagtcggcacaaagcgcattcattcgccactcatttctttgggcacacccggcaaagcgaccgtttgggtggtcattttgaaagacccgaatgagcatgaaatttgttttgtgggcgacgaaggtttccaagaattatcgaaag

SEQ ID NO: 88593 - DNA, 739 bp, Heterodera glycines
  SCN-specific regions: Sequence locations=1-739
ggccgccaagctagcattgtcatagccagtgacacttgtcctcccgagaaaatcttgatgaatcgagttgtgcgtcagaatctccgcgtcaaactgggcgatgtcgtcagtgtttcgtccgcttcaaatacgccaaatggactgcgcattcacgtgcttccgattgatgacaccgttgaggggctgaccggaaacttgttcgaggtgtttcttaagccctactttttggaggcctaccgtccggtttacaaaggcgacacgttcactgtcaacgcagcaatgcgaactgttgagtttaaggtgattgaaactgatccggcgcctgcttgcattgtggtcccaacaacgatcattcattgtgagggggaaccgatcaaacgtgaggacgaggagaacaatctgaacgacgtcggctatgatgacattggcgggatgcgcaagcagttggcgcagatcaaagagatggttgaactcccgctccgccacccgatgcttttcaaatccatcggcattaaacctccccgaggaatgcttttgttcggtccgccaggcactggaaaaacacttgtggcccgtgctgtcgcgaatgaaactggcgcattctttttcctgctcaatggacctgaaataatgagtaaattggctggtgagtcggagtcgaatttgcgcaaagcattttccgagtgcgagaagaattcgcctgccattcttttcatcgatgaaattgacgcaattgccc

SEQ ID NO: 88594 - DNA, 676 bp, Heterodera glycines
  SCN-specific regions: Sequence locations=1-676
ggccgctctccagtcgtctttggtggccgtgaatgtgcgcgtatcgccggggatgccactgcgaaattcgacgtaacgaccctcgctgatcgagcgaatggtggcgggcattcgaccggacgaagtcaattcaatgtacacattttgaaaccgatgaaaagttttcccatccaaaatgagttttgttctgctccaaaagcactcgccggtggtgtcttccgctggcgcccgctgctttctcgcccccctcttcctcggccatttcgcctgcggtggaatggcatgcaatgcccgacagtgccactccatccccaatcgctccgtcttgactcagtccgccgcatcctgctgacgaacgttccgccaaatggcaatggttggccgagtcgctgcccaacgaatggacgtcctccgaaatggccgattccgacaaaagataagggagcatcagcgaagaagtggacgttcctccgatggtcggccctccaccgatggcaccagcaaaaccaccgacagcgccttcggttctgccgaagccaaggaatccgaaaggggagccgcttttcttcgtctgagtacgtctcttcgctgtgcctgctgcatctgtcagtccaatggcacccaaatgcagcgccgactcggcaccaacactcgacgagggaatcacgtcgttctg

SEQ ID NO: 88595 - DNA, 245 bp, Heterodera glycines
  SCN-specific regions: Sequence locations=1-245
ggccgccaagagtttgagggccttgattatgcgtgtacccatttctccgtccataaagttaaatatagttgggaaaacagtagtacccttttttggctcagttgtccagtgtccttcttggagtgtcacgatttgtttcgaccgtgccgaattggattcatggacatagggtcgaatgcaaaacgaaagattggattgaactaacaaatccagccacaaatgaagtggtcggccttgtgcccgag

SEQ ID NO: 88596 - DNA, 260 bp, Heterodera glycines
  SCN-specific regions: Sequence locations=1-103,126-260
ggccgccaagggcacgcagccacgttggccaaggcgtcgccagcgaagaagaaaagtccgatcaaaaaggcgaagaaagcggcgcctccagcgcccgcggcggtgccaaaaaagaccagtccaaaagtgccagcaccagcggcggtcaaaaaagtggcagtgaaaaagccgacaccgaagaaggcgccgaaagccatcgcgcgcaagtggccgcaccaccgccgccagcgccggcggcgaagaaagcgcccgtgccatcg

SEQ ID NO: 88597 - DNA, 213 bp, Heterodera glycines; identical to SEQ ID NO: 88537
  SCN-specific regions: Sequence locations=1-133,155-213

SEQ ID NO: 88598 - DNA, 179 bp, Heterodera glycines
  SCN-specific regions: Sequence locations=1-179
ggccgccaaggaggttttagaatgtattaccctaaaatgattaggcttccgtctgaacttatttccgaattggcgagtgctcttccccttgacccccgctgggccgtcatccgtgtgtcctcggcctttgattttttcgtttatgcaaaacagataatttataggaaaataaaacttgg

SEQ ID NO: 88599 - DNA, 352 bp, Heterodera glycines
  SCN-specific regions: Sequence locations=1-352
ggccgccaaggtccaattaagaaaatcatactaacaaagacggctatggcatcatctggggaccagtcgttgagagacgcgttggagtgcccggtgtgtaaggacctgttcactgaaccgaaacaattggattgtggtcacacctactgtctgaattgtgtgaatggactggaaaaggtgccgaacattgtccaccgtattgtcggcgacgattatttcgacactcttggcgtcggtcccctctccacacttgtgcagtccgtccaaaacaatgttcaatgcccgcagtgccgcaaaatgtgcctggtgccggacagcggactgagcacgaactacgccatcaaagatatgg

SEQ ID NO: 88600 - DNA, 279 bp, Heterodera glycines
  SCN-specific regions: Sequence locations=1-194,216-279
ggccgccaagcggcaaactcacccagggcccgcccgtcgtcggaccgcctggcccatcaggaccccctggccagcccggacagcccggcgagaacggacagcccggccagcctggaaaccccggcccgcaaggataccctggcgacggcggaagccccggccaacccggcaaccccggaggcaacggcgagcaaggacagcctggagcacagggatcaagcggccaatgctaccactgcccaccgccccgcaccgcccccggctactgagtgtgatcag

SEQ ID NO: 88601 - DNA, 242 bp, Heterodera glycines
  SCN-specific regions: Sequence locations=1-114,136-242
ggccgccagggacatttagagctatcaataattatatttcgtccaatcgaacaacatgaaaggagttatacccaaaacagggtcaagactcgagtgtggtcacctgtttaaaccaaattctgttgcagattaattaatttgcagctctttgctcgtcacttcgtctgccgacgactccatcactgtgtacgactgtaacagcggcaacaaacatcggtcggtgaacagcaaaaaatacggcg

SEQ ID NO: 88602 - DNA, 576 bp, Heterodera glycines
  SCN-specific regions: Sequence locations=1-167,191-237,259-576
ggccgccaaggcaaaagtccccaccttttcttatctcccgtttctttgtgtttctgtgataaataaaaatgtcttctcattcttcttctgttgtggttgataattgttgtccaccatcacaaatgacaacttcttcttcccccgctgcctttcgttcttctgcgctcgcttttcttcagttcctcaacaaatcggtcacccctttccatgctgtcgaatcggtcgaggccattctgaagagtgcaaattttgttcaaaagtccgagtatgacaagcttcaaattcaaccaaaggatcgtttctatgtcaaaaaaagcgagacttccatttttgcttttgctgctggcggtgcctttaaaccgtccgaagcgggggtttccattgtcgtcgcgcacactgacagtccttgcttgcgcattaagcccgtctccaaaaagacctccgaacaatttcttcaggtcggtgtttcgctgtacggcggcggtctgtggcgcacgtggttcgaccgcgacctgagcaccgccggccaagtggtgttccgcgagtcggcggacgcgcccatccgacacaagctgg

SEQ ID NO: 88603 - DNA, 250 bp, Heterodera glycines
  SCN-specific regions: Sequence locations=1-250
ggccgccaaggtccaattaagatcgcggttgggacttggacaacacgaagtgatggacaattggcgaaggatgggcgggaggcggaaacgaccatgccaagtttgcaaaggacaggccgcaaatgttgtctctaagcattggcaaatggttgagcaatagagatgcggccatccattgccgcaatggacaaattaatgttcgaatgggcgaacattggatgaaaatggtggagaaaagcgatgacatcgg

SEQ ID NO: 88604 - DNA, 209 bp, Heterodera glycines; identical to SEQ ID NO: 88547
  SCN-specific regions: Sequence locations=1-209

SEQ ID NO: 88605 - DNA, 198 bp, Heterodera glycines
  SCN-specific regions: Sequence locations=1-198
ggccgccaccataatggtggccaccaccataatgtgtggttgtcatgatgatagccaccagaatcacgcggacgagcaccatatttgccatcgtgctccgcccaattatcctatttgccagaaatgcctatgtgaacaagtgccaagaaaagaatcgacaaaagtgtctattttttttgtaaacatgatcaaagtggg

SEQ ID NO: 88606 - DNA, 577 bp, Heterodera glycines
  SCN-specific regions: Sequence locations=1-240,263-488,510-577
ggccgcaaattcgaccattccggatgtatccacatattgattatctacaaatattcgaattagtgaatattccagatattattgagatcggcgtaaatccctttgcgctcaaactgctctctgcaactccgacgaaatcgtggagacgtacgcctgtggggcctgataagtgaacattctcacgtaattctgagcgttactcactggccacctttcacgacatagagctgaatgccatcgtcaattaataaaattgctttcactcccagacatgctgtaaactgacggaacagccagtgtgtgtacaatttaaatgcaccgagacaggaatcagacgcaaggaatttgccagcagatcctcattgtccgacaatggatggtctcgctacattgccggcgatgtcgactcacatgtttggtggcgagtcacggattggcatagcatgaggtgcatgtgccaatgtattgctccactaccctatgattcatcacaatctgctggatgccctccttcttgtcaacgcctcctcccaaaggctgtgtgggtcgaatgggcctaccaaagatggaacgagaa

SEQ ID NO: 88607 - DNA, 352 bp, Heterodera glycines
  SCN-specific regions: Sequence locations=1-352
ggccgccaagcttcttctgctgctggatttgcattgtaccggtgccacaccggcctcggcttgcattttgttaaatctctatatgcttccggcacttattccgccattgtgttggcctgtcgaagtgaacagcgcgcgaagagcgcaattgaacaaatttgctgtggccaatcatcgccggcggaaaatggcaacggcacccaaacaaaattagaatttgcgaagttggatttgacctgcaatgattcggtccgcactttcgtctcccaactcgacgagcgtccctatcaaaagggcagtttgcgattgctcgtcaacaatgccggcattatgggccatccctttcaattgg

SEQ ID NO: 88608 - DNA, 694 bp, Heterodera glycines
  SCN-specific regions: Sequence locations=1-24,47-694
ggccgccaagaagtttgagacaaatttgtttgttttgttgaatttccaaatgctgcttattttaaagaattgttttggtcggcttcatgttatttgtcatcaacttacgcgcagaaattttcgtcttcttttgcatcgacgaaaggaattttccgtattccattaaacttcctgtccacaaaacgaatgaataaatgttttagaaaccgattttcttcagcgtcggtcagccaaagtcttctttcactggtggaaatgcatcgggcggtagcggcggaatgcctcctaacccttttcagggcatgtcaaactggcagaaaatggctgttgcagctgctgtgattgtcggactgcaatacttcatcaatcggctcgcttacacagaaatatcatggaaacagttctacacggactttttggaaaagaacaatgttgaacgcctcgaagttattgacaataaatgggtccgtgtcattaccagggatccaacgcagaccgttttttacttcaacatcggaagcgtagacacttttgagcgcagtttaacccaggcacagcaacatttgggcatggagacgagtcagcagcaggtgccggtgttgtacaaaagcgaatcggacatagtcggaatgattccccatatggttaactttcttatcacgggcatcttcctgttttacatgttcagaatgtt

SEQ ID NO: 88609 - DNA, 663 bp, Heterodera glycines
  misc_feature (647)..(647): n is a, c, g, or t
  SCN-specific regions: Sequence locations=1-663
ggccatcgccgcttccactttttcccgcgttttcgcagaaacgtggctggcctggttcaccacgcgggaaacggtctgataagagacaccggcatactctgcgacatcgtataacgttactggtttcacattcaccaccctgaattgactctcttccgggcgctatcatgccataccgcgaaaggttttgcgccattcgatggtgtcaacgtaaatgccgcttcgccttcgcgcgcgaattgcaagctctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacagggactataaagataccaggcgtttccccctggaagctccctcgtgcgctctcctgttccgaccctgccgcttaccggatacctgtccgnctttctcccttcggga

SEQ ID NO: 88610 - DNA, 202 bp, Heterodera glycines
  misc_feature (168)..(168): n is a, c, g, or t
  SCN-specific regions: Sequence locations=1-202
ggccgccaagcaagtttgaggggttttgagccgcccccggacgtcgaagttccgtcagaaccaccggtggaatggcgcgcgtggctcaacaaaagcaggcgtttccctccgtcggaagaagaaattcagctgaacctactcaaacaacaagctcaattggtacaaaancacagaaacggaaaagaaagcgccaatgattgtg

SEQ ID NO: 88611 - DNA, 163 bp, Heterodera glycines
  SCN-specific regions: Sequence locations=1-135,157-163
ggccgccagaataacaaaatgtcccctcttcgttttctcgccgttctgctgctgatctgtgccatgttcagcttcaacaatttggggcttgccaatggcgaggaaagcaaagacagccaagtcgctctccgtcccgatgttgctgctgttcagcctgacctcg

SEQ ID NO: 88612 - DNA, 173 bp, Heterodera glycines
  SCN-specific regions: Sequence locations=1-173
ggccgccaagcaaaatgcattttctctttttgagcgtcttttcactctttttggccaagcactgttcaaatgccattccgatcggtgctggtaaccaacgggatgtgcggcgatcaatggtcattgatcttcttaatgccaatcaagagtttgatcagttgcgaagccaattg

SEQ ID NO: 88613 - DNA, 266 bp, Heterodera glycines
  SCN-specific regions: Sequence locations=1-266
ggccgccaagcaggccccgccctccctcggaccgcctggcccagcaggaccccctggccagcccggacagcccggcgagaacggacagcccggccagcctggaaaccccggcccgcaaggataccctggcgacggcggaagccctggccaacccggcaaccccggaggcagcggcgagcccggacagcccggagcacagggatccagcggccaatgctaccattgcccaccgccccgcaccgcccccggctactgagtgtgatcag

SEQ ID NO: 88614 - DNA, 437 bp, Heterodera glycines
  SCN-specific regions: Sequence locations=1-18,44-437
ggccgccaagacttattttagcttaaattttcttcctaaaatggacatcgatgaattgaaaaaaatgagtcctgagcagcaaaacaagcttctcgaggatgttcgtcgtcaatcagacacccaatcggttctgtctttgttggcatccttctctgaaaaatgttcccaacggtgtatcacaagtccgggcaacactttgagcggaggtgaaaaacagtgtttgcaacgatgcgtggacagatggcttgacagcttcagcattgtttcaactgcttttgctgccaaggcccaacagatggccggcatgggcagtttcggctcgcccgacggaggaccatctttctcatgagggtggacagttcattgatcgttgagttatttgatttgttggtttttcgcttgtttgatcttttagtggtttctttttgaaaacagtg

SEQ ID NO: 88615 - DNA, 174 bp, Heterodera glycines
  SCN-specific regions: Sequence locations=1-58,173-174
ggccgccaagcgcaatggaagagacgccaatttctctgttgcgcatggcgcgcgaggcggagaaggagcagaaggaagagaaaaaggaggaaaagaaagaagagaagccagaggagggaaagaaggaagagaaaaaggaggaaaagaaagaagagggaaagcaggaagagaaaa

SEQ ID NO: 88616 - DNA, 623 bp, Heterodera glycines
  SCN-specific regions: Sequence locations=1-623
ggccgccaagtttgagatcaaataatgccacgtcgcgtgtatggcatttaccgttcggcgtccactgcgcgaatgccaagcgaatcgcgcgggactgaatttgcggctgcacgtagcgcttccttgccccgttctcgctctaacatcgacataccggcctttggatgtgccggtgccaattatatgccattcactggtttttctgccgtcaaatcggatatctaccgtgtgaacccattatattcattgcgcaattacatgtccgacaaatattaccatttttcgcatcgctacaagcgtacacaattccatcgccattattaccacggacaaattgaccagtacccgtatgaatggaacttcgaagggcgtggaacggcaacgggacaattttactttgcccgacgtatgaaattcaacccgtggcagttcgggtggaatcgcttctacgacccgtacagacgctactacgacccttaccatgacgcgtacatcaagctgtacgactacagaccacgtctgattgacggcatttattgaccaatcacacaattgatcaaagaaaaggggatgggacagacagaaattgatgagaaaaaaatgccaatgacaactgccagaaa

SEQ ID NO: 88617 - DNA, 136 bp, Heterodera glycines
  SCN-specific regions: Sequence locations=1-10,34-136
ggccgccaagtttaaatatattttattaaattagaccaaaaactttttaaaatgcaattcggaactggcgctgatccggtgcttgaagaatgcgcattttgtggtgaaaaagtgacattgactgatcgattgatgg

SEQ ID NO: 88618 - DNA, 196 bp, Heterodera glycines
  SCN-specific regions: Sequence locations=1-196
ggccgccacataatggttgccaccaccataattgttgttgtcatgatgatagccaccagaagcaggcggacgagcaccatatttgccatcgtgctcgtccgacttatcgtatttgccagaaatgccaatgtgaacaagtgccaagaaaagaattgacaaaagtgtaaatttcatttttaaatttgctcaaacttgg

SEQ ID NO: 88619 - DNA, 3762 bp, Heterodera glycines; identical to SEQ ID NO: 85123
  SCN-specific regions: Sequence locations=1-102,124-1038,1060 -1828,1850-3742

SEQ ID NO: 88620 - DNA, 5442 bp, Heterodera glycines
  misc_feature (971)..(971): n is a, c, g, or t
  misc_feature (984)..(984): n is a, c, g, or t
  misc_feature (1161)..(1161): n is a, c, g, or t
  misc_feature (1282)..(1282): n is a, c, g, or t
  misc_feature (1287)..(1287): n is a, c, g, or t
  misc_feature (1564)..(1564): n is a, c, g, or t
  misc_feature (2549)..(2549): n is a, c, g, or t
  misc_feature (2551)..(2551): n is a, c, g, or t
  misc_feature (3039)..(3039): n is a, c, g, or t
  misc_feature (3202)..(3202): n is a, c, g, or t
  misc_feature (3253)..(3253): n is a, c, g, or t
  misc_feature (3329)..(3329): n is a, c, g, or t
  misc_feature (4269)..(4269): n is a, c, g, or t
  misc_feature (4280)..(4280): n is a, c, g, or t
  misc_feature (4319)..(4319): n is a, c, g, or t
  misc_feature (4416)..(4416): n is a, c, g, or t
atgcattttcacaaattgtttttgcttttgcctattttgcttctccatctccaacaatcccaagcttgcttttcacgtggcaacagtggcgaaccgtcggatggcaatcccgaggcccaggggctaaaagtgccaaaaattttgaattttaaaattaaaaaattctcaaattttcagtcggaaaacgatgttcggactgttcagttgaagaaggaaaaacaaacggatgaaacggaagaggagaaagacgaggaaagttcggcagaacaaaaattgccatctgaattggacccggaatttgtgaaagtgagagaaattggaaaatttctttttaattaaataaatatttaaaaaattaaaattttcttttttaacattatttgatattgtctttatttttgagggttttgaaaaactattgaatatttttatcaatttaaaaaaaaatttttgcttggcttggaaatttttgaaaaatcttatttatttgggaacaaaatatttgaatttaaaaatgaacatttctttgaaaaaatattgtattgaaaatttaataattttttgaaatttatccaagttttttattcaaatgattcttttaaagacttatctgcgagaatttggtcatctgaagcacaatgagaatggcctttcccatggcgttaagtgcgtttaaataaaatttcaaaaagaaatattttaaaaatcacaattattttaggcatttccaacgctttttgggctaccggcagacgggcaatgtcgacttggcaacccttcaaaaaatgtcgtggaaacgctgtgccaactctgacgagggctacacagcacaaggtgggggcggatcgatgaattatggcattcgccaggattattttggagtaaagaaaaatgccggaaattgggccctcaaaatcgaaagtcaaactaatttcctggcaaagttaccacccgagaatggcacttgcatnacagggtcgttcngggtcgagaaaaatatcgggtcgggtttcgggtatcgggtttcgggtaccccggaacaaccctgttgcattacacaaagtgtttaatgcaatggcactggctgtgttttaaataaataataattattattttttaattagtccgataattaattaattacttaattattcgcatttntttttttcgctttagacccatcgcaactttgggaacgttcgacattgttctggaacctgaacgcgtcgcaccccaagcagttcactcatggcgaaacgaagtcagccaaaatttggcacantttgncaatttgaattagcactcattaaacatgttttattacatgcttttgcataattaacttaattgcgcttaattttgcagggaattaattgcgcaagcattccgcgcatgggaaattgtgatcaaaatcgactttctggagacgaacaatgcggacaatgcgcagatcattttcacatttgaaagcgacggagcaaaaaaggagaaaagcaaaaatggggaggaggagaaggaaaaggagggcaaaacaggcaaatcactttctgatttgataagcacngatcggttggtcaaaaagacagagaaggaaattctgatcattctggcaaaaaacaaaatttgatcactttagaatttgttaaaaatttttcaaagtcggaatattcaattcgaaaaacgaatttataaaagtatttgctgaacatcaatttattatttccccatattctgagtaaattaggcgagtttttttaatggctcaatgtttaagtttttaattttttactttttaaagagcaattaaattttgatattttaatcaattttattaattaagaaattaacaaaaaacatgaattcatcacataactcattaacttaattaagtgtttaatttgtattatttatgttttttgtgatttttaaatgctttttgcttttgttaaggcctcgccattgccaaggcgtcgtcgccgcccgttgcgcgaattgttttgaatgccgacgagaattggtccacttttcaaacacaagaagaggtgaaagttaaatattgctaatttaacaatttattttttcagggaaaaatcgacatttttgtggtaaaactaaatatatttttcgaaaatttttggcattttttgccaattttgaggttttactccacgaaattggccatgcgcttggccttcgccattcgggagacgaacattcagtgatgttcccaatgtttgagcgttctgttggcgaacatgtaaaattaaattaattaatttaaaaattaaaaaaatatttaaataaaattctctaatttatttcagttgccagtcatttcaaatgatgatgtcgagcatttgagagcactttacggtgattaactgctaacaattcattaattattttcttaacatttgtgtgtgtttgaagtgctaattaaaaaatggaaaattctaacattattaattaattttactctttgacaatttattatttatgatatttaaattattacatttttattttttttaaattttttaaacccttcncntaagccaatttgctaagcctttttttcttcgcttcggcttcatttgtttccgcatgctttttgttttgtttttttgccatcactttttgcttaaaatatttttcaccatgggatttcccattgctttttccatttttggcatttttcagcgcttttcggcaataaaaatgatgggcccaaactgcgcgtgaagcgcagtagcagcgtcgccagcagcgcaagtgccgccggtgccatcgctggtggtgccaatgccgattctaatgccgacaatgcgtttgcatcattttatgccgatgatgacaataccgttttgtgttgtgtgtgccctgcgccgatgacattaggcgatttgaagaaaagttcgtcgaaaaaaaataatgaaaaattattttgaaggctttgcggcttttcactatttagaattttcaaaaatccatttttaaatggcttaaaatagaaaatttgactcccaaaagtgcctgctntgctttttctgctttcttttttcgtttttcgactattagagccgggtcttcccgggaggccgaaaaatgagacaaaaacctctccacggaggccccaatccaaaccacacactccgaaaagtatgccattacaaaaaaactccattttgtacctggacaaatngaagaaaaaattccaaaaatgccacatgcctggcttttgaaaattttgtgnttcacaagatttaaatcaattttcaggcttaatattccaaatatatatttctcgtaaaaacattcgtctatatttnaacgcgtgtttttcactttgctttttcttttgccgtgtgttttgcactttattttaaattattttttaaattaatttttaattaaatttattacattttattttctgatcactttcagagggcgacctcaccgatcgaccaacacttgcggccgatctgcgcccaacgaggcccgtgcccgtccagggcggcacgcacagcacagagtttaaatttagaaaaataaaataataataaataaaaaataataaaaaataaacaaaaatggttaagctcatacggcggcgaaggagctacgacagcagcaggaaaagaagctgaaaaatgccctcactccatcacaacggcagcgaatggtaaaaaaggggggaaaatttctttttaaattattttttaaataaaaaggaattattttttaaataaaattaatgcccccccccccaattttgcttttttcagttaattccgagactttgttcctcttcaaggacggttacgcatggcatttgagcagaggaaaattggtcggaggcccctacaaaatcagcgaggtgtccctcctaataatgcgatttttttgaagtttttgaaaattttcgcccagtttttcccggacggtcctgaaaaggtcgacgtcgcattttcatccggtcgactgacagtgctggtcaaatcgcgcatgctgttcggctatgagtttgatcagaaaacggcccaattcacgtgagacaatttttgatttcattaaattattcgaaaagaaaaaggactgagatgctttctcgagtcatgactaattatcacccgagaatctcgaacatttgcccttcttttcgaggttagaataaaaacggaccggggttgggattaacgaattcaaaataaatttttattcgacaattttcgaaaaataatcctaatgagaattttggaagtccanatgggactcanatcacttccaattccgctatttattctcaaatacaaaanatgaactcatttatatcattaaaagaaaaatcatatgttcgaatatcatttctaaaataaataattttaattatttaaatatttcaaaatgttttanttgtatttaatttttaggcgtgaccaccgttacccccgcgaattgcacagccgaattcttttctaccccgagggcgcttttccgattgtcaatggaagcgtaattttgttcaaagtatggcaaaaacaaataaaaaataaatgttctaaaattgaaattcaggacgatgtgttcgccacttacaacgtggagagcaacacgccgcatttggtaattagttaattaattcattccaattaattaattgattagaatcattagttacgcaattaattaattaatgagtaaaaattccagttcggaagcatgtccgaatttttccccggactgccccaaaatttgcgcgccggttttgccgccacgcccgattttaccacctaccatatgctgaccaatgattacggtaatttgctgccacaaacaataaccgatcgattttgcattttgtgccctcaaatttcaatgaaaatttacaattttgaacctaataaaaaataaaaatgaacttttatgccaaaattgggcttgatttccaaaagctctttcttctccgcattaatagggcaattagcacaaataattaacaataattaacaaatgttttcagcatttttgtacgatgttcgcgtggcacgaacagtcagctcacaaagcattggccaatttgttggctgtgaggggaacaaattaatggtgaaaagcaatttattaaacattctatttgtataattaatttataattaatgtttcttaattaacactttaaattaatttaaatcattatttttattaattttaattattaatttatatttttaataaaaataatagttttaaatttcgtttgttaattaattaaatttttagcctcctggtccaccgatgcctcatcttttcttcccataccagccgtaaatttatatatatttaaaataataattatttttaaatgattttaattttaatttaatttttaggtctccacctcaaaatccgcgattcccacaacaaaattatggaaaataa

SEQ ID NO: 88621 - DNA, 977 bp, Heterodera glycines
  SCN-specific regions: Sequence locations=1-604,627-667,690-977
gatcattacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcaga

SEQ ID NO: 88622 - DNA, 378 bp, Heterodera glycines
  SCN-specific regions: Sequence locations=1-378
tacccaagtgattcctattcaccacctacctgctgtcctgttgggctagcgttggcaccaccaaatgcccccgtccgctgatgggcacaggtcgttcgagatgacttgtggacgctgcccaacattacggggcagctgcctcacgagccatgcttttggggtgcttccatacgttggagctgtggtataccgctcagtgctgcacatgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactg

SEQ ID NO: 88623 - DNA, 1191 bp, Heterodera glycines; identical to SEQ ID NO: 85166
  SCN-specific regions: Sequence locations=1-33,55-1057,1082-1085,1109 -1191

SEQ ID NO: 88624 - DNA, 1597 bp, Heterodera glycines
  SCN-specific regions: Sequence locations=1-536,558-1016,1146 -1421,1443-1471,1494-1597
caaatgtgccgactccaagcaactcatctgctcgctcgactctttctgcttcttgcgctttgcactgctctcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaattcacatccggacgaagcggtcaaattcttcacccgaattgctcaagcgtacggctcctaccctcacattttgtacgaggatttcaacgagccgctgagcgtttcgtggaccgatgtgctggtgccataccacaaaaaggtcattgctgccatccgagctattgacaagaaaaatgtgatcattctcggcactccaacatggtcccaagacgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtcggtgtttcgtcccgttggacatcctccggaaatatggttgcttcgtactacaagaaaaaatccaccggcgtaagctgtagcggctcaagttccggcagctcttcgggctcgagttctggctcttccggttcaagttccggcagctcttccggctcaagttccggcagctcttccggctcaagttcgggctcctctggttcgagctcagggtccagctcgggttcgggatccgccagcatctctgtagtcccatccaacacgtggaatggcggtggtcaggtcaacttcgaaatcaaaaacatcgggtccgtgccattgtgtggcgttgtgttcagcgtctctcttccctcagggaccacgcttggtggatcgtggaacatggaatccgcaggctccggccaatacagcttgccaagttgggtcagaattgaggccggaaaatcgagcaaagacgcggggctgacattcaacggaaaagataagccaacggcgaaaattgtgacgacgaagaaatgttagggaaaagacaaagcgcaaaatgggaggaaaagaatgggaaaatgaaagagtggagaaaaagaacaaagggaaagaaagacaaagaattaatgattatgataagagataataactgataaagtttagcataaaatgttgaccaaagtaaaaaaaaaaaaaaaaa

SEQ ID NO: 88625 - DNA, 819 bp, Heterodera glycines
  SCN-specific regions: Sequence locations=1-142,164-438,460-462,484-819
atgaattcgtccgtcgtttcattttcgctgttactttttgggttattcacaattcgcactgcaaaatcgcaatgcgagaaacattgcactaaaagcaaaccgatgggccaatgcaatgaggcggaagaagtgattctgcgcaactccgactgtgccttcatgaagaaaacggaaacggcattcgaatttgtggtcggaatgaatggccaaacggaggacaaaacggcgcccggggccaatgccaatggggcatttttgtgctgtaaggcaacccaaggaaccgcaacacttttcatcgtcggcgtggccaacaaacggctgatgttggccaaggacgtggtcaattacaaatttcatcaaaacatctcaatcgatgattttgaacgggaaaagcaagtgttggaaagtgtttcggcgcagggacaaaaagccggcattggggacaattatggagaaaaattcttccaggaccaaatggacgccaacaaaatgattcagaaaggctatgtgaagctgtggaccgccaacaaatcgttgcctcctcaaaatgtgccggatttacagaaagatacccggcccaaagtgacggcggcgacagaagaaatgattttggcactgaaagtgtttcaacagtttcgaaagaacaaaaattgttgggcatctgtggaaaaggaactcttaaagtcgcaaagctttttgagtttggccgaacccaacggaaaggacgcaatgcgaaaagcggcggtgcgattgtgcgcaaaaatggaagcgaaaattgaggcacaaattgacgaaacggcaaagaaattgttggcctga

SEQ ID NO: 88626 - DNA, 808 bp, Heterodera glycines
  SCN-specific regions: Sequence locations=41-808
ttgattacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgtctgcccaacattacggggcagctgcctcacgtgccatgcttttggggtgcttccatacgttggagctgtggtataccgctcagtgctgcacatgtgaaagcctgtgtatggctgctgcgtggcaatgtgtcggtggcgggccgctcgcttggctcggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgt

SEQ ID NO: 88627 - DNA, 724 bp, Heterodera glycines
  SCN-specific regions: Sequence locations=1-183,207-212,234-528,556 -618,648-702
cgccccgggggcggatttgccgttggcattgtgcctggaggggcggccgaagcgttggaatcattccccggcatgaatcggctgattacgtcacggagaaaggggttcgtaaaattggccatcaaacagtggtgtcgcaattgtgccggtgtttcatttgggagaaaccgacgtttatgagcaaaaagaaagcagagaggggagcacattgaagaaaacgcagaatttgttgaaacgattaacccgcgtcagttttccgttggcctatggccaaagtttcatcgctgcccttttgccggaagaaacggcacaaaaattgccgcgatggcttcgcgtcggaatctttccgtaccggcggaaaattgtaacaatcgtgggcgagccaatggaaattgaagaaaatgcaaattgtgaggacgaacaaacggtggacagaatacacgcggaatattgccaaagactgcggaaattattcgacgaaaataaagtgaaattgggaggactttcggaggacagcgaaatcgaatttgtgtagagaaagagagagagtgagtggggaacggggagggcagtgaataagcagagacacgcgaaagacaacggttacagagaagagggagacagcagacagacagacaaaaacaaaagtgatcaattcacaaattgtacaccttaaaagaattaattagagacaacattttgatttaaaaaaaaaaaaaaaaaa

SEQ ID NO: 88628 - DNA, 689 bp, Heterodera glycines
  SCN-specific regions: Sequence locations=1-689
gtgcaaaccgagcgggttttggaccaggcggtacgccagacgttgtcgctcagcgacgcctcacgccaagggttggtcgactcggcactcgccgacatcctgatggcaccttgcggcttgtccgagggtggcaccgaagtgtcgctgatccgtgccgtttccaagggcctcgttgacgcgtccaaaggcgtggtggtcgacccgcgcttccaacgcgagctgtccgtgcgcgaggcgtacgaccgcggcatgttcacctcgcttcgctcggccatgcatctggccgcgctgctcgacgtccatccgtcactgatgacgcccgtgaagaagaagccgtactcgaagaagcgtatccaacgcccgggccagccagcactggcagaggaccaagtgaaggtgacgcttgccgaagcgatgcgccagggactgatcgacgcacgcacgcagcgcttccgccagggcaaccaggaaatgtcgcttgacgacgcgctgcaccgggggctgatcgacccgcagagtgaatggattgtgccgtcccgtgcgtccggcattgggccaacgattgaggagcgcacgcaggagacagtgaccgagacgggccaacaattggcaccgaaaatcttcccggacaaggaattgcaagaatcggtgaacacggtgaagcgcgtgcgacggacggagaccagcgc

SEQ ID NO: 88629 - DNA, 1080 bp, Heterodera glycines
  SCN-specific regions: Sequence locations=1-944,969-972,997-1059
tgcggtggcgccgccgttcgggcaattgtccgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcgattgaattcttcaccaaaattgcgaaagcgtacggctccaaccctcacttgctttacgaaacgtttaacgagccattggatgtgtcttggaacgatgtgcttgtcccttaccataaaaaggttatttctgcaattcgtgccatcgacaaaaagaatgtgatcattctcggcactcccaaatggtctcaagatgttgacgtggcggcccaaaatccgatcaaaggattcagtaatttgatgtacactctccacttctatgcgtccagtcactttgttgatggacttggcaataagcttaagaccgccgtaaataagggtcttccggtgttcgtcactgagtacggtacatgcgaagcgtctagcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtgtgaaatgctaaataaagtctgaagtccggatgatcaactgaaactgaagaaaatggaaaatgtgaagattgcgaaaaaataaatatatataaaatttgcatgcgaatgtttatcgaaattccgattaaattgttttttgagcgcagataaatcgcaaagcataaaaaaaaaaaaaaaaaaa

SEQ ID NO: 88630 - DNA, 1511 bp, Heterodera glycines
  SCN-specific regions: Sequence locations=1-447,469-927,1057-1347,1434- 1511
ggtggcgccgccgtttgggcaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaattcacatccggacgaagcggtcaaattcttcacccgaattgctcaagcgtacggctcctaccctcacattttgtacgaggatttcaacgagccgctgagcgtttcgtggaccgatgtgctggtgccataccacaaaaaggtcattgctgccatccgagctattgacaagaaaaatgtgatcattctcggcactccaacatggtcccaagacgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtcggtgtttcgtcccgttggacatcctccggaaatatggttgcttcgtactacaagaaaaaatccaccggcgtaagctgtagcggctcaagttccggcagctcttcgggctcgagttctggctcttccggttcaagttccggcagctcttccggctcaagttccggcagctcttccggctcaagttcgggctcctctggttcgagctcagggtccagctcgggttcgggatccgccagcatctctgtagtcccatccaacacgtggaatggcggtggtcaggtcaacttcgaaatcaaaaacatcgggtccgtgccattgtgtggcgttgtgttcagcgtctctcttccctcagggaccacgcttggtggatcgtggaacatggaatccgcaggctccggccaatacagcttgccaagttgggtcagaattgaggccggaaaatcgagcaaagacgcggggctgacattcaacggaaaagataagccaacggcgaaaaattgtgacgacgaagaaatgttagggaaaagacaaagcgcaaaatgggaggaaaagaatgggaaaatgaaagagtggagaaaaaagaacaaagggaaagaaagacaaagaattaatgattatgataagagataataactgataaagtttagcataaaatgttgaccaaagtaaaaaaaaaaaaaaaaaa

SEQ ID NO: 88631 - DNA, 715 bp, Heterodera glycines
  SCN-specific regions: Sequence locations=1-375,397-434,464-677
tttggtccgtcgacgattcggtcattcacacggattactccgcactccgttccattgtaatgtcaaaccgcgaggaaaccgtaaaaatgccgatcaacgagccggccaagtcacgcaaagcggtttcacagattcaggagtacgtggattactacggcggcgcgggtgttcagcacattgctctgaacccttcggacattgttcacgccatccaatcgctgcgcgcccccggcttggagtttctgagcatcccggacagttactacgcgtctctgaagcagcggctgagcgacgcgggcgtggagttgaaggaggacttggagaaactgagggagctgaagattctggtcgattttgacgagcagggctatttgctccaaatattttcaaagccatgccaagaccgccccacccttttcctggaaatcatccaacggcacaaccaccagggctttggcgccggcaacttcaaagcgttattcgaaagcatcgaggcggaacagaacgaacgtggcaatttgttctacaaagacgtggcggtgggaggggaaaaaatcgaagcgaaaaaaagcgaatgaaaacgggcgatagaaaagaaagaaagacagccctaattgaaaaccaatgagaataataagaaacaaaatatttatcaaaaaaatgcaaaaaagtgaacgaaaaaaaaaaaaaaaaaaaaaaaaaaaaaaaaaaaaaa

SEQ ID NO: 88632 - DNA, 787 bp, Heterodera glycines
  SCN-specific regions: Sequence locations=1-710,739-750
gtggtcattggtacggatgacagcggcaaaatgccgatgactgaaaaacaggagacggcaccaaaatgtgccacaaatgttgcggcacggagttgcgcatgttgtgagcatgtcaccgtgcgcaaaattcggctggacgacgaagtgtgcgtgaatgtgacttatttgcccaccaaaattggcgtccgattggccgtgtcggtagatggccatgtgtactattccaaggatttggcagtgttcaacccggagtcggcctgctttgaagtgcccgagatgcgcgagtacgcgagcatttgcatcaatttgtacaatatggaactcaaaaacaacaagctgaccggttgcgcaaagttggaggccatcctgctgcatttgagggtcgcccagcacaaaattggctgcttcagcataccgatttgagaggagctttgtttattacaaaaaaacagtacaaaaaagaataccgtatgccacccagctgataatacagtatggaatccaaaatacaaatagcactcttaacgtattgattcttctgtgatctttttaagcccccatcaattcgacatatgacgtcattgtacaaattcctcccccctctaattaattgttcaattattctaccatcttatgcagagcagtgctcgtaagtgtgctcattttttgagtgtgaaaaaaagccaaaagtgctgatttttgaggtttcgacataatttttgaaaaatataattttttgcaacaaatctcattaaaaaattttcttttttaaaaaaaaaaaaaaaaa

SEQ ID NO: 88633 - DNA, 1245 bp, Heterodera glycines
  SCN-specific regions: Sequence locations=41-788,811-852,875-1169,1241- 1245
ttgattacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaacaaggtagctgtaggtgaacctgctgctggatcattacccaagtgattcctattcaccacctacctgctgtcctgttgggctagcgttggcaccaccaaatgcccccgtccgctgatgggcacaggtcgttcgagatgacttgtggacgtctgcccaacattacggggcagctgcctcacgtgccatgcttttggggtgcttccatacgttggagctgtggtataccgctcagtgctgcacatgtgaaagcctgtgtatggctgctgcgtggcaatgtgtcggtggcgggccgctcgcttggctcggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccttagtaacggcgagtgaaa

SEQ ID NO: 88634 - DNA, 647 bp, Heterodera glycines
  SCN-specific regions: Sequence locations=1-647
agtcctaaagaaaaacgttcaaatgtttcgcttttcgctgcttctgctgcttgtccctctcgtccgctgtgtccccaacccaaagcctttgttcggaattggcatcggtcgcaagcaaagcgcgggagcggaggggaagctgacctgcgctggagagccgttggcggatgtgaaggtgaaactgtatgatgacgaccgcggggtggacacggatgatctgatgggcgagacgagaacggactcagagggacgcttcagattggaggggtacacgcacgaaatcaccaccatcgaccccaaaattaacatttatcacgactgcaacgacgggctgaagccatgccagcgcaaaatctcaattatgatcccggacaaatacatcgcctcgggcgaacatcccaatacgtattacgacgcgggcacagtcgaattggagggcaaattcagtggcgagacaagggactgtctgcactaattgcattggaactgatcatttggcactttctgatcagttgggactgaccaattggaactctctgcactgatcactttcccatttttgtttctgttttgtcaccgattttccccaaagtcttacaccacccaatgtgaatttgcataaatttgtccgcaaaaaaaaaaaaaaa

SEQ ID NO: 88635 - DNA, 797 bp, Heterodera glycines
  SCN-specific regions: Sequence locations=1-102,176-504,526-607,629-772
aacaaaacaaaacgaacatttgccagcagttggctaggacaacggcccaaagagaagtgaagtgaattgcctctgctctgaacactgatgatgatggttcgttcttcctcctcttccttttcccttccgtcgtacttcctttctctcctccccctccttctcctccttttctcccaatgttcccaaatttcttttgcttgccaatgccaatgggccccgccaaaggacaattattgttcctccgattgggttgcccacgtgcaggtgatcaaacgacaggacggcgtgcgaatgccggcggggatcaccgaccgacagacggacttaaactcgcgacacgaagtcaaatatttaaggatgtttaagatcagcaaacaaatgccggtcaatcagcagaaccaagtgattctccctgtcaatgtttatacggccaccgaggatgccgcctgtggcattttgctcgagtcgggacaccaatatttgttggccggcgattacgtcaacggcacaatgctcaccggactgtgccggcaaattctgctcgaagaccttaaggagtcacgaaagcacgacattctcgagtggacagaagtgccgcaaaagctgaaagaacagctggaaaagcaggaatttgatcagaaatgcaactgaacagaatggaaaaagaaagagaggacaaacaattgcaaatgaatgatcagaaaaatcaaacggacagagaaatggcccaatcgggcactttttgctgaacgaacatttccaataaacgacgaataaattaaaaaaaaaaaaaaaaa

SEQ ID NO: 88636 - DNA, 725 bp, Heterodera glycines
  SCN-specific regions: Sequence locations=1-478,501-725
aaaaagccaacaaagaacaacacacaggaagttggctctatggaatgggcaagaattgaacttgaaaagcgctttgcggaatcaatgcgccgtttggctgaaatgcaagaacagtgtgatagagtcgaacatataaaccaacagcttcaattagagaatgaaactattgccgatcatgttgtactgtatcaacatcagcgacgcttgattcgtgaacgtcttcgtctgaaggacgaacaaatggcggctcttgagaaggagcgtgaacgtgttgtggctagatgtaatgaactacaagaagcgcttaggcaagtcttgggtaatggtcgagatgaggtggcggagtttcgcccccgtttatacagccattcaacggtggacgaatttagtggagacgaagagtgcattgtcgacagtgcaaaagagaattctcaatcccttctgccaaatgttcatcactcaccagaaacaaatggtcaaaaagaaattcgatcaactgaagagaattcaccatcaactgattggacaaatcgcgaggatgcggtgaagaaaatcatggacatcatcgacgatataaagaaaccgtccatgcctttgtcttcagttaaaatgcagtgtaaacagtgtatcggacctgttctacatctttagcaagagttacatttttgtactacaaaattgcataacttttcaaaatagcctagtttgttctttgttggcttttt

SEQ ID NO: 88637 - DNA, 1284 bp, Heterodera glycines
  SCN-specific regions: Sequence locations=1-214,236-796,818-1026,1048 -1177,1199-1222
cttcctcggcatcgtcaacttccttctccaattgtttctgtttgttgtcaccggtggcagacgcaatattttggcagttccgcaaagacaacgtttaacggccgaggaacgctcagcagcagaaatggaagagcatcagcagcagaagaaaacggcagaaatttacagcaaatattttgtggtcggcgaacatcgcctttcagtgaatttgccacaacaacacaacgccaacacttactattcaaatccgccgtattcggtgcacgtgcgggattggattgacggcaaaaaatgggaattctccgtcacgaagccgatcaactcgcagcagtgccttttgaaactggcaatgctcgagacggatttggcctcaaaccccgtgacggccgaaattgtcttttggcaatggttccgaggaaagcaggcgcacattttgcaaaagagtgtcaaagtgttttgccagtcgggtgcccaagtacagcttcagcacaacgccggcgctgccaacgcggcaccgtccgatggctttttcaacgttctcatccgcttgttggagaagagggagcatcaaatcattgaaaatccgtgccccccgtgcgactcggagaacgaagttgtgctgaaggtgggccccgagcagttcactgtctccaagcactttctgatgtccgtgtcgcccgtcttccacaaaatgttctccgtcgacatgttggagaaggcacagggcgaagtgagcctggaggaaaccaacggggaggagttcggcgcgtttctggacgcaatctcgcccaaaatggcatcgccaaatcctgccaatgtgatgggaatgctcaaattggccgaccgtttccaagtcgatgcgttgcgcaaccgatgcgaggcgcatctgatcaattgcgtggagatcagtctgatcgaacggcttttgtgtgcggaaatgtaccgattggaaaagctaaagaatttcattctgaaaagtctgaacggcgtcggaatgcgcgagttttacgaggagaatcaggcggcactgaatttgctgagcaaagatttgctcatccaactgacagttcgcatctgttccagttcgaaaatcgatcggtcggcactgtgccataattgcacgaaaattttgaatgaatgaaacgtaaaaccgaagggatttgaagaaaataaaagctaatgtttatatttaaaaggaattttttgttttgtttttctttacaaatttaaatattttgatttgattataaaatattctttatgtgtaaaaaaaaaaaaaaaaaa

SEQ ID NO: 88638 - DNA, 660 bp, Heterodera glycines
  SCN-specific regions: Sequence locations=1-29,52-396,418-556,583-660
gaatttgtgttcatttacaaacttgcagcaaaaaacaaaccagcaaaaagatgaaacgcaacggaaattccatttgctcagaaaccaagccaccgcttttggaattgacgccaaagaatgtattaactttccgtggcaaactcggccacgtcggttccgtctctttggacatcaaaaattgtgagatctgctccgtttacttcaaagtcaaatcaaatgccaaccacttctattcggttcgtccaaacaccggtgtgattggggcgtacgggcgcgtgaaggtggtcatccaattgcacgacgacagtctggcaaagttggacgagattgaggaaaacaagcacaaattcctgatcatggcagcgattgtttcggatgcgtccattggaacggagaaattttggaaaggcaaaaaagaggggatggatggcatttactcgagcaaaatgaagacggaggtgcacaaagtttgtcggtgggaaggagggaagggtgtgctgagccaacagaactcggaagaaaatgtgccgaacggaaagaactcagtgtctgtggagaaagtgccaaaccaaattttggagttgtgttcggagaaggaagcgccgaaccaattctcgaacttggaggaaaatgtgccgaacggaaagaactcaatgctgc

SEQ ID NO: 88639 - DNA, 630 bp, Heterodera glycines
  SCN-specific regions: Sequence locations=1-478,501-630
aaaaagccaacaaagaacaacacacaggaagttggctctatggaatgggcaagaattgaacttgaaaagcgctttgcggaatcaatgcgccgtttggctgaaatgcaagaacagtgtgatagagtcgaacatataaaccaacagcttcaattagagaatgaaactattgccgatcatgttgtactgtatcaacatcagcgacgcttgattcgtgaacgtcttcgtctgaaggacgaacaaatggcggctcttgagaaggagcgtgaacgtgttgtggctagatgtaatgaactacaagaagcgcttaggcaagtcttgggtaatggtcgagatgaggtggcggagtttcgcccccgtttatacagccattcaacggtggacgaatttagtggagacgaagagtgcattgtcgacagtgcaaaagagaattctcaatcccttctgccaaatgttcatcactcaccagaaacaaatggtcaaaaagaaattcgatcaactgaagagaattcaccatcaactgattggacaaatcgcgaggatgcggtgaagaaaatcatggacatcatcgacgatataaagaaaccgtccatgcctttgtcttcagttaaaatgcagtgtaaacagtgtatc

SEQ ID NO: 88640 - DNA, 630 bp, Heterodera glycines
  SCN-specific regions: Sequence locations=1-6,28-320,342-630
cttcgctttaacattattaatgtttgctattattttctaagttttattttccttcaatcatcggctaataaaattcaaatgtccatcagtttggctgatcggatgaagcttttgttgaccaatggcgatggggcggacattcaatttttggttggccaaggagaggaaaaggaggttctaaaagcacacaaactcattttgatggctgcttctgacgtgttcaaagcaatgttccgtttcgacgctcaaaacgcaaagacaaaaacctcctcttccgctgaacagttacaatccgtggagatcactgacatcgacgccaatgtgttcaaagtgatgctgagctttatctacgcggaagattcaagcggattgaccggagacaatctcatcgctgtgctttacgcggctaagaagtaccacatttctttgctggccaaggcttgcgcggactttccactggaaaatgaattgcccaatgttttcctcgcttttgaccaggctcagcttctcgatgagaaagatttcgcaattcgttgcttggattacattaatcgaaaggcggaaactttgtttggttcagaagaattccttcaaatcggccaaaatttgttgtctaaaatttttgcgagt

SEQ ID NO: 88641 - DNA, 606 bp, Heterodera glycines
  SCN-specific regions: Sequence locations=1-256,285-330,376-499,521-606
aaaattaataaaatttgaagaaatgaattttcaaattatgtgatcaaaataccgacctattaggccatagaattacaccaattatgtcaagaaaagtgcgagaatttatattttttgaaacgacctaataaaaggaatagtcatggtttacgtcttccacgggtccaatggttgctgctgttcgggctcattgaagagatgttgttgcggcatgtcgtgcacttctgacatcgcatccgatgggcgcggcaaaacagtgccagcagcaccgacagagactggtctacttggcatccgttgcggtggcggcgtttgtggcggtcggggctgaaaattttttttaaacaattattttttattgttatttcttttatacaatagcagtatttttcttaaagataagtggaggggaatcccaccacaacgcgctgaaaatgacggtccgtcgcgtcgccggtagcgcgacgatggccagaaacaccaccgctcctgtgttggctggcattgtcatcagctttgtcaaagcctccgttggaaacaccggacatcggaggagtgccaaagtcctgctgaagtgccagcggttgttgaagcacatcagaatga

SEQ ID NO: 88642 - DNA, 630 bp, Heterodera glycines
  SCN-specific regions: Sequence locations=1-2,24-606
gtccaattaaggaaacccaattatgacgagctcccaacccattatttatgagaaaattgtgcaacaaaatggtagcaaaaacagcgctgaatggtgtctggcctcggaacggcgactgctccaaaaactgatccatcataagccggtggggatcaatcggcacttcaacctcaacttgttggtcatttacatgaacaacattttcgactttgaggaggacattaactttgatgactatctgagcgaaaaggatgttgaacagttgaagaggcggcgtatggagggcaagcaggacgagcgaaggccaatggcattttcaccgtcctacgcaattcgaccgaccacgaaacaggttgaagaaaagttgaacgaatacttcgacatggagctgatcggggagaacgagtccccctctgaagaattggaaaagaaagctgtttttgaactgccccaagagtaccaattcaaggaggaaatggtcccacgataaatccatcacatttttggcatttaatacaatttttttacgtaataaccaaatcctttggtttctatcgaaattttctgtaaatgtgtaaaaaaatggcataaaaatacatagggatgaaaaaaaaaaaaaaaaaaaaaaaa

SEQ ID NO: 88643 - DNA, 873 bp, Heterodera glycines
  SCN-specific regions: Sequence locations=1-248,270-362,387-853
gctcaccggtcagcaaaggcattttgcaatacgacatgtgggatgttgtaccaacggatttatgggactggccgctgctcaaagaacgcatttcaaagttcggtgttcggaacagtttgctggtcgcccctatgccaactgcttcgacagcacaaatcctcggcaacaatgagtccattgagccgtacacttcaaatgtgtacagccgtcgtgtcctttcgggagactttcaaattgtcaatccgcatttgatgaaggatttaattgaactcaatctttgggatgatcaaatgaagaacagactaatcgcggagaacggatcggtgcagaacatcaagcagttgccgcaagaaatcaaagacctgtacaagaccgtgtgggaaataccgcagaaggacattttgaaaatggccgccgatcgcgccgctttcattgaccaaagccaatcccttaacattcacatagcgcagccgaactatgctaaactgagctccatgcacttttacgcctggtcattgggacttaaaaccgggatgtattacctgcgcactcgtccggctgtcgatgctgttcagttcactgtggacaaaatggcccttcggggaacaattgccaaggacgaatctgtcgaaatcgacgttttgaaagacaaggaaaacatttctgccaattcggagttgcgcttgccgtccaaacgcaaatacaatgaacaattggaggagagcgatgggtgtttgatgtgttccggttgatggattgtttttccatttatttgattgtatttttgggcattttttttatttggctttaaccattggttttcgttaacatatgataaattgatattttgcttaaaaaaaaaaaaaaaaaaaa

SEQ ID NO: 88644 - DNA, 370 bp, Heterodera glycines
  SCN-specific regions: Sequence locations=1-343
ccaattaagagcacgctaattaaacaaaattattcaatgcaatccaacggggctgcgaccggcacggcatcggcggcggacgccgggcgggcgaacacggcacaaatggcgcaggcgaatggtggcattgaacgtgagcggaagccgttggagagtcgtcaaattgttgcacaatacatcaaatatgcagtgaaattggaacggatcatttgagcgaaggcacacggctggagaaaatcggacgagtaaacgaaatgttataacgaaaattttgtataacaaatgttgtgttgcttcgttttactttgacaattcaattcaatgcaataaaaaaaaattggtcaaaacaaaaaaaaaaaaaaaaaaaaaa

SEQ ID NO: 88645 - DNA, 685 bp, Heterodera glycines
  SCN-specific regions: Sequence locations=1-274,296-685
tgagctttcacaataaaagaaaatgatgctttggggttctccgtcgccagtttctacggatgagacgaaggataaaattggccatgattactcacaccttgaattgatcaaaggtgacacttacgaaattggaatggagccgtcatcagttggtgggacttctgctggacacaatgcgaagccgttcttcgctctcgatcagctgaaacaggcgggagtcccgcttaaggcgcagattaacccatacttacagttggatccgtcaattttcaaggagagccaaccacaaatcatcatgcctgaaggttatgagtctggtcggggaaaatttgagttcgctctcggttacatcggttgttcggttatcggaggattcggagttggaagtgttcgtggaatgttcggcgagttaggaaatccacagaacagaactttggcttggaatccgtggtacactcggatgctgaatgccgccactaagcatggcagcggatacgcacaaactgctgggactgccatgtttctctattcggtcactgagttggggctgaagctgtcacgagccgatgacttgcttaattcttttatcgccggaccaatcgctggcggacttttccgcggattgcctcatgggctgcgtgctggcagtgttggtgcattggccggactgggtttgtcaccgtct

SEQ ID NO: 88646 - DNA, 1165 bp, Heterodera glycines
  SCN-specific regions: Sequence locations=1-15,37-136,158-430,452-1165
gtccaattaagagacaatttatttaatctttttgaaagtatcttaaaaaaatatttttgtgcaaacaatgcgtgtaacaattattgctggtgaaaatgttgcttcattggagatttcggcagacatggaactggaaaacttcttggccttgtgcaagttcgaactcccctccattgccgacacaccaatcgaaagaatcgcgctcaactgcagcggtcggcaattcatcgccaatgctggactagcaaagaaacagcttaaggagttgaacattcaacatgaagacgcgattcatttcgaaacgatcagtgcttcttccaccgcccaaaccccccactcgtccctttccacgccgtcctcagccgcttcgacctccctcggcgcgccgctgcaaacttccaatttgatctcttccctcgtccaaaacatcaaagtgccccagaagcaaaagagcgtggcggaagaccgcgccatgtccgaccaaatcttcaccatgctccaacacccggcacggctcgacttcctccgggtggaccaccccgagttggcagctgcttatgagaaaaacccaacggacaaagatcttttttacatcgccttcatgaagaacaaagaagaacagacgcgacgagttcggctgatgtacgaccatagcagtgaggagggacagcgatacatcgcccaggaaatcgaacgggagcgaatcactcgaatgcaggagttggccatggagcacatgccggaggcgttcatcccggtgcatatgctgtacattcggatgaagattaacaaccaccttgtgatcgcttttgtggactcgggtgcccaggcatccattctgtccgagagttgtgctcgacgctgtgacattttgaaatacgtggaccgccgttaccgagtgcaggcccatgggattggcgggtcgcaaaagatggtagggagaatcttcgcctgccaagtgcaggtcgatgacaatgtttttgcgtgtccctttgaagtgatgagcgacagagacgtcgacattttgttcggcctgaacgcaatgcttcgccaccggtgcaacatcgacctcaagaaaatggtccttcgctttggggacggcacggagacgccttttctcagtgagcaggaagtcaagcgggagaaagaagcgattgcaatggcc

SEQ ID NO: 88647 - DNA, 742 bp, Heterodera glycines
  misc_feature (707)..(707): n is a, c, g, or t
  SCN-specific regions: Sequence locations=1-660,682-719
cctcgtgccggtttgagtgcatttcctttaatttatttgctttctgaacaattgaaattgcgaccatatttaagcagtttgatgtagttgaagcatgtccttgcagtgcctaacacaggaagaagtgaacacaatttgcaaagacgtcctcgaaaatctgatcggtgcctcaacctatcagcataccgaagcagtaaaatggaaccaaagtgtcgttgagaaaatcaccgccagattggtccagcttcaaaaaccctataaatattgcgtgtgtgtaattttgatgcaaacgggttcgggtgcgggtcttagcgttgcgtccatgtgcttttgggaccgacggtgtgacaattccttcgtcgtccgttgggagagcaaagccgtgaccgctgtttgcaacatttttgcgattgccgtcgactccggcgctgtgtcgcccgtgccaatgatggacaacgacgccgccactgatggggagggcggcactgttgctgcgtccgccaccgcaaccaccaacggcggggacatcgtcggcggcggcaaaagcgaatgcgagtgacagcgacaaaaatgtgaccaaacgcggcggacggagggacgggcgcgaacgacttgccatcatttcaatgccccagcaaaaaattagaggaaaaaaaatgcaaaaatttgatttgatttttattgattgatttgtgtgtgacttttanatgacgggagagaaaaaaaaaaaaaaaaaaaaaaa

SEQ ID NO: 88648 - DNA, 941 bp, Heterodera glycines
  SCN-specific regions: Sequence locations=1-225,248-376,398-941
gagcctaaattattttgttctcatttaaaatcacaacagcctgaaatgtgcctgaatcgtgtggtattggggcctgaaattacgcgaaggccggcggcgatgccattctgggccgatttggcccagggcaataatgacaacagagacggggccaactgggagggagcgcggcatttcgaacattggctaaggagggggagtagagcccataagtgccctatttgtcagcacctcactcccactcagtccgtcatgttggccttattcgcctcaattttcgaatgcatttttctgctctttagcacatttggcgccctggcttcagtcatgcgaccaaagatgaagggctttctgttgctcgcattgcttccgctggtcacatttttaccagaaacaatggcgaaaagtatacaagccgctgaaatgtcggaaatgaacgacgaattgtccgactaaaaagccaccgatcgcatcgcctgagggaaacacacagcaaacgcaaatctgcggacaccaaatattcgggtcttccatttctttttactcttcctttgtcaccaaataatattttcaaatgaaaaatgacgacctaattgattgtttttgtgtgtttcgtaggcaattctgggaccatatcgagaaattttcgattcctcagaggaaacttcccaaaattgtccatatttatttatttgtgcgtttgtaatttttgggtttgttcatttataattaaaaacatgtataatgcaaaattaaaacaacaggattaaaaacgctgttttttgagtatttcgggacgccacagcagcgggtgagaatcttctgactaaaagtggaagagaatcaaactatgaatagccaatcattccctcccacattttcttgccgctggttttgtaattaaaatataaatgtgaacatttctcaccgcttccgagtcc

SEQ ID NO: 88649 - DNA, 145 bp, Heterodera glycines
  SCN-specific regions: Sequence locations=1-84,106-124
agagagagagagagggggcgggggggggaagtgatcagttgggacaaaaagtgccattaatttgtgtttcatttttagtgtgaatttcattaatttatcatttaaaagtataaatgtttaccttaaaaaaaaaaaaaaaaaaaaa

SEQ ID NO: 88650 - DNA, 690 bp, Heterodera glycines
  SCN-specific regions: Sequence locations=1-184,206-299,321-690
catcccaagaaaatgcacaagggcagtttagtgccactttttggcaaaaatttgcaacaaaattcgtggagagcgtttggggagaagagcccactgaaaaggtggcgattaaacaaattaagtgccttcaaatggcttattagttttctcttctccaaatcgcttcccctcgtccttctgctgatcattttgctgctttacttccaatttcctctgaatcttttcggcccgagcgatggcaccgattttgggcgaattatttccaatggcactttcctcgccaaatttgttgattttcaaaaacgtttttcaaaaaattattcaaccatcgaagaaaagctgacgcgattttcaatttttgttgccaatttcgaacaattggaaaagatccgaagggaaggcgaagtgtacggaattacgacatttttcgattgcagcgatgaagaattgaaagaattgataatgccacatgaatactttgaaagcgttcccttttcttgggctaagccaatccgcgaatttcgtccgatggatgcgaattttaagcggccgagcgaattcgattggcgcaaaaacggagtggtcaatcacgtgaagaatcagaggcgtggcggcgcgtgttgggcttgtgccaccgcaagattgggccaagtcacagcacccaattcacagcggaacacggggtcactc

SEQ ID NO: 88651 - DNA, 867 bp, Heterodera glycines
  SCN-specific regions: Sequence locations=1-765,787-867
taagcaaaaaaaaggatgattcaaattaatacgtcaagcgatttgaacgaaaaagtgtacgatgccattgtcgttgtgtcggatgggataaattcgctgtcgaaagtggacaaattcagtgccgaccttcgaaatgccgtcgagtcttattcaaaaattgaccattcgctggacaaaggcaaagtttcgcttatccaagcggacaaattccacgcaaaacgaattgtttacgcgagcaccggcacagtgcacaaagactttgacgatgttcgacggtacacaaaagcgggcattgcagcgggtgaaactgcattgtccgccggcgttcgttcgcctctcctcgtcgctgtgccctccgagcgttttccaaacgcgtcgcttatggctgcgcttggctttctccacactttgtacacaccgctgaatttggctgtgccggacaagcccatccgtaaggtcgacctgctcggcatctttgaggtcgaagccaacgaaaaaagcaatgtgggaccttcggtttcgatgctgcaagcgttgcaacaatcgtttaacgtcgccagagacattggggacggagacccggagagaatgtgcccagcaaaagtggcggaatacgtcaaaaaaacttttgagaattcgtcggtccgcgtttcgattatcgacgacgttgaccaaattcgccgtgactatccgcttatgtcggccgtttcgcgttgtgccaatgccatcgaggagcacaaagctcgtctcatttggctcgaatacgacgggggagaagagaccgagactctgtttttagtggggaagggcgtcaccctcgacacgggaggggtccacctcaaagtgaacggggccatgctccgaatg

SEQ ID NO: 88652 - DNA, 654 bp, Heterodera glycines
  SCN-specific regions: Sequence locations=1-271,295-654
atcaaaaacacaaatttctccatccaatttattctcgacaaaattcgccgttcattcgatttggaagaggcgcaaaatgagcaaaaatcaacggaatggccggtggccaatcagctggacagtttcgaagccattgacatcaccggcggtgccgcgtttatgtcgtcgattttaaaagttacgttccattggaaagagcccaaaaaagcacatccctttcccgattctgttgtactaaagattcctggcccaaaatacaattctttggtggcacaaaatgggagggaagaacaaacggacaacgcaatggaagaagaaagctccgattatctgatcaaagcgcacaccaatgagattcttttctacaaaaactttccgcgcttcgacgcgtccctccgtctgcccaaattttacttcggttccgactacagtcccagccacaataatgggttgatcatcatggaggacctgagcagccgcgcttcgtcccttctcactttgccaggcttcgacgatgcccatgtgctggtggtcatcgacgaactctccaaaatccacgcaatttcttggaagcacggcgaactgaagcaacacttcccgatcgaaattcggcccagttttatcgagtcaatgcgatctaacgcgaaacaattg

SEQ ID NO: 88653 - DNA, 529 bp, Heterodera glycines
  SCN-specific regions: Sequence locations=1-365,391-529
atgacttgtgtcaaaaaaattgagttcccggatgagcctggttttttttgttcggataggttggccagatacgaacagtccatgctaattgagacgggacatatgtacgcccaggcagcgcgcaacaactctgaggcggcgcgcaacaattctgtgacggcgcaagagagtgtccgtgctatggtgaacaaggaccgtttggtggcagacaaggaattactattggcacaacaaaagatagaactggacgaaaaggaccgcttaatcgcgacgctgagggacaccatccagaacaaggaccagaggatcgtttacttggaaggttatatcaacggacttggtgttccattgcccgcgccggcagaacagcagcagcaggacggcggcggccaatgagagagagaggcctctgacagaatccgactgaccagaagaaaaaaattcgcggacttttctttgatgtggaatgttttgttttgtttttttgatgctttgcgcctaaaaaataaacatggcttctgacaaaaaa

SEQ ID NO: 88654 - DNA, 865 bp, Heterodera glycines
  SCN-specific regions: Sequence locations=1-533,556-865
aaaacgtcgactcggttcgagtgcggcgatatattcgcttggcatgtcacaacgaatgtgccaaagaatgtgcgagacatcccggcttcgaaagtcaatgctggccccactgcacgaagtactgcttggactacgcggcaacacatggaatgctcgactgctcgggcaaagaatgctaatctctggaggaaaaaggcgatgatttttcggctgattgaagaattagtgacataattagttatgtccaagcataaagcacaaattatcgtttatttcccttccgtcactttccttttcttcagtcgctcaactagttcggccagttttccatcgtcgatctgttgagcccattctggctttcggctcgacaccgacatttgtgccattatttgttttatttcctccgttttcactctgtccaaattgaaatcgttgggtttgtgctgaattgagtccaaatccgctgcgggtgggggagcgggcaacagccaattgctctgacaatgcgttggacttgtggcggtgggcgttgaggcgggcggggagggcggcgcgtcgtcgacggcggaggagggcaggaggacgtagccgcagttcagcgacggaccattctcagcatcgaacgcagtgttgtggccatcttccgttgcatcgctttcactttccgctgattcgtgcggacggtcgacgcccgcgacaccgacgcgcatttccacgtcgaacccaattcgccacccctccgccctccatcccgcgatttcatcatcatcactttcaacagagtcaattctattcggtgtcgaagacgaattatgtttatgtgcttcttcgtttggtcccatgcgataaaaattgaaatttgttc

SEQ ID NO: 88655 - DNA, 456 bp, Heterodera glycines
  SCN-specific regions: Sequence locations=1-291,359-433
gttttcagcgcgcaaatctaaaaatggcatctacccaggaattggcggtcatttacgctattttggcacttcaggacgaggagttgccgatcacggcagaaaaagtgcaaacgatggtcactgctgccggcgttaccgttgagccgttttgggctgggctctatgttaaggcacttcagggtgtcgatgtgaaggctcttctgtccgccgttggcagtccgggctcgggagcggcagcacctgcgggaggcggagcagcggctgctgcgcctgcggctgaagcagcaccggccaaagaggagaagaagaaagaagaggttaaggaagagtcggacgacgacatgggattcggacttttcgactgatcacgtacacatgctattatgtgtttttgttgtttaccagaatttttgcgtattaaatttgtttgttgaaaaaaaaaaaaaaaaaaaaaaa

SEQ ID NO: 88656 - DNA, 906 bp, Heterodera glycines
  SCN-specific regions: Sequence locations=1-54,77-374,397-906
aatgcttttcccctttcgtttcgtcctctctatcagaattggtgctgctttgcctcattctttttgttccttttctgatgcttttccatcgtctggtgatcgaattctcattcgaagagagaatttcaaccgaaatagaccaaggcttttgaaaaggaatgaaaagagtcttttggctgagaatcggcagggaattcccacggcgacggactgtgcaacactcgtgctgttctgtcagttgggctcaccatccgccgaagaaagttgggttctcttcacacaaagggcgaaaaggatgaagcatcatgccaacgaaatttcgtttcccggaggacggatcgagcagggagaaagtgtagagactgcggcgatcagagaggcggaagaggagatcggactggaccggaacgacgtggaactgtggggcactcttcgtccgctgttcttcggagaggcgggcgtcgtcactcccgtagtggcaaccattgggcaaaacgtggagcaacggttggcctcgctgagatgtgccgacgccgaagtgcagaatattttcatggcatccgtttcggatttgctcgcccgaattcactacaccacatttcgattttctggaaaaccatccgatgacaaaatgccgtttttcttccgaatgcccattttccactcgaccaaaccgcgacttttgtgcaattcttcgctggtcaattgtccggaaaagttccgcatttggggactgaccgcgcgcactttgctggaggcgctcaatgcgtttttgccggaggacgcgaaggaaagggaggcgagcgaattgctaaggaaagggaagacagacaacagctgctgatcagatttatgagcagagagagagcaatcagtcggggatcagccaaattcacatttattggc

SEQ ID NO: 88657 - DNA, 636 bp, Heterodera glycines
  SCN-specific regions: Sequence locations=1-282,371-636
attaatagcaaatttctattgtttgtaaagtgcaattcttctcccttccttttcctaatgatgggaccaactcaaaagaaggcgaggctcaacttcaccatcgaccaactcatcgtccgtccgttgcgcgactcgcaacgcgtcaacgtcgttcctccgccgaccgtaacaaacgcagcacagcaaacgcagcagccgccgttggctgcacttcagcagcagacattgcagcaactgacaaatgtgcgttggccctctcttccgtcgtccgcctttcgacccctttttccccctcctctctccgcgccgttcgctttttctcccttcgctcttccgtctctttttttctcttctccgcccttctctcttccgattccgtcttctttgcccaacaatttgtcttcatcgtttcatccgtcaccttttttgatgctcactccgccaactcgcgccgctttgatggccatcgccctccgaagacaacagcagcagcattttggaagtgcgggcagttcaacagggcctagcagcacatgctcatcctcacagtcagcgggcacgacggagtgtgttgccattcgtaccgaaaatcgcccatgcgttgtttctccggcgttgcgacacaaaaatttgacg

SEQ ID NO: 88658 - DNA, 575 bp, Heterodera glycines
  SCN-specific regions: Sequence locations=1-154,176-283,318-492,516 -548,571-575
atttgtctgtcatccaactttgtgtcacttacggcaacaaaaatttggcttttcgcctcatggaccgactgaatgcgtacgaggagcaagtgaaggcttatctcatcctcggagaagtgaaaaaggcagcgacattggcagttgaaagggaagacttgcaaatgttacagagcatcaaatgccgactggcgccatcttctgccaattgggaggaagtgaagaaaatcacggacacattgctgaagaaggcagcacatgcctaattgcgcaatgattttcatactttatttacttatttttattatattattatttatgggtacgcgggtcggttgagccaacgattcagtccaaaacccataaagagaaaaacaaagctttagtcatataatcttaatttgaatcacttctctttaatgaagtggttggattaagcaagaaaaaccaaaaaagcattggcacttaactgacatagtcagtcaattttattgtttcccaatatttccatttttaaatactgcaatattattataatttaaatgattgtcaaaaagtgatggctgataaatatatat

SEQ ID NO: 88659 - DNA, 554 bp, Heterodera glycines
  SCN-specific regions: Sequence locations=1-11,33-194,217-554
cattaaattcgaaattattttcaaataaattatagtaataggcacccaattcgggcatttttttcatttttccattcgaattcatagatatttttttaattttcaatttgcttccgttttccaggccgaggccgaccttcgcgttgctcaggccgagtttgacaaacaattggagattttgcgcattttgttggagtcactgcaaacggcacaaaaccaacagtcgaagcatttgttggaatttgtggaggcccaggcccaattcttttccgcctgccaacagcacatggccgacctgaagcgcgagatcaattcggccagcggagaacgcttcagatccaacggaattaatggcggcggtggcatttgaggggaacgaccgacggacagcgaaagaacggccgagggaaatgccgcaaagcgaagaatcccccaaaaaacgcattattttaccaataatataaatgagaaaaatgaatttatttaaattatgctttcatttcattttatacactgactgctaattgcatataaacgaacgaatcctttaaaaa

SEQ ID NO: 88660 - DNA, 532 bp, Heterodera glycines
  misc_feature (513)..(513): n is a, c, g, or t
  SCN-specific regions: Sequence locations=1-36,58-64,86-298,320-508
gtttgaggcctaatcttaaaaacctgctcattggtaaaaaatgaaatccttctttaatttcccatttgtcttttgtgttcttttgctcattggctgcgttgacaaatgcgtcggaggagtcgcggcattgccgccaaaatatttgggcattgaaaaccatgacaaatgcttaaccgacgagccaataggctcttcgcgtcggctttgtttgccagcgcagaaaaaaatcgaatgccaagatgaaacgttgaaagcgcttaatgatttggaagaaggccaacatccgccgacttgcgcatgaatccgaagacagaagcgaaagaagcaaatgaagggattgaagaatgacagggaaaagcctggctgaacaaaattttgtctacaaaaatgaaataaaaagttattgaaaataaaaaaatttattgatttgattgaaagaaaaaaggctgtattctattgaaattttcggcgcccaattattctgattcggcataaaaaatttccatttaaaanaaaaaaaaaaaaaaaaaaa

SEQ ID NO: 88661 - DNA, 647 bp, Heterodera glycines
  SCN-specific regions: Sequence locations=1-373,395-647
gtttgagaaaatccaattccaaaacactacgccaacaattcgaaccctccgcttgcaacaaaatgttcaaatccccaacaattgtgctcgtgttgatcaccttcatcatcctgcacattgctgtgcccagcgctgaatcattcatcaatctgtcggccgtcggagactttttcgctaatttgtgggactcgcgcgcggacaactgtttttacgcggcccgctaccatggcaatgtgtccgaccaattccatgaaaaagtcaaatattgggagattgaggatgtgcaaaatgtgagcgaccgtcggatctccaaggattgttcgggctcattctatgggtgccagacccacgcgtgcattgatgcaaaagggaaccccgtttttgtgttcaacttatgtgcttcttcggctgctgcttccggagagaacaacactggtcactgctctcaccctgaattggaagaactttgcgccatggaggggggcaaatcgaaatgtgccatttgcgagaatggcatgtgcaatgaggcgaacattgagctgcaaaatgtgatggggctggacatcaacggcaccattggcacggcggtggtggagaatggcacgaaaagtgccaaaacgggcgagaccggcggagacacgacggac

SEQ ID NO: 88662 - DNA, 516 bp, Heterodera glycines
  SCN-specific regions: Sequence locations=1-17,39-160,231-516
attccttgtgcgcttcgtctttttaattctctttttgcaatatgaatccaacgtacccaatggtcttttttctgctcgttttggtggccgttgttctttcgtccgttcatctgaaggaagacaaaattgatgtgccgcagcgcgttaaacgcggagaatacggcggcggtgcctatggcggtgacggcggtggcgttggtgcgcctgccccgggcggtggcggcgcggcgaacattgccaatgtgaacataaaccaacagaacggatgcaacgggcggggaccgcagtaccaatgggcgtacacgcggaagacgggatgggtgtgcatcaacatcataaacgtgatcatcaaccagcaaagcggcggaaagtgatgagaggagccgaaaaaaaagagagagagggaaacggaatgccaaacggaaaaaaagcaatcgaacggtgtgaaaaaatcatactgtaacggatgtacgataaatgttttttggaatagttaataaataaaaaaaagattgc

SEQ ID NO: 88663 - DNA, 382 bp, Heterodera glycines
  misc_feature (360)..(360): n is a, c, g, or t
  SCN-specific regions: Sequence locations=1-268,294-360
gtttgagagataaatttttaataccaaccggcggagtggagagagtggccaggccaattgctcaaaaaatatttgcccgaaacactcgaggacagaacagcacaagacaagcagaaagcagttgaagaggcattttggcattgccaccgacttatttggcgtgtcgaagcaagatgcgttccaatgaatgccgagtggaaagaatccgtcgcaattcggttgctaaaattggacaatttgaactgcaacttgaaaaacgaaaatatataattaaatgggaggaaaaaggggatattctcattgtcagttcaattggtggataaattttcctggtgcgctgaaaggcgtcgaaggattccnaaaaaaaaaaaaaaaaaaaaaa

SEQ ID NO: 88664 - DNA, 615 bp, Heterodera glycines
  SCN-specific regions: Sequence locations=1-162,184-328,352-615
gtttgagcaattttgcactacaatgggtagcgagggcaaaattttgactggaaatattaatggggaaacagaaagcaaagaagtgaattcggatgaaatgaattatttgcggcaagtgggtgagattttgagtcgcggaacggtgcgcactgacagaaccggcacaggaacaatttccatttttggcatgcaaacgcgctatagcctccggggagggaccattccattgctcaccaccaaaaaagtgttctggaagggcattgttgaggagctgctttggtttattcgcgcagaaacgaatgccaaaacgctttcttcgagaggagtcaaaatttgggatgccaatgggtctcgtgcctttctcgactccgcgggtttcactgatcgcgaggagggcgacttgggccccgtttatggcttccaatggcgtcactttggcgccgagtatcgcggcacggacgccgattacacgggcaaagggactgaccaattggcggaactgatccaaggcattcggacggacccgaacagtcgacggcacattttatgcgcatggaatgtgacggacattccgcaaatggcacttccgccttgccatacgttgtgccaatttta

SEQ ID NO: 88665 - DNA, 315 bp, Heterodera glycines
  SCN-specific regions: Sequence locations=1-315
gtttgagataaaaatgcgcttcttctttcttctgaccattgctcttctctccgttgttcttctcctttccccaagtgcactcgcaaagaaaagagcccgccgttcgatgcccgttaacgctgccatgccggaatggaaaattttgtccgctgaagtggaaaacgatggcacagcataagaaggaggaggcaagctttggatcatcggcatgatcgaagaaggaatttgccaaaatgatgaagaataaaccaatgaatgttgtggatttgtagaaattcattcaaatgccgggaataaaaatagttaaattaaaaa

SEQ ID NO: 88666 - DNA, 691 bp, Heterodera glycines
  SCN-specific regions: Sequence locations=1-691
gtccaattaagcgctcaaatactttcttttgtcgtagcacttttaaccgttgaaatatcgacaaatggctgaagaagcggtcgttgtgccggagatggaatcgcttgctctcacttcttcgtcaccgtgttcgccggtgctctctctgctcagcgaggaaatgcttcagaaagaggttccttgcgtgtgctgtgatggcgagaaagttgtggtccgtctctccatcttgtcgcagtgcggattctttgccaaaatgttgcaggacctcaacgtggaagccaacggactgagtgaggactttatgttcgacatgaccaaggcggagattccggcggagactttcaaaaagattgtcgcttggatggaggaacacaagggtcagccggtgcctgaattcgaggaggatccgaacactttcgagcgcaaatggctcacccaaaacgattttcagcagaatttcttcaagtgtgaatttgcggaggctgccgcgtttctgaacgccgccaacttcctcgacttgcagtctctgttccgtcacgcaacgcaggcggtggccgcgcgtattaaggaccgttcgccggaagagattcgtgaaatgctccacctcaacgacaaggaggacaaaccgttgacggaggaggaaaagaaggcgattcgcgagaagaatgtctggtgccactactaattgtga

SEQ ID NO: 88667 - DNA, 1149 bp, Heterodera glycines
  SCN-specific regions: Sequence locations=1-1,27-333,361-1091,1118-1149
gatatttaaaattaaaaataataattccaaaaatggcttcacgtgatgagattggccaaacggtgtgcgatttggtgggaaatacgccgatggtttacctgaacaaaatcaccgatggatgtgctgcaaaaattgcggtcaaagtggaatggatgaacccggccgggtccgttaaggaccgcattggcattgccatgatcgaagaagcggaacgccagggcaaaatcaagccgggcatcaccacaatcattgaaccaaccagcggaaacacgggaattgcaatcgcttttgtggcggttgcgcgtggttatcgtttcattgcaacaatgccatcgacaatgagcggagaaagacgcacacttttgcgtgctttcaatgccgagttggtgctcaccgatccggcactgggcatcaaaggctgcgtggagcgtgccgaacaattagctgccgccattcccaactcattcattccgatgcagttcgccaacgaagcaaaccccgaaatccattaccgcacaactgggcccgaaatttggcgtcaaactcagggcaaggttgacgcatgcgtttttggcataggcaccggcggaacgatcactgggtcaggccgttttctgcgtgagaagaacccagcaataaaattttatgcggttgaaccggtggaaagtccggttctcagtggaggcaagccaaatcctcacaaaattcaaggaatcggtgctggcattgtgccgcccattttggacacaaaaatgtacgaggaagtcgttttggtgcactcggacgaggccattgctatggccaaacgattggcacgcgaggagggccttttgagcggcatttcaagtggtgccaatgtggtggctgcgcttcgcgttgcgcaaaagccggaaatggccggcaaactgatcgtcaccgtgttgcccagctcgggcgagcgctatcttacttccgccctttactcggacattcgcgcagaaatggaagccatgtcgcatggtgaaacgctggaggacaatttgaagcgtcttcttaaagtggaggatgccaacagcaaacagtgatgaatttagcggaaatttttttaccggaattaaaatttaaaaaattaaaatttggctgtttgttttttttttgcctaaagctctg

SEQ ID NO: 88668 - DNA, 492 bp, Heterodera glycines
  SCN-specific regions: Sequence locations=1-422,491-492
aaaactttcaaaatggcaatgtcagcaattccaattgaacatgatgcagcatcacaatgggactggccgctacaacacactgacggagttgtcaaagtgcacaacacaaaagataaatttgaggttggattagacgtgcaattttttgctccacaagaaattgaggtcaaagtgtcgggccaagatgtgatcattcattgtctccacgaaattcgcaaagatcagcacggaagtgttaagcgcgaaattcaccgtcaataccgactgccaaatgacgtcgacgcggcaacattgaaatctcatctgtccacccgtggcgtgcttacattgacagcctcgaaaaaggactaactgagaaggaaaattgagtgaatttgatgggaaattaggacggaaattttgctcatcttgtgagctgctgttgaaataaattgaaacaaattgctaaaattaaaataaaataaaatgctccaaaaaaaaaaaaaaaaaagg

SEQ ID NO: 88669 - DNA, 554 bp, Heterodera glycines
  SCN-specific regions: Sequence locations=1-335,357-554
aaagattataaattctctgctttgaacatttttaagatgacacttaatccgcctcatttaactttgcgaggttatgagggtcacgattacatgggagacactttcaagaaaacgaatgattacgcccaaacttggttcgttccgttgatgaggggacaatctatagacaacagacaaattcctggcgatgattgtggattcttcgaagatcaatcggttagatgttttactgcttttggtgcaaaattgggccgtttatattgcgaccttgagcatagggaccttcaggaatgtgtttcgcgcacaaaaaagaataaacggttctggaagatcagagatgttcgcttcaaaaaatggctcagaggtgaaacgccacacattttcgaaccattggctgactatttgaaatcggttcatggtgctccgacttcctatccgactggtcatcgtgtgaagaaatgattagattagatatatcgtgagattctggtttttaataggagtcacatatgcatatgtatatttctgcgcgataaaatgcttttgttcaaaaa

SEQ ID NO: 88670 - DNA, 871 bp, Heterodera glycines
  SCN-specific regions: Sequence locations=1-195,230-871
ccgatttggtggtccgcagttttgactacaccacaaagcttgtctctgacactgattgttccccaacaaccaaatttgttccgcttattcaactccgtttgcattgtgaggaccgacaaaagtgtggcacagtgcgcacattcgaattcactctcccggaggcccgtcaatttttactcagtttaaaagccgaggacgacgacgacaaaaataacaacaacaacaacaatcgccaactgtcgcactgatgttttcgaaaaccgcctccccctcctctgtaccctacgacaaagtgtcgggactcaaattgcccaagccgagacggttggtgtacacgcgcacgtcgttgaccatttcagtgctcctctccggtggcattggctattacatgtacaaaatattgcggggcgacgagcgcttacacagggaatgggttgttccgatggtccaccgttggtttgctcccgaaagtgcgcacattctcggcgtcaaggcggtcagattgggtttcctcgacgattttgtggagagtcgcaaggagtaccccgagttggcatgtcaaatgttcggcaaacagttgaacaacccaatcggtttggccgccggctttgacaagaatggggaggccattgacgggctgcgcaagtcgggcttcggcttcatcgaaattggcacggtgacgccaaaagcgcaaattggcaatgatcggccacgcgtttttcgcttgagagaggaccaggcggtgattaattcgtatgggttcaacaacgacggcattggcacggtccttggccgtgtaaagaaggcatttgtgccggacagtggcgtgccgttgggcgtcaatttgggcaaaaacaaaacggcggaagac

SEQ ID NO: 88671 - DNA, 621 bp, Heterodera glycines
  SCN-specific regions: Sequence locations=1-365,387-621
gttcagttaaaatttaactctaatgactgatcggttgaaagaattatcagaaactcgcctgcatttaaaagcaactaagacaagggttacacgcgaagatggctcagtgatcgaagaagagaaaactgaaaatggcgagtttgttgtaatttttgagcgagccaatggaaatggaaatccgagtggatttaaacaatccaagcgaatgcaaaagggtcgtggctatgtcattgacctctcgcccgacttgcaagtggccaatgttagcaaaagcatttatttgagcagtcaggacgttgctcaggacctctctctgctgcaaaggcatggcatcactcacattgtaaacgcagcgtcgggcgttcgctgtttcttcccaaaggaaatgctgtatttgaagttaaagctcctcgatatgcctagtgaaaatttgaagaagcatttctgccgggttcatcggtttatgaaaaagtcaatcgacaaaaatggaaaggtgctcgtccattgcaatgcgggcatttctcgttccacagcccttgtgctttcgttccttatgcgcttcgaaggacaactgctcactgaggctttggcgcttgttcgggagcagcggccagttgcaca

SEQ ID NO: 88672 - DNA, 1183 bp, Heterodera glycines
  SCN-specific regions: Sequence locations=1-8,32-117,139-818,840 -1096,1120-1183
gtttgagcctatatttaattttcttcttctcaaaatggcttcagaagatgcttccaaaatcgtcacagagcaacgtaattttttcaaaaccggcgcaactcgtgccgcggcatttcgcaaggaacagctgaagaaaatgcgcgaaatgattgttcaaaacaaagacaaaatttgcgaagccatttacaaggacttgcgacgtaacaaggagacaaatatgaaaatggaggttgatgggcctttgcaagccattgactattgtctgtctgagttggacgaatggatgaaaccccaaaagctggaggaccaccaattgggcaagccgttggtcatttttgagccgaagggcgttgtgttggtgatcaccgcgtggaattatcctgcagccctcgcttttcaaccggccattgaagcaattgctgctggaaacaccgtggtgatcaaaccgtcggaagtgtcgccgaacacttccaaattgttgaagcaaatgtttgatgccacttttgacaaaaaattcatcgccgttgtggagggggcggcccccgaaacgcaggcgcttctcgaccaacgctttgaccacattttctacaccggaagctcgtcaattgccaagctgataatgcaagcggccgccaaaaatttgactcccgtcactttggaactcggcggaaaatgtccggtggtcgtggagaatgacgccgacttggagaaggctgctttgcgtatcgcagaagggaagtggttgaacagcggacagacttgcctggcgccggactacgtcatgaccacggccgagatgaaaccgaagctggtgaacgcactgcagaagagcattcagacgctctacggagagaatcccaagaagagcgagcagtattcgagaatggtcaatcaacgccatttcgaccgagtgaaggcgttgctggacaagacgaatgggaaagtgctgtacaagaatggggagccggaccgagacgatgtgttcattccgccggtcttggtggatacggacttgaaggacgcactgatgcaggaagaagtgtttggacccgtgctgcccatcctcaccgtgaagggacttgacgaggcgatggacgtgatcaacgacggagaaaagccgcttggggcgtatttgttcacgaacgaccaacaaaaggtggacaaatttttgaacgaaacttcc

SEQ ID NO: 88673 - DNA, 729 bp, Heterodera glycines
  SCN-specific regions: Sequence locations=1-45,82-181,203-265,287 -316,340-392,414-729
caaaaattttcaatttattattgctgagcaagtgggtatttaagcggggtttccttttgcaattaattaattgtaattaattgatcgtctccccaatggcttcttcactcaccattgaaaaacgctgcaaacttttcaacacaaaacaaatggaatgccaattcgatggaactgaagccggaaaatgtgctttttgtgtaaagcttccgtgtaaatttggagcagttaattgtgcagaggaagtgagcatctcttgtgtaaatccgcaagaattggaaaaatgctgcaaggcgcgtgacaacgaatgctgcgtgtgtgtgctatgcgagaaaaacaaagttatgaaggttttggtcgaatgttgcggaaagcgcaccgaaacgagtgccgaggccgggaaagcgctttgcatttgtgtgccgaaaattggtggaggcaaatgtggaggacaagtgcaagtgaaacaatgcgatgcgaagctggttgacgagtgctgcgcagctaacacggagagtggcgactgctgttgcgtctgtttgagctgcaatgaccaaaagtgtgtggtcaccgtccgttgtcctactggagaagcaaagtcgactggtccaacttgtactgcttcaaaatgcgaaagtgtgaagtgctgctgaagtcaaaaaactgatcgaagactgaaaggatgcatgcatttaactgactcagttttaaaaatgctttttcaattagcaa

SEQ ID NO: 88674 - DNA, 596 bp, Heterodera glycines
  SCN-specific regions: Sequence locations=1-164,186-596
ccaagtttgagtccatataatttcgagccctactgatggcactatttagtcatttttaattttattatttgtgaatggcctgctactaatacaccatggatattcgatctgaccagcaccggtatcctttttgcattgtttggacgccaatccccctcatcagttggttatttccctttattggacacattggtattgcaactagcaaaggtataattcgtgattttgccggcagcaattatgtctctgaggacaatatggcatttggatggccgacgctttatcatcaactaaatcctgaaaaagttaatggaggttcagaggcatgggataattctgtggcagaagctagcgatgaatacaaacgtcgtttacacaatttgttccttgacaattgtcactcgcacgtttcacttgcattaaatacaatgcgatacgacgggaaaagcaattggaataattttcgggtcgcagcggacattaatttacacggaaaattcgtccgcttttgtgggttcttgcgacagtttttgccattttctctgatccttttgataattgctttcgcattatttttcttagtttaaaataatgat

SEQ ID NO: 88675 - DNA, 620 bp, Heterodera glycines
  SCN-specific regions: Sequence locations=1-588,610-620
gtccaataagctttgtatttatgagctctatagaattcagtttgcctgtgttttgttcgccaactcagctaaattttgtgattggaaagcgagatttatgcgagagcaaaccgatacaaatattcaacccttacaatcatttactgcgctttaaattcttttcaaatgcgcctgagcgttggcgcgtggaaaatgctcagggcggcatccgggccaacaattacgtcacgacgacagtccaactgcgcgagccgcacacaatccgacagccgaccagcgactgtctccgcgtggaaattttcagggacggcgaaagcgttgcggtcggaagaaaagacattttgctcaacattttgacggttgagccgccctcttcgtccgtcgatggcgcaaattttgtcgaattttctgacggcaccgacgcggcattaaacagcacggcacagcgcggcgaggccaaattgcggacgaattccatccacaatttgacgggcgaaaatagccaacaacggcgacaccagcaaatgaggccctccccctggcaattgtccactttctattggctcgccttggccggtctcttcgcctgccttttctgccttttgctgccccccacggcg

SEQ ID NO: 88676 - DNA, 617 bp, Heterodera glycines
  SCN-specific regions: Sequence locations=1-42,64-515,537-617
gttaaaaaaggcctttccccacaaaaatgtccaatttgtttgtggcttcttctgctgttgtttttctccttctccaattgcatttcgtcgtcactttcgcatcatcctttgaaggggcgccgccaaaagcaaatgaagaagcaatgccaacgacgggggaacaaaacggaggtgccgaatttggtggaagcaagcagaaaatggcacggaaaatgatgcgatacaatggcaacaattttgacaaggtgtccgtcctcttcattcgacgtgaaatggcactgcgaaaacttcagctccaaatcaacgttttggagcagcaattggccaatgctttgtcgtccgctttcgccgccggctgtcccccctccggcgtttcttccgtttccgatggcatttcgcaccgacgccatttgccaatgccccgcgagtgaaagtgcgacagagaaaggaacacaacccgatcagtgaacgcatcagatgagaaaatatcagaaaagagtctcccccccccatttttgatcatttgagtaatttataatgtatccatccataatcaatggttttgataacgaggattaacaaatattgtaattttgtctaggatattccgcataaat

SEQ ID NO: 88677 - DNA, 773 bp, Heterodera glycines
  SCN-specific regions: Sequence locations=1-41,63-423,446-773
gtcgttggaatgtctcccgtcttccgctgccatttccccgcctttgccaattcgctgaccttcgctttggctttgttcgtcgccgctttttcggttgcttcagcagaacaaacagtcactccggggcggcacgacgactcgctgggccacagatgcaattattcggggcccggccactgtccctcggggttcgcctgtgtcaacaccaaatgcgttcgtcgctgcttcttcagtggcaattgccccgagggcttcttctgcaaaagcaatttcatttgcgtgcgaaaggaatgcgccgcgggggacaccgaatgttgcgcgaattgtgccgagatatgcatcgatcactcggagtgtccctccgatgggtggggctgtgtgctgctcaaatgccgaagagtcgaatgccgtgcccgccccgattgtccctccaattggccatgtctgctcggcagatgctatgcctcgaattgtaaaagtcacgaggaatgtcccgagggatggaaatgcggcaaaaagcggcgatgtgaaaaaggaaaagccgaggagaaggcaaagggaaacggcgaagaaaacgatgggaaatgaccaaaagaaaatgcgcagttcaatgatgaaaatggacaattcaaacattagaatgcttttttaaaggttttaacggaatatccttccctttcttttggctcttctgttgttaaacaatttcaaaaatatttatttccgaagaattgtttgtatttgcgcagacaaagcaagaaaattacaaaaaa

SEQ ID NO: 88678 - DNA, 689 bp, Heterodera glycines
  SCN-specific regions: Sequence locations=1-26,48-160,183-333,358 -632,675-689
ccaagtttgagttattactgttgtcctaattaaaaataacatgtaaaaatggcagcaaaggaactgttccttgctcagcagcccgacctgttcaagccgattcaatccatcaatgccgtgctcatactgatctgtctcggctcctccaccgccgtgccgggcattggcgtcctttggttcatcggcctttgctctctgatcgtctcagtcaccgccacggtgatctttctgctgaaccgtgaaaatggcttgtccggcgtcaccatttccggcgcttttctcccctggggcgtcattgaatttgtctattcgtctgtcctcacgctgctctgcggggtgggcttttggctttcattcggcttcgcctcccacgtgccggacaatggccattcggccggctatattttcgcggggattttcctggtggcccaagtggcctgctatgccatccctgtgctgatcatttacgatcggagccgaacggacggtccggcagccgccggacacgaacaaatcgccaacgtacatccgtttggggtcaccacggacggatgtgagcagcactaccagtcaatgcaacatgaacgtcccattgtctgacattgccaaagttccgttcgcattgactcctcccattttttggcccaatttcaccattttttgtttattaattattaaacagtaattgc

SEQ ID NO: 88679 - DNA, 679 bp, Heterodera glycines
  SCN-specific regions: Sequence locations=1-679
gacgactcgcacattcgcgaccaggcaatttccatgagggcgcaacttgcagaagcggacactttggtgctgggacttcgcgacagactccagcaaatcgacacgaatgctgcggtgattgaacagcaattgggacagtttagcacggacaaggaaaccacccataaagagctgtctgttggagtgaattatgtgcaaacacaaggagaacagcacttggcaaaagcgcaggaggcgttcgaccgttacggggaaaagagtcagcaattgtcggatatcgctggcgaatccaagtagttgtctgataggcaggagcagcgtcgccgggagatcctttcgttggctgagcaaattcggaaggagtcgcggcaatcgctcagcgacgccaacgaagcaatttttggagcttcaagcaccagtctgcaaatttctgctttgttgaccgaggtccacgagttggaacagcgactgaaagccgtccaacaaatggcgacggaacagtccctcgagacaaaccaaacacacgacggggccgccttcattctgagcggagtggacagtatccgtctgccgaacgttttttctgatgagttgatggagaaagtcaaaagggcacaggaagagggtttggaagcgctgtctaaaacacggtcggaggcggaaaacaagcggaattggt

SEQ ID NO: 88680 - DNA, 629 bp, Heterodera glycines
  SCN-specific regions: Sequence locations=1-154,176-333,357-361,384 -399,435-629
aaaccgttcacatggtcggcattgaccggcacagcgggcactttgtgccgttgatgcaaattgggcacagtgtgcttgccgacgaccagctgatcagcggggcggcacagctgatcagtgcgcggacggagcgctgcttcaccgcattccgtcagcgttttctcacctttctgtacagagagttccaacggaagggccaaatccaacagtttttgcaccatttcgacctctttcgacatgtcaaaatgcgcaagctgcaatttgttgggcccgagctgctgctgattcgaatggagcagccgaagggcgacgatgattttgacgaccaccaattcgcttcctcctccttttgccctccctcttcatcatcatcgtattcgtcatcatttgctgcttctaatcaccaacatcatcatcatcatcattaccagcatatgtttgtgctgttcgagtggcgagtggggcgcattgtcggcgtgttcaaccgctcctccgaggcgttgttcgccgcgttcgagcggcacaacgagcagttccgcaacgggcacattgtgcgcacaatgttccccacttccatggagcattgcggtgcggaacgggcccaacacgaggcgctcaagcagtcttcc

SEQ ID NO: 88681 - DNA, 901 bp, Heterodera glycines
  SCN-specific regions: Sequence locations=1-188,210-215,248-260,285 -381,435-459,481-556,581-727,759-901
gctgattccaaggagcgtctttccctgcgccacacgctcgaatcccacaagaactgggtcacctcgattgccacctcggccgaggctccggacttgctgttgtcgggttcccgtgacaagaccttgctcatctggcaattgacccgcgactcgcaaaactacgccattgcccgtcgtgccctcactggccacaaccactttgtgcaagagattgccatctcgtccgatggtcagttcgccctgtctgcctcgtgggacaagacccttcgcctttgggatctgaccactggcaaggctacccgccgcttcattggccacaccaacgacgtgctctcggtctcgttctcggccgacaaccgtcaaatcgtctcaggctcccgcgacaagaccatcaagctgtggaacacgcttggtgagtgcaagtacaacattgagggtgctcacaccgagtgggtctcgtgcgtccgcttctcgcccaaccccgagaaccccattatcatctcggcaggctgggacaagctcgtcaaggtctgggatctctccaagtccaagctgcgcaccaaccacattggccacaagggctacatcaactcgctcgccgtgtctcctgatggctcgctctgcgcgtccggcggcaaggacggtatccccatgctctgggacttgaacgatggcaagcacttgtactcgctcgatgccggagaggagatccacgccctgtgcttctcgcccaaccgctactggctctgcgctaccaccacctcgggcatccgcatctggcatctccaaaccaaggagcacattgacaccgccattgtctcggacgaggacgagttcgacatgggcgagagcaagaagaagttcgtgcccccgactcccttgtcgctcgcttggtcgcccg

SEQ ID NO: 88682 - DNA, 983 bp, Heterodera glycines
  SCN-specific regions: Sequence locations=1-983
tttaagagtattaaatggctggacccgactctcgttttattctcgaattcttcaaccgtgaggctaaagagattggagtaacgcaggaattgcttgacaattcacagccgtccgatcagttgatccaggcctactactttctgtgtgatttgatttttgaaaatgtcggcaccaccaaagagaacgagtatgaaatggccactgaactgacgagggctcgtccccagatgatcatccgaacgcaacagcattgggatttggagaaccaactggaaatttgccaagggttggtcaacgaactccgagcggaagtcgattcattgcgcggcgaactgagcgaatgcaaattgcctttccgaatttccaacagcgaacttcaaaatatcaccgttcgtcactctcgcactggcgacgccgtggagcgaattgggccacggaaagcgaacaccaaaagtctgctgaagccacgtgcgcgtctctgttccaacactccgaaaatggctgtgccgtctgaaaagcgtgccaagcgtggattgaccaaagacagcgaagatgacgacaatttccgcaccgcggaatttgtgccgaccactccccgtccgcaatttctgttgcctccgcttgtgctcaccccgctcagcagccgtttcccccctcttccgcggcgttcattttctgtcgaaccaactccaactcatatacagaaaaacgctgaacagcaactgacaatgattcgggacggcaacggcgacatgccgtgtccgtccagtcaaaagcggctgaatgacaacggcgaaattcagtgtccgtcttcctccacgtcctccacctttgctgcctcaacttcggatggttccgctgtcagtgttttctccgccgacggcggtttgttgggcccactgacctttctccgacggcggaacatcggcgacccgcaaacttcgtggctggccaaccgaattcgcaaccaaggactgccctgc

SEQ ID NO: 88683 - DNA, 525 bp, Heterodera glycines
  SCN-specific regions: Sequence locations=1-238,261-489,511-525
gagacattaaatttgcctcttaaatatggccgaatttgcccaccgtgccggtgctccgttggagtgcctttgcatggctttgaaggtccaaaagcgtcaggaaggaacggacgccgaaggcaatcggcgatggaaaattggcataagtatcggcggtggcattgaccaaaaccatcgacagtccgtctacagtgattccggaatttatgtgaccagcgtggaagcaaattcacccgcggaagaagctggactgaaagtgcatgacaaaattctgcaagtgaacggcgtcgattacacgatgatcactcacgaaagagcagtcaaatatttgaagaaggagtccgtgttggatttgctggtgaccagggccacacccaaacacagcacggaaatgcaaatgtgaacagattgtccgactgctgatctaacacaacatttcatccaaataaacacacattccaatctttgatccatgtattggtccaatcgaaaaaataaaactttttcttgaaaaaaaaaaaaaaa

SEQ ID NO: 88684 - DNA, 423 bp, Heterodera glycines
  SCN-specific regions: Sequence locations=1-215,257-306,328-396
tacaaatgaaaactcaattcatttttcttttggcacttctgccatttctgttggctcccaatttgttgtgaacaatgcagttgggacgacgtgaataacatttgcgttggagattgttcatcactgtgtgtgctgaaagattttgacaattgcaactgcaaccgcttaccaaaaaatcttcaattcttcaaaaaccgtcgtaatttcggcaacttaaaagcattggcaaagaaagaagaaacaaacaatggcaaattgatgtacaaaaaataaattttcgaaaggaggcggattaaaattcaagatcaaatgggatggagaaaaagaaagtgcaattaacagatgaataaataaatacattcagtgattgaattaattgataaaagataatttaataaaaaaaaaaaaaaaaaaaaaaaaaaa

SEQ ID NO: 88685 - DNA, 653 bp, Heterodera glycines
  SCN-specific regions: Sequence locations=1-39,61-302,324-365,392 -461,483-653
cctcgtgccggtccatttaagctaatttatttgcccgcacttaaacataaaataattaataagcgctttttttattattgttattgaaaatgacgtccgaaactgtgtcaagtgacgcgtcggcagcgggaggggcggacaaagagaacacaaaaacggacacaaccaccgacccgagttccagcgaaaattcggcgtccatcgaggcggaccacaacaacagcaaattgcgctacgccgacgagaccaccatcatcccgcacgacctcgtggagcggcattttctgcaaaacacttgggctctctggtacttgaagggcgatcgcaacaagaattggaccgattgtctgaagaaagtgtccacctttgacaccgtcgaagatttctgggcgttgtacaaccacatccagccggcgtccgggctgagctggaacagcgactattacctgttcaaggaaggcatcaaaccgatgtgggaggacaaaggcaatttggagggtggtcgttggcttgtgcaggtgaatacgcgaaacacaacccagtctcggcttagtctcgaagtggacaaacagaagcgccagaccaagctggacatctactggcaggagatgatgatgtgcatcattggggaacagtttgagaagtggagtgac

SEQ ID NO: 88686 - DNA, 626 bp, Heterodera glycines
  SCN-specific regions: Sequence locations=1-105,128-626
aacccatccaattgtcggaggtctccgaaggtgtgcaaaagctgaacagaattgttgctcagtttaagcaggacatcgagctcagagtggctgaagagatttccgcctgcgaagagttggccaaaagagtgggccatctgagcgaagcgaacagtgccgaggagacggcacaacactttttcaatgagcaacgactgaaccgactgatcattgaccatttgttgcgcacggggcatttcgcaagtgcgcaggcgctggccgactttgtcggtttagacatcagcgcacaataccaagtgtaccatgtggcgaggcaggtggaagaatcgctggcgctgaaggaccttggcccctgtttggcctggatccgagacaatcgctcgcgtctgcaccgaattggcagtccgctggaaacggaagtgcgcattcagcagtgcgtcgagctgatcaagcagggccaccaccacggggcgttgaaatatgtgcaggcattctttgggggtcgctgcgacgtcaacggggcccattgggcaacaaatggcaatctgttgcacctgatgggcctcgtcgcacttggcaaagagtcgactcggccagagcatcggccgctgctcagcgacgagcgc

SEQ ID NO: 88687 - DNA, 1040 bp, Heterodera glycines
  SCN-specific regions: Sequence locations=1-1040
gtccatttaaggtgtctccgcttttgcctttggactgttcactttcggcagaaatgaacggtcttccaccatttcagccgcaactgtcgctgtttggggacccgcaactgttcgctgccaccgtctccaacccaaccgtcggtagcacaaacgcggcagcccccgcggcggagtcggccgcggcgctgcaaatgcacggacgacagcagcaactgcggatgagaaaggaaatctatcggtacacttgcgaagagccgttgtacgccgctgcgtggtccaacaaattgtacccggacaaacgcttccgattggtggtcggtactctgctgctggacgaagagggcatcagcagcaacaagatgtacatcattgaactggacgaaaatgtcggcgaacttgtcaaacgattcggaattttgcacgggtacccatgcactgccacgcaattcattccaaatacggacgtttcccaaccagaattatttgctaccacttcgaattgtctgcggattttccgataccatccgtcctccgcctccatctcccaagaatgcgaactgagtgcgacaaaatcgagcgcctattcgtcaccgctcacaaatttggattggaatgaagtggacccttcccttgtggcaacgtgcagcatcgacacgacctgcacagtttggaacattgagacgaatcagccgattgggcaggcgccgtccatcaaagggctgcaaaagactcagctgattgctcatgagaaacccgtgcatgacattgcattcacccgactggacaacggacgggaccaattcgccaccgccggcgccgatggaagcatccgacttttcgatttgcgggcacttcaacactcaaccattttgtacgaagatgccgaaaggagaatgctgaaccatctctcctggaataagcgggacccgacaaaattggcaacggttgcccaagagtctaaagaggtcgtcattctcgacgttcgggtaccgtgcagacctatggccaaatttggtaatcaccgagctgcaataaatgga

SEQ ID NO: 88688 - DNA, 431 bp, Heterodera glycines
  SCN-specific regions: Sequence locations=1-201,223-406
agcaattattaaagctgctaaaatgtcaactacagatgttgaagagactatcaagagaattcaatcgcaaaaaggtgtcaccggagtgattataatggacaatataggccgtgccattcgttccacgtttgatgatgacaccaccgcgcaccatgccgcacttcttcaacagctctgcgaacggtccaaaaatgttgtgcgcgaaatggacacgagcaacgacctgagcttcatgcggttgcgcaccaaaaagaatgagatcatgatcgcaccagacaaagattatttgattgcagtgatttataagaagagccgctgaaagacaagacaaaaaaaaatttattccccttatttctatttttcttcacccctttttccatgtatttgataaatgcgatactctgctaaaaaaaaaaaaaaaaaaaaaaaaa

SEQ ID NO: 88689 - DNA, 639 bp, Heterodera glycines
  SCN-specific regions: Sequence locations=1-639
ctcattttaagtggtacaaaatgagtattattgacattgacgctgaacaaaataaccattcttttgctgttgattctcagtccaacaattattttttggtcggccgcggcggtgacaaatcgattttactcaacgaaacgagcggcaattcgtatgctttcagtaatgtgcccacattgccgtccgtccattaccttttcaaaaacaacaaaatccactttaacggcatcttctcctatgaaatccacgagttcttccaatgttccattgacaacgctcgcacattgtactccattcgcgacttgaaagagttcgccaaagcctgcggcggtggcactgaattaataccattttttggctacgctttgcgcatcgttgtcgaggcgcccatcgaattggggacggacacaaaaacggaggaggacgatggccaacagcagaaacaatggggcgagtgcgcaacttttgggagtggaaagacggagaaagaggccgaaattatcttcgaaaagaattcccaagaagcgccggcggagacatttagggacgaaccgttcttcgaatttgtcaaggcaattgtcagcaattttctcgattggggcactgaacgctttcgtcatgggcgccgttttgcgggcg

SEQ ID NO: 88690 - DNA, 601 bp, Heterodera glycines
  SCN-specific regions: Sequence locations=34-466,490-540,597-601
cctcgtgccgaattcggcacgaggccaagtttgaggccttccatattcatcataaaatggaattacgacttttatttgcttccctatttgccctctgggcagtgacagcggcgatgcgcaagcagggggttgccatcagcggaaaattcgtgtgcggccacgcgccggccatgagcaattcgaccaaagttcgcattgtcgacattgacacagggcccgacccggacgacactttggacgaaaagtttgtggacgctgccggtgcatttaaactcaatggctacacacgggaactcactgacattgatccggtgctgtacgtgtggacagactgtaacgacgggcatacgccatgccatcggaaaatcaaatttttgatcccaaaaacaaagatcattggtgaagacccgaaagccaatgattggcttgacatcggagtggtcaatctccaatccacctttgaagaagagaaaagagaatgcattttttgatcgagtcgctcatttaacagcagaaggaaagagaatgaatgaattgatgttataaaatttattttttatatttaatttttagttacaaaataaataaatttaattcaaaa

SEQ ID NO: 88691 - DNA, 506 bp, Heterodera glycines
  SCN-specific regions: Sequence locations=1-75,99-222,244-506
cttaagcaattttacttccatttggttagcaaaactaattataagacgcaaacaaaaaatgccagtgaaaatcgaaacactcaaagcgggagatgaagcgacttacccagcggttggtcgaaaggtcgtttgtcattacgtactgactttggaaaatggccagaaaattgacagctctcgcgaccgcggaaaaccattcgaattcactattgggaagggcgaagtgatcaaaggatgggacgaaggcgtggccaaaatgtcagtcggtcagcgggcgaagctgaccatcagcccggacatgggctacggagccaaaggaatccccggaacgatcccagggaattcgacgctcatcttcgacgtggaattgatagccgtaaaataatggagagaaatgacagtgatgaggggaaggaccgactaattgagccgcgcatttgcattaaatgtttaggatttcattccgtttttctttgtgttcactaagtaaatgggctttcgaaaaa

SEQ ID NO: 88692 - DNA, 378 bp, Heterodera glycines
  SCN-specific regions: Sequence locations=1-140,162-353
cgcaaaaccatctctttgttcgcttacctcaccagacatcgatagttgttgacaaggacccgctgaaggagttgaagatgatgaggcggcgattgatccagctgacgaaacgcgtttccgaattggaaacgcaaaatgagcagaaaaatattgagaggaaagtgctgctgggcattgtgagtacgtcgactttgttgagtgtcgttttgtttgttcgcacatggctgaaccgttaggagggacccgtacaggaaatatcggaatgtccatatgttaatcccgtgttatttccttttctgtaccaacgaacttaaaatttttgttttattttcgcgaataaatcgttaacaacgaaaaaaaaaaaaaaaaaaaaaaaaa

SEQ ID NO: 88693 - DNA, 364 bp, Heterodera glycines
  SCN-specific regions: Sequence locations=1-364
actcggcgacgtgagggagggcattgaaagcgccgaagccattggcgtgtcccacgggcgacaacgccgtgaaagtttgcttgggctggacgtgccgtacaaagcgcaatcgacggaaaaccaacaacagcaaaacgccgaggggcaaatgggggagcaaaaaagcaaagacggaattttggaggaaagagcggcgggaagagaaacagagaaacagccggtgaaatgagcaaatggcgagaagcatatgatgaattctgtgaaattcacaagcaatcacttttttctgtcacataaattatttaagacaatttattattaattaatggggctgtaaatttcacataaatatttattttttcct

SEQ ID NO: 88694 - DNA, 633 bp, Heterodera glycines
  SCN-specific regions: Sequence locations=33-225,247-633
cctcgtgccgaattcggcacgaggaaatgactgcaaatttggcaatggcattggacgaaatcatcaaaacccaggtcaaagcaccacgtgcttctgctgctggtagaagtgttggttctggacgccgtcttgccggtgcgactacaaactctcgttttcgttttcttcagagaggatttgtttcgggggatgttcctgccggacaatggaagcatgacaagtttgcagagctctatggaggtggcaagaagcgcatgggtggagctagcctgggacctctcaaggcggtaaagggcggtgcggggagttccattggagcacgcattgcacggaatgcaatcgagcggaattctgggggtatggtgaagctccaagtttctaacttgcccggatcggtggtcactttggatttggaggaacttttccaagacttcaatgttttcggagtcgctgttcattatgatgagatgggcaatcatttgggaactgctgacttgttcacagaccaacaatctgccaccaacatccttaacgaattcaaaaacatcgctatcgatggccaagaaatcaaattttgtttggttactgaaggcgctgattctgttggaggtaaaagagggaacattcgcgacc

SEQ ID NO: 88695 - DNA, 671 bp, Heterodera glycines
  SCN-specific regions: Sequence locations=1-671
cacattcctacccctcctagcattaaacctcaacgaacaaaatgtctgaagcgaatcttcagcagcaaacgcacggcccaattgctggcactgactacgattcggcagatgaatatgtggtgattgaacaggaggaagaaaccgacttggaaaagaactcaactttgccggagacggtggctacgaacactaattcgactcccagtgacgtgcaaagtgtggcagcatcagtcggcactttggacgcggtcgctgacattggcaatggcctcgacggagcaaaactcagtgtttcgtctgttttcccacagaatgcaatgagcggctcgaactattcgcaaaatggcttcaattcttccatttttggatccttcgtgatggaagaccaacttcgcgatttagtccgttctgaaaatgagcagaaccgtctaatgttggacagcatcaaaaatgcaattggcgaacttacgaagcaaaaatcgaataacaacgaactgaatgcgctgatttcacaacaaaaaaagtcacttggagaggctttgacgaagctcgacaattcggaaaaattgagccgagagaaagacgagagaattgtcgaacttgaacagaaaatccagcagctgagtgaggcattggacgattcggcagccaaaacgacccaattgggcgag

SEQ ID NO: 88696 - DNA, 467 bp, Heterodera glycines
  SCN-specific regions: Sequence locations=1-313,336-408,431-441
attttatttattattttattgcgccttttcctaaaattcaatttccaaaaatggttgccaagcttcttccagtcatcctctgctgcttgtttttggcttctttcgccctctgctcgcccaatgctgctgatgtgctgaaattcaaacgagaagctgcgatcagcagttgtggagctggacagtttgaatacgggggcggctgttgtacgacatgcacaagcgatgctgattgtacgggcgggaagctttgtgtgccaattctcaacttgctcagcgtcagtctgtgctttgccccatgcggaaattaagacagaaaagaaagcagcagcaaaagagggctctgatagtgtgataaattgataggattaaatgaaagattgggagttaattattacttaaatgcatttaatagtgattgattgatcaataaatatttttcggaaaaaaaaaaaaaaaaaaaaaaaaaa

SEQ ID NO: 88697 - DNA, 624 bp, Heterodera glycines
  SCN-specific regions: Sequence locations=1-25,47-180,204-565,587-624
attaagcaaaaatgcagcaaattcccattctttccctctccaatttcctccccattttctcacttatttcggtgccctttttattgtcctttccttccacggccttcggttgctcttgtgcacccaccaaattcaatgagtcgatgtgtgtggccaaatgggtgtcccatgtgaaggtgttgcaaaacacaacaacaacaaactcccaccgcattttcactgtccgacatttggaagtgttcaaaagtcccaacggcaccgctcacaatgaccaactgattgggaaggaaagtgccgtttggactcccatttttacggcggcgtgcggagtgagagaattggacactgaaaaggaatatcttttggctggcactgtggacaatttgggaacaatgcaaattaatctttgtctgtttattccaatcgaagacggacagccaaatgccgagaatggcattgtcgaatgggcgaaagtgccggaggggacgaaggcgcgaatggccaattgggacgacgaacagtgccagtaaaattgcacaaaatgccagacggaagctgaaccaatgacaaagcaacaaacaaaacattttttcgttgcttaatccacaattacaagcccaaatt

SEQ ID NO: 88698 - DNA, 470 bp, Heterodera glycines
  SCN-specific regions: Sequence locations=1-470
caatttatcttttttttaatgacggaagcaacaaaaatttacaacagactcagtgcttttcaaaagtttcgcatcaatttgaactgccatttgcgtcgcgtccggtcgaattggttgtatcagctttcgacggcgctggtcttcgttaccgccttaaaccatgccagcatttacctcacttacgggcccgaccacccgcgatgcatgcaacaatggaaggaacggaaacagcgcggattgttaacggacgaattgctttggaaggagcggctgctgtacgcccgcaggcgtgagtttctcactgctgttgatggttacggcacagttgacaattggaaacacccgagggcgacgatgggagcgtcgactttgtccagcaaactgttttaggaagaaaagcaaacaatccaaccttcgtttaatgcaattattaaatcggattaactccaataaactttttgtttgtcaaa

SEQ ID NO: 88699 - DNA, 632 bp, Heterodera glycines
  SCN-specific regions: Sequence locations=1-29,51-632
gtccatttaagttgccctttccgccatccatttctttttctgttcaatgtcttcgtttttcatgcatcaccagcagaagcggtcgcaccaacaagcggccgccgtcactttggcggacattcgctggatggaaccgatggccgcgactgaaagtgccgctacttcaacaccggcaaagcggctgttggcacgactcggcacaaccagagtgggccgctacgttcaacagttggccatcgattacgcagcttccttccgcgacatcgtcgttggaatgcgtcagcgaccgctgcgagccgtcgcttgcggcgccgccttggcttcgcttgtgttcactttaaaatccaatccggacgaaattgcgctgcgcgcgcgtttggctcagttgcgtcagcaaatggtgctcatcccggcgtccattcacagcactcgtgccgacgaacggctcgagcagtacaccgtcctgttgaatgggaatcggcttgaactcgtcgactttttgctcttctctgtgctcgttgagcgtccgtttgacaaaaagaatgacttttacgctgcccacgacaaaacattgcgtggatggccgtggaccgagctgtggcggaacgcgtgggacatcggcgcgttcggcc

SEQ ID NO: 88700 - DNA, 377 bp, Heterodera glycines
  SCN-specific regions: Sequence locations=1-377
cccaagtttgagcaagcattcttcctttcctgtccgttcttttccaattgacaaatggcaaatgaaattcttgaatttccactgaaatatgacaacgatatacactatttaaaagtccgacgtactgatacggtgcgcgaattaaaatttgtcatcgaggcaaaattgaaaattcccccggaagaacagagattgatgattggcaactgtgtgcagccggatacccgccttttgagttcaatgaaagggctggatttggtgcgtgagacgggccctgctgctcctccctaaattggcaatgctgagtagtttgagaaagacgaatgattattggcttttgactttgtttgttgcgaataaaaattaaaaagcaaaaa

SEQ ID NO: 88701 - DNA, 552 bp, Heterodera glycines
  SCN-specific regions: Sequence locations=1-238,262-344,370-435,465-552
gtttgagctaaaatattacttttgacttttcaaaatgtcatctcgacgtggcggtggtaataatgttgagggaaaggtttacgttggcggtctgccagaggacgcaacttccgaagagctcgacgacgtcttccacaagttcggcagaattcgtaaaatttgggtagctcgtcgtcctccaggttttgcctttgtcgaatttgaggacacgcgcgacgcggaagacgcagtgcgatcattggacggaacacgcatttgcggtgttaaagctcgcgttgagttatcaacgggccgttctcgccgcgatcgcgatgaccggggcggtggtggtggcggataccgaagcggcggcggtggtggcggcggcggttaccgtggcggtggagggaaccgcgactattcaagatctcgttcgcgttctcgttcgccgtaccagcgtcgcggaggaggaggaggccgttctcgctcgcgttcccgttgaaaaatgggagggatctacaatttccgaagaagttgtgacgaactgatgcgatttcaaccattggcgatttt

SEQ ID NO: 88702 - DNA, 798 bp, Heterodera glycines
  SCN-specific regions: Sequence locations=1-218,241-798
attcgttcgccacgggcggcacggcgtggacacggacggacttgtccatgctggcggacaccacggacttggcatcgtcggcaaaacagacgccggtgactggctgagagtgcgcgttgaactgggcaatgttgttccaacttttggcctggaaaatctgcacgttgctgcccccgacggccaaataggcgccagactggtcaaaaattcttcagtttgcgcaggtcccaaattttcacttcgccgtccgttgacccggtggccaagtagtagccattttcggaaaacgaaatggcaacaaccgcctcctggtggcccgggaattgggccacgttgatctgctccttgatatcccagattttgacgacgctgtttttgccgccagtgccaaagatgagtccgtcggggtgaaactggccacagcaaattcccggcacatcgtcgtcgtcggatttcacttttatcaacggacgtccagcattgaggtcgatgagcgaccaatgcgaatcctcagaggaacagagcacataatcgccggttgggtgcagagacacgtcaaaaaaaagtcggtcgtggatgccaatcacatttctggcactttgatcatccgcgttccaaattcgtatctgtgagtcaaaagagcccgagacaattgtttgaaggttgggatggaggcggacggcactgatgcgtttctggtgccccttgaacgtgttcttgatggtctccgtctctgagtcgaacagcacgatggtcttgggcataacgccggttgcgatgagatttttctgcaaatcc

SEQ ID NO: 88703 - DNA, 450 bp, Heterodera glycines
  misc_feature (429)..(434): n is a, c, g, or t
  misc_feature (439)..(439): n is a, c, g, or t
  SCN-specific regions: Sequence locations=1-17,39-181,300-450
caaacagtccatcccaaaaattaaacttttttctccataatgctcgccaaccatcgccaacttttcctccattttctgttcgcaattgccatttttgtctttgtcattgcgccactgatggccgattcggagcacgaaatccacgctgatcagcaaagtgccataaatcccagagaaaaacgctggggcggcggatggggcggcggttggggacgcccgtggggttggggcggcggatggggccgtccttggggctggggcggcggatggagacgcccatggggcggctggggctggggacgatgagccgccgattccgtgccgtgttatgccatcatcagtcgtgccgtgtcagaaaaatgatttacgatttgaataatttttataattgatatgtgttgttcgagagataaacttttggctgataannnnnnaaaanaaaaaaaaaaa

SEQ ID NO: 88704 - DNA, 576 bp, Heterodera glycines
  SCN-specific regions: Sequence locations=1-576
ctgaatttaagccctattaattcgctttaatattaaaaatggacgccaccaaatggcacacttttgtcaaccaagtggccgccacgggcccaatcacaaaggcggcgatttgtggccaagacggaaatatttgggccaaatctgacaatttcaatttggacccaatggaagcgaatgtggcagtgagcgcctttagaaatcccggcgttttggcaaaccgtggcttagcctgcgaaggagtgacgtatccaattacgcagcccccgtccacgaccaacaacacttgcctcagcggagagattgacggacagcacggcgttacgattgcaagaacgaacagagcatttctcgtcggagtgaccgaagggacggacacggacgtcggccgagtggaaacggtttcattggcccagcaattggccactcagtacggctggtgaacaacgcattgatgcggatgaatacaattgttctacactgatgagcatgggctataattgttctgacaccttgcaattatttgcgtcatttctattttctatgaaaattaattggataaatgcaatttattcaaaa

SEQ ID NO: 88705 - DNA, 693 bp, Heterodera glycines
  SCN-specific regions: Sequence locations=1-598,626-693
ctttcgagaaagataatgatgcagcaacaatcgactcaggctcaacattcaaatccgtctcagcaccttcggaacactccgcaaagtcccgcagcgacggcaccgccgacgtcgagtcaaagccaacacttccaacagcgaccacacgtcgcataccatcagccaccacagcagcactatccgttgcagcaggagacgaaccaaagccaacacatccgtccccagcctggcgtaaggccggcacatccgcagcaacacccaaccgagcagcagtacccatcaatggccgggccattgttccaatcgcaaccgtcgagtgtccaagcccttcaagagcatgagattggcaatgttggacagccgaggcttgcgcagcatggccacacgcacatttctcaccaacaacaagtgatgatgggacaacgccacgcgacccatcacccgtcgcagcagcaaacactgatcagccaacagcaaagccaacacccacagcagcagcatcccaccacggcgattcgaatagaacaatccggccaagtggtgcatatgcacgcggcccctccggcgccaccgcagcaccaaacccagcgaatttttgtacaacagcagcagcagcaacaaatggtgcctacattgccaccccaaagtgcgcatgacccgtccctgcacccgccccctcttccgcacccgcac

SEQ ID NO: 88706 - DNA, 575 bp, Heterodera glycines
  SCN-specific regions: Sequence locations=1-223,246-517,539-553
tgctttttcaggtcgaccctttgatgctgtccaatttttctctcattttgggcggttttgccaccgcctttgccccctttctctcccgtctttggatgttcgccctttactgttttccgtttgcctttggtgctgcgagttttgccgcccttcgctccatcatttgcgtggaattgctcggcattgaccgactgacaagtgcttttggtatgcttatgcttttcatgggcgtcgctgctcttctcggcccgccttttgcgagggcacttaaaaattggtcgggtgactatggactcgcctttcacattatgggctcactgatggcattaagcggttttcttggtattcccctccgacgaatcaacgaatgggaatgtgccaaggagcgaaataggaaaatgattgaagacgaaggcgaaacccaagggacgaaaaatggaaggaaatcgggagaagaaaagcaatgaaagggaaaagaatggccaaaccaatgtgtcatttcatgtaatccgaaggagttttgttaaactaaataaaaacaaaaagcacatggaaaaaaaaaaaaaaaaaaaaaa

SEQ ID NO: 88707 - DNA, 548 bp, Heterodera glycines
  SCN-specific regions: Sequence locations=1-122,144-396,419-548
attttctgtcccaaatgattcgcctgccctttctttcgttggcactcgccttttccgccgttctcctcgtcctctgcgacgatttgccatgtcccaccgatccgtcgtccgcgcctcttccgcccgggtgccctccgcccccggcggacggtaaaaaagcacccgccgacggaggaaaggatggcggaaacaaaggccgaaaaaaacgagacaacattttacgtgccaaaagagaggacaaaagcaaggactctgaacaaaaagcggacgacgacgaagcggactgtgcgccacccaatggcacccctccgcccggcgcccctccgccgggaactcctccgccgggcacttcaccgccttgccgtcgtcagaggggtgggcccgccggaggagggggaggagcagcgcagcacccgccgaacggtccgccgccgaccacgccgaagccatgagaaattggcaaaaaaaaagagaagagcggatgtagcacacataagcacttggatgaaaagtgttcatagaagaagtcgtatgatcaaatattgcat

SEQ ID NO: 88708 - DNA, 669 bp, Heterodera glycines
  SCN-specific regions: Sequence locations=1-10,32-42,65-483,505-669
attttttggctaaatttttattaaaaattttcatggaccttttttggatttaattcattaaaaatcaaggcatattcggcatctcagagagtttaacctccaagctatatccatccaagtctccaatacggtgaccgcacccaataccgttgcttccgtcgccgatttcgccgatgccaatgtcgccacagccaattttgcgcaccatcaacggacagactttaattaaaaaatgcacatttatcgatgcccaactaaatgccaaaaatgaaaacagataatcaatagtgattaaaaagactcaagcactcgataactcatcaatcttgtcttgtccaattcgtaaattatttcttccctccgtatgtgtatgggtaataatacatataatagtatgacggattgtaagtggctgacgacgaatcatccgatgaagaacgaagcttccaactcccgctcgacgcgtcatagctgtaatacggattattgtcagatgcgctgctaccgtagtaactgtagtacgggttgtaatagtaggcaggataataatattggccagcgttggaaaagtgggtgatcatcggcataaatacgacgaggaaacagatcattcgggtcgttagcattatgaagttgagataatgagcgtgtcgaaacttttgttgattg

SEQ ID NO: 88709 - DNA, 731 bp, Heterodera glycines
  SCN-specific regions: Sequence locations=1-47,72-98,120-731
gtttgaggcttattatgtttgctaagcatttgcgcaatttcccttttggctgtccttttgctgcgcgtcccttgaggcgatactcagcccatggactgcaggtgcacagggacaacgagcggaacaatccgaacacgcctttccaatttacggaagccaatttggccaaaattacggtgctgttgaacaatttcccggagggacataaaggagctgctctcattcccgtgttggacttggcccagcggcagcacgggtggctgcccatttccgcaatgcacgaagtggcacgtgttttggaaatgcctcgaatgcgcgtctacgaagtggccaccttttacacaatgttcaacagggaccccgtgggcaaatactttctccaggtgtgcggcactacgccgtgcatgttacgcggcgcagaagcaatcatcgaggcaattgagaagaaattgggcatcaaaaagggagggacaacggcggacggactcttttcgctgcaggaggtcgaatgtctcggggcttgtgttaacgctccgatggtgcagatcaatgacgattactacgaagacctgacccctcgggacattgaagagataatcgacgagttcaaggcgggcaagcgacctttgcccgggccaaggagcggccgtttagccgccgaacccctcgccaaacaaacgacgctgacggagacaccgccggggcccggctttgggcttcagcagggattg

SEQ ID NO: 88710 - DNA, 810 bp, Heterodera glycines
  SCN-specific regions: Sequence locations=1-106,128-197,219-810
attaagttaatctttaaatcctttacataattattgaaataatgattaatttatccatctcaacaaataaaaccgaatttccttatctggtgcgttatccggcaacaatggctttggttgaatttaaggtaaaattggagcttgtggtaggaatttattctgctgatatgaagcttgaattgcgttcgcacgaagggaaatttatttcagaattaattggcgacgaccgtaccttagaagaattgggagtccgagatcagtgcattgtgaatgtttgcgataccagtgaaacaagaaatgataattccacgaatgaccccaatgcattttatgtaattcccgaagagagatacgccaatagaaaagacacagctcgaaaatggaaacaacaacttatgacaactgcaacgacaacaaccgatgtcgaacgatccgagcagcaagtgccaaataaaattgggcctgggaagcgctgtattgtccaactccgtgatcaacctccacgaaaagcccaaattgcttttgtcggtcctactcattttggcgaaaatccggggactactcaatgggttggcgtaatttatgacgaagcaactgggaaaaatgacggttcacttgatggacacaggtattttcgttctgagccttcacatggcgggtttgttcaaattcgagcaattgtaaatgttttggatgacgtggaacaagccgccaatgacaaagagcaaatacaacagcagatggaaattgaagaaatctaatgaccattcattacatgaaacaaggagaaatcccgtttatgtctgcatt

SEQ ID NO: 88711 - DNA, 645 bp, Heterodera glycines
  SCN-specific regions: Sequence locations=1-78,102-645
caagtttgagaaaaactttccacgccttatcatcccctaaacactttgtaaaaatgcgttttacttcaatcccgttgattttttgccttattgcactggtttgcgtcattgcatcagttcctgaactcccgcaaaaattcctcaaatcctggtcggttgatcattccgaaaatttcgacgaatacctggaggccaaagggtacggctggttcatgcgccaagtggtcaagcttgccggcatcaccaaaacattttcgaagaatgagaacggcacatatgcatgcaaaattgaaaccaccaaaaagaatgtggagtggcccagcttcaaattgggcgaggagttccaagccgagtatttggacgactcagtgcctaagatcaccttcgactacaacccaacaaccgacgagctgatcgaaacgcacaaaaaggtggactcggaggagaagccggacatctacaaatacaacatcgactcggacggctttctggtgatgcaaatggaatataacggagtgaaaacgaagcgcttctataagaagaatgaatgagcggagggtgaatgctttgtgggggtcaagaacgatgtgcagatggagaagaagcgacggatgattttgatttttgcctgattaattgccgatg

SEQ ID NO: 88712 - DNA, 301 bp, Heterodera glycines
  SCN-specific regions: Sequence locations=1-245,279-279
gtccaattaagcccatagttagaataaagcgaaacgcttttttaattcgaaaatgtttgctacaccggaatttatggatgccgaagacagtttgatggagatgaaatcgaatcagttcaaaatggacaaaaatgagttcattgccgcggagaaattgatcgacaaggactactacagggactttggcgatatctttgacccggatgtgaagtaaatgcggctactttttgtgcggaaataagcaaaatgtaatgttgttgtttttgatttttgagacataaaattgtgtatgaggtaaaaa

SEQ ID NO: 88713 - DNA, 408 bp, Heterodera glycines
  SCN-specific regions: Sequence locations=1-182,204-214,237-408
ttttgtgctttatctggtggtctctgtagcaatttttgatggtaccgaagacgctcagacagctcacataacccgcaacatttggcggtgtttttatgtgcgttcggcaaaacaccatacattggccgttgtgaattcgatcaattccttcctgacgacaacactcggaatggtccacttttgaggtggcgcagtcgaacgctttgctcagctgagcagacggacaatgggagccgagcaaagcgattagcagcttttcttgagtgaaagtgtcgaaattgcaaaactgttggcacgtggagggcaactgctgtttctgacagcacagctccaatttggcattgggcgtcatcagtggggagactgtgacagcagcggaaacagtagccaatggaaggtgcggtactg

SEQ ID NO: 88714 - DNA, 561 bp, Heterodera glycines
  SCN-specific regions: Sequence locations=1-351,373-374,397-512,535-561
gtttttacttccatcaactaattatttgtagaaggttaatgacttcgcgaattttaagactttggcagcccggagctccccgtcctagggtatttttgcctgatttctggataaaattggttgagcaaccgagcaagggttacaaccgtcttccaaaaaatgccgctgcgtttgaggtcgacctcaaaatgtcgcgaatggatgtccgcgaatatttggaaaaaatttacaaatatccggttcgggatgtgcggattcgtgtcactatgggggatatcacatgggaccaccccaaagaccgggacaagagaagagcactttggaaggaagaggaccgaaagattgctatcgtcttttttaaaaagggtttcattgctgaagtcccggatctgttccccggccgtggcaccgatgctgaaattgatcagatgaagaagttccaagagcaggacgcaaatactttcaacagtcgctttgtcaataggggaagggcagggataggagaaatgctacctatttaatgctggaatttttgttgataaaatgcgatgaatgtaaaaa

SEQ ID NO: 88715 - DNA, 490 bp, Heterodera glycines
  SCN-specific regions: Sequence locations=1-249,273-374,396-398,420 -434,463-469
atataatattttattgctggagaatgtcttcgtctgcgatgggaactcaacccgctctcttcgaccgttccaacatttcctttgcggtgtcctttttggccgggggtttggccattggctatttgctcggctggcgaaccgcggcttcaaaattggcccgatgcaacacgcgagtgcagttgagcaaggacaaagtggtggacactgtcgaattggaggacattggcgagaaaaaggcatattgtcgctgttggcaatccaaaaaatttcctttgtgtgacgggtcccacaatgagcacaacaaaaagacgggggacaatgttggcccattgattgtaccgaaggcgaagtccgcttcatgagcagcggaggacagaacaaaaaatattaaacaaagcattggattttattgtttggttggaaattcgctcaattgttaagaaaaaatttaacaaataaattattctttaaaaaaaaaaaaaaaaaaaaa

SEQ ID NO: 88716 - DNA, 764 bp, Heterodera glycines
  SCN-specific regions: Sequence locations=1-170,192-245,268-764
aggctgtgatgagtgttggcgtactttttcgtcttacaattaggccaagcccggcggggcttcgactgacttgttttttggccaccaattaccatcacaatcttcatcagttcaacaacaactgcttggtgaggaggcatttctcttgtacatcgcggcttctgttggccaccaccaccgacaacaaaggcgatgccgcatcggcaaaacagcaacagttcgccaaaatagaattgaagccgaaaacggggagcgacggtgctgtggcggagccggaacggacatatttggaggaaatgctcattgaacgggatgcggagccgaagacggcgggccaaaaagtaaaacgtgcggtggagacaaccttctacatttcgtttggcctcatctcctgcgccgttctgggcgtgatgacctacctcgtgttcaaggagttcttcgccttcaacacgccccagggcgtttaccgcgatgcggtgaaaagggtgaaggcggacgagcgctgtcgggaaatgttcggcaagcgaatcatgacatttggcgaagagtcgggccggggacggcgacggcacattctccacaataaatatgtcaaggacgggcaggagcggttgagcgtgatgttccatgttaagggtgacgcgggcattgggaaaacgtacgcggagatttacaagggcgaggacggcaaatgggactatcgctttgtactggtaaagagtgacggggttccgaagaaagccattttcttaattgacaacagg

SEQ ID NO: 88717 - DNA, 638 bp, Heterodera glycines
  SCN-specific regions: Sequence locations=1-638
gccattttaaagtgcacagccaccaaaagccattcgtaagacgcccgcccaatgccaacttttgcagaacttttcgaactcagcgcaacggatgtcgtcctcgttgttctgttcgtatacgtcgtctacaaattgttcttcgctcgtcgccatattccgcctccccccgacgtgccgcaagtcgaaccgttggagaagcaggacatgacggtggagcagctgagacgctacgacggagtacaagacgaacacatttgcatggcaatctgtggaaagatttacgacgtgacaaagggaagggactattacggacccgagggggcgtacggagcattggctgggcatgacgcaactcgtgcactgggcacgatggatgtcaagcaaatcaaagacgaatttgatgaccacgccggaattgacccatccgatttggaagaagcgaaagagtggcaacagcgcttgtcattgaaatacccgttcgtcggccgacttttggctccgggtgagcaacacacggagtatgagactgttgcagaaaaccgtgagggaaattaaacagcggttgacgcgtaagaaattcacacattccttcacttcaatttttccaccttttcactttgctccataaaatcactatc

SEQ ID NO: 88718 - DNA, 684 bp, Heterodera glycines
  SCN-specific regions: Sequence locations=1-82,107-585,608-684
attactgttcgttcactctcttcatctttggcccaatcactttgaattatttaatcaatactaacaaataaataattcgctatttaacttttaacaatgatggaaatggcgaatactgacgaaattaatctggtcactgtggatgtgccaccgaattgtcatttcactgtttatgtgcagaaaccgagagagaatttggagggcaaaactgtttttctcactgtccatgacgtcggctccacctcccaatcgttcatcgaatttgtgaacagttcgcccatgaacagcgtcaaaaatcatgccatgttcttgcatgtttgtgtgccgggccaggaagaggacgctcctccgctggacggggacttcccatcaatggagcaaatgggtgagcatttggtgcacgttctgaatgccatggatgtgcagaattgcgttggcattggcgagggcgctggcgcggacattctttgccgttttgctatggcttggccaaaccgtgtccttgggctggttctgatccattgtttggccacttcgcacggaatcatcgaaagcctcaagcaaattttcttaaatttgcgagtggaggacgggaacatgaacaatgccgcgtgggattaccttttcttgcacaaatttggattgcacgaaaaaacgttgaaagaagcgttcattgccgagctg

SEQ ID NO: 88719 - DNA, 127 bp, Heterodera glycines
  SCN-specific regions: Sequence locations=1-105
ctttttcagcagattaattaatatacgatgacaggtgataatacaatattgatacgcaatatgcatcgcagtaatgcgtgaatatatatagaagataaagtttttaaaaaaaaaaaaaaaaaaaaaa

SEQ ID NO: 88720 - DNA, 665 bp, Heterodera glycines
  SCN-specific regions: Sequence locations=1-665
gtccaaataagcattttcaacaattttcttacattcacttttctttttgcacatttacaaacacataattttgatatttcacaacacatgcatttgaatgcgtttggccatgttcctcgatgagcaacccatcgcacagtcaattcacaatgctttcacagattggcagcggttcgtttggcaaatgctttctgtgcaaaagggtggcggacggtgcccaaatggtgttgaagaaagtgcggatcagtgacgagtccaaaaatgaggcacgtctacacagtctaattttacacccgaatgtcgtgcgcaccttcgaaagttatttgagccaacgcagcatttacattgtgctggagcacatggcgggcggcaatttgcacgaacacatcaaaaggaatgaggcggaggagttcaaggatgaggacattctcagcatcactgcccaactgacagccgcgttggaacacatccatcagcttcggataatccaccgagacgtaaagccacggaatgtgctgctcagcgaagactggaggactgtcaaactgtgcgactttggcatcgcaatcaaattggcggacggacagaaggccaagggacgctttggcgaagttggcaccatcaactacatggcaccggagattctggagggacgcgagtacgac

SEQ ID NO: 88721 - DNA, 1009 bp, Heterodera glycines
  SCN-specific regions: Sequence locations=1-333,355-356,378-717,739 -1009
ggagcttacttatgctcactcatcggaaataccgtctcttgcaatttgcatccgtttctggtcgggcactaacaataagtccggaattcaggcagctcagttctgtttcgtccatcccatcaaattcgcataaaacctcaaagtcagatggaaaggcgcccaaatcgagcactctttggcttaatttgccctccaatgcggaagaggatgtgcgaacacgtgttcggagctctttcttcggcacttacgtcgctttgttattcccagccgccacttttgctttgggttgttggcaatggaaaaggcacaaatggaagaccgaactcatcgaaaaactgaaaattgcaacaaaaactgcacctgtggaattccctgtggacaatttgtccgcgattgatgatatggagtttcgcaaggtgcacgtcagagggtattaccttttcgaccgccaatttgtcattcggtggcgctgtcggttggaccccgcaaataccggcacttcgaattcggaaaaatatggggcgtatgtgatcactccgatgagactggagggcacaaacgttacaattatggttaaccgaggatgggttccaaacgaaaacatcgaatccgaactgaagaagggcaagcaactgcgggagtccgagctgaaggatttgaacgcggtcgtcagaagtgctgagaagggctctcctttcgtcaaaaaccacccggaaaagggaatttgggccttcaaggatttggaagaaatggcaaggcaaagcgaccccgtcccaattattgtggatgccgatttcgaatcgactgaaaaagacggaccgatcggcggacagaccattgtcgtcctgcgaaaccagcactacagctacatggtccaatggttcggattgaccgttggtgtgcttggcatgtgggccttgcgtttcttgtgacgctgcgaacaggagggaccagatggcatttgtcatatcgtatttagggtctttgctgtccatctctgttgcctttc

SEQ ID NO: 88722 - DNA, 1164 bp, Heterodera glycines
  SCN-specific regions: Sequence locations=1-735,757-1164
gagttccattttgagaattccctccacctttttctccaatttcttaaatgatgtccaacgcaaccaaaaacattctcggcactccaacaatcgtcgacaatgttagtttcgaccccaaagtgagcgccaatttccttcacaaagccatcgaagagaagcgaaaggatgagattatccatttgctgtgcaccatttccaaccaacagcggcaagaattggcacgcgaattcaaacaattgttcggcgaagatttgtccgccaaactgaagaaggcactctctggcgactttgaggaactgattttggctttgttggaaccgccagctgtttacgatgcgcagcaaatgcaccgcgcgatgtccggcctcggcactctcgagggatcggttctgattgagattttggtcacgcatagtaaccgacaaattgatgagatgaagcgcgtgtacgagcagctgtacggccatccgctggagaaggacatcgtcggggacaccagcggcgcattccaacgactgctcgtgtcgctgtgcaacgattcgcgcgacgaaagttggagctccgacccgatcagagcgaatatgacggcacgtgctctgttcaaagagagcgaggtggagagcggggtcaacgacgttctgttcaaccaagtgctggccaacgagaatttcattcagttgcatttgattttcgaggagtatcagaaggtcagcggtcatcccattgagcaggcaattcagcaacagttcagcggagacacgagggacggttatttggcggtggtggaatgtgtgcacaatcggcacgccttcttcgccaaagtgctccaaaactcgaccaaaagcttcctcggcattggcaggcgcgactcggacttgatccgactgattgtcactcgtgccgagtgcgatatggtcgagatcaaagagcagttcatgcaaatgttcaacactccgctggagaaggccatcgaaagcaactgttccgggccgtacaaagacggacttttgactctggtcaaagggaattgatcggcggaagaagcgatctgaagatgattgatcattggcattggattgattgatcggatttgccactcgctttatcatttattttgcttgcatttggtcagtgtcaccaattgtaaaggtcaaacgttaaaaa

SEQ ID NO: 88723 - DNA, 648 bp, Heterodera glycines
  SCN-specific regions: Sequence locations=1-181,213-330,352-385,498-620
ctttcatttcgtccgctttttcagtgcgaaatgaatggcaagggaaaaaacaaaaagacttcgtcttataaagaaaggaaggccatttcgtaccagcagggcagtgaccctccgtttttggcacaattcaaaaacaaactcggatacaaagaatggaccgtcgaggataagtttgccaaaagtgatgacgaggaggaggaggagggggcggacaatccgacggatgacatccgaaagatgcgagaagaggaaagaccccaagtggtggtgttggacccgagaacggatctgtcggcggaagaactgcagaaagagattgagaagggaaacgaggaggaagacaagcgcaaaataatggaaggaaaaattatgtttcggaagcccgagaaaaggaagacggaaaatggatgtgggaaagaaggaagcaaagaggaggaggagaaggagaaacgagccaaaagagaagagaaaccgggacagcagcagaaggagcagaacagacgacttctttcgtttggagaggaagacgaatgaaccaaaggatttctcgatttttatgcgatggtttaaaagcatctcgatgtaattttagtgaataataaaaaaaaaactcgactcttaaaaaaaaaaaaaaaaaaaaaaaaaaaa

SEQ ID NO: 88724 - DNA, 283 bp, Heterodera glycines
  SCN-specific regions: Sequence locations=1-283
gttttatattctcacaaattcgacgagcccctttttctcttcagctctttttggcactgaaatatgcgagcgaagtggcgtaagaagcgaatgcgtcggctaaagcgcaagcggagacaggcgaagaaatgagcggacggacggagagaaaactcagccgaacgcggaaacggaggcacaaaatgttgttgctgtttttttgttattgttgtcaaccgcccctttactcagataaaatttgttgcaaaaaaaaaaaaaaaaaaactcgagactagttctctct

SEQ ID NO: 88725 - DNA, 701 bp, Heterodera glycines
  SCN-specific regions: Sequence locations=1-701
ttaaagatctttaatatcttcaaaaatagctgaatacgaaaatgacaaaaccgcaacaggttcttgttcttgatccgaataacgaactcagcttcaagggaccgtttactgagtatgtgaatgccaatctcacactgtcaaatccctcgcgaaaggacgtttatttcaaggtgaaaacgactgcacctaagttttattgtgtccgtcctaactctggtgttatcaaggcgaatgataaaacccaaatcaacgttatgctgcagccggttgaatcgcctgagactctcgagagtgagcggagccggcacaaatttatgattcagactgcatttgcgcctgatgacgagcagcttcctgtggaccaattctggaaaactgttgacccaacattagtcatggattcaaagctccgagtggtgttccagcgaccttttggatttggcgatgaaaacaatcgggacgaaaccaatgcgactggtccgtttttcaatttcaacaaaacgggcgaaccgaaaaacgaacagccaacgcaaactccaaaatcgaccgaagcaaattctggcgatattcaacttgctttgcaaagggaagttgaacttcggatgatgtatcaggacgagaaaaaaaacctcgaaaaggagaattacgcactcatcgataagctcgaaaaattgactcacaatgctgctgcgggaggcgtc

SEQ ID NO: 88726 - DNA, 693 bp, Heterodera glycines
  SCN-specific regions: Sequence locations=1-693
cctctacttagatttgccagccgcttttgctttggcacagctttggattaaaaagtcgctcaaagcgggttatattagcaatgaattggcctccggttgcccgacggggaatattcgcagtcgcagccgcactctctcacagggaccagacggcaaactttcatgcctcgacgaagaccaacatccaaaaaatgcaacccgtgctgacaatgagagcgaattggaggagtgcgcgcaccagcccaatcggaacatcatttgagatggtcgttagggaatagaataagacggacgttcttgcatagatgccgatgattgtttgacatgagttacctttcggcaaatgtccgtacactttgaccgaaaattgtaaatttacgaaaccgttaaccccatttgcctattctgttcgttttttgatacatttgctcgttattttatcgttagctatctatttattacattgcaatttgtctttttcattttcctccgttacttccttatcgatcttcatcgctacagatatgtcataaacgaattcatccatttatccataatatcagccttctatgtttttccaacatatttatctttgacaacgagaaaacgtattgaatgtacaatcagagcaccccattactccaactagattaaacccagccattcgatcgcgggtcccctcaagttaaccaa

SEQ ID NO: 88727 - DNA, 631 bp, Heterodera glycines
  SCN-specific regions: Sequence locations=1-473,495-631
aattccatcaaatcagccaaagatccttcaaaaatgtcttctccttcttcgtccgtctctctactcgccatcgtcacaattttctgtttgctgtgcaaatgttgcgtttcggcaccgcatccgtgctgtcccggcagtcaaaaagtggtttcgctgatggccaattacgttggcactttcgcccattccttttcaaaggcatcgctttgttcggatgcccaaagtgttgcgggcgcattgaaaggccaactgatcggctgctcgaagggcggcgacgcaactcttttggccgacatcgaaggatttcttggcactcattctgctgatgagtgtgcccacagcctcggcttcgtccgtgccatgttcgtcattgccgcctccgcttcttcccatgccagcaacaacagcgaatggcaggcattgagtgcccagtttggtcagcaaatcagtgaaattgactcgaaatgtgccgagtttggcattggcattgccaaagtgccatatgacggccccaagggtgatcactcccaacgaaatgtgcctggcacggacagtgtgatttcgatgcccggattgaccggctcacacaaacaatgaaaatgagtcaatgagatcattttggagttcattt

SEQ ID NO: 88728 - DNA, 657 bp, Heterodera glycines
  SCN-specific regions: Sequence locations=23-424,446-570,594-657
gagcttttctctaacaaatatttgtatgaattaatcccaatgatttgctcccgtcttttttcgtctcccatttcttcgtcggtttgccgacgatcccttcggcgaattggctactgtgccgacccgaccatcggcctctcctcggaacaaatcgaaatccaacggatggccaaggattttgccaagaaagagctgtatccggagatggacaaatgggacaagctgggccaacttccgatggacgcgcttcgtaaagccggcgagttgggcttcggtgccatttactgcgacgacgcgtacggcggcgcgggactgagtcggtccgacgctgcgttggtcttcgagcagttggctgccgggtgttgcagcaccgccgcttacatggcggtgcacaacatggtgccgtggatgatcgaccgttttgccaacgaggagctgaagcaacggtacatccccgaattagccagcttcaccaagttggcctcctattgtttgactgagccgggcagcggctccgactcggccgcactgcgcaccaacgcacggagggaaggcgaccattacattgtaaatggctccaaggcgttcatcagcggcagcggcgtgtccagcgtttatttggtgatgatgcgtcacaaagacgcgccgccgggtccc

SEQ ID NO: 88729 - DNA, 702 bp, Heterodera glycines
  SCN-specific regions: Sequence locations=1-702
attaagatgctttcgaagaaactaattgccttttgttccgatactttttccggaaaaggtttgtcgtctcgaagactgatcagttttgacctatctgaccaacataaagccatccaggatggagctcttaaattcgcgaaggaagtggttgcgcctaaagccgcggaatatgacaaaacaatggcatttccttgggacattatcaaacaggcgcatcaattgggattgatgaatccgacaattcccgaaaaatatggtgggcctggttgttccaatttggagactgctctgatcgttgaggcgttatcttatggctgttcggctattcaattggccattatgggcccatcgcttgcgttagctccgcttcttttggccggaaacgaaactcaaaaacagaagtacgccggcatgttggcagcggaaccactgattgccgcgtattgtgtgaccgagccgggggcaggctcggacgtgagcggagtgaaaacaaccgccgttctgaaaggagataaatgggtgctcaacgggagcaaggcctggattaccggtggcggatacgcaaaatggttttttgtcttggcgagatcggactcggaccccaagacacccgctggcaaggcattcactgcctttgttgttgacggagacacgcctggaataacccgcgggaaaaaggaaatcaacatgggccagcgttgc

SEQ ID NO: 88730 - DNA, 836 bp, Heterodera glycines
  SCN-specific regions: Sequence locations=1-55,80-756,788-836
gtccaattaagatgttcggatgtcgcaaaatttattctattaaacaaatttagtagtttttcctccaacttcagtttcaaacaaattattcccattcgaaccattttcacaattcctttgcataatgcaaaatttgtttcccggcaaatttggtcaagccgcgcaagcggccaacacagcccaaatgcaaatgaaagcggagcatgaccctagcgcaggatttccgtggtgggttcgatttctcgccaagggccttggcatcgtcggtggttttgttgccatatttttcggagtccttgccctcttcaccatccatcccatgtgcatggtcgcagcgcttcttcaactcgccgctggttttttgaccattgcccttgaagcgcccttttgctgtgctttcgtcgatttcatcgaaagaattgctcaattttccgagtcgcgtgcgtattggcaaaaggcagcactttatggcgggatgggtatcgtccccattttgctgtgtgccgggactgagactattttgggtgccgggatgatatgcgcttcgggcgtcgcctacggttttatggcattgggaaagaaggctgaccgtactacgatgttaggcggtgctaataccgctggacaggacccggcatggagcccacaactgaaccaaccatttccacaacctgccggattcaatcagccctaagtgattgaagagaccgatgatggatcattttcttattccaattctctcattttgacacttacatttgaaccctaaaaccctttcaaaagcccgctggaaaattgtgcatttttaaaggagatgaatcgacattggcaatgca

SEQ ID NO: 88731 - DNA, 888 bp, Heterodera glycines
  misc_feature (867)..(867): n is a, c, g, or t
  SCN-specific regions: Sequence locations=1-403,426-791,835-864
gcttttgccaataatcggctaaatttgcgaaatgagacagaacaaaattttccgcttaatctctgccgtcccttcgcttctcctccccccaaatggactttgtggcgcttcgattgtcgcgactttccgaatcattgcacagtgaaaacatgtgcattttgtgccgaagtgaacaaattacggccgaccgccaaaaacattgtcaacgaaacgcacgcccgctgggattcgatgaagcgcgagaaaagcttcgacgacgcgccgactctgctcagaatggccaccgatacatttctgcccagcaaattgacgaaaagtgtttttttcaatcataaattgggcgtcgcaattttccgcgacgaaattccgccaaaattcgaaagtgtcgaaaatctctccggcggcattttccaattgtattttcacggcacttcgggtcgtcaaagtgcggtgaccgtgcaaaaactcgacgctctgttcatccaaactgtccgctcgctgttcggaatgccctctccaattgcgtgccatgtccacggattgttctaccgatgcgaaattaacccgggcaatcgccgtgatccgatatcctatggcaacttgttggacttgccattcatggccaaatttgaggtgccattatgtgcgaggaactttctgatcagacagaattggcaaaaatcctttaaactttgataatcagagtgatcatttaagatttggattgatgacgtcgtgaacagacgactgatagagcagtcgttcatttatcaccccaattttcaatgaccaatttttaaaattattttttaaaatttattattttttatttatcccaaatcgattcgataaatttttgatcacaanaaaaaaaaaaaaaaaaaaaaa

SEQ ID NO: 88732 - DNA, 631 bp, Heterodera glycines
  SCN-specific regions: Sequence locations=1-631
gtttgagcacctaaaaacagtggccctgattgtaaattaccactaaaatggcgacttcttcaaattcgaccacaacagtcgctgagccgttgccgacaaaaacttcgatgaaaattgccgaattgcgcagccgcgttctgatcggcgatttgccagccgactttttgcgcattccgccggtctcttcctccgtaaatctctcgtccgcccccgaccaaattgttgcccaacaaccgcaacagattgtcgtcccttatggccatccgtacgctttcgtcaatccggcggagcacttttattccttcgttccaccgcacacgcgggggcgaattgcggtgaaaattgtggaggcgaaactgaccaaaagttacggtttgcccggcgtccgaatggatccgtacgtccgacttcgaattggcaacactttgttcgagacgcccacctgcgtaaatggcggcaaatcgccgcattggaatcggacggtgaacgcgtatttgccggacggagtggagtcgatttacctgcaaatttatgacgaacgtgcgtttaccagcgatgaatgcgtggcgtgggctcacgtcattatgccgccggccattttcaaccacgagacaatcgacgaatggtacca

SEQ ID NO: 88733 - DNA, 646 bp, Heterodera glycines
  SCN-specific regions: Sequence locations=1-320,342-343,365-646
gtccaattaaggatttatgccattccttttactccaatgaaaaaaattgattgtcatccaccgatggcaaacagtggtgaacattcctcgcgccgtcagcagcaacaacaacgccatcctaacaccacggcggaaaacaactcggacattgagggcactgcgcatcgggtggcgtccgttactttgaacacggagtccgactcgcgcacatccgccgacctgccggcatatccttttcggagtaaacggcgcaaaaagttgccacgtcgagacaaacaacagggggccgatatggatgttgatgaacatcaaccgccatggaaaaaactgtcggtgaacaccgtggacaatttgactcttccaagttgtaaagtgcaaatggactgggagcatggacatggacaggcactgtccactgccaatgacagcactcaaaaccaatcgtccagcacaacgagacaagcatcggacatggaaaacagtgtatccgaccagttttcccattcacaatccgaatctgaggccagcacttccaacattgacgcggatgatgaacaaagtgactggcccggaaatgaactcgctcgtcatccccaactgtcctcctcctcttcggtcattgtgcccttccaactcgccccaccac

SEQ ID NO: 88734 - DNA, 602 bp, Heterodera glycines
  SCN-specific regions: Sequence locations=1-554,597-602
tatcgttttctttcaactttttcccaatttttcattttgatgttttttcttttgatctgctcatttttgacgaccaatgctctcaaatgctggtccggctccaatatgacggtgagtctgttcaacgtaagcaccaaagttgaggaggagcaatgcgcggtagaagtgacaaattgccaccgaaagtactgcaaatacgggaatgggtcggcttattactctttgggctgcgggggaatggacgcgtgcgagtcggggcccgtggcgatgctttgccgggcgagcggccaattggcatgcaccaattgcacgggcgaactgtgcaacggagcgggggcaaaccaccgctttttgggcggcactttcgcagcgacacttttggccattttcatcgcactttttgttcttcaaagcaaatgaaaatgacagaagaaaagagggaaaagtgaggacaacagggacgattgattgacaaaacagatcaaccaacaattggctgataatttatcattttgtaatttgacaatttcagttaagaaaatatttgggaatacatttaaaattatgttaatgaactaattaaaattaaaatatatgaaaaa

SEQ ID NO: 88735 - DNA, 635 bp, Heterodera glycines
  SCN-specific regions: Sequence locations=1-227,250-528,611-635
aattaagataaataatatctaagtcaacaaaagctcaaggaattctcaataaaatggccgattgttgggacgatgaagactacgacccatccgcgcaaatggcggacaaaatcgccagcctcggcttggacgacgtcattcggcaacagcaaccgaaaggggaaaaagtgccgacgcaagcgacgaataacagccgaaaagagggcacagcgaaagagggggcgacggaactgagcgaaagggaaaagagagaggcgcaaatgagggcggacggaacggcggcgatggatttgttcggcttggccgtcgagcgcaaggagcccacctttgacgaccttcgcacgaaggacgactttcaggcatttgcggataaattgggcgaacaaatcggggcgaggaatgaccacgcgaattactcactgtttgtcagtgctttggttgaccatatgacaaagccaatgagcaaattgcaactgcaaatcgtcatggcaaaaatacaggcccatttagacgttcatttgaagcgcgaggaggaggagcagaaactgcaacaggaaaagaccagcaaaaaggagacgaaaaaggccaagaaaaaggagttggaggaggacgtcattgaggacgaatacgacgac

SEQ ID NO: 88736 - DNA, 496 bp, Heterodera glycines
  SCN-specific regions: Sequence locations=23-256,278-470
attaagaatatatttaaaaaatgacacttcatttgttgcttgtccttcccgttttggcgatggctttcgcttttggcaactgccaaagtcaaactataattagcggttccggctgtgtgtaccataacggatgggtgactgaaagtggacgctcgcggccgttgaccaccaacgaacgcagtcaacttgacaattaccagcgccaatcgcaaagtgccgccgctgctttttccgccgcatttcgtccgccctttccttttggagggccaattaacccgcagttgaatttgccgcagatgccatgtttctgttccgctgcctcatgcgcgggcggtgtgtcatgggttgacaattaatcagtgggccgatggacagagggaattaattattcactaatgaaacgaatttgtctgattcacagtcgggggattacaataaagcacataaatattgcggataaaatgctttctaaaaaaaaaaaaaaaaaaaaaaaaaa

SEQ ID NO: 88737 - DNA, 635 bp, Heterodera glycines
  SCN-specific regions: Sequence locations=1-60,82-459,484-559,581-635
gtttgagtaaaattcttgcatttttttcgtctctacctaatcatgaatcgtggacggaacaatcaaaattatttaattcatggaattagcaaatactggcaagtcgtcggcgctctgggtctgtgcgttgttatggtatgcatcacttatcaattgtttctgcacgtggacgaaaagcacaaatcgttcaaactgatgatcagtggacatttcaacgatatcaagcaaatcaacaacgatttcacggcgtggtcaaaaaatttcacatcgcatctcaatgagcgtttcgaacagcaacaggctcgatcaagggctcgtttcaaacaacagttggcgaattttgtcaaaatccgtttggattttgataaacaatttcaaaaaacaatgtaccgttttgccgaagttgagttggaaaccgtgctgaataaaagcaaagcctccggcggtggctgacattgacgtttgtttgttggttgttttttgccgctcaatgtgatctcctccgacttttggacttcaaaatttttgccccgttttgtgggaaattggattatttacattgttttttctttgttgctttgccagtgactgtttttttgtttgatgcgcaaacgaccacattattttgcacaaaa

SEQ ID NO: 88738 - DNA, 368 bp, Heterodera glycines
  SCN-specific regions: Sequence locations=1-58,81-368
caagtttgaggatttttttctcgaagataattcaaatttccattaaaatttacaactcagtctccaacaactgttttgacaatgtctgctgtacaattcaaacagtcatttgacaaagtctgtgccaccacagccaacgcatttcgcttcagcctccaatggtgttttgtgccgctggtcgttattcttggctttcgtcgcggtgccgagccgttgccgaacggcgaaattgtgccattgtcgatcgcgtcactcttttggggctgaacttttggcgtgtgatgtttgacgccgacaaaatatattttcaataataaaacgagcaaatgtttttttgttagtccttgaataaacaatttttccaaaaa

SEQ ID NO: 88739 - DNA, 572 bp, Heterodera glycines
  SCN-specific regions: Sequence locations=1-572
attaagtcctctgcttctgcttgtcagataatgattgtgaacccaattagaaatatattcgtgaggaattttgcctgtcaattcggaccttctgaactcgctcgttcctatgtcaccgatggcccactgacagtgagcggacgcagtgcgcctgtcaaaaagcgcacaaatgccgcagacgaaattgcgcggacaaagttcgagcttttggaacctatcgctgttactgacttgccacgggcgcaacaacgttttgctcgtcaaatccacagatccaatcggactcgggtgcaaaaaatatttgccaagaatatcaaaatgatcaaaaacggcctggccggcattgcattggtggtcgccatttatttgtacacatttttcgtgatgcgaaaggaaacattcttggaagaaattgacgaagaaatggcaattgaacggggcgaaatgaaactcgatgaccaagggagactggtggcagtgaaatgagcacttttgttaatttgattttagcacttcatttgtctaatttgttttgttttattttttgaagagaaattaaattgttttgttta

SEQ ID NO: 88740 - DNA, 796 bp, Heterodera glycines
  SCN-specific regions: Sequence locations=1-53,74-481,503-605,649-796
gtttgagaaaaattcattccatcactccatttgtgactaattaattttgacaactgctgctgctgctgctgctattgacggcgcatcgcatgagtaatccgaagcgtgttcgattggagaggcttcatgcattggattttggtgaatcggatgacatttcagagacacaaagcctcgatggttctgctatcacttttgccaatttaaacactgttaacgccaaaaatcagcagcgcaaaaagatgaacaaccgtgatcattttgaattggaattgagtgccgaatcggatcaccgatcaccagacaaatcatcaaaatttcaaagaatgccatcgtcatatttttcggatgccaaacggatcatcgattacgtgttggtctacgaggagaaggaaatgacgaacagcaactacaacaacaattgcgatgacaacaaacaacgcgataattcacgatcatcccccaacggcacgcacaaaaacagttgtttctctgctccgtctgagtgcccatttcttagccggtcttcatgcattggaacggctctgacaactttccatggatgccaatgccatcggcggaggggcgaaagacaacgcaaagggcggagagacggcagacgccgagctgcctctgcgcagtgcttccctcgaaaaattggatctttcatccaatgccttgcgcagagtgccgaccaaattggtggcccattaattgcattccctcaaaattttgagtttggcggcgatttcaatcgaacggatggaaccgaaattaatggccaatttcagcgcat

SEQ ID NO: 88741 - DNA, 413 bp, Heterodera glycines
  SCN-specific regions: Sequence locations=1-389
gtttgagataattaaaatcatttaaaatggcaataaaattggaatttgccggagggcctgacgcaatttttaatgggaaacgcgagaccgaagctgaaaatgacaatatttcgactgttcgtcaattgttgcggtggctttcggacgggcccttgcggggcaatgatcggtcggaaatgctcatccaacgcgacaccgtcagaccgggcgttttggtgctgatcaacgacacggactgggaaattctgggcggattggacgctcagctcaacggcggagacaaagtgacattcatttcgactttacacggcggataaaacagcaaaataattgaaaaataattcattcgttttttgtccatttttgcagaagcataaattataatttttaaaaaaaaaaaaaaaaaaaaaaaa

SEQ ID NO: 88742 - DNA, 630 bp, Heterodera glycines
  SCN-specific regions: Sequence locations=1-197,219-536,572-630
aaagaatctccaaaatccctaaacttcgaaaatggcagaaaccgccgagacaatcaacaccacgatctcatcgccgccaccggaatccgaaagctccaccactatttctgcaatgacagatccaacatctcaagaagcagcctcaaaagacacagatctgacgaaagaagccgaatcagagaagaaaccaggaggaatctctctccgaatctggccaccgactcagaaaactcgcgacgccgttctgaatcgcctgatcgagaccttatccaccgaatcaatcctctctaagagatacggtactcttaaatctgacgatgcaaccaccgtcgcgaaacttatcgaagaagaggcttatggtgttgcttcgaatgctgtgtcgagtgatgatgatgggattaagattcttgagctttattctaaagagattagtaagaggatgcttgaatctgttaaggctagatctaatgctagtgttggaaatggaagtgtggaggatgctaatactgatgctagtgaggtttctaaagatgatgctggtcctgcttcagaggaggagaagagtgaggcttgagaaatttggttttacttccttattataatctcttgtctcttagggttttgctgttc

SEQ ID NO: 88743 - DNA, 634 bp, Heterodera glycines
  SCN-specific regions: Sequence locations=1-634
gggaaataatcaaggtggatttcacaaacgagaacggactggggatggttcccaaaggcgtgcaaccggcggaggtacaatccagatcctctcgtcaagctcttcaagcactgggtcccatcaaactcctttgcaaggtcaaatatcctccagcaccgatgacggatgtcccgtacaaatgaaaatcgccaaacctgacttgatggctgaggattctttggaatttgcccacaatgagtatcctgtcgtcttcaaatggcattccgatgctcaacctgccaaacatgtgtatttgactggttcatgggacaattggcgtaagaaaatccctcttgtgaaatccacccacgatttttctacgattatcaatctcaatccaggacgttacgaatacaaatttcttgtggacggtaaatggatggtcgatgatacaatcgcaaaaacagacaatcagatgggaagtcagaacaatgtgatgtccattgatgaagctgattttgcggttttcgatgccctcgacaaagatttggcctcctcaaatgctggcgaggcaatgcgttcgatgaattcgacgggtgcacagccatcgcaagacacgccaaacgatcgcgagttggaacgtcttcgcgaattc

SEQ ID NO: 88744 - DNA, 628 bp, Heterodera glycines
  SCN-specific regions: Sequence locations=1-628
gagcttttgactttgtcacccgccaatgccgacctttccgtggagtaaaaagagaaaggcatccgacgatgaggtggtcgagagtgggatgacggtacgccaaatattggaggagcgggaggagtacgtgaaaaacattggcattgagtatcgattcggctgctacgaagaaaagcgcgccgattcgtgccaatatttgggcgaatatttcgaagccgtccaaaccgacttcaaatccgccttcgacactttccgccaaaattgtgagcagcgaaagttcccccgcagttgcttcaaatacggccaatatttggccgctgggagggcgtgcgaggcgagcttcaaaaaggcgatcgaaccgctcagattgtcctgcgatgcgggcatcgccaagggctgtcgcgtgttggcgctgattttgtggaacggggagtcggaccgtccgccggactcagcccaggccgagcagttcatgaaacgggtggccgaactgggcgattacgaggcgagctggacattaagcacttggtatttgggtgatacaataaaataccaacgtgaaaagtcggcgccctatggtcacaaaatgggggaattgtccagggatatgcaaaaggcgcttatgtac

SEQ ID NO: 88745 - DNA, 1471 bp, Heterodera glycines
  SCN-specific regions: Sequence locations=1-253,275-590,615-824,846 -1089,1112-1471
cgtgtcgtccctttgagcctttcgatttgttccgtttcggtgcagtgaatctcgacccgctgactgagacgtacggattgcccttttatttgcattatttggtgaattggcccgattattttatggtcgctgaacatctctccggcgaccttatgggatacataatgggcaaatcggaggggcgcgaccaaaattggcacggccacgtcaccgcggtgagtgtggcgccggaataccgccgcatgggcctggcggccagattcatgcagaagttggagttggtctcagagaaggaggactgtttcttcgtcgatttattcgtgcggattagcaacgaaacggccattaatatgtacaaacggttgggttatacggtttacaggcaaattgtcgattattattctggcgatgacacccacgaggacgaagatgcattcgacatgcgaaaggccttgccccgagacgtggacaaaaagtcagtagtaccgctgaagcaccccgtgtcatgcaatgagatagactttgactgaatttccgtttttgtttcgtatttaaaatcaacaacgatgaaaaatatggataaaaattcattccttttcatcttttttcttttcaagtccatatcggcttaacaattcttcggaaggcgaagtgggcgaatttgtcattgggcaacggccggaagatgcctttggaaatgccatgacgtcacggatcgtacacttcgcattcccttcgaaattcaagagggcaataaatcggtccactcccaaggcgaagcctccgtggggtggtgcgccaaaactcaaagcattgaggaaatgctccaattcttccgtcttcaatttgagtatttgttccatcacatatcgctgcacttttgaattatgaattctaatcgagcctccgccaatttcgacaccattcaggacgaggtcataatgttgagcttcgatttggtcgagatccttcccctgacaaagtttttcaaaatgttcgggaattggcgcagtgaatgggtggtgcgaactttccaagcaattggtggagtcgtttcgagtgaaaagcgggaatttgagaacccacacaaaatcgaaacgaggaaaagaggcatctgagccgatgtccttaaaaatcatggtttatcagtgccgaatttatccatggcttcacgatgagacattctcggaaaagggatggtcggtttgggagtaatttcatcaggccatgaattcacgatcatttgctcaatcagtgacaaaaccatctcttgtgaggtgaatgaaagttccaagtcgagctgagtgaattcgggttgtctgtcgggctttgcatcttcatcacgataacaaatagcaacttggtaataacggtcgatggagccacacattagcaattgtttgtatatttggggactctgcgggagactgaagcagtcgccgtttttgttggcggggattgggaattccgc

SEQ ID NO: 88746 - DNA, 333 bp, Heterodera glycines
  SCN-specific regions: Sequence locations=1-151,173-186,212-238,260-311
tgattgggataaaaaggtggccggttgggacgacaagaaagtgaacaaaggctgggaggaagccgaagcaccgctcaacatccgtgcccgtcgcggcggatgggatgagcgcattttgggcggtcgtgaacaatgaatggagagaatgagtgaagaagaagaagaagaagaattcgggatggatgccaaaaaagtaaacattcattttcaatttaattccccctttccgcccccatttgagcccctttttccaaatttcaattatcaaatgcataaacctgttctttctctcccaataaatgatccgatttaaaaaaaaaaaaaaaaaaaaaa

SEQ ID NO: 88747 - DNA, 532 bp, Heterodera glycines
  SCN-specific regions: Sequence locations=1-20,46-466,501-507
gtttgagaatttttttttgcgtcaaaataatgtttttaaaatttttgattctggccttctgttttcaattggcaatggctaacctatttggtcaaaaacaatctgtagctgttgttggaatgctcaaatgtaaagggaagccaagtgctggtacaaaggttaagctctacgacaatgaccattttacgactgatgatttgatggcacaatccaaaaccgacaattatggacgtttcaaattgagtgggacggcataaagaaattacgaaaattgacccaaaattgaatctgtaccatgattgcaacggcgatttcccatttacaccatgcaaatggaaaattacaattaaagccttggatgggagtcgagcccacgccttcagctagtggttcaagcagctctaccattgtgccaccgagacaaaaccacaactttatatatttgtagaatttaaattgtaatcacaattttatattttaatttttataataaaatattagccacttaaaaaaaaaaaaaaaaaaaaaaaaa

SEQ ID NO: 88748 - DNA, 473 bp, Heterodera glycines
  SCN-specific regions: Sequence locations=1-389,411-442
ataaagttcatcctaattgattcacttttcttgctgttatggttcgaatgactcccgatgagtgccgttcaattgcgagcgaaggcgaacgatcccttagagaaggcgacgctgttaacggcataaaaatactcgagaaggctcttcaatgtaacacgtttgatttgtctctccaatgttcactccattctcaattgggtaatgcgtattatgcccgtggtgactacaggaaggcgaggttcccttcaaccgttcggtctttttactccccgacccattaaagagaccatcacatggctgacctttgcgcttctagattgcaaaaggacgaattgcaacaagcgaagacattgtccaatttgtccgcaacttacattctgtaatggagattatttttgtttgtaattatttgtgtgaactattagtaaataagggctagcggaaaaaaaaaaaaaaaaaaaaaaaaaaaaaaa

SEQ ID NO: 88749 - DNA, 350 bp, Heterodera glycines
  SCN-specific regions: Sequence locations=1-241,275-327
attaagcccatagttagaataaagcgaaaacgcttttttaattcgaaaatgtttgctacaccggaatttatggatgccgaagacagtttgatggagatgaaatcgaatcagttcaaaatggacaaaaatgagttcattgccgcggagaaattgatcgacaaggactactacagggactttggcgatatctttgacccggatgtgaagtaaatgcggctactttttgtgcggaaataagcaaaatgtaatgttgttgtttttgatttttgagacataaaattgtgtatgaggtatatgaaatggaaacaatgaaagcgtagaaattccaaaaaaaaaaaaaaaaaaaaaaa

SEQ ID NO: 88750 - DNA, 698 bp, Heterodera glycines
  SCN-specific regions: Sequence locations=1-479,501-698
gttgcgacaattaaggtttcttcttcttccgctcatcagttgcacaacaacgcatcaataattaacattgacactgtccgtttcacttcgcactcaaaagagaatgacaccgaaaatagcaatggaagtgatttcactgtgaataatgggggcacttttgtgaggcgaaaggacccagtagaacggaaagtccaaccgaatgtgaacccgtcttcaaacccttcgtcctcttttacttcccatgaccactacccaccggtcgttagtgacggtgatgaaactgccgacgatggcaccggaactattcgaatcatttctccctcaaaagcggtccctccaataccacctcatcattttcatcgacaacaacaacaacaacttcagcacaaccaggtcaacaatgtgccatctacttttgttgccgatgtttcggttggcattgctccgccaccgcctacaatccgtggcgttcgctgtagctcactagagaacacactgcttcctgcactggataagttgactcgaactcggcacggtgccgcccatttggacacaattgctgtcgcactgaaacgcgctgaacaggcaagccccgggctgtgcgatcacttagtcaccgaattgatcaccaccatggcacatccccaatgcacgaacgcggagctgcgcaaggctatcgaccgattgaccacgcgaag

SEQ ID NO: 88751 - DNA, 639 bp, Heterodera glycines
  SCN-specific regions: Sequence locations=1-71,93-610,632-639
ccaagtttgagactgtttggctcgaaattcataccattttttcatacgattctcatgagcagtggtatcattgaatttgctgtggccaggggattgcacgtcaaatccagagaaacggcagtgccatatttgcgcagttccattcgccgttttcccgttgatgaacaacgcgtgccatggaatgtgcctcttgtggactattctccgtgcgattacaccgctgattcggtgcacggaaagccatgggctgacccatcggagccgtcaaaatgtaaattcaattcgatggacgacggggtgaacagagtttcgtttcacggcagttacaatttggacaccgatgggaggcctctaaaccctttcggacggacggggctcagaggcaggggactgtttggccgctggggtccaaaccacgcggcggatgccattgtgtcacgacggctggcgaatggccaattgcaatttgtggctattgaacggcgtgacactggcgaactcgcactgcccggtggaatgttgaacaaaggcgaaccgccgactgaagccgccgtccgggagtttagtgaagaagcaatgggagggcatcgacgggaggacaaattggaacatttttggaaaaaggggaaaactgtgtac

SEQ ID NO: 88752 - DNA, 891 bp, Heterodera glycines
  SCN-specific regions: Sequence locations=1-205,229-522
gtttgagaagtttaaaaatgcaagagacgcaaataattgtcggagtggcctctctgtgctccattttggccatcctcgccaccgttgttgtggtgccatcgctgtactcggagatcaatgagatcgccaccaaagtgcacgacggtgttcaggctttccgcgtggacactgactcggcctggaccgacctgatggacttacaaatcacagtcacgccgccgtccaagccgcgtcagaacccgttcagctccatcttccgccagaagcgtcagttgcccggccactgccaatgcgcgggtgtgcaacagccgaactgcccgcccggcccaccgggaccggcagggtcgccgggacagcctggccagcctggacagcccggaggacctggacagcccggagtaccaggacaacaaggtccgccttgccctgtctatacgcccccgtgccaacactgtcccgcgggaccccccggacagcccggaagccaaggaccgcaaggccgccccggagcacctggtcagcctggacaacctggacgcaacagcggacaaggcccgcctggacctcccggaccccagggaggagctggccaacctggtcgccctggaggacctggccaacccggacagcccggagcaccaggagttatcaccacctccgtgcccggaccgaagggacccccgggcgcacccggccaacctggacaacccggagcgcctggacagcccggcaaacccggaaacgctggtcagcccggggcacagggcccgcccggacatccaggacagcccggatctcctggccaacctggaagccccggacctgctggacctcccggaggcgacgcggcttactgtgcttgccctcctcgcaacgctgtgctcatgaaga

SEQ ID NO: 88753 - DNA, 864 bp, Heterodera glycines
  misc_feature (852)..(854): n is a, c, g, or t
  SCN-specific regions: Sequence locations=1-265,287-739,761-766,789-864
ggtctccctaatttggggttttccattttctattcgtcaaaatgtcaatgcgtcggtcgcggtcggccgatttgagtttgatcagtcgtgagaaatatctgtcgcgatggtctcgcgagaacactccgatggattgtgtggaccgatggtgcagcaatgtgcggcgatcattcactccggtgcgcgacatttcaggatacgagaacattcgtaacgaaagacgctcccgctccgtggacagttaccgttctccgctgggcatcgttacggtgccttaccacacaaatgtcaattattaccaggaaaatcagccggtgcgaaagtacgacgttttccaagcgcggacatggtcatacccaatttacaagtatatttacggaagggataatcattactcgcggcccggcagttacacgcgcgtgtacggccaacaatcgctgtacacgccatccgtcatggcaccagaggccaaattggccaccgaacggcgcacttattcggggtacaattatgtggcaggcgaacacagcttcaatctgtccacgaagccctggtcccagtccaattaccgcttcctccgcgtctctcacatttcttcggtcccttggtatttccacggccaaaccagcaatgtcagacattacaacagttaccgcccgccctccttcactccgcgtctgtccacctattggaaaagttatttctgaccagcgaccgttcagaatggcatttcgttgtccttttgaattctttgccttttcacctttcatttttccctttgctttagtccctccattatcattctgtgcatagaaaatgagcgtaaagtgtcaataaatgtgcacaaaagcnnnaaaaaaaaaa

SEQ ID NO: 88754 - DNA, 681 bp, Heterodera glycines
  SCN-specific regions: Sequence locations=1-642,664-681
aatttttagctcctaaaaaaactaaccctactcatcgctctcttttgttttgattcgctaacaatgcactcaccactgttcggctcaatgttggacaacaaggaatattcacgtcatatcgaaaacttccgttcttctatttctccacccaaaggcatcaccaacggactccactgtcatgacttcagatctccttcggatttcgacgttttagtgaagttggcaaaagaccccgccggggtgggcaaccgcgaattgcagcaacggatggaccaggaccaacaattccgacagcaagttttgtgtgcaattgtcaacggtggaaaagaacgttttctgcaattgtgcatcgattgcaacggatgtttcgtcattcagaagttagttgagaacggttcaaaagaaaccaatcaaatgttgctcaatttggtccgtccgctcgcctttaaaatggtgctcaatcgttttgcttgtcgcattgtccagaagctcgtcgttaatttgtccgggtcccaagtccgccaattgttctgccaacagttcaaaggacacgagaacactttggtcaccgaccaaaacgggaaccattttgtgcaatgcgtagttgaccattttgcgcccgacgtgtacggaccttttatcctcgccttggccaactgtcccacccgactgagcgccgtt

SEQ ID NO: 88755 - DNA, 383 bp, Heterodera glycines
  SCN-specific regions: Sequence locations=1-351
attgagattcaaaagcgtttcaattaaatgatgagtttattggccagtaataatgcgtcgtccaatgggacaaacgctgctgccgttgcacctttgtcgccgctagcttcgtacaaggagcagcaacagaagcacaaattcaaaaagcctaacccgctagaccgttttctctacaaggttgttccggctcagacgcatcccttcacccagctttgttacaccgctctcatctttggcttatgggcgcaactcgggcgttatatgcgatgattctacgacgaaagaaggatgactaattttaggcttttgactctatgtgtgtgtatcgtcgcaaacacttgaataaaagttaaaaagtaaaaaaaaaaaaaaaaaaaaaaaaa

SEQ ID NO: 88756 - DNA, 676 bp, Heterodera glycines
  SCN-specific regions: Sequence locations=1-255,278-431,468-520,554 -566,588-676
atatattgataatcccccctcactttcacttaaatttattggcgaaatgtccactgccactgacgttcagcacaagagcatctacgactttaaggccaacgacatcgacggtcacgagatcagttttgacaaataccggggcaaagttctgctggtggtcaatgtggcgtccaattgcggcaccaccgagttcaactacagccaactgaagcagctgtacgacaagtataagggcaaaggcttcgcggttgccgccttcccgtgcaatcagttcggaggacaggaaccgggcaatgccaacgaaatcaaagactttgtgcacaaaaagtacaactttgagccggaccttttcgagaaaatcgacgtcaatggatccaacgagcatccgttgtacggctttctgaagaaagagcagcacggcacactcatcgacgccatcaaatggaacttcaccaagtttttggtcgaccgaaatggcaatgttgtgcagcgttactcgcccaacacagagccaagggacatcgaagcggacattgagaagttggtggctgccgcagcctaatcgcaaaaaccatttgaaagaaaacgaaatacgacgatcgacgagaccaaaaattaaatgatgttcatttaagcaaatttctaaatttactttggaataaaaaaattatgattt

SEQ ID NO: 88757 - DNA, 1010 bp, Heterodera glycines
  SCN-specific regions: Sequence locations=1-15,38-80,102-171,193 -378,400-1010
ctgattccttcagcaaataaatcatttcatttctcttacttatggtttttgccattcgtcgtttcgttggcaaatgttcgccttttcccaattgttttttgcttcgtccctcttcttctttcaccccttccgccgatggaaacaccgacaaaagagaagatgcaattcgacttccaatccttcccaaaaaatcgcggtccgcaggacagccctattctttagtggattataaaaatgtcttttgcaaagcgggcaaaggcggggacggacgtgtatcgtttctgcgtttaaaaaaagttgaatttgcgggccccaatggaggcaatggcggaaacggtggccacgtcattttccaagctgactccaaaatcactgatctgtcacaagtccattcaattctcaatgcgcaggacggagtggaaggccggggcgactgtgcccatggaaagtgcggagaacacctttacgtgcccgtccctctgaacactctgatcaaaaaaccgagcacggacgaactgcggccaagcaaagtgacattacacgaactgtgccgtgagggcgatttgttcatcgcggcacgtggaggcgcggggggacacggaaacgcattttacgtgtcgaatttggtgagaaagccgttgaaagcggaggagggcggacaaggcgaagagatgagctacgacatcgaaatgcgcatcatggccaccgccggtttggttggcattccaaatgtgggcaagtcgtaagccttctcttccgccttaattggtcactgtccatctcttcattattacaattagcacacttttgcgtgcgatttcgagggcaaagcctaaagttgccgcttatccgttcacaactctcagcccaagcgttggaatggttcagtacggcgacttcttccaattggcagttgccgacattcccggattggtgcaaggcgcacatcgcaacgagggactcggcttcagtttcctccggcacattgtgcgctgcgaatgtgtgctctt

SEQ ID NO: 88758 - DNA, 647 bp, Heterodera glycines
  SCN-specific regions: Sequence locations=1-137,161-647
gtccaataaagatttccacaatttctaacatttacattaacttcttaacttaactcatccaccgttaaccctccctaactaattgcccacccccctgccccgcccctcttaatgcttaaccacatttacaacattaacaccaccaccgccgccaccgcgcagcagccgcgcaagcgcggcaccaccggcacaacaaagcacggcacaatgccggccccaacaacgacaaaggcgagcggcagcagtgaacgcggaggcggcacgcaacaccaccagttcacgaatgggcgacaggttaccactggccaaagacggaaaggcgccacaggaaatgaggcacgcgaccgtaccctggccagtcagccgcctttgctgccaccgctcacttccgtctacgatttcaaagatgtcgttggcatcggttccggtgcgtttgccaacgttttccgcgcccgtgaattgataacggcggcgccggccgaacgctaccgccacgtggcactcaaacggattaatctgtcagccatcgaaaaagagaaccagctgatgtacgaatcggtgctgaacgaggtggacattttcaagtcgctttcccacaccaacattgtcaaatgcttctactcattcaccgaaatttcgccccattc

SEQ ID NO: 88759 - DNA, 634 bp, Heterodera glycines
  SCN-specific regions: Sequence locations=1-634
gtccatttaagcattaactaaaataattttcttattatgaatctcggacggtgtagcatttgcactttaagctttgacttaaacgatgtttcagctctcaaatgtgggcatacgtatcattaccaatgcatcgacaaatggattgcgaattccaaaacttgtccaaattgccggacatcgaatctcaagcgcgacatattgaagcttttctttgatgagggcgaaaagtcttttagtcaattggtgcaagaaccggccaatgcagaacttcttgctcaactgaaagaggcgcaagacgtgaaatgctttttggagaaaaccattaaagagcagcacgagcgactgacccttctggaatttaagctgaagcaacaaaagaccaaaggcaacgaattgaacatgcaaattcaaaggaaggcacaacacatcgccactttggagtcacagctttttgaccagaaggttctgaaggaaacaaacgaaaagtacaaacggcgcctcgttgtctgtgaattctatgatttgctgatgagaggcggtggcgatgagggaaaaattgacaagtacatcaatcagaatggccacccagacgaagctaagtttctcgacttgatgagaaagcaacgcgacgaag

SEQ ID NO: 88760 - DNA, 671 bp, Heterodera glycines
  SCN-specific regions: Sequence locations=33-81,103-671
cctcgtgccgaattcggcacgagggtccaattaagcaaagatttctgcattatgtaattcttgattatgtcgagtgttggaaaaagaggcacaagaaaaaccacgcggaatgacagcgacggcagttgtaattccgcggaaatgcaagacagcgaaaacaacgccgaaaatgagaggagaggggaaagcggaggcgccggtcgtggagaagaagacggggcatttgaaccgggcagttgggaatgtacagtttgcacatttcgcaaccgttacgaagcattcaaatgtttgatgtgcgacactcgaaaagggacttcaactcgaaagccgcgactaaatccctctgttgttcagcagcaaactttggtgcaaaaattagcggttgaagttgaaaaggcacaccaaaatccgtgtacttcggcaatggccaattcgccgaagccctcacgtgccccatcggccaatggtggactgtccaacaaacaacagtccaaactgaccatccgtcgtcggcccgtccctttccgagatgccctcgtcgttcggagtgcagccaagaaaatggtggtcaatgtgagcggtgtttcgttcactgtcactgagtttaaaccgcgcacatcgccgcgagggcgcaagaaattgccggtcaatcaaaacaatggcaaacacaa

SEQ ID NO: 88761 - DNA, 634 bp, Heterodera glycines
  SCN-specific regions: Sequence locations=1-453,475-598,621-634
agaaaatgtataattatcatttaatctttttgcttgtcgcactaataagaggatttggtctgatagcgccaatgaaaattgaagaattgaatgacctggacgcggaaaattttgtgtcaaagttgggcaaaatttttgaaaattcagcttgggtagtccaagaagcctatggagaaaggccatttgaaggtgtggaccaattgttcaatgcaatggaacgggttttaatgaatgctggacgagaaaaacaactgaaattgatccaagctcatcctgatttggcggggaatgaaatgtttagtggaaatctaacgcaacattctacgagcgagcaggctaatgctgggcttaacgcattaacggctcagcaattgtccgagtttaattcgctgaactccgcttacaagtcgcgcttcaattttccgtttattattgcgcttcgagaccaaaaagaaggcattgatggcattttggcggcatttcgtcgacgacttaacaactcggaagaacaagaaatcaacgaggcactctcacaaattggacgaattgctcgccatcgattggacacattgatgatctaaccccaaaattacataaatttcaaaaattctaaccaaaattgaaaaaatagtca

SEQ ID NO: 88762 - DNA, 718 bp, Heterodera glycines
  SCN-specific regions: Sequence locations=1-718
gcactctgaattctgagcattttcagcagcatctgctccatccccaaacacaatggccaagtcccgacaaatcagaatccactttggatcgaacttgtcaagcaaccccaaaaaaacaatggccgcctcaacaccatttgcaacctccgctgccccagcgccatcccggtccaaggccccgctcggccaagcgactcactcggttgacaagaacgcccttggcttcgacttcaacaagcttgtgctctacctctaccaaaccgtcccgcaattcattgcccccttgcgcatcgaaaagtttgccctgggccaatccaaccctacgtttttcctcgtcgatggccgtgagcaaaagtacgtcctgcgcaagaagcccgccggcgcactgctctcaccgaccgcacacgccgtggagcgcgaatacaaggtgctgcacggtctcggcacttgcggccatgtgcccgtaccgcgtgtgtacacgctgtgcatggactcgtccgtgatcggcacgccattttacgtgcggatcatggctgtatcgaggtttatgtcatgcagagcgttctcacgcacgatccctcgttgcggcacatacatactaggtcatggaattcgtcaagggccgcatctttccctcgcccgcacttcccgaaatcccggccacggaacgtcgcgcatactgggaagccgccatccgcacactcgcgcgcctgcattc

SEQ ID NO: 88763 - DNA, 691 bp, Heterodera glycines
  SCN-specific regions: Sequence locations=1-651,673-691
gtttgagaggagtgttcaaaaatggtgacccgtttaaaatgtgtgtcccgagtggaaaacgacgggaaggccatgggacgttcagcaaacgggtttgttgcattcggatgcgagcgcaaacggatgggcgaagaggaaaatggtggcaaagtgttttatctgctgctgaccactcggctgaacaaaggacacccacgcaaaattaagttgagccatttctaccgactgtttgacaaaatgaagcgcaatgggatggcaaccttccaatttgctgacccgaacttgacagtttacgtgtcgcaggcagaccctaaagcactttgccagtttttgctgcatctgaacggcttgttacgacatgccgttgatgccaacattagatgttccgccccatcatgttcatctcccgccaatgtgccgtcatcgcccccgccaatcgcaacagtttcgactgtccatcgccaatgcacttcagcaattgcgtcagcgaaaccgaccaaaatttgcattcaatcgcgacaggaataccagtcgatgatcagacaagcttcatcggccaatctgcaacgcctcgacattgtcgggattggctttcgtgccgtggacattcgttggtttggcatgcgccgcttgcaacaactttcgttggctgccaacaaattgggctcggacgaatggtgcactgaacgca

SEQ ID NO: 88764 - DNA, 631 bp, Heterodera glycines
  SCN-specific regions: Sequence locations=1-55,79-631
ccgaggcgagggcggttttctgattaataacgaaggggaacgcttcatggaacgctacgccccggtggcgaaggacctcgcctctcgggacgtcgtctcccggtcgatgaccatcgaaataatggagggacggggagtcggacctctcaaggatcacattttccttcaacttcaccatttgcctcctgaacagctcgcacaacgtttgcctggcatttctgaaacagctaaaatcttctctggcgttgacgtcaccaaagaaccgatccccgtgttgccgactgtccattacaatatggggggaacaccgaccaattacaaaggccaagtgatcagattctccaacgacaaaggcgaccaagtcgttcccggtctttgggctgccggcgaatgtgcggcacattccgtccacggagccaaccgactgggcgccaattcactgcttgacttggtcattttcggtcgcgcatgtgccattaacattttgtccgccaataaacccggcgattcgctgcctcctttggaaacggatgccggagagtcttccattgccaatttggacagcttgagaaatgcgaatggtgacgtgtcaaccgcggaccttcggctcgaattacagcggacaatgcaa

SEQ ID NO: 88765 - DNA, 289 bp, Heterodera glycines
  SCN-specific regions: Sequence locations=1-266
tgcttgaccaaatgttgaaacggatggacaaacgggtgaaggagttcaccgaggcagcgctacgccatttggagaccattgacgcgtttgacatttacccgaccggtgccacggaggagcaaaagtgccggtgccgtgagaagcgcaaatgcatggtggacactgtgcaaacgctgctcaacgaaaatgacaaatacacattccgactagaccaataccgcaaatcgttgttgtacaaataaattattatatttttggttgattgtaaaaaaaaaaaaaaaaaaaaaaa

SEQ ID NO: 88766 - DNA, 474 bp, Heterodera glycines
  misc_feature (454)..(454): n is a, c, g, or t
  SCN-specific regions: Sequence locations=1-454
tgagattattctcttttggctatggctgactcaattcaaaaccttaacaagcctaaagatgcctttgaacaattggaggaagaggagggcactcgccagggattctgtcacatccgaattcagcagaggacgggtcgaaaaacgatcacaacggtgcagggaatagcgccggaatacgacttgaaaaagattgttcgctacctcaaaaaggaatacaattgcaacggcacaatcgtcgagcaccccgagtatggcgaagtgattcaactgacaggggaccaaaggcagcacatcaaggactttctgtgcaaggtcgggatcgtcaaggaggacaactgcaaaatccacggattttaagcaaaacttattccatttgtgtatcaatgagcattaaacaaaatgtgttgaccgtccctaattcgttgatatgtcaccgtaaataaacgaaaaattnaaaaaaaaaaaaaaaaaaaa

SEQ ID NO: 88767 - DNA, 675 bp, Heterodera glycines
  SCN-specific regions: Sequence locations=1-648,670-675
gtttgagtcaccgttatggatgtcacttcgaatcccaacggatcggtcgaatttgaaaaggtcccaaaaagtctaaagaaaggttctgctgacactgggctggattttgatgaggatggcctgacaattcacgaattgttcagccaaggcaccgggctcacgtacaatgacttcaacattttgcccggttacatcgacttcccagtctctgacgtcgaattgggcacgcatttgacaaggaaaatccgtctcagtgcgccgcttgtttcttctccgatggacacagtcactgaaagcgaaatggcaatcgcaatggccttgaacggcggaattggcataatccacgccaacttcaaaacgacccaggatcaagtcgcggaggtgctgaaggtgaagcggtacaagcagggcttcatctccaatccgcagtgcattagcgagacggataccgtttcggatttgcgtcacatcaaaaggattcatggcttcaccggcacgccggtgaccgacacgggcaaagtgggcggacgactgatcggtttggtgacttctcgcgacatcgatttcatcaaacgcgaaaattacgagacgacgcgaattgcggatgtaatggtgccgagggaacgactgattgtgggacataagaacatgacgctgagagaggcctattgcatc

SEQ ID NO: 88768 - DNA, 534 bp, Heterodera glycines
  SCN-specific regions: Sequence locations=26-534
cctcgtgccgaattcggcacgaggcaaaaaaatgcccgcgccgcaacagtcaaccgatgaacaggctgaagaggacgcaaccgaattgaagttcccgaaagagtttgaagtgtccagctgcgatgctctgatgatttcggaagtgtttctgctgctcgaccatcgccgcaaacaatcggaggaaaaggaggaaattgaggacattagcgaagtgtttttgaagacgctcaattacacgcgacggctgtccaaattcaaaagtcgcgagaccattcgctccgtccgcggtatcttcgctgggaaacacaacatgcacaagttcgaagttgctcagatcgccaatttgtgtcccgagacggcggaggaggcaaaagcactgatcccgagcctcgaaaacaaaatggaggacgaagaattggacgaacttttgaaggaattgcacgcgaagaaaacattccaataaaaattttttgtataatttctctatcttatcattttccctatttttttgttgcgtaaaagttttagtttttc

SEQ ID NO: 88769 - DNA, 659 bp, Heterodera glycines
  SCN-specific regions: Sequence locations=1-659
gtccaattaagcctttaattttggtgaaaatgtttaaatttgcaaaaccgatgaccaccaccgccgctcggatgattgcgcgcaagtcgcgtttggaggtgatgccgatggccaagaagtacaccgagtcagactaccagcgtgagctcacttaccggcgttccgactattcatttcccgcattctgcgagtccgatgtcacccacttcaagcgtggcgaagtgcaccacaaattgatgcagggcggcgcgtcggagggcggcttcacattgactgcgtatgtgctggttgctttgctggagaaccacgtgcagaacaaagtgacggaattggcacgaagcaatttggtgtcacacctcgccgacttcaaagaggacccgtacgcgttgacgttgtgcacttatgtgctgcatttggcgaacagtccggagaagggtgacgtgctgaagatgttggaaggccttcaaacaaccggcaccacagatggcatggtccattggacgacgaaggtgtcaaacggtgccaaagatggctctggtggagcagcaaagaacatcggcgatgtcgcttgggacaccaaccagtacttctctcagccccagtcggccgacgttgagatgagcgcttatgccttgctcacatacatgctgctggacaac

SEQ ID NO: 88770 - DNA, 378 bp, Heterodera glycines
  SCN-specific regions: Sequence locations=1-378
gtttgagattcaatggaactggaaccttttgtgaacaaatgtgtgtccattatcactggcgacgggcgaaacattgtctggactgcatgaaaggctttgatcaaactgtaaacattgtgttggaagattcacatgaacgggtgtacagtatcgattctggagttgctcaaattccgcttggactttacattgtacgaggcgataatgttgcggtgatcggagaggtcgatgaaacaattgacaaacaattggacttggaaaagatgaaagcaccaccgttaccggcaatttggattccttaaaatatctttttcgtttaaataaatttgacggattttaaaaaaaaactctaaaaaaaaacgccaggcccccaaaaaa

SEQ ID NO: 88771 - DNA, 596 bp, Heterodera glycines
  SCN-specific regions: Sequence locations=1-515,537-574
caattaagccaaaatgaacaaattgtttggattgctaatgctttttgctgctttattggcccatttcattgattgtcgcccgatccgatcatcaaaacgacttgtcaaagttggagtccaattggacaacagcgaaaaaactgcttcagcatcaggcaacacatacaaattggagttcaccaacctttcctacaaattggtgtgccaagtcaaattccgtattgaactgcctcagacggcaactttggacgagtattggaacattaaccccatcggtcctgctgatgaccacctgttcacattgcctgttgaacaaatgtacccgggccgttccttcaccagtgctcgcgtcaaactgaacggtgttggagagccgaaagttacgataatggatactgtggatgttctgagcacaaaaccgtgcccaacagtgccaaacttttaatttggtaaataagcaaaacgcgagacttcaacccatttacatgataattgaagtgaattaatgataatgttcaaccatttctttaataattgttcttttttatttgggtaaaatttgcataaaatttggttttaaaaaaaaaaaaaaaaaa

SEQ ID NO: 88772 - DNA, 274 bp, Heterodera glycines
  SCN-specific regions: Sequence locations=1-27,50-133,158-247
gtcagggcaaaattcaagaatgatgatggggaaaagcccataaaatggcgattttggcgtgatcagaaaaaacttaaattgatttgtctgattttgcatttagactccgtccgatcgatcgctcctcggcatatccttcccctcccctcccccaccaaataatccccttaattcatactcattcgcatttaaatattattttgtatgctaaggttaccaaattacgtaattaaaatatttagtttctaaaaaaaaaaaaaaaaaaaaaaaaaaa

SEQ ID NO: 88773 - DNA, 696 bp, Heterodera glycines
  SCN-specific regions: Sequence locations=1-696
ttgagtttcaattagcactcttaattagaatgtctttttgtcgtgcgcccagcactttctccgtgccagctcaactttttgtcgacaacagagtccgtttggtgaaggctttgcgtgaaaaattgggcggcgctgctcccggcacgtgcgttctgttgcagggaggcaaagacaatccgcgctataacactgacaccaccgactcgcccttccgccaggaatcttactttttctgggccttcggtgtccatgaaccggaatgtttttgccgcggttgacgttgaaagtggcaaatcggccattttcccgcccaaaatgagtccggacagtgcaatttgggacggaaaaattcagcccgaaaaatggttcctggacaaatacaaagttgaccacgtgaactttcaaacgaatggcgccgaaattggccaatttttgcacaaacttttcaacgccaaaaaattattgcttttgaaggcagaaaatacggacagtggaaatgttttggagcccgcaaagttcccgggaatggacagtttctccaccgatttggcctccctttacccgacgatggccgaacttcgcgtcatcaaaactgaattagagttggctgtgcttcgttatgcctcaaaaattgctaacgaagcgcacaaagaagtgatgcgacacgttcggcctgagatgtacgagtaccaattg

SEQ ID NO: 88774 - DNA, 563 bp, Heterodera glycines
  misc_feature (24)..(25): n is a, c, g, or t
  misc_feature (542)..(543): n is a, c, g, or t
  SCN-specific regions: Sequence locations=24-473,495-543
tttttttttttttttttttttttnnaaaatgctatattttcatagtcaaatcaataaaacgcatcatttgaaaagggaatacgatccaaggatcatcatcaatctcatcttttccttatgggcgttgcttctgctgatgatgactcagtgcctgatccaattgtgattaagttgggcgagtcattgagcctttctcagcttgtgcaaaaaattgaacaattacaaaaccgaactgttcgagagctgcttgttaccctacgtcgtcgcacgtacgaaatgcctgttgggcctcccgacccaaatggagatcgctttttccaaaatgggcatctcctagtggaagatgttgtgtacaattgggtaagaaaaacgcgtaactccatccacggaattgtccagcttcatgtgttatatgaggggattgcaatgctcgatgaagtcaattatcacttttagcgattggttaaagaaaatcttgcaaaattatttgccttaatatttcgtactatatgcgaatttgacaataaatttgttccaatgtnnaaaaaaaaaaaaaaaaaaaa

SEQ ID NO: 88775 - DNA, 732 bp, Heterodera glycines
  SCN-specific regions: Sequence locations=1-689,722-732
gatttccatttgcactcaatttcgtttctcattttaaatggatcaattagaagtttttttgtccgagcatccgacggtggaggagagggaactgttcaccacttattctcttgcgggacgtttgcttcgtcctcttctgccgcgcgatgagaaccaccgacgactggtttatttcaccgaggaattgaacagcactgattactttttttctgatggtcagaacgggagattttgtgtggtttctctgcgacttatgcgtgccgataagcgtcagagaatgcgcgagtattttaacgagaacatggcagttttttctgaaacgtacgactgttcattcggtttccacgaactggaggcgatggagtgggacgtagcggtcattaaagtgtaccgtgagcacatggctcgttgctggaacgacatgatgggacagcttctgtacgtcgttaacatgtacgatcggggtcttgacccagtggatatggtccgcacgccgtctgctggtgagtcgtcgaacaatggctcggatcagtctgatgtgtctcataatgatccgttgccttcggtgtagcaaagagaatttggacggacattttcactccatgttttgaaacgttaagcatttttattgttacaccaaaagttaaaaatatctcgcaatttttgtggaataaagaacatcccaatgcaaaaaaaaaaaaaaaaaaaaaaaaaaaaaaaactcgagactag

SEQ ID NO: 88776 - DNA, 522 bp, Heterodera glycines
  SCN-specific regions: Sequence locations=1-211,233-522
tgacacctttttgcaccatttcgacgtgaatacggtcggccccgtcatgaccaccgccgcctttcttccgctgctcaaaaaggccgcctccgccggggagttcgctcgcgtggtgaacatcggttcgtcgctcggttgtattggacaggcggccgtttcgcctcggctgagtccgtatcagaacgtggcttatggcatgagcaaagctgctcttcatcacttctccaaaatgatggctttggacgagtcggacattgtcaccgttgcgattcatcccggttgggttaaaacggaaatgggcggtgctaacgctatgatgagtgtttccgactccgttgcaaaaataatggcgcggatttgcgcactcacaaaaagcgactcgggaaaattgctataccgagaaaaggaattgttgccgtgaagaaaaaatgatgccaattcttcccaatttgccttttgccgactttgaaccgtttctgtgaaattatgcctatttttaggccacataaattcgtaatttaa

SEQ ID NO: 88777 - DNA, 628 bp, Heterodera glycines
  misc_feature (367)..(367): n is a, c, g, or t
  SCN-specific regions: Sequence locations=1-242,264-285,307-628
caaaaacaaaaatttcttttgccattatggccaatccttcaaaaaatattgccatgctgcgcgaagcgcgctcctccccgtacattggcggcggcggaagcgtcggcactttgccacctgacgcgctgcctgcttcaggcccgatgcacacgcgcctgcaacgcaatcgtcgaccggattcggccaccgcgcccaacactgcacgactgcagaacgctgcaagcgctgaacattttgagcagttgaaggaactcatccagttcagcgctggctcgtcctcttcaacctctctgattgctgctggacgccattttggcactgaacaatccattgaaaattatgggcgactcaaagcggaaagtgtggnacaatttgtcggaggtcagcggcatttgtccgaccagcagcaccgttccgtccatttcggaaagtcgcgcatcaatcacttcaatgacagccaccgcggggagcatgagcccaactctgatggagacgaccaatttgcgttcatcagccaagcagcactgttcagagaccaatttgcatgtgcgggaaggcgttgttgggcttagagacaatggattcaaaattctcgaaaaatgctgttctgtggagctgtcgccggcaa

SEQ ID NO: 88778 - DNA, 902 bp, Heterodera glycines
  SCN-specific regions: Sequence locations=1-247,269-671,693-799,821-902
attttaagaaaaatcgagaaattactcttcaattatataaaaacgattttcgtaaaaagattgccgcatttctccggatcgagggatggcgcaatcagctgaaaaaatagtttttgtgcgtggggctgacggcgatgatgaaaatggcgacggaagtgagattaagccagtaaagaccttactccaagcccttcgactttcgcatggaacttcggaagtcgattttttgcgcgtttctgtgtcatcaaaagaaggacaaaagcaatgggaaaagccatctaaatcggcgatgaaaaaggcaatttcgcgtttggaagaagaacgacgtaaacgggaaaaagcaacaaattccgcggcagcgaaattaacggaagaggcaaagtcagtcgcagaacagcaacaagaaatggcacgagaaaaacgtttggaagaagcaaagaaaatgcaagttaaattggacgaatccttgcccgaagcgaagcgaaccaaaattcgcgaatgtccggcactgtgtggccagcgggtgaaagtgttcgcattcgtccatcggatgagacagcaaaggaaaaacttgatgttcctcgtccttcgcgatggctccggcttcctccagtgcgttctcaacggcactctctgtcaaaccttcgaagcgttgacactgactactgaaagttctgtttgcgtgtttggccaaatcaacaaattgcccattggaaaagttgcgcccggcggcatcgaattgacggccgatttttgggaacttatccacggatcaccgcccggaggggttgacaatgtgctgaacgtggaggccaacgtggacgtgaagttggacaaccgccatttggtggtgcgtggagagaattgctcagccattctacgaattcgcgccgctgtgacac

SEQ ID NO: 88779 - DNA, 634 bp, Heterodera glycines
  SCN-specific regions: Sequence locations=1-634
gtttgaggtacgacactttggtgtttatcctttcccttctcattccttctgacattgtaaaataacaatcaaaacaatcgcacgggtcatttgtgactgccatattattgggcaagaaaatgaaacgaactttgaggaaaatttggatttgtaacgacgttttgatggacattctgccgttttttgaccatgctcaacttgggctcaaattggcactgatttcgcctcattttgatgcactggtggacacgcattttgatggcaaaagcgatttgacaatttggagaagaataacaatttggggcttcggcgaaccgaaaataattgtcgagcgcaaatcggaagaatttccattgcccgaccgtccgctgcccagcaaaattcactttaaggaccttcacattcgcaacatttgctctcctgtctgtgaatttctccgttccaatcggcacatttttgacaaaggcatcaatttgcgtttggatatggatctgcctgcctccgtacagcgagtggtttcccggccggattggcattttctggtccaacaaatgttgcccatttttgtgccaaacattcgccacctggaattgattggctgtggcagcattgacatgttgttccacatttcgcc

SEQ ID NO: 88780 - DNA, 335 bp, Heterodera glycines
  SCN-specific regions: Sequence locations=1-335
gttcgctgtcagacctgcagcggccatcagaccgggacctaaagcgccttcatatcgcccgccgcctgggaagtttgcgattttcatgaacatttataacgacccattccaatggtcctttgtgaaaagtgctcttggcttttgcgtgggaatttgtgctgctcgcattttgagtgaggaattgagttcagtataaatcatttgctcgcgcacattgttgatgtgtttctttgattgcatcgttaacaattgtgcctaatggctgttgatcacatcaaatttgaataaatacgattagaaaaaaaaaaaaaaaaaactcgagactagttctctct

SEQ ID NO: 88781 - DNA, 714 bp, Heterodera glycines
  SCN-specific regions: Sequence locations=1-47,76-714
caagtttgagcgtctttccattgtccgatgattctgcaatttccattcggggattttaatgttttgttgctgcttacaatcagcactgttcttttggccagatgtttaggcacaattgtacagtttgaagatgaattagaattgatggaaaacaccgggacggcggatgaatccgccgatggtccgttgggtgctttttgggaatggcatcggatggtcgctggggctgacaaattcggctccatctcgcagcgaatgcttcatctgcgtccttctttgaaagtgccttccgtctccaagcgaattgccttcccttcgaccgccttcccaaatccaaatccgaacaatgccatccctccgccgaatgtcgtccgtcgccgtgcccataacattccaagggacaaacccccgtgccttcgaccgatggacagaccattccgagaacatcggacgtacccgcgcagttgggaaatgcccggctttgaggcgaccattccccgccagtgggactggcgaaatgtgtccggaaccaacttttgttcgcccaaccgtaaccagcacatcccggtctactgtggaggctgttgggtgtttggcactttgggctctctccaggaccggtttaacgtggcacggaaaaatcgttggccaatgactatgctttcaccgcaggaaattattgcgtgtaatggccgtggaagttgcaacggaggg

SEQ ID NO: 88782 - DNA, 567 bp, Heterodera glycines
  SCN-specific regions: Sequence locations=1-28,51-367,390-407,429 -461,483-495,517-567
gtttgagattattttcgttcgaattttatcattaaatatccataataatatatctcttctcccaatcaacaaaatgtgccgtccttcgttcccttcaatgtttgcttttctgctgctcgttgctgctgccattgctctgatcattttgccttccgcttcttgtgcccctctcgacaatgcccaaggcgtcgttcccgacgctgcccccggcatcggttccgccagtgccgttggcatcgctccgcgacatcggaggcaatggctgtcggccgcccgcggtgccggcggagactccggcagtttttggagtctgttcggcaaaagatgaaaagccgtgaaggttccgtgccaatcgagacaaaaaactggtctttcaatgcccagaaacaacgagattaatacaaaatcattctctttttgtatattttacgggataactaaatttagaattccaaaaaatatctaaaaatctctgcttttcagtttaattggaattttaaatttattacaattttttcaacatttttgtcatattgacaaatattcagaataaattttacaaaagtg

SEQ ID NO: 88783 - DNA, 651 bp, Heterodera glycines
  SCN-specific regions: Sequence locations=1-432,454-651
gtttgagagtaaattatggataggagattcactgtcttccttgtgatcgcattggttacttctatttatgaagtgcttagtaatggaaatttgaacgatggcgacgactcatttaaacaattcgatgaactcgaagaaaacccagcgcataaatattcaaaagaggcccagaaggggttcgaaatggaggaggaggaagtcacaatccgagaaccttcggggacgaaggaatcgttcaaattgcccatcaatatgccgccagtgaaattttctttttgtgtctcatgtggttatcgccaagcatatgaacagtttgcgcagattttacgcgaaaaatatcccggaattgacatccacggcgaaaactatcctcccggcattcttcgcacggtgggagcgcaggtcatcggaatggtcaaaattgcactgattgtgtgcgttgtgtccggaaggagtcctttccccaccttgggacttgaaaccccaactttcttccaatggatgctcagcaatcgtttgtctgccgcacttatgctttttttattttccaatgccatcgaagggatgctccaatccacaggagccttcgaaatttacattgaaagcgaacgaatttggtccaaattggaaagtggtcgcgttccgtcacct

SEQ ID NO: 88784 - DNA, 608 bp, Heterodera glycines
  SCN-specific regions: Sequence locations=1-264,322-444,466-470,502-608
gtccaatcaagtttcgaatttaaacataatttccaaatgaccaacgaaattacgcccaataccacctttggagacataacatcggaccgagtgttttatcgtcctacttttgtgaccggtgatcagatggatttgtccctggccgcgttggcactgcgcgaggggagcaaatcgccaacggaaagtgtgtgcagtttcgacttgatgtccgctgttggggaggacggagagcaaaacatcgccgacgaattggcttccaatggaactgctggagaagtggaggagcagcagcagcacactaagcagaacaacaagcagaataatgaaaagaagtgtttcgccattctcaaagttcgaccgattagcgtcaattcgaccgcggcgcattgtccgaatttgaaattcgaattcgtctcgaaaaacactgctgacaatggcacaacgcagcagcagcaactttccactgccgcttcttcgtcttcctcctcagctgctgcttcttccgctgacgaagtgccaccgattgccccttccgttggccaaatgtccgtggacattttgtcgcgtcattttggcctcacatgggaacagctgatggcacagtttgt

SEQ ID NO: 88785 - DNA, 659 bp, Heterodera glycines
  SCN-specific regions: Sequence locations=1-447,469-659
cgccgatgctaaggaaagcacaaatgaaacgataaaggacaaagaaaagatccattcgcgaagtgatgtcggacaattgatgggcacaagcggctgtgtaagaacagacaaagggctgctgcttcttgacagcatttggaaacgaaagtggcatcatcgtcgctcatccaaatctgttcatcctcaacacagccgcaaaaatattcctggagctgaagacaggcgatgagctgagccatgtcaatctcctcaggtttatccaacaaaatgcgaagacgacaactggagagactggccaacagacgcaggaattgcttatccgacgattttagccaatcggcgcccaaactttgtgccgcacaatagctcagttcgaagcataatttgacatattcctccgggatattgaaagtgcgcaagagtctgttaagcacgacgcgaaggtcagcaggccaggaaagggaaatgtattcggctcgttgttttgcgagtatttttggcgagttggcgagaaaatccaagcattgtttaatctcatcaagaaggtcagacggagggaattcactcgtgtcctccttaattgttcgtaatagctgattaaggcaagaattaagatcatccaattgctgagaattcattcaaaaaagcgctaacaaaaa

SEQ ID NO: 88786 - DNA, 607 bp, Heterodera glycines
  SCN-specific regions: Sequence locations=1-202,224-324,346-355,378-607
ccaagtttgagaaaaaacaaaataaaatattcgttttgaatggattacgccaatcgtcacacatgttgttggggaccgttccgcaccagaattgaaacgggaaccactgtgatggcattgttcggatttgggctcggaattctttctgcaatttccagctatgttggctttcacaacatctatgccggaatggtgtacctggcttcgtctcttttctatctgtcggttattattgccatgaaaaagaaggagccgtcactgttcctgccttatctgattttcgagggtatcggcttgttatgcgcagcggtgatctcattgactatgtttatctttggaatttggtctccacagcaagccttctctactaaggaacaggaaatgaattttcgttccctcatgcttttctttgccgccaccgtgggcattgacgtcgctttgaacgcctggttctactccatcatttaccgcacctacaatttgctcaaaaagacaacaaagttggtggcatcggcttccgccgtcgcttcggcacgcgtgccgccgcccgtgtgatttatggcgagagattgatttgatgagtaataacaatggatggatgtgatcg

SEQ ID NO: 88787 - DNA, 632 bp, Heterodera glycines
  SCN-specific regions: Sequence locations=1-632
attaaatcgtcacattacaccactaaaaggctcatcattttgcttttaatttacgcgtataaaatgaccttgcgcaatgatactccgatgcctccggacgaagaattgagagtgcctcatgagatttcgctgtcttcgccttggctaagggctgtggcggtttatatgggaatcgcctgcgagaaggaggccaaagagtttatgcttttgcgttccgaacgcgacaacgacccgcgcaaagcgttgccggtaggggcgcgcagtgactgcgtgcgctatcaattttttgcgcaaaatgcgccgcgagtgcggtgacgaaatccgcgactacgccaattgttttcacagagagtccggcagaatgcatttgcatcagtgtcgccgtgcacaatttcctatggatatttgcgctgacgaaaagctgggcgttcgtcgtccgatggtcggttacttcaacaaattgcatgtgcacgaaagcgctgtcccaccgccggaccctttggaaagacagaaattgtatcgcgattacaaagcggaggccgccaaattgttagaagagctcccggaggattggaagacggaccccaaatcagttcaagaagtaccggaacaacttcgttttcgacgcgttc

SEQ ID NO: 88788 - DNA, 621 bp, Heterodera glycines
  SCN-specific regions: Sequence locations=1-408,430-621
gtcggacattcaaaaagcgattcaggcactggaacgagaatacgccgaacagaaagagctgttcgaaaaatggaaggaagaaaatgcatccgaagctgatactgaaccatacaatgcatatgtagagcagttccgaggatgggagaaggatgtgatggacaatttgaaggaactgcgggcatccatcgcccgacagcccgtggcgccggagcccgagttgcccatggtcgacctggacactcagctgaacaacttgttggaccgtgtcgatactccgcaattcatcatggcttttatgagtatgagccaacaggacccaacgtttttggcaaaggcatttgaggttgtgatggaagagtgtcgtaccaccggcttctccaatccgattatgccccaaagtgccaccattccatctcttcggcctgtccaccgtctgcccactccgctccaccaacaaccgcccggcgtcccttccgcttcgtcgtcagcacggcatcaatcggcgagaagtcctggctctttgtacctgccgcctccgctgcagcccaaagcgtatgtgcaaggctcatccctgctggggccatctcggccaacttccaccgtttcttacacgcaaattac

SEQ ID NO: 88789 - DNA, 1267 bp, Heterodera glycines
  SCN-specific regions: Sequence locations=1-697,730-1024,1046-1267
catacatattatttgaaataaaccaaaatggctgtccctcaggaagtaattgacaaaattgaggctggctacaaaaagcttcaggcggcggctgattgcaaatcgttgttgaagaagtacctcaccaaggacgtcgtcgatgcatgcaaggacaagcgtaccaagctcggagcgacttttttggacgtcatccagtcgggggttgccaacttggacagtggtgtcggcgtgtatgcgccagatgccgaggcttacacactcttcaaaccattgttcgacccgatcatcaacgactatcatggtggctttggaccgagcagcaagcaaccggcaacggaccttggtgaggggaagactcaactgctgacggacttggacccggaggggaaattcatcaattcgactcgcgttcgttgcggccgctctcttcaggggtatccattcaacccatgcttgaccaaggagaattacgtcgagatggaatcaaaggtcaaagcggtcttcgagcagctgaagggcgatgccgagttgggaggcacctactatccgctccagggcatgaccaaggacgtccaaaatcagctgattgccgaccacttcttgtttaaagagggcgaccgttttctgcaggaggccaatgcttgccgttattggcccaccggacgcggaattttccataacgccaagaaaacctttttggtgtgggtcaacgaggaagatcacctccgtatcatttcgatgcaaaatggcggcaatgttggacaagtgctggagcgtctcataaagggagtcaaggccatcgaatcgaaagttccgttttcgcgtgacgaccgtcttggctggctgactttctgtcctaccaacttgggaacgactgttcgcgcgagtgtgcatatccgacttccgaagatcagcgcaaaacccgacttcaagtccatctgcgacggcctgaaattgcaaatccgcgggattcacggcgaacattccgagagcgctggcggcgtttacgacatcagcaacaaggcccgtcttggtctcacggagttcgaagcggtgaagcagatgtacgacggagtgaaacacctgatcgaattggagaagaaagcataatgggaggaccgatctatgatgatgactttatattgcgtaatgtggagatttgctagttgttctgaatctcttaggctttaactatttaattattgtcccaaaatcgtgcttcatccgtatgattatttccgtgcataaatttgttcgtgttcaaaaa

SEQ ID NO: 88790 - DNA, 499 bp, Heterodera glycines
  SCN-specific regions: Sequence locations=1-137,161-296,319-352,374-499
gtccaattaaggtcgtacatttatttttgttgcttcgatgtcgccaaaatcgtctcatgtcaattacgatcttctgccggaagtttctcacaccttccgcagccctgaaccccgaccatctgttctagtttctgacatgttttctgttttgtgtgcttcgccgcttatcatccttttccttttgtggcttcgtattggcatcaattttggaaaattcaagttttcgctcagtgctcttgggtttcatcttggtctgtgtgctgtttttgggctctacgttttcttttggctcgagttgaacatgttccagacgttgaaatggctggctgttattggcgtgcccactttgttccttggaagtcgtctttccttttaaaaccaaggctttaaagcttaacacacaattttttgggatatattgtatttcttaatttatatgttgggaaataatattatggttttttaaattccatttatcccccacaaaaaaaaacaaaaa

SEQ ID NO: 88791 - DNA, 621 bp, Heterodera glycines
  SCN-specific regions: Sequence locations=1-621
gtcaaattggccactgcttccgacgatgcgaccgcgcgcgtttgggacttcgcgcggtgtgcggaagagcgcgtcatgcggggccacggagcagacgtccgatcggtggattggcacccgacaaaaggacttttggccacaggttctcgcgactcgcagcaaccggtcaaactttgggacgtgaaaacgggccaatgcttggccactcttcatgaccacaaaaattcggtgatggctgtccaatggaatcggaatggcaattggctgctcaccgggtcgcgcgaccacgtgatcaaaatgtacgatgttcggatgatgcgcgaaattcggtcattccgtgcacacaaaaaggaagtgacatccctcgcttggcaccccgtccacgagggactttttgtcagcggaggcggcgacggatccatcggttattggctggtcaattcggagaaagagttgactctgctcgagcaggcccatgacatggccatttgggctttggaatggcacccgctcggacacattttggccaccggttccaacgacaacaacaccaaattttgggcacggaatcgacccggggacacgcaggaggatgtgttcggcatgacaagcgtgggaggg

SEQ ID NO: 88792 - DNA, 624 bp, Heterodera glycines
  SCN-specific regions: Sequence locations=1-604
gtttgaggtaattgcatttacaattgtaatataaatgtcttatgcttttgttcgacaaccgcacaaaaattcggtgtgccttatgggatggccaacgacaaattcggtgattatcagacaaaggcacggcgactgaaactgaacaggcgcgcatttattggccaggaagtgggctcagaacgaagagcgaaattgaggaggagtttaaatgtgcccgcgacggcaaatacccacaagagaatttggaagattggtcaatcacaggcaaacggagtttgactcacaaggcgcttttccattacacggaccgtcgggcgggcaaaggctattccgactttgccaccaccctttactacggtcgcccttacatttggccgcccgttcgcgaaattaaccgatggcactttttcatttgtgtgacctttgccctggttattctcgtcgactgcaaatggtttgtttcgtccttcgaattgtttcgtccgcccaaatcggaagccgcgactttggaaggcgactcggtcgaatttgaggatcggaaaaaaacttcagtttcgacgaatggtcaaatttagattaattcccttggaaataaattcagttcaaaaaaaaaaaaaaaaaaaa

SEQ ID NO: 88793 - DNA, 670 bp, Heterodera glycines
  SCN-specific regions: Sequence locations=1-70,92-325,347-473,512-670
gtccaattaagaaaccgaaaggaatggaaatcgaagaaaatggcaaagcgacttcatccgaggactccaacatgaaatggaaaactgaagaggataatttgtccgggacagcggagcaaacgaatccattcgatgacccggtgcataggacgaagtgtctcattcagtacatacggcttcgaaaacagcgtgccgaagcagaacaagcgaagcgaaatgcaatcaaaaaacagaaaatgaccgcacgtgcgaccttacaaagtgcgcgagaggaaaaggcagcggcagaaaccgaagaaagacaatgcgcaatgaaaatcgaggagctgaaccaggagaagcaccaagtgttggctgcactgaaagccattcacagccgcgaaacggagcggaaaaggaagcgggaagaacaagaaagacagcgccgtgcactggcggaggaacagcgacggaaagaagaacagcggagaatggcagcgcagcagcagccacaacagcagcaacaacaacaatcactagctgcgcttgagtaccttttgcagctgaaaaatgcgcaattaagtgcaataatcgcatcagcaacgggcgaaaacactcaattgggcacaccggcggtgggcggacattcgcttgcttcttccctgcccccttcgattctctctcttctcat

SEQ ID NO: 88794 - DNA, 837 bp, Heterodera glycines
  SCN-specific regions: Sequence locations=1-837
gctcaaagaacagcagcggttgcgcgtggcgttcaacggcttcatggagcagcagccgagcttcgtccccacctacaaattcgacccgggcacacacaattgggacacgagtgaaaagaagcgtgtgccggcgtggtgcgaccgcattttgtattgggtcaaggacaaaaatgtcggcattgaacaagtgacctacgaatcggcacaccaagttgtgctcagtgaccacaaaccggtgctgagcacattcagagtccaagtgaagaaggtggacaggcacgagaaggagcgcaatttatgagcagttgttgtagggaagtggacaaacgtcaaaatgaacttttgccccaaattacattgtcaaacacagaattccatttcagcaccgtcctcttcgaccagccatcgttggccgtgctgaccatcacaaacactggacaaacgcccacccatttcagcttcaaacccgcgaggcccgaggctgacagattggaggaatggctgaccataacgccgctctcctctttcatcgacgttggtggtgccgtggaggtcactctgcaaatcctcgtcttcgatgagtcggcctgcaaagtgccaaaggatggcgccgaattgagttccattatcattgtgcatcttacgggtggaagagattatttcattgttgtggacgccaaatatcagcgagaagtgaaggatttgatcagcttcaactaattttaatttttgctttccaacccaaaatttaattcatttgtttgttctttttttgtgacataattccatatcccaaaagcactcaacctaatgatcaaccaattagcattattctaa

SEQ ID NO: 88795 - DNA, 626 bp, Heterodera glycines
  SCN-specific regions: Sequence locations=1-268,296-328,355-626
gctcgtcaggaggcccatcaaataaggggtcggattcgactgctcattggtgacagagatttggaattggctgccaatccatcgccgacaacaaatgaagacgttaattacggattccgttttatctcggaaaacaatcttaacgccgacgacaaccaacaaatccctaacattattgcctttggacgagaaaatggtgaggcagacgatgaccaaaacgagaacaatagcgaagagggaagagagatcgaacaaacgcaaaacaccaccggagaagaggaagaagaagacaacgcaaccgacgacaatgtcggcatgagttccactgaaagtgatggccaagacaaaatgaaagccaacaacggaaaagggacttgtaaaaatgaagacgaatccaagccaagtccaacggttgaaacagaacagaataaagtgcatcagtccgcttctgaaactgtgataagtcaaaaggccaatgccaacaattcggaggaatgtaaggaaagcaatggagagaacggcacgcgcatttcaatgaaacgacaacggcgttcacattcagtggacagttcgccacagcaaaagcgagtcttttcacgcaaaaattttactgccgaggacaaacc

SEQ ID NO: 88796 - DNA, 387 bp, Heterodera glycines
  SCN-specific regions: Sequence locations=1-250,272-353
gagaacagaaaaacaaacgctcataatcactattccataaattcgacccaaaatgagcaaaccaattataaaagtgcgaattgttcagattattgaagcagacgaagctgctgggcaacctaagcaagtggtggctgagtatgtggacgacccgagcagacgagttaccatgaaagcaagcggagaggtccgaattggccaacttgttgctttctttgaaggtcctgacagaaaccgcattcagcgatgcttcacgaacaacaacaacaactgatttgaaggatttgataaaaataaatttgaaaaacgtacatatgtaatcctttttgaaagcgcaataaaaaaagcacattaaaaaaaaaaaaaaaaaaaaaaaaaaaaaaaaaa

SEQ ID NO: 88797 - DNA, 375 bp, Heterodera glycines
  SCN-specific regions: Sequence locations=1-94,116-133,172-349
gagagatgtttgaccgcgtctttcttcgctttaatccctttaattgctcagcgttcattgggaaagcttctccagtcgctgtgttgcaggtgcgattcaactgtccatggcatcggagcggttacacgccaaattttttcggttttaaagtgaaaagaaaactgaaaatgcgaactgttgaacggttgagtcagacagaaggaagtcggcacattttgatgagacgcgtcctctcagagaaacattttgtcgcatggaattggccatcaaagaaaccgcggaatgatcgactgaattaccctctctgatcgttgacattttgttgatagaataaacgctttggattgttaaaaaaaaaaaaaaaaaaaaaaaaaa

SEQ ID NO: 88798 - DNA, 884 bp, Heterodera glycines
  SCN-specific regions: Sequence locations=1-57,79-101,124-637,659 -807,829-884
tagcaaaatagctggggaagctgtagcagttgggacaactgtatcaactggaaagagcctaccactaccaccatctactcctgtatcatctatacaaccttctgggattttgctaaataaagcaggtaaaagtgctgatagatgtagcgtatatcctgctagtcctgctcctaaggtacttttccatcatatagcggttggaccagctggagcagcggtatcaactggcaataatgagtttctatctgaattacctttagtagagaagaaaaaagagcttcttttaaaagaaatacaaaataaaaacgaaagagagggggtaatacagaaaaagggtcctactctgccacctaaaccaacacaaagtgatgtcacccctagcaaaaggagaacagaacggttgctaagtagtacttcgaatagcgcatctcctatttcaaggttaagtaaagaaaacgcagatctacaagctgaattaataaaagcaatgtataagagacgcaatgattctggttacgatgatagcgaagatgacagcgaagatgacagcgaagatgtttctttggttgctatgaaagctactgaaagtggattagataatgggaatcaggtaaaaaatggtgttatttctagcaaaacgggagcaggaggggcctcttctagccaagtagctagagtagttcaaggaagaagtagtacttcgaatagcgcacctcctattaacgctgtgcttaatgaacaaataaataatcttttaagtgatattcaagaagggaagtccctaaaaaaaacaaggagatggaaagtaaaagaaaatggagaggtggaattcgtcaaagaaacacagccaagtgagggggattcggtcaaagaaccacagccaa

SEQ ID NO: 88799 - DNA, 410 bp, Heterodera glycines
  misc_feature (386)..(387): n is a, c, g, or t
  SCN-specific regions: Sequence locations=1-23,45-387
gttctgtccttcctaataatcatttttatcccttttctcattccaatatggcagtgacttttgcggatttctttaaagtcatttgtgccatcattttaccgccccttggcgtttttgtggagacgggctgctccatccaccttttgattaacatcattttgaccattctcggctacatccccggcattatccatgccctctacatcattttccagtactgatgaagatatcgcaattgtgaaaattcgatcagttaaaagaattatttttaatttgtcaatttgcttttcaacaatatcggatgttttttgtgatatgtaacagttctcgccaattctctcctccattttcacttctcatttcagaataaaattatggataatttnnaaaaaaaaaaaaaaaaaaaaaaa

SEQ ID NO: 88800 - DNA, 853 bp, Heterodera glycines
  SCN-specific regions: Sequence locations=1-317,339-853
gtccaataaagatttgtctgatttcaaattggattgaaacttgagagtgccgatcttaatcgaattttgaagataatttcagaattcccatatattctttcgtaaaatgccccaaattttggatggaataaagcttgactttcgtgatgttttgctaatgcccaaacgttcacagctcgccagtcgttcagaagttgacttgaacagagaatttgtttttaagaactcgaaagcgacgtacacgggaattccaataattgcatcgaacatggacacagttggcacttttgaaatggcggaaacactcagccaatccaatttgttcactactgtacacaaacattacagtgttgaggaatggaaggaatttgctaatcgcgtcagaaacaattcgaatgtgctcaacaatatcgctatttcgtccgggtcgcgttccgatgaccttaccaaaatgcgtgacatttgcgacgccgtgcccgaaataaaattcatttgtctcgacgtggcaaacggctattctgaaactttcgttgactttgtgcgcaaagttcgggaggaattccgcacctccacaatttttgctggcaacgttgttaccaaagaaatggtggaacagctgattctgtcgggtgccgatgtggtcaaagttggcattgggccgggcagtgtgtgcaccacgcgtaaacagactggcgtcggttatccccaattcagcgccgttttggaatgtgcggatgcagcgcatggactcaacgggcacattatcagtgacggtggcacaacatgtgccggcgatgttgcgaaggcatttggcggcggcgctgacttcgttatgattggcggacaattcgct

SEQ ID NO: 88801 - DNA, 290 bp, Heterodera glycines
  SCN-specific regions: Sequence locations=1-269
cgcaaattgcgcaacgatgtcgccacggaatgtgccaatgtcgccattcatcgccagcagcagcagaagaacggaagtgccatcatcatgcaaacttaagcagaggacggacgagtgggatgaagaatgatggtgctggtgccaacaaacattcaatgcgatgaaatgatataaagcataatatgtatttctcagctgtattccattgtattgtatattccattatatcgcctatatgcgtatgcatggtctcaaataaactcacctagaaaaaaaaaaaaaaaaaaaaa

SEQ ID NO: 88802 - DNA, 781 bp, Heterodera glycines
  misc_feature (763)..(763): n is a, c, g, or t
  SCN-specific regions: Sequence locations=1-154,177-742
gtccaattaaggattaaaaaatataattcggaatgggattttcgacaaagccaataattattgacggaaaagatcatttgcttggacgtttggccgctgtcacttcgaaacagcttttgcttggccagaaaattgttattgtgcgatgcgaatccatcaacatttctggcaacttccaccgttccaagctcaaattcctcgcatttttgcgcaaacgctgcaatgtgaagccatctcgcggacccttccactaccgtgcaccatctcggattttctggcgcacggttcgtggaatgcttccgcataaaaccgcacgaggtatggaagcactgaaaaagttgaaatgttttgacggatgcccgcagccgtatgacacaaagaagaaattcgtacttcccaattctcttcgccacatcgcattgaaaccgcgacgcaaatattgcacagtcggccgtctcgctcacgaagttggttggcagtatcaaggcgttgtagagaaattggagacgaagcgaaaggtcagaggcgctgctttccatgagaagaaaaaggcagtgctgaagctgaagaggaaggcggtcgaaaatgcaaagccaaagacggcactgttcgacaaaattctcgagcaatacggacacgcgtaaagaagacgacgaagaccagtcagaaatgtgggaccgtttacggtgaataatcaccttttttgttgttaccatttgttgaatgaaagtatttcaaaaagaaaaatttttcatttcttaanaaaaaaaaaaaaaaaaaa

SEQ ID NO: 88803 - DNA, 425 bp, Heterodera glycines
  SCN-specific regions: Sequence locations=1-379,401-403
attctcgaagaagaaatgaagccatcattcaacttcaaacttttcgcatccgtctttcttgtgctttgtgtggcctcacttgtcctctgtcagcataagccagcagcagcatgtaaaccgcccaaaaacgtgggaagaggcaacttggcactcacgcgatggtggtgggacggccgtagttgtaagcaattcacctacaaagggcagggcggcaacacaaacaatttcccatcaaagaagctttgtgatcaagtgtgcaagccatgaatgagtcgtggaggtgcagcgtgaagagaccagcaaaagaagaaaagtgaagaaattaaaagaaaaatttttcaaaaaataaaattgtgcattaataactacataatgatttgtggaataaataaaattgcatctgaaaaaaaaaaaaaaaaaaaaaa

SEQ ID NO: 88804 - DNA, 759 bp, Heterodera glycines
  SCN-specific regions: Sequence locations=1-29,53-211,233-317,343 -538,560-759
ccaagtttgagatttttttccaattcctcagcctgaaaatttattctttgacaatggcacaacaccaggaatcgttgatccgtcagaattttgcagctgaaactgaagccggcatcaacaaacagatcaatattgagctgtacgccagctacgtctacttgagcatgtccttttacttcgaccgtgaggacgttgctctccacaacattgcgaaatggttcaaaaaacagtccgacgaagagcgtggacacggcaccactttcatgaaataccaaaactctcgtggtggtcgtattgtgcttcagaacgttcagaagccggagaaggatgagtggggcagtgccttggaagcattccaagccgctttggctctcgagaagttcaacaatcagtcgctgttggagctgcacaacctcgcttcccaacaaggcgactctcagatgtgtgactttcttgaggacaaatacctccgtgagcaggtcgaatcaattgaggaaattggcaaaatcatcaccaatctcaagcgtgttggaaagggtttgggcgagtttctttttgacaaggaatttgccgagaccgactgaatgaatgtgcattttggacacattcaatgggttgccactggctgaatccaataactttgcagattgtcagatcatttacgaattttattaatctctccaatggcgttcattctcctttttctctccgacatttataaacacgtggataaattaatgaatgcgcaaaaaaaaaaaa

SEQ ID NO: 88805 - DNA, 793 bp, Heterodera glycines
  SCN-specific regions: Sequence locations=1-197,220-320,342-401,423-793
gtcgctatttcaacgaattttcggcggcggttcctcaacgccaaagaagcaatttgctgatgcgggaacgtcatgcagtccagcaaagaaaatgatgacgccgagcacaattggctttcgctttcgaaaaccgcgttggcccctctccaatttgcgttcttcggctgtctccgcaacggcactgacaaaacgctcttccaaccaaatcccccaaaacttccgatggcatctttcttcaccaattctaacattggaaaagtcagcggaagatcaaaaaaagcaaaacgaatgctgcgaaatttcaccgccaaacgccacaaaaaatgagggagaagaactactgtacgacgacagaatcaaagaatggatttatccgatggacgtcggcccaatgattgaagaattggagaaattggcctatttttgtcgatcgcaagaaaaagactctgtgatgaaccatttgcgggaaatgcccgttggccatttcgcgctgcgactgtccggcacgaggcgaagatttttggcactgagtatccgagtggaaagggatgagaagaatcagaaagggattgcccactatttggtgcttcgcaatgagcatgggtttcgcatcaaaggttccaagcgttacttccaatcgcttcccatgctgatcacccaccactcagtgatcactgaccaattgccgtgccgtcttttgctgtccgattggcgttggacacggggagacgcaaatcaacgacgacgtcaaagcagcgggggaagcactttggcagtgctaagggcaaccgaa

SEQ ID NO: 88806 - DNA, 492 bp, Heterodera glycines
  SCN-specific regions: Sequence locations=1-492
ctctgccgagggtcgtctgacggacagtgccgccgccgtctccgcgccgtgcgattggctccgcttgttcggccttggcccctcttcgtccgtccgtttccattctcagcgatcgcttctcatcgtcaaagtgttggcggagcccacaaaggtgttggacgtgtggctgaacaaagacttgccgagtcagaaggcattggtgcgcgggttggtccaactgttgcgcgacgacttcaaggacgagtccatcatgtgccaaagtcagtacaccggctgtatcaacgttctcaaaacgtgtgactctcgtctgaaggctcttatcacctctctgaagtgatcggcgattcgcttggcggattgcctacaatgaatgatttttgactttaaacttttacatacattaatgcttttacagttttttgttcttttttcagtttcgcttatgtcatcattcattcttaacataacataaagcattctttctcttaaaaa

SEQ ID NO: 88807 - DNA, 252 bp, Heterodera glycines
  SCN-specific regions: Sequence locations=1-44,122-189,212-229
caccaagctatggagccccagaaccgccaagctatggagcacctccgccaccgccaccgcctccgccgccgcctccgccgccgccaccaccgccgcctccgccaccaccgccgcctccgccacatcaaccaaaatatcctccacagcaataagcgcaagatggatgcaatacggatgagataatatggagataaagctgatattgataattaaatgcgctcactttgttaaaaaaaaaaaaaaaaaaaaaaa

SEQ ID NO: 88808 - DNA, 721 bp, Heterodera glycines
  SCN-specific regions: Sequence locations=1-721
gtccaattaagctagtccaattcggttgatctgctaattgtaagagcatcctttgccaatggataatttcaaaaactctgctaacatttcgccggtcgacgaactgtccgagtggaaaggccgtgctttgtttttggaacagtccgtgaaaaggctggtgcaggagaatcgcgagttgcgccacgagttgggacggaccaaaaatcaggtgatgcaatgtcagaaggactgtgaagaggcgcgccgacaaagggaccgcgaagtgaacaaaaaacggaccattcagcaatttgaggaggaggagcgtcgtgcgcgtgcaattgcttccgccgcctttgctgaccccgtgccgctgacggcggacgaacgcggccatgccgaactgatgaagcgcatttcgccgatgcccatgcgacgcatcatggtctccgccacgcagaatcagcagaaaaccgaagctgcggcgcgtgttgtcgccgcttacgaccgcacggcgatggcggcaccggcaccgcaatttgttcagcagccgagggggcgcacttttcccaccgctttgtcagtgtttggcgaatgcgtgccaaataattgtcgtcgtgtcggagcaatgccctcaaaaaacatcgtcggagttcgcctaacccagcagaccaattctgtggcaaacgcttcgcaactgaagcgaacttttcctggaaagtgagaaatattgaaacgcaga

SEQ ID NO: 88809 - DNA, 546 bp, Heterodera glycines
  SCN-specific regions: Sequence locations=1-226,259-466,488-524
gttaaaccaattaattacagttgcacttgcacgttgcactttcttgatttcttcacaacaagaacatttcgtataaaatgactcgcggtaaccaacgcgacttggccagggagcgcaatttgaagaaacagcaacagcaaaaaaagcaagagcagggcacgtccactgagaaacggatggaaagggacgcagaagcaatgcgcctaaaacagcagaaagctgcagcgaaaaaagccgaagaggaaaaggcaaatgcacaagcgccgaaggtggtgaaagtggaccctttgaagggactgtgacaagcgaaaagaaccactcggctatgggatgcacaaactgacgcttttccgtgctttatttagtcaatttttcgaattcttttcagcaaaaaccataattaacaaaacttctgcccataacaaaagcatcgcatttaagctatgtagttgaacgccttcatattctttcaaatgcttcatgtttttatatgtgtgttacgcttcaataaaggctatccgtttaaaaaaaaaaaaaaaaaaaaaa

SEQ ID NO: 88810 - DNA, 708 bp, Heterodera glycines
  SCN-specific regions: Sequence locations=1-25,47-393,415-596,618 -628,650-653,676-708
caagtttgagaaatatttcgaatttttaaaatccaattaaaatggcccatcaaatggcacgagcggcgatcaacaaaggggcacgagtgctgagtgtacttgagaaggtcaaattggtctgctggtttgaggagacgcattcctttgcgcaagttgctcgaagatatcgggccgagttcggcatggagccaccgcaaatggaccaagtgaagaagttgcaccaacgattcctgaacacgggctcaattctgaatggcaccaccacaccgcagacgatggcaacggcattatccgccggcatcgatgacgtcgtggtcaaccaatcccagcaaatgtcggtggtgtgcgatgcgggcgcgttggatgccgaggaacagctgagaatggcacggatgtgaaatggtgttgttgttgaacggcgagtaccaagaaaaacaccaagacaagttccaacatttttgtaaaatgtactttttatacatagtctccctcattttgaatgccttttcggtgtcatgacaactcatacaattggcttaggctaggcctagaattaggcttaggcctaagctttattcctatgcttaagcttaggctttttgtaaaaaattttactgtacgagttgccattgacgtgccttttcactcccccattgccgtgtcttatttttgcacgaacgctcatctctcaatctctaggctagggct

SEQ ID NO: 88811 - DNA, 829 bp, Heterodera glycines
  SCN-specific regions: Sequence locations=1-110,134-829
ccaagtttgagaagttatatttaaacaaagaaacggttaagctaccagcagtaataatacctactaagtcagttgttttctgtcaccaatgctggttagtgcgcctctcatccaacaacagcaacagcagcaagtgttccaacaacaacgcccttccacttccgcttcttccgccgatgctgttttgcttccgcatgccacggaagcttctgcaccaactccctatcagcagcaacaaacggaggatcagctcgaattgccgacctccgtaccctccgctgccgactcccagcgccaacaccgcgccacccaacaaccgcagagattcttcaaatccggatcgggtatcagaataatcgacaatgatttgccggagggaccgggcagaaggcttcgcaaaaatgtggccaatgttcggaaacacatagactacatcgcaaacgcactcaatcacatggaggcacgcctttggcagtctccgcaccgtcgccaattgcggtgggaacgtccggtcattcagccggacattctctaccagtcgtatgtgttaatgccgaaacttacgccagaagtgccggtggattgcgttttgagtaaatttgtgcgtgccgcgatgaacaaagtgaagtgtccgatttactcactttgctggaccccggagggcaaacgactgatcaccggcgcatcatccggtgaatttacgctttggaacggaaccgcgtttaatttcgaaacgattctacaggcgcacgacgtggccattcgggcgatgaaatggtcccacaatgaccaatggttggcgtcggctgaccacgacggctttgtgaag

SEQ ID NO: 88812 - DNA, 427 bp, Heterodera glycines
  misc_feature (406)..(406): n is a, c, g, or t
  misc_feature (408)..(409): n is a, c, g, or t
  SCN-specific regions: Sequence locations=1-54,76-204,228-355,377-427
aacaaatttacgacgatgggcagcgcgagactcggcgaggcgcaacgaaagcaacttttggagcctttgctgaaggagggcgggtggcaaatggagcagggaagggatgccatcaaaaagagcttcactttccgagactttaacgaagcgtttggcttcatgacgcgcgttgcactaaaggcggacaaaatggaccaccaccccgaatggttcaacgtgtacaacaatgtggacataacactgagcagccacgacgtgcagggcatttccgagagggacgtggcattggcatcttttgttgaggatgtgttcaaagcgatgaacttatgatgatgacgataatgaagtgttatttatacaaattattttcatctcaaacccgaatgcgaatataaattcatttcanannaaaaaaaaaaaaaaaaaa

SEQ ID NO: 88813 - DNA, 634 bp, Heterodera glycines
  SCN-specific regions: Sequence locations=1-341,363-597,621-634
cacaaattcagccgaacacttttgttaaccaaacatcgaatagtcttggccgtttctgaccacatttcaatagcgtacatctttgtttcttacattctctactacatatccctgccgcttatttggctcttcaattgtatgcacaattggagcaagccaatcaaaacaactccatactcaaaacgctgtggcctcaacagttcgctgattgggcctcgggaccgaactcccgagtttaatatgccgtcttcgtctgacctttcgcgacagccgatcagcagcacaccgttccgtttccggctgaatttcgacgatccgtctgcatacagtgacaatgagaatcggccctctccagccaaccaaacttccgtctctctgcctgacaacggctgcaacgtttctccgtacgcgcgttacacgggcagcggagactcaccgaccagcagtcggtccggcaacggacggaagcggcgcccgcgcagaggcgacgaattgttcatggacagacggcacttgcgcaagagtcgagaggtggaggaggatgaactggacgaagtggaaaatgactacacaatgggcgacgactgacttttctaatctcctttgaaacggtgctgactatatattctattct

SEQ ID NO: 88814 - DNA, 669 bp, Heterodera glycines
  SCN-specific regions: Sequence locations=1-110,140-669
atttccgtaaattttcaacccaaaattcgattcgaaattccaaaggtatttcccttatgaccagcaaaactgcacattggtgatcagctcatggacgtcggacataaagcaaaaataaaattgataattaaaataattacttaattggcttaaaaaggtccattgactattggccggacagtgaaacggttaatctttactcattcattccaaacgaagaatgggaagtgatgtccttcaaaattcatcgagtggtggagaaattcgtctgctgtgatggtgaatctcgttctgcccacttcggtgatcactttggtggcggtcaccggctttttcacgcccgcctccaccagcaatgaacgccgcgaaaagctcagtttgggcatcgattcgttattggcaatgtccattctgatgatgatggtcagcgaacaaatgccaaccacttccgaatatgtgccattgttcggtctcttctacctgtccatcattgtcattattttttctggcactttgatcaccgccctcgtcctcaatgttcaccttcagaagacctataatcgtccgattccgcctttgatcaccttcatctttttccataaaatcgccccttggcttggcatccgtccttcaacaattcttttggaactttggcaagaaactggagtg

SEQ ID NO: 88815 - DNA, 494 bp, Heterodera glycines
  SCN-specific regions: Sequence locations=1-55,90-494
aaaaataataattttgtctcaaagtgccaaaaattgcaaagatttaacccaccaaaaccccttttatattttgaaaatgttaattctattgttcaaccaccaaaatcacaccacagtaaatgtgtcaccgttaaagtgatatgcatccattccttcgttgaattctgttttttttaaaattttcccggatgctttggcataacgtcgtcccgtgttccccgtttgaaaatggaattgattggagcttatcagaagttatcagcagcaggacagtaaatccgcacattagctgctgatcacttaagacttggctccctctcccctcccccctgcttttgctctctgatcgcaccgttgtgagcctcgaccatataaattaattagcccataacacactcactaattgacccaaccaattattattgctcgtatatatatttggttattattatatttttcattttttgtagcataaatctttctgaaattaaaaa

SEQ ID NO: 88816 - DNA, 598 bp, Heterodera glycines
  SCN-specific regions: Sequence locations=1-598
attccaatgaagcgatccatgtcagcaccgtgatccaaactgcccaccatgcccaaccaaacgctcgcctcggccaacggccccgtctcgccctcgggcaccccggtggtcagcaagtctgccgctgtcgcccgccgcgccaccaaaccgctgcgcgacattgccctcgacgtgtacgccgggctcaactcgaccgacacggccatgcaagcccaagttgtcgccgactactttgacaactactcgacgtttgccgatccgctcgtcgtggcttcctcgaccaacctcatcaagggcgtctttgcaggcaacctgctggcattctcgtccatcgaaaagcgcgtgctgtccatcaccgaatcctcggacctgcccgttgccgacacgcacgtggtgtgcatcgacgccgatgtcgtttaccgtctccgctggcttcccttctcggtcacggtccgtaccgtcagcaaaatcacgctcaacaaggtcacgggcgacgttgtgcatttcgaggacatttggagtctcatggacttgattgaggaggtgccgatgtttggtaccttgtattccaaggcgctgcgtcccgtgctcggcacgg

SEQ ID NO: 88817 - DNA, 306 bp, Heterodera glycines
  SCN-specific regions: Sequence locations=1-211,233-284
gtttgagtcatttcttctgagcaaatacctaaattcgaagtctaaaaatgtttatgcctatggaccacaacattcaacaacaggtccaggcctccgcttctaggaaggcccgtgacgactttttcacgttcatcgcttgtggcttcatcttggagatcggcactcgcgcacttcgttatgttggattcgattcttttctcgtctaatttcgcaggaattgtttttcaattttcgcaggaattgtttttcaattgaaagtcgtaaaaaataaacattgtttttgcaaaaaaaaaaaaaaaaaaaaaa

SEQ ID NO: 88818 - DNA, 716 bp, Heterodera glycines
  SCN-specific regions: Sequence locations=1-716
gattgtttctagaaacaattatattcacctaataaaagcagctgaccagctttattacaaggacaaaactttgtatacagccattaaacccgaattaatccgaagcgacacgaaccgaccaaaagacgctgaaaagcaccagcaaatacagaaaagtgggaagaaaacggcggacgataattctgggaaaaaggctgctgaaaatctgaaacaaaacaatgtccaacaggcgaaaaacggggagagcaaacgcagtaaattgcaagaaatgatcggccaagccaaaaaaactgttgaaaatgcgctcggttcttcgcacggatcgttggagagtcaccaaaattcgattgaccttcgtcaagaagtggcggaaatcaattcgaaatgcgcggatttggccaatttgctcaatgcgttggaacagaggctgagagccgtcgaagaactgacggaggggattgccaaaaagatcggctacagcagctgatgagtgtttgagtgagcggagtttatcggggcaatccccagaagatgatttcgatgatgatccagtgcagcaccaccaatctgatctttttgctagtgtaacatttgatttttgatcagatccaaaaacgggaaacgtttattgttttgttagaatattgttgcttttagtaattgttgcatgcgaaaaacatttatttcctccattcattgaaaaagcgtaaattgaa

SEQ ID NO: 88819 - DNA, 702 bp, Heterodera glycines
  SCN-specific regions: Sequence locations=1-78,100-702
tgtttcctcctcctcccgctttttgccatgactgtccaataacagcagcagccgtcctccactgccccccatgtgccgtcctcctccgcctcgtcgtccgttgccactgcaccgaaacgccaattccggccattggccgagtacagaaaggcactcgaagagttctcggcagagcgccagcagcagcgtgaatcaatcaccgattcgtcttccgacccgcctttggtggatgagtttttggagttcgtcgctttgtccggtcaatcgcatttgccatggactttgattcagcccgtcatcgtttggaagcttcaagctgtgatggacgccgtccacgtgaaggaagcggaggcgcaacgcgacgatttggccaaagaagcgctgataaacgacgccgagattaaggacacaaaagcatttattatggaaaaggcacgctcattcgacggcattcccttcacaatccaacgcctctgcgaattgctcacatcgcccggcaaacattaccacggcaccggcacttatttgcgtgcgttggagaagaacatcaacgtggttacaacggtgacggaaaacggaatgcgaataacgggcgctgatgaggaggaagaagcggaaaaggacgcgccaattcgagtggagagcaatttcattgtcagcgtcgatgaaatggacgaaccattggcattgaaattggagaga

SEQ ID NO: 88820 - DNA, 460 bp, Heterodera glycines
  misc_feature (433)..(433): n is a, c, g, or t
  misc_feature (436)..(439): n is a, c, g, or t
  SCN-specific regions: Sequence locations=1-368,393-403,428-439
ccaataaccgaattacctcttaattactagccctatttttaattgcacaaaaaatgtcgctactccgttttttcaccgcttccaatttgatgacacttattctgctgctattggttgttttgatggtccaactgaacgagtcggcaccggcagatggccaaggaggacacttggcaatggttaatgaagcggaaaacgaagccgaccattctcttaccgttttgcgctttaagcgttcatgtccacccccgtgtcaagaaaaagattgtccttctcctatgtgtgctctatgcagtttctgcggatgagcgttttaaaataggcgaaaggaacattttgcgaaggcatgataaatgaatgaaaagaaagatttattttttaattaatttgatggacaatttagttttttatgaaaataaatttaatggcagcnctnnnnaaaaaaaaaaaaaaaaaaaaa

SEQ ID NO: 88821 - DNA, 491 bp, Heterodera glycines
  SCN-specific regions: Sequence locations=1-82,104-491
ctgacacccgccaacaaccgtccgcaatctgcccatttctcgctcccctccgcgaccccccgcccgacacttcaaacaacgaccaccccccaaatacaacaccatgtctgccattgctgaaaaggccgtcaagattgtgcactgtgaggaggcggaggtcgaggaagtcgaagaagtcgagatttccgaccccaaggagcaaatcgccgaggagtgccgcgagcttccgtccaacgccccgctccgtgaggcgcttgaggcgtgcactgcccgcgttgaggccggtgccgaggagacctgcgttgaggagttcttcaagcttcaaaaggccgtcgaccaatgcacctcggcgaccctcttcaccaagctcaagtaatcagccagtgtcgaccactttcccccatcctacattccgatgtcctctactctctaaacttcttagccgccttgttttccctccgttcctccatgtatttctttttcttctctta

SEQ ID NO: 88822 - DNA, 604 bp, Heterodera glycines
  SCN-specific regions: Sequence locations=1-222,244-604
ggaacgccttcgagaaaaattagcatcactaattatgacggagaatcatctgctcagagaaacacttgccgagtttgttggcactttcttccttttgctcaacggaatttcggccaacatccaatccttccaggcggcttctgtccatttcgggcctcaatttacctgggggcttgacctcgcttttggtgtttatatttcggcacaaatttcgggtggtcatttaaacccggccatttctttggttcagatggccaacgggtccatctctctggtccgatttgccctgtatatttctgcccaattgtgtgccgcttttctgggcagtgctgtggcatttcctggccatttcgagaattgcatgcaaattcaaacacgaaatggcaatcaagaattctcacaacttttcgccacttttccaagtactaatttaagcatttggggcagtgttgctgatcagatgatcagtactgcaattttggccatttgcataagtctgatcatggacaaacgcaatcgcgtccccattggactggcgcctctgctggcaggcctttccctgacaatgatcgcgatgactttcgacacaaatggcggctttgcc

SEQ ID NO: 88823 - DNA, 800 bp, Heterodera glycines
  SCN-specific regions: Sequence locations=1-27,49-104,133-800
gtttgaggatgttaattggttcattaataaacaacaaaaatcgacaaacttggcagttttcttccttttcttcaattttatttaataaaagccgcaaaaaacaactcaattttcttcatttaaattttttaaggagtacttctgcttcatcttcgtgcgtcgagtcttttcccgaatggcggcatcaaaatatgtccaacgaatttagtccgtcaaattggccaattcttccgacgactgttcagcccgactcggagcagttcaaacagaacgaagccgaaatggcagaatcgataagcgaattcaaaaatgtggtcgatgcggtgatcgatggccaaatggtggaaaaaacagtgatcgaacggcacaaaaacaaaggcaaattgttggccagagaacgcattgaacagctcatcgaccagggcggttcctttctcgaactcagccaattgacggcttacaaagtgtacggccaagagaaagtgccggcgggcggcgttgtcgccggcattggcccaatctgtggccgattgtgtgtcattgtggcaaacgacgcgaccgtaaaaggtggcacttattatccgattacggtgaagaagcatttgcgggcccaggaaattgcccttgaaaattgtttgccctgcgtttacctcgtcgactcgggcggtgccaatctgtcgcgccaagcggagattttcgcggacaaagacaatttcggccgaatctttttcaaccaggcacaaatgtccgccaaaggcattccgcagattgccgttgtgatgggttcgtgtacggctggc

SEQ ID NO: 88824 - DNA, 755 bp, Heterodera glycines
  SCN-specific regions: Sequence locations=1-13,35-755
gtccaattaaggtgaattgaaatgccaatattttttgcaaggcctcttccggccgagaaaaagcttccaattctgaataaaaccccagagccaacagagtcacaaaaggacacgttgagtgacgacggccaagacaaccaggacagcggtgcctcaacttcctcacagaccaacctaatcaaaaatgtgcgaattcttcggaaagaggcggcggaaacatcgctcgagccatacattcagtttcaatgttttgcgcatttcgcaatttcccggaaatgtgttaacgaattgtgcgctgatgtgtcctcggatggcgtcgatgtccacatttttttcgaggatgactttccgcgtcttccccgcattggcttctcctgcctgtctttgcaagagctttacgaagaccgtgctctgctgagtgaaaaaaacgcaacgccagaccaactcagtttcatccaattggtgcgttttgtggacaacgggttgaacgaaatacccaattggctgttggttgctccgaagcggggtcaaattttcaccatttctctggacttggccgacggaaacggagtccgggttcgcttctcatttgggagtgtgagtccgactccgtggtacagtgtgcgttatcctccgtataaatcagacttttctctcgtcatcgaagtggacaaaaaggcggtgttgaggcggtcgtacgaagaaagtagcacactgagcattttgagcagctttggactgttggaacgaaagct

SEQ ID NO: 88825 - DNA, 746 bp, Heterodera glycines
  SCN-specific regions: Sequence locations=1-227,249-746
gtccaataaagtagggatgcgatttttggattttaactgcgcgcctaaagtgtatataaaagcaacctgcttcattcacattcacttttgccaacaccaccaactgttcactcgtaatttctgagaaaccgacagtttgctcacgttcaacaacagcgccattctcagcaacatcgcacaaaaatggcacgccggcgaagaaagaaggagccgcgaaagcagtcgtacaagctgtacgttcgacgtgtgctgaaggaagttcatccgggcaaggaaatctcaatgcgtgcgttgaacatcatgaactccttcgtcatcgacgccttggaccgcattgcaacggaggcgacgcgaatggcccacaacgaccggcgcaaaaccatcacgcttcgcgacatggagttttctgtccgactgtgcctgcctgacgtcatggccaaagatgcgaaccagaaggctcagaaaacggtgaccaagttctatgctgcaaaggtgcgggatcggatgagaaggacggagatgcgtcgtggcgaatttgcgatgatgcagatggcagcgctgtgagcacactcaacttttggacgaccggcggatgaagccacctgtatattgttgatgattggccccgtatcccccattactgtatgtgtatgtattatacaatgtatctaccattcttgtgtgtgtatgtattattcactatgtgctttatatgtatacctggtcaataaaatataaccccattc

SEQ ID NO: 88826 - DNA, 827 bp, Heterodera glycines
  SCN-specific regions: Sequence locations=1-197,222-541,564-827
gtccaattaagcattttaaaattaaaagctgataattatttaatccggcataacattcgtgttctaaatgtcatcatttggccctgttttatcgtcgttcgtaaattcaatgctgtcggaatcgtcctcaattgtcgacatcccttctccatctcccagcaatggcactcaaacccttggcactgctgtcaatggcattggcacttcccactcatccacacgtcatgacacttcttcgcctttggtcgcctccgaaacgttcgtcgacgacgcgccggacgactccgactcatcgtcggcggtgttttatgtgcgcaacaacggcaccgatggcggcaaacaaaaggccaacaaaaaacaaaaggacacattcaaatgcgcaaattgcaacatcaatttcaagtcggatgaaatgttggaattacatcaaaataattgtcgccgctccgttctctctgcccccgccaatttttgctcatcactgtcattttgcgacatttgtaaccgaaaattcatctctccacgcggggtggcacttcacaaaggcaaggcacacaaaggggagagcagcagcaaattggtcaagccgaagaatatggcgaagtgccccatcgccacccgcgcagtcaaacggggccgtccccgtaaggttggcgtagtgccgccgacgtttgttgacactgccaaaaaaggacgagcccattccattgccgccgtgccgccgattggccatcaaaaccttttgagtggccgtcaccgcaccaaacccacaaacgccgccactgctcagcagcaaccaaatggcaatgtgcaaattccgaagttgc

SEQ ID NO: 88827 - DNA, 491 bp, Heterodera glycines
  misc_feature (473)..(473): n is a, c, g, or t
  SCN-specific regions: Sequence locations=1-469
acaccattcaatcaaaaccaaccaaatccccactcattagctcattatgaaatttgcccctctggctttgcttgtgatccttttggtgtctttggtcgctgccgtctctgctaattccaacaacccttttgatgcggacgcggccgacaacggtggcatgaagcgcgtcaaacggcagcaacagcaatggcgttggagtccgcaacagcagcgctgggtgccaataaacattgcgaatgtgaacattgctcagaatggataagcgcactgagaaggagccgaaccgaccgaccgatggacggacggagacgaagacaaaatgccaagaatatgtgtgatcagtgacaaattcaaacccaatgccgcgccctttcgatttatttccgatggaatgacaattccaaacttttttttaatttgttaaaattaaagagtgcatggtaataatttaaattcgtttaccgttaccaaanaaaaaaaaaaaaaaaaaa

SEQ ID NO: 88828 - DNA, 749 bp, Heterodera glycines
  SCN-specific regions: Sequence locations=1-488,510-700,724-749
ccattttctttggcattttcccaatttttgctggacaaatgtcaatttgcgttgatttgcgtctgtcttctgcggatttgccggtttgtggtcggcatcggcgtgtgccgtcccgcactctgctgttcttctgctcaatttttgaggcactgaacttttggactcgactccgttgggtgacacttttgcgccgacggttggccatcgtcgacggatctgcctcatttgtgcgcctttcccttcgccgtcggcggccgacatcaaagaaagcgacggactttcacattgacaagcgctgggactcccgactctcggcactcgtacaaaaggttctgcatgtcgagaccgagctttggcgcctttcaacgcttggcggcgctgtgtccgcaatgggctttttcagtcggaaatttattcggcatgcctttgtgatttccattcgtcagctccgtttggccatcgaaattggtgacccggtgctgatttcgcgctgcttcctttacatttcactcgcatttgcccaaaaagggcaattccttacggcactcaaaattgtgcgccaggaatggaacagaggcactgagcttaagtccgcttttttgctgaattgcacccgcggcgtttggtccactatcaaatggctgatgatgaacagaaaagtgatgatgcttaaataatttcgcacacatattttttcctttaatttattgttttgtgttttggctaattaatcaaattaattgacaaat

SEQ ID NO: 88829 - DNA, 624 bp, Heterodera glycines
  SCN-specific regions: Sequence locations=1-523,545-624
gtccatttaagttgtttaaattataaattaaagcttcccatggccgtgctcatcgaaacaacccttggtgacttggtcatcgacctttttgtcgacgaacggccaaatgcgtgcaagaatttcctgaaactttgcaaaaacaaatattacaatctctgccaattcttcaccatcgagccaaaatacatcgcccaaactggggacccaacgaactccggaagaaggggcgaatcaatttatggcactctttttggggagcaagcacggttcattgaaatggaaaatgtgcccaaattgcggcacagtcagcgcggcattgtgtcgatggtgaacaacggcgatgggatggtcggctcgcagtttttcgtcactttgggcgacgaattggattatttggacggcaaacattgcatttttggccaagtgggcgaaggcatggacacagtgaccaaactgaacgaggaattagtggaccgaaacaaccgaccctaccgggacattcgcattgcccacacaattgtgttggaagacccatttgaggacccgcctcggctgtccatttctcgtcgttcgccttcgcccaccatcgatttgattaagttggacaatcaaattgcgttggac

SEQ ID NO: 88830 - DNA, 621 bp, Heterodera glycines
  SCN-specific regions: Sequence locations=1-67,89-621
gtccaattaagagcctttctattaacattgaagtggtagaaaacgaaaatcgtcataaatggcaggtgaagaagaagaagaaacagtggtggaacatcctttgccgaaaggctgggagaaacgaatgagtcgttcatccggtcgtgagtattacttcaatgtgttcagtcaaaaaagtcaatgggaacgtccgacgcgtgacgccgaagacacggcaaaaaaacccgaaactgtccactgttaccatattttggtcaaacacgaaagatcaaggaacccaaagtcgtggagaagtgacaaagtcacacgaagcaaggaggacgcgaccaaaacactcgaatcttatcatgccgaattggttgcattggacgttggcgaacgcttttcccggttcaagaaaattgcgcaggaattcagcgattgctcttcggccaaacgcagcggcgatttgggcccattcggtaggaataaaatgcagaagccattcgaggaagcatcttttgcactgaatgtggggcaaatgtcggatattgtggacaccgattcgggccttcatttgatctatcggttcgcttaattttgaagacgagggtctgtttgctttcaacgtttaatataatt

SEQ ID NO: 88831 - DNA, 644 bp, Heterodera glycines
  SCN-specific regions: Sequence locations=1-316,338-586,609-644
aagaaattaaattaacaatgttttcttttgtaaaaatcacccatcgtttttattccaccgaaccgttggtaaaaaaactaacggtgattggctcgggtttgatgggcgcgggcattgcccaagtcagtgcccaggcaaacgtaaaagttgtgctggtcgaccaaagtcagtcaatcgttgagaaggccaaaagtggcattgaaaacagcatcaaacgggtggcgaagaaacaattcgaagacccggggaaacagaatgaactcgtcacccgcgctctttccaatatttccctgtcgacggatatttcgcaggccgtgtcgggcgccgatttggtcattgaggcaatttctgagaatttggacgtaaaacggaaactgttcgcagaagtggagtcggctttgccacaaaatgggaaaatggccacaaacacttcttctctgacattggccgacattgcggccaatttgaagcgcaaagattcctttggggggctgcactttttcaaccccgtcccaattatgaaacttctcgaggttgtccgctttgatggcaccagcgaagagacattcaacgttctgatggactttggcaaaaccattggcaaaacgaccgtcgtttgcaaggacaccccggggttcatagtt

SEQ ID NO: 88832 - DNA, 995 bp, Heterodera glycines
  SCN-specific regions: Sequence locations=1-640,662-995
gtccaattaagtttgccaaataaacattttattccatctttctttcgcttttttcgaagttttcactgttttttgtccacaaaatgccttcgtccgcccaaagaaagcgtgccgaattgcactggggtatcatcggcttggggaacatcgccaatgattttgtgcttgcgatggcttattgtcaacacccgaacaaagtgaccgccgtggccacttccaattccgtggaaagggcgcagcaattcatccaaaaggttggcctgaacagcgaacaggtcaaggcttatggcaactacgagcagttgctgcaggacgccgacgtggacgtcgtttacatcgccaccattaacagcacccatttgccccttataatttccgcacttgaacaccacaaaagtgtgctgtgcgaaaagccaatggtttattcaagtgccgaactttccgttgtccaaacggtgcaaaaaacgatcaatcgaagggagggaaagaaactctttgtgatggaaggcttttggtctggtttctttccgagttggcagaaaatccgacaaacggtgcgcgacggacagatgggcaaccccaaattggtctcggtggatttcagtcaaaaattgcccgacaaacggcgcgacctttccaatggcatttgtcccctggtggacatcggctgttacaccgtcgatttcgccacttttgtttttgagggcaaaaaaagtgatcgacgtgaaagtgatcggagatgtgtctgctgaggacggtgttgacaattgggcctgtattgccttgcgctttgagggcggcggtcactccgtttgccattacaatggcaatttgtcgaccaattcgaatgcttcggtgacttttgaaaatggcagtgttttggaattgccggaacgcttttgggcgtccaccgatttgcgcagtcggagcgaattgcaaacgcatcgaaagggccaatggcacgacgaacattttgcattcccggagagaaaggg

SEQ ID NO: 88833 - DNA, 684 bp, Heterodera glycines
  SCN-specific regions: Sequence locations=1-220,242-684
gaccggttggccctttgggaccgattgatggtgttggcctcgaaggtgcaaaaagtcatcaatctgtcgtccaaaatttcatctgtccagaacacggaccacatgatgcaacagccaacggaggaacagcgccagcgaatttatcaaactgataaagcaaagtctgcactgcttcatcttctgctcactgattgtctagcgaaaaatgatgaaacaaccgtttttgaccgttttaaaatgttaaaagaggaaaacaattgtaaaattgctccagagatgttcagcaatttaccattggcacgattattagtcaatttggaagggaatgacaatgagacgaggactcgcgtcgaagaagtcagaaatttgctctttcgtgcattgcaagtgcttattgacgcggaaataacgccatctgatgaattactctatagcttcgagcagcaaaaaatgtacgaagaggcgaagctaagcggtttgagcacattacaatggttggaacgtcagagatcattgaacaagaggggtaaaaagcggaagcaggaagtggacacgaaggcatcgaaaggacgcaaaatccgttacgtggagatcccatagttagtcaatttctttccccgcacccccgaaagaattgcatggacacacgaaagacgggacgagctggttcagacgttgtttatt

SEQ ID NO: 88834 - DNA, 670 bp, Heterodera glycines
  SCN-specific regions: Sequence locations=1-68,90-215,240-670
gtttcggtggcttcggaatgccgcgacagcagcagcggatcaggcaggacacggcggtgacacacgaattgcccatcagtttggaggacctgtgcaaagggtgcacaaaaaaaatgaagatcaccaagaaaattgtgaatcctgacggcacgtcgcggacggaggacaaagttttgacgataaatgtgaagccgggctggaagagcggcacccgcatcactttccccaaagagggcgacgtgttccccaaccgtatgccagcagacatcacttttgtcatcaaagacaaaccgcaccccaaattcagaagggacggctcagacattcggtataaacaagtggttccattgcgagacgcactttgcggcatgtccataaaagtgccaactttggagggtgacatcatcccgttgaacatcaagcacgtgaccaaacctggcagcacacaacgaatccacgatcgtggcattccgaaccctaagacgggcaaacgcggcgacttggtggtggagtttgacgtgcgcttccccgattcgatagcgcctgccgcgcgggaactaatcgccaatgcattgccaccaaactgatcggacgaacggagggccaaaagacgggaaagcgaaagaatgtgcatttgaaatgttcaattgacaagcgataaaaggctttt

SEQ ID NO: 88835 - DNA, 635 bp, Heterodera glycines
  SCN-specific regions: Sequence locations=1-56,78-563,604-611
ttgagttgtaaaaagaagatggcacaactgttcgaaaacattggcgttcgacgcaaagttgatgacaaattggtgaacgggcaagaggcgctaaagggttgcgaagtggtggcgctttatttcagtgcccattggtgtccaccgtgccgcaatttcacgccggtgctcaagaaattttatgacgagttgaaaaagtcgccggagacggcgccctttgaaattgtttttgtgtcctttgatcgttccgccgatgatctgagcaactatttgcgcgaatcgcatggtgattggctgtacattccgcttggaagtgagcacatcgaaacattgtccaaaaaatttggcatcagtggcattccggcattggttgtgctgaagcaggacggcactttggtcaccaaggatggtcgagcggatgtgcagaacctatcaccatcaaatgcaatggccaaatggcgctccggctaagagaacaccccttcactggggagactgatggaagaaaatcaaaaattttgatatggatggacacattaatacattagtagtgatatatcgaaaactaatttttacaaattaaatttttaaacaaaataaaaaaatcttttgttaaaaaaaaaaaaaaaaaaaaaaaa

SEQ ID NO: 88836 - DNA, 647 bp, Heterodera glycines
  SCN-specific regions: Sequence locations=1-55,77-253,275-647
ttgagattttataagcatccgttcttcttcttccctttccaaatgttctcccattcgccctcctctcttcttcctcatccctcctccattcatccgtccggcataaccaccgctggtgcctctaataacactctttcatccgaaaactttttcgaggacgaagaacggccggaggagaacatttacgagaggcattttgcccagcagcaaatgaccaaggaggagacgaggctggtcgagttgcaaaagcgcaaagagaaagcgatggaaaaggcggacgcaacgcaacaaattgcgcaggacataaatgacttgaatcagatcatgcaggacttggcccaacttgttcatgaacaacatgacatggtcgacagtattgaggatcacgtggagcgttcaatgcaagaggtcaaatcgggcgagcgcaatttgcgtcgtgcggtcgcttcaaacagtgccaagtacccagtggccgccgctgcagttggcggtgcggtgatgggcggaccggtgggaatcgcggccggctcattggtggcagggattgcggcagccgtagggggcgcttttgcaggcctttacggagggcgtgtgctgcaacggaaagtgaagcaaagtacagcagtcgactcgcagcaatcagttgt

SEQ ID NO: 88837 - DNA, 595 bp, Heterodera glycines
  SCN-specific regions: Sequence locations=1-413,435-595
atttaagtttgcattttgattttaaaaatgaaaaaacacgtcacgttcactccgagtatcggagacgatgtccattccaccaatgtatcgtcggtagcggagtctgagttcagcgttaaagagcgtgccgaagtgccagaaatattcaagaaattggccgacgatgcctttcaaatattgcctttgcccgacatcgacccgaccgtcacttcgaccccggcggtcgtcaacaatttgatcgaggcggtcgagtcgctcgactcgcggatgcctttggcgttccaagagcagcagcaaatcctgaaaatgcaaggcgaaatgctgcaactcggcgtcagttgcaaggaacactacaagaagatacacgagcagtccgtgatgcgttacaatctcgagaagagtgtcaataaaaacatcgacgatctgaaggagggcgcagttgtcgcgcagaaattggtgaaggcgaagagtgcgtacgaggaaatggtagcgaaggcggaggcgttgctggccaaggcaaacaaatgacggatgaagacgagtcgattgagatggaacatatgatggacttatttgataaaatgttttttctttc

SEQ ID NO: 88838 - DNA, 886 bp, Heterodera glycines
  SCN-specific regions: Sequence locations=1-47,70-439,462-513,535 -733,755-886
gtcattttctttccatccattcaaagagtcattctcccatcacccagataaataattaattaattaattgactgctcgttgattctcttaattgaccacaatgtttctgctaattgctctactgctcgtcgtttttcctctcttttgcggtgccatccccgcgctgcccaactcagccgcggcactaactcaacagcagcagcgcatgatgcaaattgatgctttttctgcggcggatgacgcacagcgaaaggacagcgacgccgcgggcggtgcggcgcccttcgctttcgaaccctccgagcaaaaggcattcgtactgaaagggttgcgtcgcgtgaagaatccgtcgccgccggcggtcgttccgaaactgacggcagatgccaaaatcatttcattgaacgcggacgacgacgagtggcgagaaatgggacaacaacagaaacaacagcagcaacacggcatgggccgacttttgccaccgacggattctttggcgcggagaatgagcggcgccgcggccgcggtggggacacaacgcgcgcaacggccgacggcgacggaagtctttggagacgcagcaaatggcgacgcactgataaatccggcagcgtttttcatgggcggcgccgacctggacagaattgctgcgccctcgtgccatttggtgggctgcgtcggccctttggccaacgacggggacatcgccatggagggacggacggggccgggcgcgggcggcacgcgccagtgccaccaaacatttgtgccgttgaacggctgctgggagaggggggcggtacgcgactcgtaccccgtgggaatggtgtgcacaatttgctgtgagtgcagcgctcagttagcggcagagatgcggcgcagt

SEQ ID NO: 88839 - DNA, 319 bp, Heterodera glycines
  SCN-specific regions: Sequence locations=1-270,293-319
gtgacacaaattctccaatattagttgtttagcatggtcgaaatttctattagagcccggattttaaaattgccattacttagaaaatggacagggacttggtcccgagattcacgttttccgggactcccggtcccggtattttgtccaaaaaaaccgtggacctgaaccacgagtctcggcaaaatcccggtccctacaagcctaatttatctgcgttttttggattttctccggtatttatctggtcaatacgctttgtccaatctctaattaaaagaataaaacaatatccaaaaataatgggaaattgtaatta

SEQ ID NO: 88840 - DNA, 661 bp, Heterodera glycines
  SCN-specific regions: Sequence locations=1-23,54-110,135-215,253 -260,292-292,316-345,415-415,493-493,543-549,627-661
gtttgaggacaaatggttgccgccaatctgaagctttccctgatttttgtggccggcttttgcctgctgttcatcgccgactccgatgccgggaagtcgtgcaaaccgggagaaaagggaccgccaggccctccagggaagccgggaaacaaggggaagcccggcgtgtgcaagcccaaatatgaaacaacttccaagtacggtacgactacttccaagtacgacaccaccacttccaagtacggtacaacaacacccgaatacgatacgacaacatccaaatacgatacaacgacttccaaatacgacacaacaacttccgactacggtacgacaacttccaaatacgatacaaccacttccaagtacgatacaaccacttccaagtacgacacgacaacttcaaagtacggtacgactactcaaaagtaccgtggcaaacgctttgcggatgccgtgctcgttcgggctgctcgcgctgagtacgacgccgattgcccggccggtcccccgggagatgccggcattgccggaccgcccggcccccccggcgagccgggcaaatgctatggcagcgggtccaaagagtccaaagaaaaggagtacaaacccagcaagcgcagcattgacaacttcgagcatggcttacgcgtcgccaggg

SEQ ID NO: 88841 - DNA, 304 bp, Heterodera glycines
  SCN-specific regions: Sequence locations=1-304
aaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatggcgattgagcacagccctccgtctcatacgcaagcgcttttgcgaggtataaaatttctcaaaaaaagagatagccatttttctgggatagagtataaatttaaaaattccctcaaaaataaaaggtctattgcgcaccgccctccctatcatg

SEQ ID NO: 88842 - DNA, 609 bp, Heterodera glycines
  SCN-specific regions: Sequence locations=1-609
gtttttatgcctttgcattttaaaagacgccgaaacatcgacgatctcctcaaggaacacctcatctttaaaaggtccataaatcagaacacatcttttcgattagaagcggcgattggttccgattctttgcacgacaggaaaatccgttttgaagaaagtacaaattcattggaagagaacgaactcgtcaattttgacggtgttgtcgttttggaaggaatggacgcttttactggaacgacttcgggcgttttgaaaggtctttgcttttccaattcttcatttctcaattatcgaactgcgcaactttcttcgtctgccgatttttccatttgttccgtctccgatgagcaaaatcagccgaccaaagcgttgccttccgcggtgaccgcaatgagtttcagcggggcggatcagatggaagttttggtcgggcgcgagaatggccgcgtcgaccatttcaattctttgactgaccaattcaatgcgctttttgctttaccacagccttccgaactcaaaggaattcatcgcatcgacggtgatcggattctgactgctcaagaatgtggcactttggctgtttggagcgcttctggagaacgg

SEQ ID NO: 88843 - DNA, 631 bp, Heterodera glycines
  SCN-specific regions: Sequence locations=1-545,567-587,609-631
gtttgagctaatttattctccaaaatgccgtgctctctcgctacacaatcttctgttctgaagcgcagagcacctgcgtctcctcagcaggcaaaaatgcatgacaaaaagagacactttgacgaatcggcaaacaatggacaagaaaaagcggacaaagtgccatccaaaggggacaaagtgtcaccgacaaatgaggaaaagaagaaaaatgttgcctttgccacattggcaatccatgcgggaaatgaacccgagaaatgggacatgaatcaggtggttccaccaatttcactggcaacaacatataagcagcaatttgctggaatgcccaaaggtcatgattacgcacgaggcggcaatcccacccgtgatgtgctacaacaaagcattgccgcgctggaaaatgctcgtcactgtcgcgtgttcagctccggactttcagccacagcagcaatggcaaattggcttcattctggcgaccacattattgcgtcggatgatggctatggtggcactcaacgctattttcggcaaatctctgtccagcatcatggcatggaattgagctttgttgatttaacgaaattgtcaaaccttgaagaaggaatttaagccgaatacgaagatg

SEQ ID NO: 88844 - DNA, 695 bp, Heterodera glycines
  SCN-specific regions: Sequence locations=1-50,72-631,654-695
caagtttgagagataccatttattcgccttttgtgaagggcacaatgtacaaaattgtgcagcgaaaggaacgaaatgctgatggcacggcaaaaacagacgctgaaccttttgcaactccatcaacttcaacggttgtgcccttagtcagaattgcgaaggcaccccatcgtaaggccaacgacacaacagtagccaatgttcctgcggaagtgccgacctcaaataccagtgccgatggtctctcatctgccgctttaaacacagttcggacagaaatcgcaaaaagcgggggagtgccatctccagcggcgaaacaatcggcaaaagacgcaggggcaaccacggaccaagcccaaatggacgcatcgatccgactgattgacgatgaaatggaactgatcgacgctgtgaaggattttctcattgagtccaacacaaaatattcggtcattggtgcgattggggcacaaggcactggcaagtcgaccatcctcagtatgctcgccgggaacaatccggtggatatgtaccgccagtacatttttcgtcctgctgcgagggaagctgttgaggcgtgtcgttaccaaaccacaaaagtctcagtgtatgttgtgcccaaactgcgcactttctttttggactgtcagcccttaaattgtgctccacttctcgaggactttttgcgtgcgcga

SEQ ID NO: 88845 - DNA, 566 bp, Heterodera glycines
  SCN-specific regions: Sequence locations=1-566
gtttctctgatgacgctctctaactctgaacaccgtcggccatgtccgaaaccccttgacgacttttactgttttaacggagggaaatgttctgtggaatttgaaggacaacgaattgttaacacttccttaagttgtcgatgtccacaaaactttcacggttatcgctgtctgcattcgttcgactcgcatattttcggattcagcaaagtgaacaatggagtggaaagcaaagcaattcccaccattgctgtgatactctttctggtgatcgtcatcttcatttggtgtctgttgttgcatcggaggagtgtgagttcctctgcgcggactttcctcaacaacagacaaacgtccgcctcccagtctcggttcgttcaaccgtcggtcgtctaatgggaagggtgacaccgtcgaacaccaacagacactgaatgccatcatcccaacgactaaatataactgacctaatgcaaataacctgcctgtaccattcctaactattattagcatgtttttttgtacttgataatagctttttgaaaatgaagtttgtaatttataaa

SEQ ID NO: 88846 - DNA, 1094 bp, Heterodera glycines
  SCN-specific regions: Sequence locations=1-760,782-812,847-1094
gacagacgctgaagtccaatcggacgcacggcagccaaaaatcgccggatggtggaaatttgttgaaagcactgaaggctgcggtggtcagtgccgtgttggagcagcacagatgggattcaaaagcgttggattatttgcgtgttatccaattgaatgccgtcgctgaccaagtggtgcccgaccgaagggcgtgggaccaatcgtgcgctttccttgccaacgcggcctctgaccgaattcgtgaacttaaaaagacattggaagaatctcgcggtccttcgggatggtcacgttggtttggttggagttcgccgacgcctgagcaactcgtcaaccaaacggttcaagacgaacttcgagctttgctcgtcaataatccggagcataaacaatctttgctggacgacgatttgactgtgatccgacggaatttggagacacggaatttgccagggcccaacgaactttctgccgaaatgattcgtcagcaatggcggctcatttacagaaagcattttctcgaacgaatgctccaagctggtcacgattgccaaagtttttaccaaaattacaaattgggcgtacgctcggaagactcggacttggactgtcaagcggtggtgttcttctaccgaattaatcggatgctcgatctcagttgcaacgcgctcagacaacaaattgtgaacacggaacagcgacggttggaaaaggaagtgaaggaagtgctgaacgactggtcagcagacacggacaagaagaagcagtatttgaccgggagacaagtcgaattggccgaagaattggcccacgtgcgcttcatccaggagaagttggaggagttcattattcagcttcaccaggagaagccttggtagagcgactcgcattgccaacttatgtccatcaatctcatgtctcgcttttccactctcaccattatttgaggcttttctttctgtgtttaatatgtctccttttactttgcttccttgtcgttgatacgtgtgacaattcgttgttatcactttttgattttcctttgtttttccaccttttcctgtaattcagaatataaatacgatttattt

SEQ ID NO: 88847 - DNA, 812 bp, Heterodera glycines
  misc_feature (787)..(787): n is a, c, g, or t
  SCN-specific regions: Sequence locations=1-397,420-812
attttaaaaagaagtaaaatggtcgatgcgcaacattttacccaactgctcatcggaatgatgaactccgaaaatgaaattcgaagtgaggctgaaaaacagtacgaagcgattgcactcaaagacaaaggaccacttttgtttaaacattacttgatttcctctgcggatgttgagtctcgctctttggctttggttcttctgcggcgtttgctgtcgaattcctacgaagaattcttcacagaaactcaaattcaaaaggaccaatttcacaacgaattcattgtgtgtatcaatggtgaaacggagcccgttttgcgcaaaagactcaccgatttgttggcggaacttgcgcggaattccattgacgacaaaactggcaaacagacgtggactggcatcatgcagttcctggacatgtgcgcaacttcggacaatcccacctttcgcgaggctggcatgtcgctcattgaaagtgtgccaaatgtgttcggctccgactcgttcaaatacattgccgggattaagacaatgttccattcttcgctgctttacggtgccgacagttccgtgcggactgccgctgtccgtgcctatgtcgcgtttgtgtgcgacaatgaggagaacgacgctgtgatccgccaactgtccgacttggtccctgccgtcatcaaagtgtgccaacatgtcgtggacactgaggacgacgacgatgtgcctttgcaatgtttgggcgatttggcctccactcttcccaaaattctcgcccctcacatgagcgacattntttcgctttgtgcagggactgtggc

SEQ ID NO: 88848 - DNA, 120 bp, Heterodera glycines
  SCN-specific regions: Sequence locations=1-58,80-85,107-120
ggttaaccataatggtttccttaaaatattagtaaaaataaaaacaaaatgattatgtaaataaatttctttattccttttttggacaagaaatgcttaggaaaattttttactaaaaaa

SEQ ID NO: 88849 - DNA, 396 bp, Heterodera glycines
  misc_feature (365)..(368): n is a, c, g, or t
  SCN-specific regions: Sequence locations=1-265,287-368
gtccatttaagatttaatacagacaaaaaacgctcacgttcatgctagcgcataaatttgaccaaaaatgagcaacccaattaaaattgtgcgtgttgttgagattattgaagcagacgaagctgctgggcaacctaagcaagtggtggctgagtatgtggacgacccgagcagacgagttaccatgaaagcaagcggagaggtccgaattggccaacttgttggtttctttgatggtccggacaaaagacacattcagcgatgcttcacgaacaacaacaacaactgatttgaaggatttgataaaaataaatttgaaaaacgtatgccatcctttttgaaagcgcaataaaaaaagcacattnnnnaaaaaaaaaaaaaaaaaaaaaaaaaaaa

SEQ ID NO: 88850 - DNA, 805 bp, Heterodera glycines
  SCN-specific regions: Sequence locations=1-805
ttgagatttaaaataatacctaatggcttcagcagtgagagctttggaaggtaaaattgcagttgtgactggtgcttctcgtggtattggacgagggattgcgcttcaacttggtcaagctggtgctacggtttatgtcactggacgagctcctgccgcttcgtactctctgattgagaagggacttccatctttggaacaaacagcgaaggaaatcaaaagtcgtggaggagaagctcatcctgtgtattgtgaccacgcgaactctgacgacgttcgccgtttgtttaagcgcgttgaggaagaacagaacggccgactgcacattttggtgaacaatgcctattccggagtgcctagtctgattgaaaatgccgggaaaaagttttgggaatgcgaaccggagttttgggatgacatcaacgaggttgggctgcgcaacgtgtacttctgttcaacgcttgccgctcgtctgatggttccgcatgaggatggccttattgtgcacatcagttcggctgggggacttcaataccttttctcggttccttacggagttggcaaagcggcggttgaccgaatggcatccgacatgggactcgaactcaaatctcgcggagtggcagtgatctcactttggcctggttttgttcaaacggaaattacgacgatgggagaaaaggcggaacaatttgcttctgccgctcgcatgtcaatggatgcattcaatgcggcattgaaaggtgccgaaacccccgaatttgtgggcaaagccatcgttggtttggcgactgaccgccagcga

SEQ ID NO: 88851 - DNA, 923 bp, Heterodera glycines
  SCN-specific regions: Sequence locations=1-37,59-354,377-703,725-923
cacacacacgtgatacattatatagtttttctccgtgtttttattttcttttgagatgatgtccttctcttctacctccgaaaattcatttgacgaagtgccaatgccaatcgtgggaggacgtgtcgaggggcccccttcccttcccgtttctcgctcgacttcgtcatcttccttcacgcgccattcgtggactgagttaaaaaccgatacgaatatttcggacgaagaatacgcagatcagtgggcgcgagtcggacacggccaatcccttcggcagatggaattctcagacaatgactcgactttcggaacatttggctgtgaaatcgatggcacggcgtccgacgcattaaagcgaaatttggccaaaatggcactttttggaattatcgtagcgatgatcttcggaaagagcgtttacccttggggggatataacgaaaattaatgaaatgagcgaagaaaatgcgacgaaattgcgcacggagttggacaaaatggtggccgataaatgggaatttgagttgaaattggtgaaactgcgagaagaattggagacagagagaaatcgccgtaaggaagcggaaaagacattacggaaggcgcacgaacagttggaaattgatttgaacgatcgaattcgactggagacggaattgggaaagacgcgggcagaactggtggaaacggaggaaaaggtggcggaagcggagagagaggcggacggaaaatggatgggcggtggagggatgggccaactgaacagagcgtaccgcaaagtcaagcgggcgcagttggcacacggcaaattgagggagacctccgagtggtgggtgccgttgtattggcgcgtggcgcgcgtcactctcttcaacgaacgctgaaaatgttttgtccgaatgctctctttcggtaggataa

SEQ ID NO: 88852 - DNA, 381 bp, Heterodera glycines
  SCN-specific regions: Sequence locations=1-141,176-358
gcagcaaatttcacactgaaaatgtcttctttgtccaccattcttgttcttctgctgataatttccatttgcttgtcattaacaattgccatgccagcagtggacaatcaaattgaaagtgttgcacttcgtcaaaagcgttatgactatggctatggctatggctacggctacggcggcagaagagtctaattgacggcggaatgggcatggatgggctttgatggacgcatgggcatgggcggcggatttgaacgccgaccctgacccatgaagaatataatattgtgaatcatctgaaatagattatttacaaaatgccattcgcaattaaataaattttgaataaaaaacttttaaaaaaaaaaaaaaaaaaaaaaa

SEQ ID NO: 88853 - DNA, 649 bp, Heterodera glycines
  SCN-specific regions: Sequence locations=1-649
gtttgagcgtattcgcctcactttttaacacgtggtgtccttctccgacactcccatttattttatcatcaaaaatatcgcattcggcaacttttttcgctttcctttcatttattggaggatcgccttttgatcctttggcaaattatttatttcaatgattggcacttacgaaaagcgtcgccacagcgaattgcccccgcacttacaacataaattcagccttccccataacgacccgtccattgcggccgccgcggccgagggggcgcggatgggcgtggagggcgccaagttggggccgctgtcgcatcagatgatacctccgcgaaaggaatcggccaagcagatgtcctccgggggagcgcaggtgttcctctgtattttgggcgttgtgctaagtgtctgtgtcagtctttggacggcaatgtttagcaaggactctcttccgcggagaatttcaatttccgccgtggcgggcgtttgttcccttatcttcgcgcttcttgcctatgcagcttttaagaaacggacaataaagacaccgctggacgacgtcgaaatcagtcagtccattttgcgagaacatcgcaaatcgatgaccaactccttgagaaaaagcacgaccaacggagacgatctgatcgga

SEQ ID NO: 88854 - DNA, 498 bp, Heterodera glycines
  SCN-specific regions: Sequence locations=1-222,244-498
gtgaagttggttacgccttggactgtgttaggaaggcacccggcaatgaaagtgtgtggagttatttgtccggcattctgatcaatgaaccattgggcactgaccgtcccgaaattgtgcactgctgtgacgaactgttggctcgtcagccgccgtgcaactcgtcccatctgttccaatttctcatcgacaaaattgcggacaaaatgcgcgaaaatgcggttgcaaatgagcaacaattgacggaaatggcacaaaaaagtggcgaatatttggatgtgttggagcggattgacccgattcggcacaatttctggaagtacaggcgggcacagctgcaaacattggcagactcggtgaagttcaacagcagtaacagtgccagtgctgctgcagcttcggcatgagttgtgcaaattgtgcccgactcatcggcggaagatgagagcatttattatttatattttcgcaattttgcataaattttttgcattttta

SEQ ID NO: 88855 - DNA, 440 bp, Heterodera glycines
  SCN-specific regions: Sequence locations=1-92,114-291,313-400,422-440
gtccatttaagtttttctcggccggctattcatatcatgaaaaaaaaaatcaacaaaaaggaagaagaacggcgaaagcggtaccgaccaggggagaaggcacttaaagagattcggaggtaccaaaaatccacagacaatttgatgccccggcagccgttccgtcgcttgatccgggaagtgataagcgaaataacatggaactctcaccggttggagacccaagcggccactgctcttcaggaggccgctgaaacttttctcacaaccttttttgaagccgctaacagatgtgccgtacacgcaaatcgagtcactattatgccgtccgattttgtccttattcgctggatccttcacacttttggcaataatattgtttgactaaaaactcacatttcttttttcattccatttgctgtataaaattgcgacttttt

SEQ ID NO: 88856 - DNA, 805 bp, Heterodera glycines
  SCN-specific regions: Sequence locations=1-49,71-721,743-805
agtccttaagatacctgaacaagttacctgaaactttgtaaacataaattaatatttttgtaaaagaagaggattgaaacctatttattgcgtcatggcgaagtggggagaaggggaccctcgttggattgtcgaagagaggccggatgccacaaatgtgaacaattggcattgggttgagaagaatgccactccttggtctcgggaaaggcttcgcgtgcttttgttgggtcaaaccttggaaaaagggccggtgcgaattgaattttccgacttcaaaaaattggagggcgaagcgacggcgaacaatcggaaggcgaaactgattttcttcttcgagtggtccatcgacgtcaatttcattgcaactgtttctggttccgaaactgagtacaaaggaagtgtggaaattctgaatttgagcgatgagaacgaggcacacgaaattgagatttccgtgcacattgaaacggcgggcccacatgaaaacgaaattcggcacattctctccaccgatgggctctcattcgtccgttccaaagtgggcacttacgtgcgcgagttgaaggaggagttcagcaaagggatcattttgccggtggacagcaaaggcgccattcgtccgcaggcggtggcaacgcaagggaaaacggtggtggacaagaggcgctttcagaatgataagacggaggagaaagtgaccacggcggaaactcaaaacgctctcaaaactggtggtttcgaactgaccgagacattcaaagtgccgcccgaacgcctttttgagattttgactgcgtctgag

SEQ ID NO: 88857 - DNA, 1071 bp, Heterodera glycines
  SCN-specific regions: Sequence locations=1-46,70-196,218-1019,1041 -1071
gtccaattaaggtttgttaattaaattccgtatttctgtgttcttccaatacacaatgctccaagaaacagaggcaaagtccgattcgagcaaagctccaaacgaagtggctttatcttctgaaggtcgtatcagcaagctttatgtggaatgtttcaacgaacgcgagaagtgtttaacggtcatcggagggggcaaaatggctactgctttagtgcatggattagtttccgctggttttatcgacaagtccgaagtgaatatctgctcaagatccaaagaaacggcctttcgttggacgacacaaggttaccaaaatgcatatacaaatgatgaattttacagcaaagtgaaaaagccacgtggaattgtgattgtcgcagtaaaaccacagatctttcccgggtttctcgacgaactgcgtaaaaatggttggcttaactttgttgggcctgaagtgctttgtgtgtccataatggctgggattgcacttgacacctttaaacagcagttgaaattggttggtttcaatggccatgccgcccgttttatgccaaatgtgaattgtctcgtttctgctggtatcgttttggtctgtgccgatgactgtgttccgacggagatggtttagcagaaattgctctagttatcaaattcatgcaatttttcgaatcgacgagtcgctttttgacgccgcgtccgcccttgcgagctgtgcacctgcatatatgttcactgtgattgaggcattggcagacggaggcgtactgaacggcctgagccgagagatgtccgtccgactcgccgctgaaatggtcaagggctcagcgcagctgatgctaaaatcgccggaagtaacttctccagcgcaattgaaggacagggtttgttcgcctgctggcactaccattgctggactgcgtgagcttgaatgctctggggtcagatcggcattcattgaagcattaagcgcttccactcgtcgtgccactgaaatggctccgaagacaaactaacaatttttctggttttgatagttttttcgtcaataaataattgtttttgtaaaaa

SEQ ID NO: 88858 - DNA, 766 bp, Heterodera glycines
  SCN-specific regions: Sequence locations=1-766
atttctctaaaatatatttgatgaagccgcaagaattttctggagctgacaatgagcagccatctccgagtcgccactcaataattggtgttaagcgcaagttcagttcgattgattatgcgtcatctaacagtcctgtaaaagtgctgccgagttttactagcacatttctgcctgatttatcaaatgcgcaagtgttgaagccaaagcccaccaatgttgatcgtcttcctttatcaaatgaagaatttataactccaactcagccaaaaaagcagcaaagtcgtccaaattccccagcaaatggcgtatccaaattgatacttccgagaagccgagtcgcttcaatacgtcgtgagtcggattgcaattcagagaaaggatttggtgaggcggaagcggcacacgaaaaaatggtaaaatcggcacagcaagtcgcgatgggttttgaggatttttgtctcgacgacaaggctttcgaggagcgcaaaagggccaagtcgttgtctgagcctatttgcattttcaccaatgcgttccttccccaatgttcgtcaccgtcgccgagtaggggttcaatggatggacagaaacaatgctattctccgtctgcccagcaagtcgtccgcagcaatttggcgtattctccgagtccgagtccaactccgtctggcactcagtcaatgcaccgaatgaggtcttgcgagagtcaaacgcaccttcccgatgattaatttattgaattcgctgaaataagagactatta

SEQ ID NO: 88859 - DNA, 1235 bp, Heterodera glycines
  SCN-specific regions: Sequence locations=1-1114,1136-1235
gtccaattaagtgtctttctcgtcaaattgcgcctcctttcgatgctttgtttgcgaagggttctttcaaatggacattcgttcgtcttttctgtttcgtcagagtgccgttccacttatttgaccacttcttccaatgacccgtccgaatttacggcggacgatgtcggaaaattgtacaaagtgcccagcaatctgatgaacgtattgaatgtcagaaggaaaatgccggagttcttcgtaagacaattggacacgttgcgcgaatgcgtttggctttaccgtcagcaaacgcaagaagctttccattgtcttcacgaggtcgacttggctcatcggcccgcccttcgcctcgtcctttggggccattttggcaccggaaagacaatcactttgagtcaactgaaccacttggcaattaacaaaggatacatcatttttggcgtgaaagatgcgttgcgttggtctcgtgacaattaccgtcctgtacaattgtccacgtataaacccggtcggttggacagtccatggtgggccgtccgtttgctgaccgccttcaaagttgagaatggccacgcgtggaaaaaactcgcggaattgaaaacaacgaaagattacgaatggacaaaggtggaaaagacgccgaagagaaagcctttgacggacattgtcgaaatgggtctgaccgcccccgctttgtccaccgattgtgtgggcgcactttgtcgcgaattgcgcgcgcacgcctccgccggctcaataaaacttctggtgaccattgacaaggcgaacggtctcttcagcgaaaaatgcgcggtgaaatggccgacggatcggagaaaagcaactccggatgaattgtcgttgaacatttttattcgtaagtttttgatgccaatttggtcaaatggactgtgcgcaatgattgccgacaaagcggtggtcagcgacgcgcgtgaccatctgtccgtctctccattagatccacgcagtttatttggcgaaagaggctatgaacaaattgagccattcgtatcggtggagtcacaacactattcggaggccgaattcaatgtcatccacgactattatttggaaaagaattggattagacagaagaagggacccgagggggaggaggcaaagcgacagatgatgtatttgagtgcattcaatccgagccattatgagagactttgctcattctcgtggaaccttagctgtagtgttcccgt

SEQ ID NO: 88860 - DNA, 797 bp, Heterodera glycines
  SCN-specific regions: Sequence locations=1-452,474-520,616-797
gtttcatatttgttatattgacataagtatctaattagcactttgttattttctgcaaaatggaagagcgaatcaaaactgaattgcgtggtagacaaccttctgaagtccaagaccttctgctcgacagctgcaaagcgaacacaattagcgggctgacagaacaattcacaagtctcacaacactttcgctgataaatgttggattgactacattggatggtcttccgaagttgccgactttgcgaactatcgacctcagtgacaacaaactcagcggtggtcttgataaattggtcgaatgttgccctcgtctctaccacatcaatttatgcgcaaacaaaattacgtccatggaggcacttgctcccttgagcaagttggaggaattggcggcacttgacctgttcgactgtgctattaccgagggaccggaatatcgtagcaaagtgtttgctatgatcccacagctgaaatacttggacggatttgacataaacgatgtcgaggcagaaatttcggatgaggaagaggaggagggagctgaggacgcgctcgaagatgaagacgactcagaggaagaggaggagggagtggacacggacgacgaggcggcgcttgcctatttgaactcatcgaaagctctcaatgatgaggacgaatcagaggactatgtggaacaacggaagaaaccaaatgacactgcgaaagaggcaacgaacggggaacagaaagccaatgccaacaaaaattctggcgataacagaaagcgtaaactcagcgacaatggcgaggcg

SEQ ID NO: 88861 - DNA, 362 bp, Heterodera glycines
  SCN-specific regions: Sequence locations=1-30,52-340
aatcattcgctgagaatgaaattgacaatattcgccattctgtttgtggcattgtttattgccatcgctgaagcagatggcaatgtccgggcaaaacgccatgaagaacgattgaagcgccaagacaaccgagctgatgaggagaaccgccaggtagacagtgctgatcgggagaagcgccaagacaaccgagctgatcgggagaagcgccaagacaaccgagcaataatgtattaagccattacggatgacattagattttccgacaagaaacgtctactatgaaaatgtttcaataatacaccgaaccttattatgtaaaataatcaaataaaattttaaaaaaaaaaaaaaaaaaaaaa

SEQ ID NO: 88862 - DNA, 589 bp, Heterodera glycines
  SCN-specific regions: Sequence locations=1-589
gtgatacaaataaatcaatgaaatttgacaaaaataacaaaatgaatgcaccaaagcgtcacaacagcgtcagtttcactgacccatcaattttgccgacagaatgccaaaataggacgaaatggcgaagttattccacaaatttccaatcgaattgccatcctcacgggtcgctgttgagttttgtgatgcgacacaaagtgaaaaacggaggccccagcagagaggcggcgatgttcgctgttccctcctcgattccctcacttcccatggccattctccaggcgatgatcgccccgaatctgaagaaaggccattcctcgggtactttttcgttggacggcgagggaccgtccgttttttcgtcggtttgctcttcctccgtatcaacgacaggcgctcagagcaacgctttcggaaggactagcgaatgccaattgggcacaacgccaaatcggtcatccgacgatttttgcgtttgcccttcgccgtggaaatacgcgcaatcggaggaaaaagaaacaaatggatatttgttcattttgcactcaaattgggcactgcaaaaggaacgaatggaaaatcgacg

SEQ ID NO: 88863 - DNA, 590 bp, Heterodera glycines
  SCN-specific regions: Sequence locations=1-488,510-590
ttaaggttttgttttcgttttttgataatttttggcaatggacgaggacgagaaagacccggacacttacggaaattggcaatatgaggagaagccatgtgcctgccattgttcgtatctgcgtgccaagaaattctaccgagttgattgtgacttcatggaccgcactaccaaaattgttttggatgctttcttatcggatactgcgctcagcggactagacattacccacaccgctttggaggtgcactacgaatgcatactttgtctcgaaattgcctacaaaacttacgaaattgtgtgtgaagacgaaacgagtgacagatggggccgttacatgacaacgtacggagatgagcccatcgttggcattcgcaccacggattttgatggcattcagcgcgtgtttgatggcatgtggaaggactacaatttaattgtcagcaattgcaagcattggaccgatgatatgatcagacgtctcagttaaagcagaaattcccataaataaataattcgatttgatggatttcacaacggaattcgaagttttaattaaatccattggaatttgttaattgaagcggaaa

SEQ ID NO: 88864 - DNA, 781 bp, Heterodera glycines
  SCN-specific regions: Sequence locations=1-24,46-142,172-743
acaataaagttgttttcgttcgttataaattcacaaataaatctccaaaatgctcctttcttccaactttgttggcgttggccgtgtcgcgtctcgtgccgttcaccgtttcttcctgtcgacttccgctgtgcgccttcagcaacaacacaaagaagaagaaaatatggacattgaaaatctcttctcggaacagcaaaatctgccgcaatcgcagagcgaagaccaaccgcaggtgttcgatgcaccgaagcgtcgcttcaacaaaggaatcaaccgtgttgaattgttgggcggtgtcggcagtcagccattggtaaaacagaccgcgcaaggctccgcttttgcctctttcaacttgtacacaaatgtggagcgtcgacttggcgatggcaccacaacgaccaacacggaagtgcacagtgttgtcgcattcggctccatggccaaatacgtggagaaaaacgtggaacggggcactcgtgtctatttgactggccgtcttcactacaccggcggtgcacttttccccgacgggacgcgctctccacgtatttgttcggtgaacttggaaagcatttacccgctctccaagcaaggcgcaattttgcgttaatgcgagtgaggcaattagaaaacgaattttggcgatgatggttgaattgaccagatgatgagacattttgatgatttgatttgtttttgtttattttttgagtcgttgttatgtcgtacaataatagaaaaataaaaaaaaaaaaaaaaaaaaaaaacaaaaaaa

SEQ ID NO: 88865 - DNA, 632 bp, Heterodera glycines
  SCN-specific regions: Sequence locations=1-9,32-400,424-608
ataagacagaaaattatttaacttattccttaaaccaaaaaatcatggttcgtcgtggtggtcgttcttcttcaccaaaagctagcgctccggttcgaagtgtgaaaagcacttctcctgctcgttcggccgttccgtctcgtcctgctggtactcaaccaacttccggtgcaacggcaccgcagcagaaagggcctgggctgctcggacaaatggctgcaactgctggaggagtggcgattggttcggcaatgggtcatgccatcggtaatatgttctctgggggtaatgctcaagaagtcgctgctcagcaagatgttcctgccaattcggacaactttgaaaccaccaagcagtactcacagccctgtgagattgagtggcgccagtttcttgagtgttctcagaaccagagcgatgttagcatatgccagggattcaacgacctcttcaaggaatgcaaagctcgctttggccgttagaccttgaaggaaggaattagaaccaatgagaaacgaagaggacgatttatgtgttaactgtccaacggaacattgctattattgatatatgaattaggtgttgggacataaagcatttcttgcgctaaaaaaaaaaaaaaaaaaaaaaaa

SEQ ID NO: 88866 - DNA, 844 bp, Heterodera glycines
  SCN-specific regions: Sequence locations=114-123,174-195,217-226,369 -393,428-454,510-510,535-536,576-772,794-821
aagattcaagacaaggagggtatcccacccgaccagcagcgcctcatctttgccggcaagcagctcgaggacggtcgcacgctgtcggactacaacatccaaaaggagtcgactctgcatctcgtgttgcgtctccgtggtggcatgcaaatcttcgtcaagaccctgaccggtaagacgattacgctcgaagtcgagtcctcggacacgatcgactcggtcaagaccaagattcaagacaaggaaggcatcccacccgaccagcagcgcctcatcttcgccggcaagcagctcgaggacggtcgcacgctgtcggactacaacatccaaaaggagtcgaccctccacttggtgctccgtcttcgcggcggcatgcaaatttttgtcaagacgttgacgggcaagaccatcacccttgaggttgagtcgtcggataccatcgattccgtcaagaccaagattcaagacaaggagggcattcccccggaccagcagcggttgatttttgccggtaagcagctcgaggacggccgctttgtcggattacaacattcagaaggagtcgaccttgcacttggtgttgcggttgcgcggcggtcagtaaaagtgctcgtgtttgcgcgtgcggtccgccctcattgctctcgctcgcccctcgcccttatgatgacgctttgttgtccttgtgttttgtaagagtgtgagtttgtacatttattaaccccctcacgccatccagcaatcttcccccgtcgagttcgttttactgttgtttttcacaatttgaaaacttgtttatatacattccaactcgtctctcgaaaaaaaaaaaaaaaaaaaaaaa

SEQ ID NO: 88867 - DNA, 393 bp, Heterodera glycines
  SCN-specific regions: Sequence locations=1-336,359-393
gaaaagatggcttcttcctcaaatgctcagcaagcggccgcgttgcagatggtcgcggatttggagatcgaaatgatgacggacatgtaccggcgtatgactaaaagctgtcaagaaaaatgcgttgatactcactacagggaggccgaccttaccaaaggggagtctgtgtgtttggatcgctgtgtttccaaatatttggaggtccatgatcggcttggcaaactcctaacgcagatgacgcagcaggacgatcgtgcagttcaacagcagcagcagaatttggcagcggctgctcaaaagatgcacatcaacaaatgattagattgtctcaccgttgatttttgtcattgtttgctcaattcccaaaattaaacaatgctaagcgaaaaa

SEQ ID NO: 88868 - DNA, 962 bp, Heterodera glycines
  SCN-specific regions: Sequence locations=1-45,68-189,226-962
gttgttaataagtgccaatgactttccctaggaacagtttgcttcgttctccaagaattcgaccaaatttgctcaatttttccgcgtgtttctcctcaccctctgatggcagtgctccccgattggaaggttcttcaccaccaccgttggcatcttcaattcgcttcccccactttgtttctcgtcagaaatttactctctcttccacatatgaaaagcaagactggttcccaaaacacatgggcgttcaactgaaagtaatggagggaaaacttcgaaccgtcgatttggtcattgaagtgcatgacgcccgggttgccctgaccggaaggaatccttcgttcggtgccaaattatattcagtgcgaccgcacattctcgtctttaacaagatggatttaatcaacatgaaacgctacaaggaacccatcgaagagtactaccggaatgagcagaacattaccaatatttgctggacaaattgcaagaatttgacaaacaaaacgcagtttcaaaatttgatggacaaaatgttggatttgttgcgaaatgaacatcgcttcaacagaacagtgaagacggaataccaagtgatggttgttggtattccgaatacaggcaaatcctcgttgataaacgcattacgcaatgtgaatttggactttggaaaagctgtgaaagagggcgcgaggcccggcgtgaccattcgggtgcaaaaccgtgttcgaattctcgatcgtccgcccacctatctgatggacaccccaggagtgcttaacccatgggctaacaacattgacgcggcgatgaaattggccatttgcaatttggtgttggatacgaccacacggcccaatttcgtggccgattatttactctattttatgaataaatatcgcgacttttcctacgtcgactttctaagaatcagagagccatccgacgacatcaaacaagtgctc

SEQ ID NO: 88869 - DNA, 787 bp, Heterodera glycines
  SCN-specific regions: Sequence locations=1-100,122-787
caaaaatattttttcctttctatgtttataaagaaaggccaatctaacgttttaaatgcaatttttatgccattttatttgtgtcgtcaaaatgcagcagcttttgttttttctgcttttggtggcggacatttcgcacggaaaagggcaaaaagaggaaaaatccgaggcaaaatgcgacgaaaaaaataataatgaagcgataaggcttcacaattggggcggcaatttcaaattttgcacccaaaatgtcgaatatccgcgcaccaccgccgaagtgcaacaaattgtgcggagggcacaaaagctgcgcgtttttggcagtcggcacagctacaacaaaatcgcggacagttgcggcacgcttttgtcaacgctcggaatgaattcgatcattgccatcaatggaagccgaccgaccgtaacggtgcagccggggatcacttacacggacttggcaccgacactttatgccaacaatttcgctttgccaactttggccgcaattgccgaaataaccgtcgccggtgccactcaaacatgtgcccacggcagcggactgcccaactccaacttggccacccaagtgcgttccatgcgaattgtgctggccaatggcactgaggcatcttttggcccggagagtgccgaactgcatgccgtcgcgtgcggattgggcgcctttggcgtcatcaccgaagtcaagctgaatttggtgcccaccttcgacacgatcagctacaatttcgtcagttcgccaaccgaaagtctttactcgcattttgac

SEQ ID NO: 88870 - DNA, 644 bp, Heterodera glycines
  SCN-specific regions: Sequence locations=1-644
attttgcatccacgtgtcatcgaatgggaaaagatggtgcgcggactaatcaataaatcgcgtgaagaacaagttgagcaacagcaagaagtcattcgtagcctacaagaagagaaccgttcgttaaaaacattgtttcgacgtgtctgtgcgcacagcaataccatcagttctgccttactaatgttcgcagaagatcacccggacactttccttcagcatccgattcttttgccgcaacaacaaaatgtccccacgccgagtcagctgcagttgttgccaactcgccatgacaacacgtcgtttagcgactcatggccaatactcggcggagcgagccaaagcctgacaatgcgtgcaagcgagacgtttcgaaaaacaactcacccgccaccgaatcttgggcttcatctgtttggcattcaagaagaggcgattattcccggtggaactgttgcagtgacgaaagacgccgaagtgacaccggcgagaaaaggaaagccgagcccgaagaaacaccgtccgtttcgcaatgttttcaaagctttgggcgacggcgtgtcgaaactgaagttctctacgcgaaagcgcccagagaagcagcagcacgggacgacactgtccgggacggatcagcgccgacc

SEQ ID NO: 88871 - DNA, 604 bp, Heterodera glycines
  SCN-specific regions: Sequence locations=1-604
gtttgaggagaatctcagcatacaaatacatattttttgtccaaattcccgtccattgttgtaaatacacaataataaacaaacgatgagtgacacaaatgtggtgaccaatttcatcgctggcggcgtcggcggctcatgcgccgtcatcaccggccatccgttcgacacggtcaaagtgcgactgcagacaatgccaaagccggcgcccggacagccgccactgttcaccggtgcgctcgactgtgtgcgccaaaccgtggcacgggagggattttttgcactttacaaaggcatggccgccccgctcgtcggcgtttcaccactctttgccgttttctttggcggcactgcactgggcaaatggctgctgcagaacgagccgggccagcagttggacttcaagcagaatttcacggccggtgccattgccggcgtgttcaccaccgctgtgatggtgccaggcgagcgaatcaaatgcattctccaagtgcagtccatggacggcagtgccggcacaacgcccaaatacaccgggccggtggacgtggtgcgcaagctgtacagagagggtggcattcgcagcatttaccggggcacggcc

SEQ ID NO: 88872 - DNA, 1036 bp, Heterodera glycines
  SCN-specific regions: Sequence locations=1-1036
ttgagatggtcgaatgttctgattgttcggttggcgttgcgaaggtcaaaacggccaaagatgggctcccccgttgttcggattgtttcatccgttggtttgagaaagacgtacatgaagcaattgaaaggatggcaatttttacgcccggcgacagaattggcatcggagtgtccggtggcaaggactccacggtgttggcacacgtgctaagtcggctgaacaaaaggcattcctatggattgcaattggtccttttgtgcgtggacgagggcataaaaggttaccgggacgactcaattcgcgaagtgcaaaagaatgaagcggacctttctctgccattgacaattaccagctacagggacctttatggatggacaatggacgaaattgtggccaaaatcgggcgcaggaacaattgcacattttgcggggtgtttcggcgccaggcgctcgaccgcgcggcactccgtgccggctgcaataagttggccaccggacacaacgcggacgacgcggcggaaacggtgctgatgaactttttgcggggagacattggccgactgcaacggatgggcgctgcggcgcgtcagccgacggacaaagcgacgacaaaacaattggggaacaatagcgacgacagtggaacaacctcagccgtggcggcagcagaaacgggcgacgacgagtcattgccgcgagtgaaaccgatgaaatatgcgtacgaaaaggacattgtgatttacgcacactttggcaaattgaactatttctccaccgagtgcatctacgccccaaatgcttaccgttcaaatgtgcgctcttttgtcaaggagttggaaaaaagtgaggcctctggcatcctcgacctgggtctcctcggggaatccactcgtctgaaggcacacgttctccagccaaactggggaaatggggaccgttggggataccatgccaagccaaaattttgcagggggggccaacctttggatggactgaatgttaaacgggggccccccccaaaacaagggcaaaa

SEQ ID NO: 88873 - DNA, 784 bp, Heterodera glycines
  SCN-specific regions: Sequence locations=1-784
aagcaaatgggtctttgtaagtgcccaaaaaggaaggtcacgaatttgttttgcttcgaacatcgcgtaaatgtgtgcgaattttgtctgctttcgaatcacgaatcgtgtgtcgttcaaacgtacctttcttggcttaccgacagtgattatgatgccaattgtttgctctgtttcgaatcgcttagctccaaagagacattgaggttgaggtgtcttcatttattccactgggactgctttgattcgcgggctcgtcagttgccccaaacgacggctcccgccggttacaaatgtccgagttgtttggaatgcattttcccatccgaaaaccaatcgtcaccagttgttgacaaactcagggccaaacttcagacagtcaattggggtcgctttggtcttggccttcccagtatccccgaaaatgagcaaaaagttttggctgccaaagtcattgaaatcgcttcgaattctaatcaccgaagcgatgaaaatgtcagcaatcgtcacattgaagctcacacacagtcgccaatgatcgccaattctattacttgccatgaagatccattcgaagcgaacactttcactgcgaggtccaaatttcccacgaattcaaatggcaattcttcgaacagaatttttatcggtaatgaggacgactcaaaatatgcgaaggctgctgcggcagaaaaaaatattcggaatcgcttcgttcggcttccccgtcctctcaaacgtgtgttctttgccttactcgtcatcgctttcctttacttcttcc

SEQ ID NO: 88874 - DNA, 394 bp, Heterodera glycines
  SCN-specific regions: Sequence locations=24-394
cacaacagcaacaacaaaatgatggcattgccttccgacattccctcccatgtcagccgaactcggcgagcagttcatcgacggaggagaaaaggccccgcggcattgcacccggctcagtgcagaaactacaaatgcaaaccaaagaaaacgaccaacgatcggattcgtcggctgctccgcctgacccggagacggcacgacttttgcccggccaaatacatcacttgtagaacaacgacactacacattaccacactaatcactcattaaacataattatattatgcactttggccgagtcccttcccaaattcccattgctcattgtcttgtcgtcttaaattgtgataaatgacttaatgatttaaaaaaaaaaacaccaaaaaaagaa

SEQ ID NO: 88875 - DNA, 123 bp, Heterodera glycines
  SCN-specific regions: Sequence locations=1-100
gaagatggtccacgatgtgagctcaaccgttttgttcctttgcctgattatccatcgatgtgtgaaactgtagcattagtagtactgtattgtcgatggaataaaaattttattaaagaaaaa

SEQ ID NO: 88876 - DNA, 463 bp, Heterodera glycines
  SCN-specific regions: Sequence locations=1-372,394-463
gtttgaggaaaaagtaataaaaagatgcttgttcgccaaaacaaaattatcgctgccgctgcccggggcgttttgttggtttccaaccgttcgacaacgcgtacgcctaccatgtgcgcaccgccaatgcgttgtccgagtgttcctaaacggttcggcatgttcttcttttgctgtgtgtccattttgggttatccgacttatgtgatgctgaaccttgacaatgtgcgtccgttcaagcagacgcacttcaacgacgagctcaatgagaagctggaggagcgccgtcgcttacgtgctgaaggcaaattgaacgttcttcaaaagaagctgtgagcacaaagatgtagaaaaggaatgacaattatagcggaagatgattaattttgctgacaaaacattgtcaaatttagtgctatgaaatatacgtgatcgtataaatttgtttttccaaaaaaaaaaa

SEQ ID NO: 88877 - DNA, 635 bp, Heterodera glycines
  SCN-specific regions: Sequence locations=1-635
aataaattcaaccttaaagaaggactttttgtcttaatcaaatggttcgaattttgttgccaaacggtgagtcggccaacgtcagtccttcagaaagtgttgaagaagcgattaagcattgcgttggtggagatatttcatcgcagaatgactattcattggttttctttggtcgcaaattaaactccgaccaacgcttagctgacattccgcatttggacggcgagtcacgctcagttcgattagtctgccgaaaatcgcccggtgttagcattgaaaagaacctggcggatgtggacaaactgcggtcacaatgccgaactttgtaccagaatcttggcgaggaacttcagcaaaagctggagacatatatggtggacgataacaatgccatattcaattccattctcaaagaccatcccgaacttgtgcatgatccgatcgcccttcccattgtcaaggatttgcgactgctggtgcctgccatcattgagaaccataaatttgcctacgagcgtcctgtttgtgccaagattttgaagaaaactttgctccaattcggcataatgcagcaagggcccgcagattcgtttatggcacaacagggagccaatgggtttccgggacaacgaatg

SEQ ID NO: 88878 - DNA, 826 bp, Heterodera glycines
  SCN-specific regions: Sequence locations=1-633,656-826
aagaaagggcttgtccttcaaggtggttgtggacatgaatggaaacacggtggtgtacaacgacagggacgtgccgatagggacgggttctgtgcggaaagtgggcgaacgatcatatgaggcggtgatcagcaagaatctattcatcactcggctgaaggatgtccggaggggcccatgctgcagagagttgacgggcgaagaatgcaccgaacccattaagttggccaacccgcagttcagtcacccgagccaaagggacgacaatggcacgacgaggctgacctggcccgactgtttcgacatgtccatcgatgtcactttgccaccaactgttcatatcaatcggctggccatgaactattggcagaagcaaggcgcaattgacgtgtggatgaagttttttgaacgggcgcccaaccgagcggagatggaaaaagagttcttctcgcagttggacaatcctttgctgggcaaagccttcaaattggccatcatcggcgaatggttggccgccaacagtttggaccagggaagttacacgccgaccaactcggaattgttggagttttgggtgtcaaaaagagcgcccgaccgattgttggcatgcgagcacggcgtggtcgactacgaaattgagggctccaaagtgaaaacgaatgttttgttcgaagcggcaacgaccgcaggaaatttgccgaacattttcaaggacaaaaagtgtgccacgtttgaaaagttgcaggaggaacggttcaaacaggaagtgcacgagttcaagcagcgcgggagcggcggaggcattatcggcagcattggcaacttt

SEQ ID NO: 88879 - DNA, 603 bp, Heterodera glycines
  SCN-specific regions: Sequence locations=1-1,23-603
caatctcaaacataaataaattgaatatttgcaatggcgtcaatgtcggatcggatgaagctgatgctaagctcgggaaagggcgccgatgtgcactttttggttgggcaaagcgacgcgaagaagattctcgcagcccataaaacaattctgatttcggcctcggatgtgttcgagacaatgtttcgctttgacgccaaaaatgcaaatgttggaaacgtgaacaatcccgtggaggtgcccgatgttgaagttggtgcattcaatgtgatgctcagcttcatttatgccgacgatttgagccaattggacggagacaacgcaatggcagtgcttaacacggccaaaaaatacaacatcactggactggtcactgccattaagaacatgccaattgcgaagatatgcggcgacgttttcatgacattggcccaaagtcgcctatttgaggaatcggatctcgtcgagcgttctttggcgtacattgaccaaaatgcggacactgtgctcaaatcggaggaatttctgcaaattgaccagcaaacgttgtgcgaaattttggggcgcagtcaattggcggtggaggaggaaattacgatttgg

SEQ ID NO: 88880 - DNA, 610 bp, Heterodera glycines
  SCN-specific regions: Sequence locations=1-205,227-279,301-610
gagactttagctcaaatttcttagagaagagtgcgttctcttaatttttcaacaaaatttatgtgctccgacaacaacgaattgctgaaggacccttccgccgcccacaaattgacgcttttgttggccaaccgccaccgttgtcataaaagcagaaaaactttggccgattttttacgaaaaaaatttcattttcataaccgtcgtgtgaaaaactgtgccaccaatttgacgacgacgacaaaattttttaccgatattagaaagggttgttacacgaaaagcattgaaagaggaggaggaatagcctaacaaaagtcgaggacaaagtgccgaaagtcgagacaaacgaacaaaaaaaagtgacagaaaattttgaaaaaaaaaatggggaagaaacggaacaccaacaaagtgtcgttggcattgccaagtgtgtcggcactgtccgctgctgctgcaaatccaaaaggtggtggtggcggttcggtgtgtggccgtgaacggttggagttgctcagcgaaatggacgagttggaaagtgtgcactcgtcgatgaccggcggcggagcggacattggcggctgcggtgattccgatggcgaaaaca

SEQ ID NO: 88881 - DNA, 403 bp, Heterodera glycines
  SCN-specific regions: Sequence locations=1-345,367-382
cggaaaagtcactttcaaaattactttgacaagtgatccaaaatcgccgttcaaagtactgagtgtccccgaaaatgctccgttcactgccgttttaaaattcgccgctgaggaattccgagtcgacccatccacaagtgccataataaccgacgaaggcgttggagttaatcctgcgcagaaagcatcggacattttcatgaagtacggctcggaattgcgactgattccgagagacagagttggccaaggcgaatgaaagaggaaatgggtctaccgacacacgcggacatatcatttggcaaaaagggaaactgacaggaccgtctattgagactattgtgattgtttctttgttattttttggtagctaattattcggaaaaaaaaaaaaaaaaaaaaa

SEQ ID NO: 88882 - DNA, 497 bp, Heterodera glycines
  misc_feature (475)..(475): n is a, c, g, or t
  misc_feature (477)..(477): n is a, c, g, or t
  misc_feature (479)..(479): n is a, c, g, or t
  SCN-specific regions: Sequence locations=1-497
gagcgcagcgcaattgatcgagccaaccgggcagaaattaacaaagtgaagatgcgcctctgtctggcattatttattgccgcttcagcattgtcacttggccgatggattgaagctggagtggtcgaggatgtaaaagactacgtcgatgccttttccgaaataagcgcaccggcagcaaccattggcgagcagctcaggaaaatttcagcccgagtttcaaagctggttcagttaggaggtccggtcggaagcctcgcagcattggctatgcagaaagcccttgaaccggagagcgaggaaatggtcgcgttgaaattgttgcactccaccatggtcaagagattcgatgtattggaccgtcgagttgagcatttgggcaataggctagttcagcacatggcattggtcgaatatgaccatgtatgagtattactattcgattaattactgtgttaatatatttaactagacnananaaaaaaaaaaaaaaaaaa

SEQ ID NO: 88883 - DNA, 620 bp, Heterodera glycines
  SCN-specific regions: Sequence locations=1-192,214-397,423-510,538-620
aattaagaaaaaataatttgctgttaatttattttccgccgctacacaaattctccagtattaccgaaaaaacgacctcaaaatgagaactgtgcaaaccgcacgcaaaagcaccgggggaatgccgccaagaaagcaaactgcgcgcaagtcagcaggagggtcagggcagcgactgcaaactgcacgcttgccagcagcaggaggaggggaaccgattctgggcactgcgcgcaggtcagccggagggtcaggacagcgactgcaaactgcgcgcaggtcagcaggaggtgcagcaccgcgaccgcaaacggcgcgcaggtcagccggagggtcaggacagcgactgcaaactgcacgcaaagcagcagcgggaccctccctacggaatgatgtggctgatgaggatgatgacgatgaatcggtgtcagaagaaatggaggagtcgtctgaggacaatgagccgccccaacttgttcaagaagttcaccaaggctgacggcatttcggagatggcacagcagcaacagcaatcatctgatctgattgatcgatgtcggatatttcctcggcacacaaaatatttgattgtttttttaattaaataaatctgatccaag

SEQ ID NO: 88884 - DNA, 499 bp, Heterodera glycines
  misc_feature (477)..(478): n is a, c, g, or t
  SCN-specific regions: Sequence locations=1-39,70-478
cgagtgttgttcatctgtttctgcttctgacaatggcactgctccttcttcctcctcctcttcttgggctgagttgggtctttctgatgcgactcttaacgctcttggcacaatgaatttcccttttccaactccaattcaaaatgctgtgattcctatcgctgttaaattgaaaaaagacataattggtgcagccgaaacgggcagtgggaagactctcgcatttgccattccgattctcgagcattggctgaccaatgcaattgccacaaatgtccaacattttccggtcaaaggctctctttttgcgcttataatttcgaccacgagggaattggatgttcagcagggatgtgcctagggcaacgaacatttggcggatttgtccgcacttcgatttttggttgttgatgaaattgatcggatgttggagcaaggccattttgagaatttcaagaaaaagaaatttaaaatttnnaaaaaaaaaaaaaaaaaaaaa

SEQ ID NO: 88885 - DNA, 533 bp, Heterodera glycines
  SCN-specific regions: Sequence locations=34-269,291-533
cctcgtgccgaattcggcacgaggcgtcaacgtaaagaaataaagtcatcaaacaaacatgccgaaatacccgtcgtcgattgccgccgttgcgatcgtgggcaagctcaacaatccgctgctcgtccactcgttttccaacgacacggacctcaagtatcagtttctttctcacgcggcgtgcgactatgccgacgcggccttgaactccgacaccgtatcaggatctgggtacttgggcctcctcaccacattggacgacctcaacgtattcggccaccaaacaaacaccaaagtcaagttcttcctctttgtccaatcgggcatctcgccctcgacccaggcccagacaaaggacgtcgaagtcaaagcggcattcgaactcattcaccaagcctacctcgacctgctcgcaaaccccttccatgacccagaccaagtcgccatggtccactcgccgcggctactcgcccgattgcaatcctttgtcaccgcctccccgtcatcacaataaataatcaatacctccaaaa

SEQ ID NO: 88886 - DNA, 616 bp, Heterodera glycines
  misc_feature (451)..(451): n is a, c, g, or t
  SCN-specific regions: Sequence locations=1-570,593-616
gcgagatgcacactcgacttgacagtataaaggcgtcctgcaattcgggtccttcaagctcaagtctggtcgcacctcgccctactttttcaatgctggtctctttaacacgggcgaccttctcaaccaagtcggacggttctatgcatccgccattctcgaccacgaggccacattccgcccatcagtactcttcggtcccgcgtacaagggcattccgctcgtcgccaccacggccgtcaacttggccgtcatgggccacaacatgccctacgtgttcaaccgcaaggaggccaaggaccacggtgagggcgggtcgctcgtgggcatgtccaagctacagggcgagcgagtcttgattgtcgacgatgtgattaccgccggcacggccattcgcgaaagcttcccgctgttgcgcgaccacaatggcgccaccgtggccggtgtgttnggtggcgttggaccgcatagagcgccgacagggcgagcggtcggccatgcaagaggtcgagcaggacatgggtgtgcccgtgcgcgcgattgtgactatggagaacatcatcgagtacttggagaagaagggtgggcaggacgaggcgcttgctgccatgcgcga

SEQ ID NO: 88887 - DNA, 888 bp, Heterodera glycines
  SCN-specific regions: Sequence locations=1-37,59-357,379-888
gagaaataaagcccttgtttaatttaaagcaatttaaaagataaaattgaaatgtttgggctaaaaaccgcgcgaaatttgcagaaatatgttcaagtcgagtgggaagatggtcttttggcaaagttcaattacgtttggttacgcgacaacgcccgccggagtccgtcgttggaccatctcgacctcaacgcgcggccccaggaaatcaaatgcagcagagaggcactcgaagtgcaatggccgccattcattgcctcaagatacacttccaattttcttcgtgacattgccctcgatagccccgtggaaaggctttacggcgctcatagaggcagacaaaatggtcaatttggcaggtcaaagccatcgatggctggcccactcaatggccatttgctggctttttctgacgcgcgagtgccaattgaagacggaatcgaattaggcaaatgttactggggagaggaagcgcaagagccgggcacaatttggccgcacctcgccaaagtcccttcggttgttgcggtggacagtctttccgggccggctaggctttccttcgtcgacgttgagaaagtgctcatcgaaatgaggaagcgataccccaaacatttggtcttcctcgggacttgtgttctcgagtacgccgagggccctttcttcgcaactcatcccgtcgttagggtggacgaccaaggccatattctgccgtagggctttttcaacaacgccgcgcgttccagcgcaattaccgtccattccctggacgaactttacgagtcgctgcaaaagtttggccgcgtttgcgcagaaaacatatgcgacattcagctgatgcccggacaacgactcttcttcacaatatccgcggaatgatcggtgcgc

SEQ ID NO: 88888 - DNA, 840 bp, Heterodera glycines
  SCN-specific regions: Sequence locations=1-817
caattaagcttatcaatttttaccctttccacttaaaatgacttatgtttcggcccaagcgcacaatgttttgtcggacattgacaagaagttgcatgagaacaatgcgttcaccaatttgctgggcaaaattgagaccaaaactggcctcaaacgtcttcacgtctttggagccttggtcgtcctttacatgctttaccttctgttcggtcgttgggctcagctggcgtgtaacatcaccggctttctctacccagcttacatctcaataaaagcgattgaaagtcaccagaaggaggacgacacccaatggcttacctactgggtggtttttgcgctgcttaatgttgtggaattcttctccaacaccattctgtactacttccctttctattggttgatgaagtgtgctctgctgttgtggctgtacttgcccagcactttgggtgctcagctgttgtacacgcgcattattcgtccgttccatcttcaacagcacaagaacattgacagcatgtacaacaaattggctgggggtgcacaaaaggcatacgaagagcacgtgaaagagacctgaacaatcgtcagaacaagaagatgaagaagtacactttttgacatcacctctctctctgatttcgtatattacaattcttgacaggaaactttacccattttttgctgtcttaccaatatttgcgtctcttttgtcgtttgctgttcatttggctttaaaataatactctcgcgagacaattttgctatgctttgattatctctctgatcaatttgcagttaataaacttatgctagtttgaaaaaaaaaaaaaagaaaaaaaa

SEQ ID NO: 88889 - DNA, 634 bp, Heterodera glycines
  SCN-specific regions: Sequence locations=1-634
attgttacaaaaatgctttcttcttccgcctgctgtactctgttggccgcgctcatttcggcggcgtttttcgccgcggctaacccaccaacggtgaagcagtgcttgtgctccgaaattcagccctgcacccaaaagtacatgaacacgtggaaggcgtgcatggagcagtgtaagggccatctgtccggcgtgggtggcaacgtggacaaattgggccactgcatggacagcaactcggcactcctccaatcgtacaatcaaatgcacccaatcgcatagccaaacggcatgtgccaaatcggcggcatcagctaaacaggtgccaaagcgataccctgaaacgttggaaattgctacaatcagtgagatcaatcggatggtcaacagcatgggcatcgaaggcgcaatgaaaggtttgatggatgccggcaaaaaaatgtacggctgcacgagcaaatgcatgaacagcaaggcgggcaactgcgagaagtcgttcaagtgcggcttggactacccgccggacaacgtggcggtacaggaagtgaagaagtgcgccctcaacagcggactgaacaccgccaacgcgcaagcgctgtgcaaatgcgcgtccgccgcgggcgttaaaaatttg

SEQ ID NO: 88890 - DNA, 803 bp, Heterodera glycines
  SCN-specific regions: Sequence locations=1-803
caaataagtaatcaaagttaaaaatggtcattccatcgtcacttttctctttgatggaaattcggaaaacgaagaccttctccgtctctccctcttcaatctccgattctcctcccaactcttccgctgacattgcttcttctctgccctccggcgatgacgaagtgtacgacaccgccttcatctcgcgcggctcaaattgtgtggcggtggcgacaaacagtgcggagttgcgcatccattgtttggactcgggcgaaagtgtcggcgttggccatggccattcccaaagcattttgtgcgttgactcgccgagttgggacgatcaaatggtcgcctccgggtccaaagacaattccattttcttttggcgcattggtggagtgaagacggactcggccagcgatgggcaccaaaatttgacggatgcatttatggccgacaaaattgcagtggccacagggcacactcattccgtggcaagtgtcgccttttcccactccaaaagtttgccctttctcgtcagtgtgtcgacggacaccacactgaaactgtggcccctctccgaactgattgtcaagcaggagaagggcgaacagcagcaacaacttggagatttcaaactgtcggcctccgccaccgatgtggcccactccaaggacatcaacagtgtggacataagtgccaacgacagactgtgcgtgaccgcgtcaatggacaagacggcaaagctttggcacatcgaccggaagactggccaactgagcgcgggtgggacactcggaggacaccagcggggcgtg

SEQ ID NO: 88891 - DNA, 602 bp, Heterodera glycines
  SCN-specific regions: Sequence locations=1-602
gttaagaagaccacttaaattttaacgaatattcgtgatggaaaatgcgagattggagtcttttgctacaaagaaacgtgataagatcatacaaataacgaaggagcagtttctggcgcccatcaaggacgaatatgtacggcgactgtcacaaacgcccattgaacagattgtcgatgacggatataacccaggcccacaaaaaccggacggtacggtgaattttgagtgccattgcgttgcccatctggtggccagcccgtgcgggcacgacttccgcaaagcgatcagttgccaaaaagcggccaccgacgcggagttggagaagggcaaatgcacggaggagttcttctcgttcatgaaatgcgcgatgaaaactcagtgcttccgatcaagagatgaagaaacactcaacgacccattgcagcctcaggacgcggagggcgatcactgatgagaaggcgggaagaaccactggtgatcaatcacaatctttgttggtctgcatattttcatttcatgttttgttattttttgtttaaatattgcacgttttgtatttttttaggctccgattggattaaaaaacaagaataaaaaaa

SEQ ID NO: 88892 - DNA, 560 bp, Heterodera glycines
  SCN-specific regions: Sequence locations=1-175,202-476,534-560
caatagtcgctcatttgtcgccaaatcatgcgactgaatgtactgctcgcaatcctcgcccccctcctcctgctaattgcaacagcaacgctttgtggtgccaccggcaaagaagcggcggccaacaaaatcggtgtcgccgccgtcgctttgtcagaggcggacaattcgacgacgccggcgccaccgccgccgccttcgccgggtggcagcgatgacaagaaaaaggacgatgacgataagaagccggacgaggatccggcaaaaaaagggcaacggaacggacacgggcgacgacggcaaaaaaacggacgaagcgggcggagcatttggcgcggggtccatttttgttgccattcttttcggcatggctttgatgttcggactgatcaaaatgtatgtccattgggagaagcggcgcgagtcggacccaccgaactatcagatgtattgaaaaaacatggaaagcattgggccaaaacaaacaaagatttccttatttcatttgttgttgttttttgcatcatttttatcacttctcattaaaatttctctaaaaa

SEQ ID NO: 88893 - DNA, 508 bp, Heterodera glycines
  SCN-specific regions: Sequence locations=1-508
atttgtgtacacgcatctaacgattatgagcggcggtcgaccaattaccacacttgcagaggctagggctgactttggcagagctaagggccagtttaaacgtgctgtcatggcacttccaaaccactcactggacggtaccttcagctctttgagcgcctatttcggcttggactcgagcgtcggtgttcagattgttcgtgacttggggctgaccgatccagcagccatttttgaaaaacgggtggaccatctatgtgagatggtgtcagaacactgggacgtccaaatgtttgggcaagcgactcgttacttacgtctccgctctttgaactacaatgatctcgcaggttgtttccgtcgtcccagcacttcgtgaaatctcgcattcgcatcacgaaaaagaagtgaccgttgattttgatgttttcatgcgtcaatttcgtattgttgatgatggtgctctgttgtcgttgaccataaagtcttgttcagataaaaaaaaaaa

SEQ ID NO: 88894 - DNA, 698 bp, Heterodera glycines
  SCN-specific regions: Sequence locations=1-698
ggaggacgagcatggcgccattgcgttggtgagaatgtgtaaggcccacagagagatgacagtggttgcgattggaccgttgacgaacattgcaatggccgttcgcctcgatcccgactttctctcctacatcgacaagctgtacatcatgggcggctcgctcctcgccaagggcaacgccacgcgcactgccgaattcaactttgcctgcgacccagaggccgcccacattgtcttcacgtcctcgaccaagcactcgacacgcgctccgaaaatcgtgctcgccccgctcgagctcacgttcgaccaagcattcgactgggacctgattgcccgcctcagcgacccgtcgcggcacgccgcgcacccgtggtccaagttcctgtaccgcatcacggcggcgctgcgccgcatgttccggtcgcccgcgcacctggatgccgtggcgcaggcaaaggacaagcaccaggcacgacgtgcatgtgccgccgcaccatgttgcgcgtgtggatacgtgcgagtcccattacttggccatttgcgattcgtgcgccacgtttccgctggccgtgcccgagtgtgtggatcggaccgtggatcagcatgtggagattgagttggcgggcgcaaagaccaggggcatgatgatgttgcagtggtgccccggcgcggatcgcagagggttggcaaagaattgt

SEQ ID NO: 88895 - DNA, 626 bp, Heterodera glycines
  SCN-specific regions: Sequence locations=1-192,217-234,256-260,295 -491,514-626
gtttgagatatggcactctctctattccttctgttggtcggaacaatcattgctaattgcaatggtgacccaaagatgaaatctgttgaagagaaaagtgtgccgcctgccgccttttggccttacattttgcatccaaaaacacctcggcataaatcagaagagagggaggattactacgatgccgtacgagcagaagaggaggaggcggagaaggcaacattgacaagcagtacagcagcaaacagaggcaacgaaaagcaacaagaagaagaggaggagcaggaagaagcgagacaattacagcaaatgatggcacttctgttggccaacattgacccggtgccaatgtttaccgccaacagcgaaaagccaaaaacgatagcacaaacgatggcaccgacaaaggcagcaaccgcgttgacaatgtctaaagtggacggggaaacgtacgacgaacggacagaagcgggcaaagacgacgaagagacagacgatgatgatgacgaagagcatgaaacccgcaaaatggttgacacggaattgaagaagcacaaattggttgtgctgccggacggatcggactctgccgatgtccgagaagcggatgcagaggcagacggagt

SEQ ID NO: 88896 - DNA, 662 bp, Heterodera glycines
  SCN-specific regions: Sequence locations=1-242,284-662
gttcaccaatgcttccgctgacaccagcaaaaagattcgtctccaaaaagcattgtgtcgattcaattcgatggctctctctccaaaggacgacttttgcgaagacaattccgcccggtccgcttctgttttcccatgtttatttgccggaacggacgccggacggacagccgcagcgcaaaccgtccgaacacccggactttatgaaatacgatttcatggcggatcccgaatttgaaaaaccaccgccgccggtcgaactttttcttcttgaggatataaaagaccttggcgaaaagtttgacattgtcaaagtgtccgccgaagtcgcgcgttgggatttgctgctgaagcgaagggcggtgtacgcgtcgccgttcaatttgaaatattacgcggagaagagaaagaagtatttggccgaaatggaaagtcgtgtgcgcattccgctcgatttgctcaaaatgtcggcacttctcatgagccaaattttgcctgtgaccgtttccgcggacgttgagtggacgctgagcagtgagatgctgatcaactccacccagagcttgggtttgtacataaccgagccgggcatcatccatttggacaatgtgtcgacactcaatgggccccgaccgaacattgagggccgtctggttccgttt

SEQ ID NO: 88897 - DNA, 536 bp, Heterodera glycines
  SCN-specific regions: Sequence locations=1-536
ggaatagccgcatggcaaacgacgtttggctggacactctgttttggattgaccgcactgaggctggtggccacgcatttcaaactgcccaaatggaagctgggcgagctgggcattcatcgggcaccaagcggatgggactggggcggcacggcgactgtcaccgttatggacgaccacccgatgatgaatccactgccgcttgccaagtgtcctgcaccgaacggcgtgattggcttccgtgccatctacatttggtgcgtcgacctggaagtgatcacatttctgcagtgcctgcaacgcgttctcaacctcggcatcgctgtgcagttcaccatccattcgaaggatgtccgctgctggtatttcgaagcgccgagtgccatttcggtcaattacgtcgtcgtttgtcatcgcgtcgcaacaccgaggtcgttgagcgggagaatgaacggacgggcgagtggctgacgctgcgttggcgtgtgcccgcggaggctgtggttgtacgccagcggagcggcacggatcggcgc

SEQ ID NO: 88898 - DNA, 642 bp, Heterodera glycines
  SCN-specific regions: Sequence locations=1-228,250-642
ctcatttgtccattttgccattccgatgtctccaccaaaacgtgccaaagtgtcagccgatgatgatggggagacaatttccgacgacggggagccatcaacgtccgcgggggcaaagcgaaagcaaaaggcgtcgaaaccacgccagcggaaggcgcacgaggcattcattttgctggtggacgtgggccgttcgtctgccgaaaactcggcgggggcacagagcgatcacggcaccaccactgacctcgaccgatcggtgcaaatcgtcgattgggtcctttcacgaaaaattttcaccgaatcctccgatcgcttctctctgatgttcttcggccacgaaaacacgtccagcgacgaccatccgaatgtttacgtgcacaacgaacagttcgccacggcgcgggtcgtaatggctgcacgtgttgcagaacgaagtgcagacgaacgtcaaatgccccggcgattacgtcgacgccctttacgctgcgttggacgcactgaaagtgcactttgacgacgcaaaagaggcgggcgaaccgatgagcggagcgacggtcactttggtgagcaatttgagcggattggacgacgagcgggcggtgatggacggagtgggtgacatcgcggccggcttcaaag

SEQ ID NO: 88899 - DNA, 623 bp, Heterodera glycines
  SCN-specific regions: Sequence locations=1-10,32-623
ctttagggtaaaggcctaaaatgaacaatgaccaattgcacgattggctggccgaccttcacggacgcttttgtcccggcagataccgtcagcaactgtcgtccgatggctctgacgtcgtcgctccgccggcgaatggcgacgcgtcgacggccccggcggcgctgtgcccttcgcccgagtcgccctcccaatggcgcccttcgctgtgccatctaagcccccccaccaacattttgctgcagtatttcagctgcaatttcgaggacgctcggctcagctctccgcttgtcgcccaattgctcgctctttactacaaattcggcgccgcgcgttgttttgtgcttcaattggtccccacatttatttatttgtacctcaaagcgttaaacaagcggtggctgaacgcggcacaaatgctcgagacgctctttttggccatttacaatgaggaaattttggccgcagggcccggcactccgtcgatggtcaaacggtcggaagaggtccttttgcctctgttgcgcagtgccagcgttgtgccgtcgtcggctgccgactttggcaccatctctggcggcagtgttccggggaaagtgaacatttgtccggagtcggccagc

SEQ ID NO: 88900 - DNA, 614 bp, Heterodera glycines
  SCN-specific regions: Sequence locations=1-79,101-614
gtttgaggacaaaatcacaacgtaaatcaaagaatgtcttcaaatcctgtagaagggactgaaaacttgggccaactacgccaaacggcaccacaacaaacgactgccgcggatccgtcgtcattgaattcttcgaattccgctgccgttgaatcaatggattcggagggtgtttatctttttgctgaccgtacccaatcctccaactcgctcacccccgaacaggccttcgtccacatggtcaaggcaatgcttggcaccggacttctctctctcccttatgcgttttcccattctggtctttatcttggtttaatccttttggtcttaatttgtcttgtttgtatgttttgcatgcggcaaattgtttttgcggcccattacatttgtacaaagaatggtcgtgagattattgactatgccaacattatgcgtggtgctgttgaggcagggccgtcatggatatcgagcaggggatacttcttcaaacagcttgtcaatgtgaaaatgttcgtggcgcaattgggattttgctgtgtttaccaagtcttcatgtctgagaatatcgcagattttttcaacaaaaacaccgccattcggttgagtaccggcgt

SEQ ID NO: 88901 - DNA, 577 bp, Heterodera glycines
  SCN-specific regions: Sequence locations=1-408,430-468,495-540
agattctttattcatttttcatatatcacctacaacaatgcaacatgcgagatgcccctatgttaaagaaaatgcaccattgccgacaaacatcaaagaggcattgccaaaggatgtgtcagtgaaaattcaacaaatccatgacgatgggtcgttgagcgcggagcaaaaaatggagcgaattgactcgatcatttgcactctgccggagaatgacattgaccaaattccggacccgccagaagttgcgcaactcccggctgatgtgcgccagcgcgtcaaacaaattgaacgccagcagggaaagtcattcagcactaaatttgaagagatcatgaaatatgtggacactttgcctgaaggcacaaaatcggctgccaaaaacattttccattgaatttttcatggaaaaagaggagaggaaagaagtggaaaaagcagcatggattaatgaaagcaaggctaaacaatatttattaaatattttattttttggtaaaatatttccaatttttcatttccaataaatatttttgctttaaaaaaaaaaaaaaaaaaaaaaaaaaaaaaaaaaaaa

SEQ ID NO: 88902 - DNA, 673 bp, Heterodera glycines
  SCN-specific regions: Sequence locations=1-23,48-507,529-673
tgagcatttcatcgcttttcctaaaatatttttcatttttaaatttgcccaatttccttccaaaacgccaatttatttctgctcctccccaccctcaaaatgctcgtcgactctctccgtcccgccactctttcgtcctccaaaaaacgttcagcgcattccatcgacgacaccgaccaattcattgaccacagtcccccgcacaaaaaacaactaatggacgaggaaaatgaccaaattttgacacaaaatacaccaaatgattcattggtaccggcggaggccaattgcctttgccacaaaagcaattcacgcggggaatcggccagaacagtgggacatgaaccaggtcgttccgccaatttcgctgtccaccacttacaaacagtcgagaccgggagagcccaaagggcacgactattctcgagccgggaacccaactcgcgacgtgctgcaggagaacttggccagcctggagggcgcgcggttcgcccgcgtgttcagttccggcctcgccgccaccgccgcaatggccaattggctccgcacgggcgaccatctcattttggcggacgacggatacggcggcactcagcgctatttccgcgacatcagtgtggcccaccatggcgtgcagcttaatttcgttgacctgactaatttgaacgagttg

SEQ ID NO: 88903 - DNA, 638 bp, Heterodera glycines
  SCN-specific regions: Sequence locations=1-638
aggtggacctggtcaccgaccgtggcgagctggccgaacttgcgcacattctcaccgagggcaccgtgggcggtcaaccgatgaaaacgaagccggtcaaactcggcaaacttggcgcaatgattgcccggaatcggtgcaccaacaacgatagtgatgatggtggcgcagctgctggcgccgatggttcggaggtggacgacgatgccgttgtgggcggcattcatcccgcgcagcggcaaggacgcgacgcggaatggcaccggcagtacaaccaactgatcagcattccggcgcacagggccaattggaccaccactcgcaagctgttcggcgaccagttgggctggccccaattcagcgcccttttcttcgccagtgcgctgcgcggcgacggcatcgatccgttgcgccaacatttgcgctcggtggccaaaggcgtggacaaatggcgcatgcgcgcgaaggacattagcacatcggacccgcgcatgctgtgcgcggagcacacgcgttccgcgctgctcaaccgctgccccgcgtacattgcgtacgcgctgcgcacgcgcatcaccgagtgggaggagtcggagcgcggcggcgtgctgcgcattgcggtcgacgtgttctgcgacaag

SEQ ID NO: 88904 - DNA, 611 bp, Heterodera glycines
  SCN-specific regions: Sequence locations=1-18,49-611
gtccaattaagttggcggtttaataataaatttatttaaacaattaatggcagcggcaacaacaacaatgccgtcattttattttcacaaacatttttttcaacgaatttttcctggcaaaccttttttcgtgcaagtattttcggcaggcgttctcgcagcaaccggcgacattttgtgccaaaaattcattgaaaagcgcgacaaatgggacccatttcgcacgtcgcgctttgctctgacgacagccattgtcattgcacccatccaatttcattggtttcgcttcatggaccgacgtattggcaaccccaaaagggagggcccggctggcaaagtgacccttcagacggggctcaagcgggtgctggtggatcagagtctgatcgcgcccgctttgaccgccgcctttttgttttccgtcaactttttggattcattttccacacaaaatgcgattcagcggacaaaacgcatttacttggacgtgttggtcaacaattacaagttttggcccttcgtccaaattgtcaatctgacggttatccctcttcactttcgcgttgtgttcctccaattcttcggcattttctggaatattttcctctcct

SEQ ID NO: 88905 - DNA, 624 bp, Heterodera glycines
  SCN-specific regions: Sequence locations=1-533,555-573,595-624
taagaatggcgcgtcctttcattggctttgcgtttgatgccttcaaacggcgtttgggtgcccatgacttcccatttctccgtggtttcatccatggattcaattattatgatgcccaaagggtcaaagaaattggtgccgaaagggccgcggccgaatgggtcgtccgttgtgaggggaaagtgaaatttgaccattccccccacattttctccgattacaacgctttgcagcggttcacttccgaattggacccgaaaagagagtccgaccgcgtccatttggtggccgtcgatgccactgactcgtgcatttcgggctggggctgtcgccatttcgatgggctcagtcgcctccaaaatgttcaatttgtgcgctgcaaatcgctgacagacaatggcctccaaatgctcgccgattcgtccgtctccgacactttgctaacacttcacatcgaaaagtgtccgaaagtgaccaattcaggcatcagacatttgcgcaaattgaaagtgctgaattcgctgactttgcaaaatttgaaaaatgtttggaagccggaaaagactttggacgaaatcagaccgaatttgccatcggattgtcacatttcttacaaggaaaaat

SEQ ID NO: 88906 - DNA, 628 bp, Heterodera glycines
  SCN-specific regions: Sequence locations=1-628
gtcgcgcaagggggagacgacggtgcagcctttacaagtttctttggaagacctgtacaaagggaacaatacaaaattgcaattgacgaagaaagtgctgtgcaaaacgtgcaacggaattggtggaaaacaaggctcggttcggaaatgtgaccgttgtcaaggaagcggaaaggtctttcacacgcgtcagattgggcctggaatgatccaacagatggcggcgcgatgtgatcaatgctcgggtgaaggagaaatggttgatgaaaaggaccgatgtaaaaaatgtgttggaaggaaaacggtgcaggaacaaaagataatcgaagtgaaaatcactccgggaatgcgcgataatcaaaagattgtcttctacggagagggggaccacgagcctgggattgaaccgggggacgttgttttggtcatcaaaacgaagtcacacgaacaattcaagcgaaagggcgaccatctcttcatgaaaaaaacggtaagtctcgcagacgcgctttgcgggttcactacgaccattaaacatctcgacggaaggcaaattaccctcaccacgatgcccggcgatattataaagccagaatccatccgaggagccatccaagaaggaatgccc

SEQ ID NO: 88907 - DNA, 791 bp, Heterodera glycines
  SCN-specific regions: Sequence locations=1-791
ccaattccgaaagtgttccaccttcgcccacttcgtcatccgctgggggtggtgatcctctgacatattccgctccagtgaaccaacgaagcatggctaggatttcggcgtccactcaagcggcgaccatgatggtcaattccatcccggctggtcttgctgcgccgcaacaaattccgcaaacttcccaagtaattgccgcaactgttattagtgcgaccggtgcttctggcgttttgcaattgggtcagcaaagctcaaattctgaatttctgtcagccttcgaatgtcccgtttgtcttgattacatgcttccgccatatctgcaatgtccatcgggtcatctggtttgtggaaattgtcgtcctaaagtcactgcttgcccgacatgtcgaggtccaattccgagcataagaaatcttggaatggagaaaattgcagcaagcctgcaatttccatgcaaatttgctcattccgggtgcacccaattcttttatcatcatgagaaagttgagcacgaagagatttgcgagtttcgtccttaccaatgcccttgtcctggagcttcctgcaaatggcaagggagtctggcagatgtgatgagccatctaatgaaattgcacaaatcaatcacaactttgcaaggcgaagacattgtttttctggcaactgacatcaacctccctggggctgtcgattgggtaatgatgcaatcgtgctacaacgcctttttcatgctcgtcttggagaagcaagacaaacaagaacaatcaggtcaaagctaccaaatg

SEQ ID NO: 88908 - DNA, 674 bp, Heterodera glycines
  SCN-specific regions: Sequence locations=1-380,402-511,533-555,616-674
gtttgagtcaataaattcggttaccaagcatataattgttttcatttcctgaagtatcgtgtgaacgaacagccactgagagcataatgccgcctggtttcaaggagtacttttttctcgacaaattggcaaaagcgtttaatattgtgaaacaaactgggggcatccgagcagccattaaacagcgttatttgatggacacgaaccgtgctggcacattgataggcgaggatcagtttggcaaccgatacttcgaagacaacacttatttcgtgccccggaatcgctacgtcgtctacgccgagagggtttggctcgactacgacgcctcgcaaatcccgcccgaatggcaccgctggttgcaccacatttgcgacaaaccgccgaccgttgagccgccgccggagcgcaagaaatggatgttggaacatgagccgaacaattcgattgtaatgagcaaaaaatacgtgccctattcgaccacacgcccaaaagtggagggatgggtgccggggaggaagagaagcgaagaggggacgacgcactgagtgagggcgaaggaatgggacgaatgaccgacggacggacaaaagacaaacggacgaacgaacgcaccaccaacccattcagttgtaatatttgtgagaggagaaggaataaacccaattaggact

SEQ ID NO: 88909 - DNA, 455 bp, Heterodera glycines
  SCN-specific regions: Sequence locations=1-280,302-432,453-455
gcagggcttttgcaagattaagatctatgccatcaatccggagattgctgaacaggcgcgcaacatgcttgagtttttgcaaaagcatgtcaaagtgccgcatgacaaagttgggcagatgatcggcaagcaaggcaaatcgattcaggacattgtggacaaatcgggcgtcgtacgcgttcagattggcgaagaaaatccggaacatggccttgtcgacttcaccttcaccggcacgcgcgaatctattggcaacgctgaactgatggtcgagtttctgctgaagcacatcaaagaaatggacgaaattcgagaggaggaggaggagtgcaagcgaaaattgttcaactctcggcactcgcccttcacttacccgaacaatgggtggcagtcccatcagcagttgaacgccagtcagagagcatccatcaatggtggtggtggtggtggtgtga

SEQ ID NO: 88910 - DNA, 645 bp, Heterodera glycines
  SCN-specific regions: Sequence locations=1-645
attttaagtaaatttgttatgtttcattgttattcgttggccatgctatcactgataacgctgctgttaagtgtcggtgccggtgctttttggccctattcgggtggccaacccgtggacgcctcaactgctgtgagtgcaccgtcgggtgcacattcgggtgcggtgtcctccagttaccatgacttgagcctggtcaacaacggatgcgtttaccataatggcatgatcaccgagaacgggggacaggcacgcaaagcaaccgctgaggaggaggccaaggtcaagcagtattttgcatcgtcccaacgctcccaggaacagttccagcaggccatggccgagaatatgagacgcatgttcgctgcaccgtttggcgcctggcaattccccccattcccgcaacaattcccattctcgtccatgccaatgatcgagacgccgtgcttttgtgaaagctgccgaaatggcgcgtcaatgaatcacaaagtgcagtcgtcgatgagcagtgtgatgggcgagaacaacggcaactcgtacaacgagtacagcgtggttgatggtcaacagcagacggaagagcaccagcagtagagattgttgtgtttggaaggaaatgaaaattggcggaaaattttcgcattt

SEQ ID NO: 88911 - DNA, 618 bp, Heterodera glycines
  SCN-specific regions: Sequence locations=1-143,165-456,479-618
gtccaataaaggtatcattaatttttccaaatgcgttctgcaagggttaatcaacgccagcaaattgaagaattggcccaaaattcggcacttctgcaggacatgacaattctgccacacaactacaactttgagataccgaagacgatttggaaaatccggacaattgatgccaaaattgtcgctttgcaatttcccgagggcctcacaatgttcgcctgcgtaatcgtcgacattctcgagaagcacaccggcgccgagttcatcattctcggcgacgtcacttatggagcctgttgtgtcgacgatttcactgcgcgtgcgctcggctgtcagctgttggttcactacgggcacagctgtttggtgccaattcaggacactgttggcatccatctgctgtacgtgttcgtcaacattgacatgggcacggcccatttgctggacacactgcggcacaattttttgcccaccgccggcgatggcatggaaaaaatgccgaaattggcattggtcagcaccgtccaatttgtggcgacacttcagattgtcaagcgtgagttggccaaggacggtttcgacattgtcatcccgcagtgcagtccgttgagtccgggc

SEQ ID NO: 88912 - DNA, 620 bp, Heterodera glycines
  SCN-specific regions: Sequence locations=1-10,35-36,58-141,163 -242,268-620
agcacattcatacaaatataatacatacttatatttaattatttctgtttttccaaattggcttaatcaacaaatgtcgtctcccagtgccggaaaacgaagaatggacacggatgtgctgaaattgattgaatcgaaccatgaggtggtcatcaccggtggactgaatgaattcctggtaaaattttatggcccaaaaggaactgcttacgaaggcggagtttggcgagtaagggtcgatttgccggagaaatatcccttcaagtcaccttccattggcttcatgaacagaatttatcatccgaacattgatgaagcatccggcacagtttgtctggacgtgatcaaccaaagttggacagcactttatgatctttccaacattttcgagtcgttccttccccaactgttgacctatccgaacccagcggatccgctgaacggcgaagctgcttccctgtacatgcacaagccggacgaattcaaggcaaaatgcatggaatatgtgcgcaaatatgccaacaaagaagccttggaggcgttggacaagaagacaatgaaaggaacggagaatgagggcgacgcgggcgaagagtcggacgattcgaccatttctgatt

SEQ ID NO: 88913 - DNA, 674 bp, Heterodera glycines
  SCN-specific regions: Sequence locations=1-530,552-674
cttaagcatatcaaatattataatggacttaagtgctggtgatgaacagttgaagcggaactttagctgcaaaatttgttttgagcccttctccaaggatcgtcgttatcccatttcgctaaattgcggtcacaccttttgcgctcgttgcgtcaggcagctcagcagcttcggcacttcaattgcttgtggtctctgtcgccgaggcacttactccgactttcgtcaactcggcaagaacgtcacactgctagatttgcttgagaatgccaaccttttggccggggaggatccaaacgaaacgacggacgacgacgaggacaatgcgccactcaatcagccctggcgaggggccaaccatttcgtttccagtgctgcattaaccgcttttatcgaccgtcacgccgaccttcgttccagcgttcgacagtttttgtcgccctcccaatgggccgaatttgacggaccgctggacgcaattcgctgtagccttttcaccatcgaaggacagctccgagatgcgggcgactcatttgttctgcaggagggacagttggagcagcttgaacacctttttcaacgcatgatgtccgagtattaccatcagcagcaacaaatgcaaggccctttcagtggctttgtgccggttcgttgggctgtcagtggcgattccg

SEQ ID NO: 88914 - DNA, 668 bp, Heterodera glycines
  SCN-specific regions: Sequence locations=1-131,154-267,289-641
tttactgtcagtggcgaagtggaagaatttttgtctaccctcaaagatgggactgttttatgcaagctcgcaaatgcgctgtcgcccaattcgataaagaaaataaacaccagtaattttccattcaaacagatggaaaacatttcattctttttgggttttgctgaaaaatatgtgaacaaaagtgaactgttccaaaccgttgatttattcgaagggcaagacccaaattctgtgctcatttgtctggctgcacttgctcgaaaatcggagaaatcatttggaaaggcggggcttggtcccaaagaagcggagggctcgaagaaggaatggacgtcggagcagctgcgtgccggtgacgctatcatcggcttgcaaatgggctcaaacaaaggcgccaatcaaagcgggatgattatgggaaacacgcgtcacatgtgaaaagaagggacagactgtgaaggaccggaattttgtgtaattacttcacttaaaagccttttgtttgtgatagtgctgaattgaccttaccacggatgacacccttaatacattccttcttgccttgacacttttgcaattccatttaaaatccaagatgcatatttctaaattatcatagaataaattagtatgttttgaaaaaaaaaaaaaaaaaaaaaaaaaaa

SEQ ID NO: 88915 - DNA, 921 bp, Heterodera glycines
  SCN-specific regions: Sequence locations=1-898
gtccaattaagtttctaatggcctctcctcctcataacatagacttaaataacaaaacaacggcaaaaatggcggtcaaatggcaaaaactgttgactgacttgacttcgtcctgctctcggctaatttccagcgaggcgttgggtttaccgccagcgctaagcggaggcccaaatctccgaaatgaacggccgtcggcggagggcccttcgaaatgcatcaacgaaattcgcacaatcgcagccgaattaagccccgaaatgcttcggtttggccccgtcaacccttcccttctatgggcctcgagtttttgtgctccggtgtacgagcagaaggatctgttcgaaatgcacgtgttcggcctacgctccgccggccattccattccgttgcacgaccatccgcggatgtacggattcattcgtccgctgcacggtcgcatacgaatctgcactttttcatggttggagcccgaagaagagcagaaaattgtcactgagaggaggaaacgcgcgggaatggccaaaggagcgtcgggagtgatcagacgaccggccaaatttacgggcgaactcatcttggacggggcctgcaaagacccgccgattgccatcgtcgagccgaacacagcaaatgttcattccatcgaggcgttggaggacggcgccgctttcttcgaccttttggtcccgggttacaacgacagtcgctcgtgtaattattacactctgtcggatgacaagggcaatggtaaaattggcatcggagacttcgtttggttggagggttcagaagaagtgcctagagaatttaccatgcaacagcttcgtttcgatccattccttatgtcaaataccaacagattcgattgaaaatgtcggaaaaatagtggcctaactaatttattttattacttttaaa

SEQ ID NO: 88916 - DNA, 710 bp, Heterodera glycines
  SCN-specific regions: Sequence locations=1-237,259-394,416-710
gtccaattaagggggagcgataaatacggcaaaattggcttttaaatggctcagagccccataaaattgttcgacgttgccaaggaatggtgctttgcgagcgaacattttcactgtcagagcctttgctgcccgaaacaatcaaattcatcaaggagagcttggaaaagcaaggcgaactccatttcgaattgccccatgtttttgtggttttcggcgcatcgggcgatttggcaaaaaagaaaatttacccaaccctttggtggctgttccgcgacggattgcttccaagagacactcacattattggctatgcccgctcaaggcttacgcttgaaacattgcgcaccgcctttgaaaaacattgcaatgtgcgagacggggaaaggcccaagttcgagcagtacatcaaacattgcagttacatttcgggtcaatacgacacggacgagggcctaattgcgctggacagagccatcattgagatggaacacacattcaaaaagcccgccaaccgtctgttttatttggcactgcctccggaagtgtttgagacagttactgagcacattcaacggcattgcatgagcaaatgcgcctcggcatggacacgggtgatcattgagaagccgttcggctacaacgacgtctctgccgcgcgcctttccacgcatttggccaaactttttgcggaggaacaaatttatcgc

SEQ ID NO: 88917 - DNA, 628 bp, Heterodera glycines
  SCN-specific regions: Sequence locations=1-628
cctcaacctcaagtcgtcaacactctcatcatgtctgccccgctccagctcaacctgatcgaagccaaccacgcctcgggcaacggcattggccagttcacgtccacgggcatcgacgcggccgccctgggccgcatccagccgggccaggacgtgcaggtcaacgtgatccagcagaatgccgcgtcgggcaacaacattggccaggcgcaattcaccaacgtcgacgccctcgtccacaagatcaacgccaacccgaacgtgggcgacgtgcaagtcaactttatcggtgccaaccaggcctcgggtaacaatatcggccagtcgcaggtgtcggacattggtgtcgtgtcgacgtcgggtcacgcttggtccggccatcacggccatggccacgggcccaccacgggtgacatccagaccaacatctcccaagccaaccaagcgtccgggaacaacattggccaggcgcagagcgccaacgtggacgtgaccgccgtgggccactcgcactggggccacctccacggcggcggtgccggcggcgacgtgcagaccaacgtcatccaggccaaccaagcgagcggcaacaacattggccaattccagaacgccaacgtggacgtga

SEQ ID NO: 88918 - DNA, 953 bp, Heterodera glycines
  SCN-specific regions: Sequence locations=1-412,435-953
cgctgttctccgttttcccacagaatctcttcgggtattcttgcaaatcgttgtcgggaaaggaggtcgattggtttgtcgcttacaaattgcccgatttggggtccgatggcgacggcaccgcctttctttattcggacgcgaacaccgccgcttggcgcctttccgacaaaaatgtggaggacaaaacttcagcaattggactgaccgtctcgcaactgttcacagcaaagaaaaaaaagggcgatttctttaccttgtttaatgatgagaacccaaacaatggcaaaacggactcaaatcgagcgcatatgaaaggagtgctcgtcttcgacgacatttccggcttttggctggtgcactctgtgcctaagtttcctgccagcactggggccgattacctttacccacagagcgggaagagaaacggtcaatcgatgctttgcatcactctatcgagcacagcgcttaaggaaatcggtcagcaattgttcgttgctcaacccaatgtctacgacttccaattgcccgactctttcgcccgccttttccccgacttggccaaggcggtcaatcggacgacatttccctacaaaaaaagggttcccttctctgtcaccgacgtccattctctcaagggacagtcattcaccacctttcacaaacacaaacaattcggaaaggatttatacagtgaattggtcgcccctcggctgaagtcgtccatctacgtcgaaacttggctggtcggcagaggcgacctcccctccgattgctcctcttcatttaaggtgcacaatgtactttccgtgaaggcctcaaaattcgcattcaaaaacactgaggatcactcaaaatgggctgtcagtgaaagtggtcggtggacgtgcattggggacatcaaccggcaacagtcgcaggcgcgccgagggggtggcactgtttgcctgtcc

SEQ ID NO: 88919 - DNA, 648 bp, Heterodera glycines
  SCN-specific regions: Sequence locations=1-623,645-648
gtccaattaagatttgatctgcgtcaaatggctaatgattctcgcagttcttcgagcgcttcctcccgttctcgctcgcgtagtcgcagtcgttcgccacgccgtcgcgagcagcgtcggcgccgctcgcgttccaccttttcacgttctccatcacctggccaaaaacgactgcacatcggcaatttggacgagtcggtccgtcgtcgggacattgaagacgtttttggaaagtatggacggatcagcgactgttggatggccagttaccctcccttctacgctttcgtcgtgttcgaaaacaacaaagatgcgtccgcctgcatgaaagacttgggcaacacggcgtacatcaaagggtgtcgtgcgcgtgttacggtggctcttccaagaaaaggatcttcacttgatgccaattcaatgaatggtgcgacttatcgtcgcggaccgccgcctcctccgcgacgttattacgacgaggaggacagtcaccgacgccgtcgtcgttcgcgtactcgctcgccccgtcgtaggcgctcgcccagtcgctcgcgcagtcgcacaccgccgcgccgcagtcgttcgcctcgtcgttcggcgcgtcgccagcgcccgccgtcgccgaagagagaacccagaaacagggga

SEQ ID NO: 88920 - DNA, 831 bp, Heterodera glycines
  misc_feature (808)..(809): n is a, c, g, or t
  SCN-specific regions: Sequence locations=1-809
cagctatctaaataaaactgacgcattaatgctgtatttaatcagaatttttttgtctcattattatcaaaatggcgtcatttattttgtttattattttgattattacgaaagctaataactcaatgggacaggattctggtactaatgatgtccaattaacgttggtcaacggttgtccatacaaaatttatgttgccggtgcggtgcaagtgaatttgacggtcaatgaaagacaaacgaaaaatgtgccgtcagtgagcacagcgcaacgattatgggccaacactgactgtgacagcgaaaacaacccgttgtgcaaccttcaagcagcgatgccgccaatttcactcttcgagtggacctttgatgcggacgggaaacaaacatatgatgtcagttatgtggacggtgccaatgtgccgatcagtgtacgtgtgctgaattgtcctggtgtcaatttcaacaaaaaattgggcaacagtttggacactttggtcgaccagttgcccgatgcaatgaaaatggatgtatttggtaaaaagcgtgtcaaaagcgtgtgtttggcgtacaacaccgactcagtgtgctgtcgaagcccatttggtacgccggaaacgtgtggcccaaccaaggggtggaccgatgatcagaaaaagggctacgaagcaatgttagccgcttttcccaactcgtacaactacgcgtatgatgatcacattgcgacggaagtgtgcataaatgccaaacaattcacgatcggattttgcaccaacgtgtaaagaaacataaagcaaagcgtttttcnnaaaaaaaaaaaaaaaaaaaaaa

SEQ ID NO: 88921 - DNA, 612 bp, Heterodera glycines
  SCN-specific regions: Sequence locations=1-413,437-612
tttaataaatgttttgtcaaataaatctctaatttcctttttcctcctccaaatcttcttcgtaagctttgcctctcgtgccgtaaaacggtcgctttactcggcgaaatttccattggcactaaatgaaattcgatcagtcgtatcactgaattcgtactttagcaaaattgtccaattttgcagcggagtgttactcacagaaaacattgttctgaccgctgcccattgcattttgagcgacgaatttggtttggccgattacatccacgtgaagggattcggatggaatgcccactccaccgaattcgtaattcgaacggattttatttttctcgatttggaagattcaatttgcgcggacattgctttgatttttttgcccccaaaagtgactggaatttttggcactgccaaattcacaaaattcacagagagcgaatggtccaataaaagtgactccgacagtaaaatttacgcacttggctatggaataactgaacttcaccgtatgtccttccgggctcgtaaagtcccgttgaaaaaattggaacaaaaagtgccgaagtgttctttggaattttatttcgccgattcggcactttcttgctc

SEQ ID NO: 88922 - DNA, 467 bp, Heterodera glycines
  misc_feature (448)..(448): n is a, c, g, or t
  SCN-specific regions: Sequence locations=1-60,83-126,151-445
agagcattaaaaatggcttcaaaaaaagccgatgaaaatgatgagcctgaaggttccgagggttctccaaccaacaaaaaccggtgggacgcggatgcggccaatttggaaaaggtgaccgatttccatgaagaaaaagatgagatgaacgaaatatcgaaggaatcgttgggcaatttgaaagcgcagcccggcgaaaagcgattcagcgtaaggaaggaggacgtgcaggcgattgttgacgacttggaagtgtccagaataatcgccgagaagaagctgatacagcacgaaggaaatctgaaagcggcactgctcgaccttatgggcttcgcggagaacaaccagtgaatggcgtcatacctaaatatatttctgtcaccaatttattgtttaaatcctttatcagcgattatcgtaaataaatacgatggcgcgaatgactaanaaaaaaaaaaaaaaaaaaa

SEQ ID NO: 88923 - DNA, 607 bp, Heterodera glycines
  SCN-specific regions: Sequence locations=1-159,181-284,313-492,514 -559,581-607
ctcagcatcagtcatttccggcggcgaataacggccgcatcgtaccaagcaaaaagtcgggcaaaaagaacatgcgaaaggagcgcgggaccaccatcaacgtgaaggagttagctggttactttggagaccgtggcttggatgaaattttgcgcgagtttcaacccaatcagccaaacaccggcaggacggcaccaaaaaaggaaaagaacggcaccgatgccaatgtcgtcgccaccgccgctggggccgcgtcagcggccgtggcagtgccaccaccaccagagcaaaagcagcagcagcagccggagatcacagctgacaacaatgagccgagcacaaagaaagggaagccgaagcacgtttcctccacggcccatcgccccacgctgacgaaacagcagcgacggcgtcagcagcagcagttggcgactcaatcgcgaggcagcagtgcagaggaaggtggaggttgccatcgagctggacagagaaggtggtgggtggtgggtgttgctgatgtgaaaccggaccaagactccgaccctactcttaatgcagaaacagtggctgaagcggctgcttcggaggtccgcaacagtttggagaa

SEQ ID NO: 88924 - DNA, 702 bp, Heterodera glycines
  SCN-specific regions: Sequence locations=1-230,254-468,512-702
gtttgagattttcgccttttttagattatttgtgcagaattctattgacaagcaattaatgtgataaaggaaatgcgatcgttcaacagtaaatctcatcagtatgactcatcaaagaatttccaagagcttttgtcgcctcgtctcttccagcgtcgacaacagaatggcggtacgattgttcagcgagtgctccaacagcagcaattccagcaaatgttccaacaatatcagctccaacaacagcagcagcgcgaatcgccgcctccgtccaccgtttttggcaacagttgtgatggcactttgtgccaaagcgatcgtctgaccagcgactcatcgcaaacattgctgcacatcggtccaaatggagacgactccaatgacctggtcggcgtcggcgctgccgaccattctgccgatgttacgccgcttgaaactgctgacaacgtccgcaactctgacagcatgcactctcagcaacaccaccaccatcaccaccaccgtgcccatcttcagccgatgccaccgcagcaaaaccaacaacattcgtccgctgtttcacgggccagcagtgtgcgcagtgcgccgctgcgcccgtcccgctacgagtcgagcagtttgccgcgcatgggcgtcaacggcggtgtcggtagtagcaccacaaacatcaacagcaatgggcatggtaccaactgcagccac

SEQ ID NO: 88925 - DNA, 617 bp, Heterodera glycines
  SCN-specific regions: Sequence locations=1-617
gttcactcacaatcaataacgatattttggacgacgttatcgccttcatcaaacggtccgaattggctcaaaatttctcattggtgagtcaccatttcaattcgcttgcccaacggagaatgcacgacgccaacgcacattgggtggagggcgactgcgtgttcattgccaatgcgaccaccacgcgaatgatcatccccaggggaaacaacgggggatttgaggaagttcccgtgcccacggttgctcagccatcatatgtgctcggctttcgtggcacaattcatttcaacggcacactcagcgacaacgcactcgccttcttccgtcacgcgttgcccccgcccacaacgctgtaccgcttctcggtgctggacgaattttatcgtgccaacggactgctgagcccgttcaaaacaacggaacgcatcaacacctttctggacacgtgcgtgcatttggttgagttgggcggcgacgaggcgttcgtcggcgcatttttgaaccttccggtgatgcgccaacgcgtccgaaaattgcgtgccacccgacacagtgaactttttctcaattggctgcaacagagtgacggcgaatggggacagttgcgcattatg

SEQ ID NO: 88926 - DNA, 596 bp, Heterodera glycines
  SCN-specific regions: Sequence locations=1-22,65-183,205-463,485-596
gtttgagcaaaatcacttctgatgtctttaaataattcaaatttgttggggaaacggaaggtggcgttgaatgagcgcagaaaaatttacatccaacgcgactacagccaagcattagttgtgaaattcagcacagactttcctgaagagctcgaacattacattgacagggatatttggctgaattttgtcactgatctcaaccaaatttacgcggaggcggagaaactgacggcgattgcttacctcgagaacattctcggcctggtgacatgccatctttccatgctgtgcttcaaatcattgtggaagcggaagttggaggaagcgcgggcacttttatacgaaaccaaccaacagaactttgtcaggaacggagtctacgtttgcaaccccttggagaaggggttcagagtgatcgaagtcgttctgctcgatgagccgattcctctgcctgctgttcaagacgaaaataatgagaaaaattccgttcccaagccaattgtattgcagccgaggcaatgagggagggagcaaatccatttctatttaacaatttgccgattcatttcacaaataaatacttaattcactta

SEQ ID NO: 88927 - DNA, 385 bp, Heterodera glycines
  SCN-specific regions: Sequence locations=1-40,62-78,100-112,138-337
cggatggggagttatggtttctcaccgttctggcgaaacggaagacaccttcattgctgatttggttgttggactcgccactggacaaatcaagactggcgcgccgtgccgttctgagcgtttggccaaatacaatcgtattatgcgcattgaggaggaattgggcactgacgctgtctacgccgggaaaagtttccgtaacccgcaaaactaagagcgtgtggaaacgaagaaaaataggactgttcgttgactattcgctggatgtttagtttcctgacattgattatttgttttcgaaaagtcacttgaatgctatgagtatattatttaattaaactgaataaaagttatttctcaaaaaaaaaaaaaaaaaaaaaaaaaa

SEQ ID NO: 88928 - DNA, 446 bp, Heterodera glycines
  SCN-specific regions: Sequence locations=1-18,43-88,112-446
ccacactatcacatatcaaaaatggctcccgcaaagaagaagtggtctaagggcaaggtcaaggacaaggccaacaatgccgtcacccttgacaaggccacctacgacaagatctacaaggaggtccccacctggcgtctcatcaccccctcggagctcgttgaccgtctccgcctgaacggctctcttgcccgcgttgccctcaaggagctcgctgacaagggtgagatcaagctcgtgtctgcccacggctcccagctcatctacactcgctccaccattggtgccgagcccgttgccgctgcctaaattgccccggttgttctgtttctcccacacgaaaaatgaaataactcgtcttttggtcttggcaatttgatgcggtttcgtctgacgcaacctgctgttgtccgtcgagtcgtaatgtacattgttctaccgccaaa

SEQ ID NO: 88929 - DNA, 384 bp, Heterodera glycines
  SCN-specific regions: Sequence locations=1-190,212-357
gtttgagctaaattttaaatttttcaaaactgattgtgagacttcattcaaatgcagcaacaacagcccgttccgaagtgtggcaatgtgaaatgcccctgtggagacgcgtgccagtgcggcactgactgcaaatgcggtgcgaaggaggccagcaactgcgcgaacgagaagtgcgtttgtgagaattgcaagtgcggcgccgactgcaagtgtggccagtaaacgacaccgaagaatgggccggagggttgtgataagaagagcaaaaaacagttaccttatttaatttgatcgtgaccgaccataattttgacatgtttattttaaaatgctgattgatacaataaatattataagaaaaaaaaaaaaaaaaaaaaaaaa

SEQ ID NO: 88930 - DNA, 511 bp, Heterodera glycines
  misc_feature (490)..(490): n is a, c, g, or t
  misc_feature (493)..(493): n is a, c, g, or t
  SCN-specific regions: Sequence locations=26-486
cctcgtgccgaattcggtacgagggtttgagaatgcactcattgctttgtccacgtgcgtccagctcccaattatcggccctttttaaacgtttttccgtcgggaatggcaccgcttcgaccgattgtgccaccaaaaaagggcctgtcgatgtgctgcgtgcacggcttctctaccagagcagaaagcgtgggatacgcgagaacgacattttgatcggtgggtttgctgaggaacacttggtcaaaatggaggaacacgagttggagcagtacgaccggatcatcaacggacgacacaccgaatgggaattgttccattatttctccggcgtaaaagaagcaccagacgatttggacaaaaatgcggttttccagcggatgcgccaacactttggggagaaaacaccacgccaattctgatggacaaaatgatttgttaacatttacaaataaaaacccagtgcttggtaaattgtgtaattgcaaanaanaaaaaaaaaaaaaaaaaa

SEQ ID NO: 88931 - DNA, 668 bp, Heterodera glycines
  SCN-specific regions: Sequence locations=1-668
tgtttgttttgttgaatttccaaatgctgcttattttaaagaattgttttggtcggcttcatgttatttgtcatcaacttacgcgcagaaattttcgtcttcttttgcatcgacgaaaggaattttccaaaccgattttcttcagcgtcggtcagccaaagtcttctttcactggtggaaatgcatcgggcggtagcggcggaatgcctcctaacccttttcagggcatgtcaaactggcagaaaatggctgttgcagctgctgtgattgtcggactgcaatacttcatcaatcggctcgcttacacagaaatatcatggaaacagttctacacggactttttggaaaagaacaatgttgaacgcctcgaagttattgacaataaatgggtccgtgtcattaccagggatccaacgcagaccgttttttacttcaacatcggaagcgtagacacttttgagcgcagtttaacccaggcacagcaacatttgggcatggagacgagtcagcagcaggtgccggtgttgtacaaaagcgaatcggacatagtcggaatgattccccatatggttaactttcttatcacgggcatcttcctgttttacatgttcagaatgtttcgagggttcggaggaaaaaagcccggccaacgtggcggcggcggaggt

SEQ ID NO: 88932 - DNA, 743 bp, Heterodera glycines
  SCN-specific regions: Sequence locations=1-387,413-743
ccaagtttgagccaattttattcacaaaatacattttttttgttgccgaaatgagcacggaacgctattccttctctctcaccaccttcagtccctcggggaagttgatgcaaattgagtatgcgttgaatgccgtcaagggcagtgcgccatctgttggcacccgagcaaaagattgcgttgtgttcgccaccgaaaacaaacactccgtcctcacacagcccgtcagcaaaatctccaagttgtccgaccatattgcatgcgtgtacagtgggatgggcccggatgcacaacttctcgtgaagaaagcgcggaaaattgcgatggattaccaagtgctgtacggctatgaaattcccgtgcctcaactcgtttcccgggtggctgcggtcatgcaggaatacacacagtcgggtggtgttcgtccgtttggcgtttcattgctcattggcggatgggacagtgaaaagggggcgcttctttttcaagccgatccggcgggttcctattttgggtggaaaagcacggcgatcggcaaaaacgaccaattggccaagaaattgttggagaagcggtacaatgaagacattgagaaggtggacgcgatacacatggctctgcttgcaatgcgcgagacttacgacgttgccatgactgaggacaatgttgagttggccgtgtgcacaaaggacggctttgaacggatgaacaaagaagcgctccgtgagcagatccaacccctc

SEQ ID NO: 88933 - DNA, 601 bp, Heterodera glycines
  SCN-specific regions: Sequence locations=1-601
gttcttgccatggcaatcgctaggcagttccgctactcaatttatcttctgttagttttggttcgtttttctctccatcaaagtgccgaattggaggacctccaacgcctttgccccgacttaaaaggcgctttctgttcccattgtgaccacaaaagtgttgagcaaatttgtccaatcgaatgcaacttttgctcaacttttcgctcaaacgaaacgccaaaattcttcggaaatgccgcagaaaatttgattgagctgaaaaggcaatgcgccaccattcgattggccttttgcaacgtttgtaagatcacttcgatcaacgaattgtgcgtggaagaatgtttggactgcgaagcgggcctaagagacgaacagaaagaagtggtgccattggtacagacctggcaacagtcagcgggggatggactcgcaattggcgacgatggcacaaattcagcgggagaagctgccgaactgagcgagtctgaggccgaaggaagagaggtgccagcggaagtgccaattgaaatggacagtttggcacttttttgaccataaaacacgaacaaccaaaagcatttgtttattggattgacaa

SEQ ID NO: 88934 - DNA, 397 bp, Heterodera glycines
  SCN-specific regions: Sequence locations=1-359,383-397
gtgacaattcgatggcaactttggacgctgttgaggaaccgcttgacctgatccgactcagccttaacgagcgtgtttatgtaaagctgcgccaggaacgcgaactccgcggccgactgcatgccttcgaccaacatttgaacatgattttggccgatgtcgaagaaacggtaacaatcactgaaacggacgaagaaacattcgaggaaattcacaaaccaagcaaaagaacaattccaatgctgtttgtgcgtggagatggcgtcattctcgtctcgccacccacaaaatatgtcccatgatcagacaaaactgcttttgttctccatatttttcattgttaaagttctttcaatttgaaaaaaaaaaaaaaaaaaaaaaattttgtattttaaaa

SEQ ID NO: 88935 - DNA, 1346 bp, Heterodera glycines
  SCN-specific regions: Sequence locations=1-362,387-1325
caacaacccttcccctccctcccatgttgtgtgatacgctgggcactgacaaaaacaaacggactcttttggtctacggccatttggacgttcagccggcggcgtttgaggacggctggaacacggaaccgttccaactcatcgaaaaggacgggaaattgtttggccgcggttccaccgatgacaaagggcccgtgctcggctggctgaatgtcatcgaaaccatgcaagggcttggcattgacatgcccatcaacataaagttcgtgttcgaggggatggaggagtgcggctccgacggattggacgaatgcctcgagcagcgcaaagattttctctccggcgtcgacttcgtgtgcatttcagacaattattggctgggcaaacagaagccgtgcatcacttacggccttcgcggtctttcgccgtttgccatcgaaatcagtgggcccaaccaggacctccattcgggcgtttacggcggcacaatccatgagccaatgaacgacctttgctggttgctcagccaattgactgacacaaaggcgaacagtctgatcaaaaacattgacaaaatggtggccaaactcactgaggaggagcgcaacacttacaccaaaattgactttgacttgaatggattcaaaaaagacgttggcgttgagaaactcacttccgaagacccgaaacaaattctgatgagacgctggcgtgagcccgccctgtcaatccatggcattgagggcgcattctccgggaagggctttaagacggtaatcccttccaaagtgacaggcaaattcagcatcagaattgtgccggatatggtgccggaagaagtggacaaaatcgtcgttgattttgtcagcgaagtttggaaaggtcgcggctcccccaacaaaatgaaaatccttccgttgggcggcactttggcatggctcggcgacttcaaacagccgcactttcaagcgggagtcaaagcgattaaaaaggtgtatggcgtagagccggactttaccagggagggcggctccatcccagtgactctgaccttccaaaatctaacgggaaagagtgtgatgcttttgccgatgggcgcttcggacgacatggcacattcgcagaacgagaaactgaacgtgaccaactacgtgaacggcatgaagatgttcgcggcctacattttcgagtgcgccaaaatatgaactggcagaaattatttatcactcatagacattccatttattttccattccatcgactttctaacttctaattacttttaaaacccttgttaacttcgaaaatatatcactttctcacttaaaaaaaaaaaaaaaaaaaaa

SEQ ID NO: 88936 - DNA, 415 bp, Heterodera glycines
  SCN-specific regions: Sequence locations=1-415
ggcactgattcgaccaataacggacattacactgacaatttgaacattgcggcgcctggcgttgttactcagcatgtgtgcaaggcgtccaacctcaaccagttccagctgagtcagatcaattcgctgcacccggacactggcgttgtcggcgtttatctgtcgaccgaagggaccaaagttctcccatttgtcaaagccgctgcccagggcttacgcgaaatggcatccaaaccgatcagtgacgagcttctccaggcttgcaaattgttggccaagggaaccgcactgacacccgacgaattcattgcccttctgaagacagtgactgcggacgatgtgaaaaaggctgcttccccaactttgcgccaaagcccacacttggcaggcgaggttcaccaggccgggcccaccg

SEQ ID NO: 88937 - DNA, 1250 bp, Heterodera glycines
  SCN-specific regions: Sequence locations=1-128,171-1250
ctaaacttaacctcacaatgaagcggttcaattcatgggcctcccaattggagaacgaactcgagggatggaaggacggatgtccctgcgactttcttccgaatatgtcgccaatttcggatgcaaatgactcctcttccctctcctcttcttcctcctggtcttcgccactccttcacaaatatcgcttgctaattgagcccggtaattctccgtttgaatacgtcgcccccggtgttagagctgttcgtcgtctttggaattttttgattttgcaagagaatttagctccaatatttgtgcgctattctttcgcaaaagcgaaggataaaatcgcttcttcggtcacaaaaggagcagatttgaacagtattttgaatgtaatcaaattagtccaccgcgagcacgacccaatcgtcgcatttgcagcgaattcgattaggcccggtgtgatggtcgtctccactgggcgtgagcttcaggaactgagcatcgaccgtgtgttggatgagcatgagcgggtcgtctcccgtctgcagcactatccgtcgaccagctcttttcttcttgcgcagaattgggccgagttggacatttcaatgcagcaaatccgtcgtgacccgctcagggacaacgatgactaccaattgctgatcccgggaagcgatggtcagccgggcaagaacatccccacgcaaacatcagcccatttgcggaaacgacttttttctggcgttcgccgtttggaggcccattcatcgctgccctactatgccagtggctcttccgatggttctgttttcctatgggaatggggcgttgaacagcctgtgttcgtcgcccgtgttgctggccaattcgcaaaagtggctaaattggcattcgctcagaacggcgcccgttttgcggctgtcgatggggatgggctgctgtccatttggcaggcacaacctggtgttccggcaaagaagccttatttcattcaaaagtgtcacaccaaatttgcatcggacgtcaaattcctcggacaaaccagcactcttctggtcactgctggtctcggcatgaatgaccaaaacatcactctttgggacattttgatgcctcactccaaatgtgcggtgcattcatttgtgggccatccagacggagcgttttgtgtggcttatcagcccaacactcagtcgcttatttctggcggaaaacacggagaaatttgcatttgggacgtgcgacagcgtcagttgcgt

SEQ ID NO: 88938 - DNA, 605 bp, Heterodera glycines
  SCN-specific regions: Sequence locations=1-30,52-358,398-498,520 -523,545-548,570-575,598-605
caccaatttgacctctccaatttatctctgcatttattattttatttatttctccggcaaataaacttttataatttgttatcttcggactttttggttgctatttatagaaggggtatataaaggaagtgaaaggaccatttgattggtacattgcataaaaaatgcaaaaccgataatcgtaaatataattgctctcgctaatctcggtaccggaattaaactaaactctctgacgatcaccgagtgtgaatttaagtataacccagaaaattcaatgcccggttatcaaatgtgcaagccccatcaaagccacggcattattatgggaatccgggaaaatgatatgtctggggacgaaaagtctgctattaaaaaatttatagaaataattaagggctcggggtgtccgggggcttcttacatcggactaaatttcaagcagggtaaaagcatgacagcgttaattttctggaccggtaaagtcgtaattacgggaactaaaaacaattctgaaattgaggaaatgtatcatcatattctcccctatttgaaaatggctcaaaagaagttagggatacgataaaaaatttttcatttattgg

SEQ ID NO: 88939 - DNA, 788 bp, Heterodera glycines
  SCN-specific regions: Sequence locations=1-109,132-189,212-556,578-788
tatatttactacataattagagcaaatacggtatacaaacaaaaaacgaatcaatacaaaaaatgcatttacatttgcacattttctatattctttggtagttggattcactcaaaattatgttgttttaatgattcatcatacacaaactttgttttcagaaattgtgttcatttacaaacttgcagcaaaaaacaaaccagcaaaaagatgaaacgcaacggaaattccatttgctcagaaaccaagccaccgcttttggaattgacgccaaagaatgcattaactttccgtggcaaactcggccacgtcggttccgtctctttggacatcaaaaattgtgagatctgctccgtttacttcaaagtcaaatcaaatgccaaccacttctattcggttcgtccaaacaccggtgtgattggggcgtacgggcgcgtgaaggtggtcatccaattgcacgacgacagtctggcaaagttggacgagattgaggaaaacaagcacaaattcctgatcatggcagcgattgtttcggatgcgtccattggaacggagaaattttggaaaggcaaaaaagaggggatggatggcatttactcgagcaaaatgaagacggaggtgcacaaagtttgtcggtgggaaggagggaagggtgtgctgagccaacagaactcggaagaaaatgtgccgaacggaaagaactcagtgtctgtggagaaagtgccgaaccaaattttggagttgtgttcggagaaggaagcgccgaaccaattctcgaacttggagga

SEQ ID NO: 88940 - DNA, 614 bp, Heterodera glycines
  SCN-specific regions: Sequence locations=1-569,594-614
atcgattataataactttccacaacgaggcaaggtccacattgttgcgtacaatttggtccattttcattcgcactccatcgcatttacttaaagaaattattcttgtcgatgattactccttcgatgccactattggcagagatttatttggtattgacaaaatgcgaattatccgaaacagaaagcgagaggggcttattcgttctcgagttcatggtgccattatcgccagtgctcctgtcctcacttttttggacagtcattgtgagtgtaacgtcggatggttggaaccggtgcttcaacgtctggtcgaaaatgacaaagctgtcgttgcacctgtgattgacgttataaacatggacaacttcaattatgtctcggccagctcagatttacgcggaggatttggttggaatttggtgttcagatgggaggcattgggaagagaagaaaaattattccggcgaaaaaaacccgaaaaaaccaataaagactcctgttatggctgggggattattctcaattaacaaaaaatggttcgatgccttaggacgttacgatactaaaatggatgtttggggtggagaaaaccttgaaatgtcttttcgcatt

SEQ ID NO: 88941 - DNA, 860 bp, Heterodera glycines
  SCN-specific regions: Sequence locations=1-18,41-51,73-152,174 -188,210-456,478-860
attacatttttattcataaattttgagcaaaacacaaaaaaggtcaaaataggttttgttaaacttcttagggttcaaagaaaataaaaacgataaaataagtgctaataactcgaagagttgcttaacaatcaccaaaaaacatattttccatgctttagggccactggaagttcaggaaaaataagtaaaatctaaaaaacttatttctatgtagtaatattatttagcaatacacattaatatgttaattaaaaagaaatttagtaaaactgacaaacaataacttgtttttatgattactgtcgaaaagtccattattttttacctttcaggcgaaaaatccttcactgtcgaaatgtcctttgctgatttctttacaatacccagctttttggttcttccgtactctttcctctccattacccgtaccctggcttttttccctccggacaaattgatgcccttctctccaatttctgtttgatctccgtttggtaacaccgaaaaatccgcagtgagtgcgcatgctttcactactttagcatagtgctgttcgtccggcttttcttcttcggtgactgggaaaattatattctcgcggagcgtccgattcaaaatcctttgctgcaattaattaattgagggattaacattcatcactaagttttaggggctaattaggtcgcaattactgaacctgttgcggcacataggccacagtgccacgaatgcccacgtaaccgtacactttgtgcatttcaccgagaatggcattgagcagagatgacttgcccgaaccaacctttgaaagattttaagacagagagatgatgctgaagacggcacgacgacatttc

SEQ ID NO: 88942 - DNA, 477 bp, Heterodera glycines
  SCN-specific regions: Sequence locations=1-75,97-477
aaccaatcaagtcccctgttgatgccacgctccacgcgcgccacaatgagttgctcgagtagggctactcgttcgggctctcgtttctgtgggagtggtggacctgcgccacgcttatacatttggtcgggaggcgttcttccaacacgcctcacctcccggttgaactccctcttcagctctacgtccatcacgacattcccgagttccatctcctcggctgcccatcccattgcccggcctaattgtttctttaccagctggacaagtgagagtgggtcaagcatcggttctggttcggattctgagggtgggtgtgtcaacacatccgtaggtgcaggcccgtccacctctggaaccaaatcttgttccttacgtgaagaggtggatggaaccctgcgtttccgaggtggaaccacatcgcgaacggcgttgcgcagccgcttacgcgtgatcctctctgtcgcccctaagtcg

SEQ ID NO: 88943 - DNA, 634 bp, Heterodera glycines
  SCN-specific regions: Sequence locations=1-14,100-386,411-634
cagctgaatttcatctccatcgtcatcctccgactcttccttcagttctccatcctctttctccacctttttcttggccttctcttcctcctctttttcgacatctttgttgtccgcgcactttgacgaccacctctttgtccaattttgcctccaaaatttctgtgagcttttcgggctctttttcgctcaattcgtcaacatcaagcgcatttattcccaggtatttttcgcccacgtacgagaacatcgcggtgaccacactgctctccggctgaacacgatcggcgatttcgacgcgcaggaacaggcttttcatgggcgatttcacaatgtgatcgcagaagtgcatctcatttcgtcattaaacattcatttacattaactttttataattttatattataatacctttaatagaatctgggataggatttatatgtgctaaaacttgcagaatcctacagtcggattttgtactctgtaatcttcagacaatgatttaaattttcaattttgcgggtttttagcataaatttaacaataattattttatagtttggcaggcggtgccggtgcggttcaaagaatttggtggattttagcctggtttatgaacatttttttttttgct

SEQ ID NO: 88944 - DNA, 776 bp, Heterodera glycines
  SCN-specific regions: Sequence locations=1-247,269-275,297-367,389 -612,634-653,675-776
gccaacttttcttcaacttcggcgtcgctcttttcccacaccaaattctgcatctttctcctcaactgttgagcaccatttaccaagcccaaattccgctcgaggaatctacggatttgcgctttatttgggcgtttggattctgtttgtcctttacctgatttgggcgttggtccccgattatctgctgaaatctcttcacttaacctatcttccagcaaagtattgggcgttagctgtgccttcctttttagtcttttccatttttgcatacattttggtgaatttctttttcaatttggtcaactttcactcgctttatgaccaagaaacaacaaaatttcaattggtgaatgatttcctcgattgaaatgttttcttctttgtgcccttccgttgtccgtcacaaatgccttcgctgttctactcgcactttggcattttctggccataatttgtccgattatttgtccgctgctcagccgtcttctcgctctcaaaaagcacgcgaaattttgaaacgccatcagtacgcgttgaagcgaaggcccaaaaagtggaagggagcggagtttggcacatttgttggacaaatggactcaatcgcagcaaaatgctatttggggaataacattgatcagttcgccagcctcgccagggcaaagtctgaaagtgaggccaaaatgaaagcattggccgagcgaaaactgtcaaaaaagcagagcagagagagcagtgactccgcaaatgccccgctgttgccatatgatgcgaag

SEQ ID NO: 88945 - DNA, 622 bp, Heterodera glycines
  SCN-specific regions: Sequence locations=1-401,423-524,546-622
ttaacacgtaagcaaaaaatgtaaaaatgtgttatcaaataacataaaaatggggttcccatgggattctgaattctttccaattgtggcagatttgtttcttaatttaaagaaggcattaatccgagtccactcacattcaacagctaaaccatcagctgcatcaatagcgcgggaagtcggcgtccacctccaacgcccatccatccattccgcccacaatgtcacgaacgatgaaccggtcgccaatgccggcctctgacaactgtttgtgcagatgacacgcagccaattgcgagtcgttgccatgatggcacacaacaaggacttttgttttcccattgtttcctgcaccgttaattgtcggacttttgcgttccatgctgttgtttatcttgtcaattatcatttccatttttgctcttctcaattcctcccagggaaaattttctgcttccggcaaatggcatatttcaaattcagtgggaggtcgaacgtctaacaaaatgaaggaaccgcctattttgttcctcaaatttaaatattccgttggcgacactcgttgttcagccgaaagtaaacataatgagcggaccttatctgatggatccgacctgcagaa

SEQ ID NO: 88946 - DNA, 1027 bp, Heterodera glycines
  SCN-specific regions: Sequence locations=1-168,190-195,225-442,464 -471,494-498,548-1027
gtataattgcttaagttaggccggtgtttaggcctaagctttcggctaggcctacgcttaggcttgattgggtctaggcttatgattagcttaagctttattttgtaaaatatgagttgccttttgtacaagttgccattgagccattttccgattatacaaaacatgtagaagccataaaaatctcatccctacttattttatttattaagtaattaatttttctctattttcagtaaatttatgagttcaaagcgcaaattacaggtttcttatttaaaagattggccattaaaaaattgacgaaacccaactcgtacttggccaacacgtactgccccaactcgtactgtttgacaaaaaaatcgtcataactcttgcaaagtcgactaaattaaactttcttggtgccattcgataactcttaaagttctccatctacatgaagcaaaatattagaaaattttattgcttttcaaaatttatgaccaaaaatggtaaaaaaatttttgttaattttttcaaattttttattctttaattttttcacatttcaattaattggctcccccattggttcatttccaaaaggtaataagcggctaagagagagaggcgtgcgttgtcccaacggccgcgccggcggcacggcgcggggtcacgcaagaattcggcacaaattacattccctctgaattggtccaacggcagacactccgtgagacgcgcaaaagcgtggatatcggctgatttgcaccgggacaaccaaaagcaggagaatattttgctgtccgtgctgcgcaattgggctttcctgaggcgcgtcctgtattacgcggtctgtgcagttgccatgggattggacatgattcacaccatcaaaattttcggtcgaattcacataactgagacagcactgaacgcgttgaacagtgcgtgccgtgtggaagtgggcagcgggccggaacattcacggcaccttgttgagaagggaatcaagcagacatcgctggtcgtctccgaggag

SEQ ID NO: 88947 - DNA, 651 bp, Heterodera glycines
  SCN-specific regions: Sequence locations=1-315,359-465,494-651
ttattcaatttgataaacaaattattaagccatcatccatccaatcgctcataaaacacactctttgttgctatcatctttatcattttcatctcaattgttttcgccatttgtccattggaatgccaacgccaagccgtgcccgggtgtatgccgatgtaaatgtaaacaaaccgcgtgaatactgggactacgagtgccatcagattcgatggggcaacattgacgactaccaattggtgcgcaaattgggccgtggcaaatactccgaagtgtttgagggtgttatggtgccatccgagcaaaaagtggtgatcaaaatactcaagccagtgaagaaaaagaaaatcaagcgagagatcaaaattctggagaatttacggggcggaaccaacgtgatcggactgctggacgtggtcaaagatccggtgtccagaacgccggcactcgtgtttgagtatgtgaacaacacggacttcaagcaattgtaccaaacactgtcggactacgagattcgctactatctgtacgagttgctcaaggcgttggagtactgccattccatgggcatcatgcaccgggacgtgaagccgcacaatgtgatgattgaccatgagaagcgccagctgcggctcattgactggggcctgg

SEQ ID NO: 88948 - DNA, 1959 bp, Heterodera glycines
  SCN-specific regions: Sequence locations=1-290,313-604,626-1627,1649 -1959
ccaagtttgagtttgtttatttggcattgcattacttacaactattaatcccgctgtttctgctggtcatttatggtcaatattctcacaatccgatggaccatctgcaccaccttgaggaatggcgcatggccatgcgcgcgggtcttgatgctatggcagccgtacaggctcctcctgctgaagaggatgttggtgaaaatggagatgacaacgcagcagcaccccacaacttattggcgtgggatggcggtgttctattggaagcagaaggcggtttcgtaccgctctaacttttacaaaaaatttaaaatgccaaaccaaaaggacggagtgacaggaggcaaacgaattgagcaggaacttgccgtgtttgaccttcccttttacatcgtcgcattggcctttttcctaaaggcgttcttccgtctgtatgacttgctcgtcttcgtcccattcaaattatttgctgaccctgagctggaaaaggaacgctctcgtgagcgaaaggccatgcccatcgatgggaagccgacttcgtcctggagacacgtcgataccattggcactgctctgtacaccgaactgtttgagggctgtccgacgcttggcaaaatttgggacaaagcggcacagttacaccgtggacacaattgcatgggcacgcgcgacattctcaatgtcgtcgaagaacagcagccggacgggaaagccttccaaaaattggcacttggcaaatgcaattggatgaactacgaacatgttgatgaagtgatcgtggaagtcgcttctggactcagcaatttgggcattgtccaaggacaaaaagtggtcattttctctgagaccaggaaggagtggatgatctcggccatcgcctgcttcaaattgggccttccaattgtcaccgtttatcccacgcttggtgacgaggcaattgcttttgccttggccgagtgcgacgccgttttggcgtttacttcgcgtccccttctgtcgaaagtgttctcttccgtcaaagactgtcctcagctgaaacgcgtcgtttacttcagcgaactgcacgcacttgccgaggtcgccgagaaagcgcctgatgcgataaaggaagcgttcaaaagtatcggacgcgaactgtacagctttaacgccctcaaggcactgggccattcgcaagcaaaactcgagcggaatgtgcagccggacgacttggcgatgatcatgtacacgagtggcaccaccggaaagccgaaaggagggcttttgtcgcatcgcaacatcatcccgaccgcttcgggacagagcgctgtcatttcagtcagtaccagcgacacaatcattggctatttgccgttggcccacattctcgaagtgtgcgccgaaatcatttgcctgtccaaagggtgccgagtcggttactcttcgcccagcactttgcatgaccgtgccgtgaagattaagaggggaaccactggcgattgcgtcgaactgaagccgactttgatcgcttgtgtgccggcagttatggacaagatcttcaaagcagttttggacgaggtcaaagaaaagtcgcccattcagcgcgaaatttttcgcatctgttacgaacggaagcgcaaccgatttgaaggagggtacaaaagtttggtgatggacagtttggcttttgccaaaatcagcaaaatgctcggtggcaaccttcgctttgtgatttctggcggtgctccgctcaatccggagacgcagcggttcatgaacatttgcttctgttgccccgtcgttcagggctatgggctgacggaaacttgcggtggcgccactttggcggatgaacacgacctcagcaccggttcggtcggaccgccgcttcggagttgtgaaattcggcttagagaatgggaggaagctggttatttgcccacaaattcgcctcctcagggcgaagttctgatccacggg

SEQ ID NO: 88949 - DNA, 849 bp, Heterodera glycines
  SCN-specific regions: Sequence locations=1-343,366-849
actccgaaagttgggccgtggcgtgcactttcttctcgatgctcttcggctaccctccgttccacagttccaatttggagtcgacttactcgcgcatccgtcgctgcgattactcttttcccgtgcgttatccgcccctttcaaagagtgctgttgacctcatcaaacggaccttaattcgtgagcctaaacagcgacttaccattggggaaatgttggcgcattcgtcactgaatccgcctaatttgaaccgcagttttattgatggaaacaatttgcagcaattctcaagaagtgcttcttgtcaacaatttacaacattagcgaagactgtggtactttctatttaaaaaatatttataaatgttctgattgttaattttttatcctcaacaaccgacagtctccaaaaatagtcctccgcctaagcagcccccgtccgcccacgactcgggcatgggcagtgacgaactgtcgggtggatgggtcgggagatttatgtgccaaacattggacaagtacataaacccgatgaccatgctaatgagtccattctcttctctcagcattgtgcccgttttgcctgcctctctcccggcctcttctgtctgcaaatgggtcgacttcaccaacaaacatgggttcggcgtcacttttcgtgatggcactcggtcgttgctattcaacgatcagtcgtccctttcaacgagttattgtcaacgatactttacctatcgagcacaaaaatttgttggcaattttgtcgaatggaattgtgacgacggttgtccatcggacgaacttctcaaaaaagccaccattatgcgctcttatcgtggttacatggac

SEQ ID NO: 88950 - DNA, 870 bp, Heterodera glycines
  SCN-specific regions: Sequence locations=1-870
gaacggcttccgttgcgcgccttcaaaaagatcggtcgcgttggcactctgcctgccctcgcgcacacttccgccgcttcggcggccattcagtcggtgatgagcagcggagacgaagcgacgacgccggcactgaccagcggagggggcgctagcagtacacggacggcgggcggaggcagcgcattccaacgatggggaggcaatcggagaggaagtcatttggtcggttgggactccgcgcggcctcagtctgctgcgcgacagcagcagcaaatgctggagagaatgtacagcaaaagcgaactgcacgaatatcagcagctgttcaaaatgttcgacacggacggaagcggcgccatcggatgcgaagaactgaagggagcgatgctgtccattgggttgcaagcggacgacgcggaaattgaacgactgatcaaagaagtggacgacacggaaatggttcgattgatatgtgatcactctttgccttcggattgtctctttctcctcccgcccattagtgaaattgatttccccgaattctgccaatgtatgaagcgaagtcagcagtcgggcggcatcaaaggtcgtctcagcaacgaagaagtgtcacggcaatgttttgaggtgttcgaccaggacagcaacggactgatcacggagaacgaattcatttacgtggccaaagaggtgggcggcttctcccaggaattggctgagtttgttttccgcgaattgctcggcgactcggccaccggacaactcgaccaaagcctcttctccgccattgtggacgattatttgttttccgacctcgcaagtggcggaggcaatgacggaacagtgggaaacaaatctccgaaaatt

SEQ ID NO: 88951 - DNA, 891 bp, Heterodera glycines
  SCN-specific regions: Sequence locations=1-289,312-891
gcggtggagaaagcggccgagcggggcggcgtttaccccgaggttttgtttcgagttgcccaccattggtacgatgacctgtacttggcccatttggagaacacccagcagcagcaggcgacaacgacggcgcttccgcccccggcccatccccagccgacccaacgcattgccccgcagcagtgcgtcgtccgtctgatgatgccctccccgctgcaccactcccaccagtcgcagcagcacttcttccccgtccattctgccgccgcttcgacttctgctgccgttgttttttccccttccgttcccccgccgccgacgcccccgcagcaatttgttgggcccaacgttgtcatccatcctcagcagcacaacctcagcaccggcaacaacttcatacagtacagccaccatctgcagcttacgcccacagccgtcccgctgttccacggccaaacggctgccgtctcaatggcaccaatttttcacaacggtcaggcgccatcggtttcatcctgttgttttctctcgcttccccctcctcaactacaagcagtacagccaccaacagttgtggatcataaacaaacatctcagcctcacctgcagcagtctgttgcccaatttggttcgaccattggctaccctcaccatcatcatgtcactgctcaccagccaccgctttccacgccacctcccccactgatgctgatggcattgcccggggcaaatgtagccgccagcgctttccccccgaggcacattttgcaaccgacaccagcacaacatcagcttccgaactacacacaacagcaacaacagacggcaaaccaacaatggacactgcaaaagggaatcggcaaacaacagcatcggattgaatggcgagca

SEQ ID NO: 88952 - DNA, 604 bp, Heterodera glycines
  SCN-specific regions: Sequence locations=1-151,173-604
acggcgcgtgctgatatcgcatgcaacaacgtaattgtggctctggacagactgatcgatgtgccgcaagcacccgacaagaaggcaatttgtgtgctcgcaaacaaccgggcagactcaaaagagggtgtgggaaccgtcatgtttcagcagaaagatggagaggatgtgcgtgttacggttgtaatcggcggcctcggtcctgaccatcagcatgcgctgacgatttatcagttcggcgaccttactgtttcttcgggcaatttccattcaactggaaagcattttagtcatgctggccaaaaacatagcccaccggaggccgtcagtcgtcacgttggagatttgggaaatatcaccgctgattcgaagggagtcgccaaaaggaattggtctgacaaagtgatctcactgtttggtcagaataacattattgggcgctcagtcgctgtacatgcacgaaaggatgactttggggaggggacacaggacgtgataaggagccgcgagagcggaaatgccggtcccattttgtcgtggggtggcattggccttgcttttgatacgaacatgtcaacttgttcggaggattttcagcgcgagt

SEQ ID NO: 88953 - DNA, 739 bp, Heterodera glycines
  SCN-specific regions: Sequence locations=1-94,116-446,474-739
gtgatgctcgtttccaactccgtgagcagctgatcatgtactgcataaatgatgttgccattcttcgagaatccgtgttgcgctttcgaaaactcatcggagaacacactcagggcctcgatccctttttggtgtcttcaacagctgctggtctggctttatcaacgctccgacgttgttttctaccgttcaaccgtttggttcactcacctgagggtggatacctccgtggacgacgagcttccgccgaatcccgccgatacatccggttcttcgagcttgaaaaccctggagcccaagtgcagtgcgcggattggtctgtgggagaggccaacattgaagacacaggctatcgtgtggacggcctctggcgacgagagcctccgcttcgtccactggccatcgagtggatgggttgctactatcatggtgttttatcgtcttaattttcaaataaaaatcttaaacgattaaaggatgtcccgactgttttccaaatcgaagacaaaagttggctgctgggagaactgcggaggatttatacgaaaggacgatgcggcgactctttgaactcgaacatacccatggatgtgagcttcacgtcgtatggggttgtgagtggaaagaacggctccgacgcgatttggagctcaagcagcgtttcgaagcagtatttgtcccgtgtccattggatccacgaaacgatgcactccgtggtggtcgtacggagccctttcaa

SEQ ID NO: 88954 - DNA, 564 bp, Heterodera glycines
  SCN-specific regions: Sequence locations=1-31,53-496,519-527,550-564
gaatgctgtaccgtccgtcgtcgtgttgccgcactgatcgttcaaattggatgatcgcctccgtgtcggcgtcttgtgttgggtcgtcgcgaattccgatcgcttcaaccgaccaaaactgttcgattgctttgaccgatggcatttgatcccgctcgtcctccccacatggggggatcgcgaataccgacgaatcgggagtaactcccgtcgtggtctgaaactgctccccgcaaatcacagtgccgaagacggtgtcgatcagataagtcccctccgccgtcttccgaaatccttgtacgaagtcccaaaatcgccgtattccgatcagcagctgcggttgcactgtgtcggtcgccgagcagtgttgcccgggagtacctcccgggattacgaattcggtcctgattggagtgcaaatcggtggcacctcagaaagctcaatactttcccattctccgtccagccgtttgagcttcactttgtatcttcccgattgtagcttcactttctttccaccgaacacttggattgccagctggtcactcccgaccttctcggggc

SEQ ID NO: 88955 - DNA, 594 bp, Heterodera glycines
  SCN-specific regions: Sequence locations=1-76,98-594
gtccagttaagcaatgtctcaaaagtgctcccaatcgcgcactttgagtgcatttgaaattgttccggtacgcggctgtaaactctccaaaagttcttcccgtcggcctgagttttgcgagtgttgtcccatccctcgcagtggccatcgcgtctttgctgactccgatttcatttacgtatttggcggatacaacccatttcactctcctgacagcacttacactgacttttggcgcttcaaccgtctcacccatttatggcaaaaatgcggcctttcctcctctgacccaacgactcagttgccgaattcgttggcttcttttgcattggcttcatcttctaggcccagcgagtgttttatttttgggggtaccggcattcccttcggtctcgccgcttcaaatgaattgcatcgaattcgaattgatttgcttgggaatgtcaatgttcggactgagccgaaacaaagctatgaacagagacaaaacacagcgaacattcggcagagggggcgcagtggcggggaggcggcggacgacgcggcggaacagcggctgatgcccccgcggatatacggacacgcaatgtgcag

SEQ ID NO: 88956 - DNA, 650 bp, Heterodera glycines
  SCN-specific regions: Sequence locations=1-650
ggaattattttcctaatgtgttctggaataccggaaggcacttatgaattgaaaattggcgctagttttctctgctcaaacaaatcgcgcccacccgaatttaacacattgcgttttgacttcaaaccagcttcaatttcctccgaggcctcggaagcgtacgtcgttcagtcgcagaatcaaaatgagaacaatttccaggtcgttgtgtttggagaggcgcagaaaaagaccattttcaaaggggcgaagaaggaaatcaaaggggacaaggagtgtttgttggtgtacaacagaaagagcaaggagttgtgcttggagagagtgtcggccaacataaatgtgaagacgacgagggacaccgatttggaccaaaaggcaatcagcgaaatcgaacggctgcaaaagcgtaggaggccaaagcaatatccgccgtcgccaaaggctcccgtcgaaaatgccacggcagtcgaaccgccggcggagcagcgcaaagagcgcacattttccacttcttcggcaggggacgaaattgacgaggacgacgaagagaatgtgtcggcattggaacagctaatggcgccaacgaaagtcgaacgatcggaggcggaggaggacatctttcacccagcacaacaacggccaaaaat

SEQ ID NO: 88957 - DNA, 704 bp, Heterodera glycines
  SCN-specific regions: Sequence locations=1-2,38-301,324-499,521-704
ttttgcttttccattttatttttgcattcaaaaatgtctctctcctcttacaattgaatttgcgttttatgtcgtcggtccgtcggatgttgtttttgttgggtcggaagtgctgctgttcgacagttccatgctcagcgacagctaacggattcgggtcgattcaacggagaaggctttggacttcgatggcacggctttcctcttccggtccatttatttgtatgatgccactcaaaaaacgacaaatgttcatttcagatgtgtataaacatgaccatttcctgcactttgaccatctgcacattgacaacattcactgtgccaggaagttggtcgtccatttgaggcccagcgagcgcacacttttgctgcaagcgctgaccgaattgaacgccgaggcgaagacggatggaaatggtcattcagaccatccgccttcgcctgctcagatgaagcagttgttcttcgtcaacacaatcccgttcgtcggcttcggtgtcctggacaacatgatcatgatcttggccggcgaatacattgatctttaccttggcactttgctgtgcatctccacaatggctgccgccgcgttgggcaacatcatttcggacgtggccggcgggggggtggcccattacgttgaacaattccccaggcatttgggctacaaacaccccgtgctccccccaaagcaattggag

SEQ ID NO: 88958 - DNA, 639 bp, Heterodera glycines
  SCN-specific regions: Sequence locations=1-71,93-239,262-338,360-639
ctttttttcgatccattaatttttctttattaaatgttggcacggatgaagaaattgttgagctcgggcgaccatgccgatgtcaattttttgatcgggaatgaagacagcaaagagattttgttggcgcacaaagcaattctgtcggtggcgtccgatgtgttcgcggcaatgtttcgtttttgacgccacaaatgcgacgagggccaccgttggaaaaccttttttgcggcctgtcgagatcaccgacgtggagcccagcgcgttcaaagtgttgctgaacttcatttattgggacgacctaagcgaacgtaatggcgacaacgcaattgctttactttacgcagccaaaaaatacaaaatccccgagttggtcaaagcgtgtgttgaattccccgtttctgagctgcgtgacattttctctgcactcgtacgaacccgtattcttgaagaggaggaatttgctgctcgatgtttgaattacattgaccaaaatgcggactttctgttccgttccaacgctttcttacaaattgacaacaaattgttgtgcgaacttttgggccgcgatcagttgctgatcagacgagaaatcagtgtttggattgcggcacttcgttgggcggacgaacattgctg

SEQ ID NO: 88959 - DNA, 616 bp, Heterodera glycines
  SCN-specific regions: Sequence locations=1-176,351-512,534-616
caacgaacgaacgacttcagtgcgcccaacaacaacacaatgacttctcactttctcgtcggcgttgcagccttcggggcgggaatgtgcttcgcgaagacgtacatggagaaaccgaagagcgaagacgacaaagaagcgcccaagaaggaagaagccacgaccggcggcgaagcggaggagaaggcaaagaagaaggacaagaaaggcgacggcgcagctgcggcggacaagaaggaggagaagcgctaggacaaacacaaatcgaaggaggggaagagcgacgacagcaaccgccgttccaagaaggacaagcacgggaagaaggacaaaaaggacaagaagaaggacgccgccgagccagccgctaacgccggagaacaaagcacagcggagacgacccaagcggacgaatagccagcgatgagaacgacgacggtgcacgacgacctcttccttcacgatcagtcccccctactgcttgctgttgtttgtgtgaagtccgttccccatattttgtacatattccatgtgatcagagcgaccttcctaatgtgatcaaaatatggatgtatgtataatatccattaatttgctgctttcatattccctattt

SEQ ID NO: 88960 - DNA, 641 bp, Heterodera glycines
  SCN-specific regions: Sequence locations=1-12,34-641
gtttgagatacttaaatttaaaatttgcatttcaaatggcaacaaaaccgctcctctactgctactggcgcagctcatgctcctggcgagttcgaatcgcattgcatttgaagggcattgaatttgatcagcgcattgtcaatttgttgaacggtgatcagaacaaagatgaatttttgtccaaacttccgttcgccaaagtcccagtgtttgtccatgacaatttagtgctgtccgaaagtatggcaatcattgaatatttggacgaaaaattccccgaacccaaccctttgttcccaaaaagtgccgaagatcgtgcacacgtgcgggcacttgcgcttcaaattgtcgcaaatacgcaaccgctacaaaatttgggtgttctcaagcacctttctgaagagccggccaaacgaaatgcctgggctcgtcattggatcgagcagtcattcaatgtttttgagaaagcattggccaaaaacgcaagcaaatatgcctacggggatcagatcaggttggccgacatttgcattccgccacaagtgtataacgccaagcgctttggcgtcgatatggcgcaattcccgatcattgcacgactggacgaaacactagcggaagtgccggcgtttaaagtgccg

SEQ ID NO: 88961 - DNA, 562 bp, Heterodera glycines
  SCN-specific regions: Sequence locations=1-214,236-523,546-562
atttatttaagattttaaagtaaaaaagtgctttgtttgcttcatgcctgtctttgcgcttcaaatgagtgccaatttggtcggtgtcactgaccttcgtccgtcggattacgacgaccatcggtggtaccttaagctcaaatgttccgcgtgtggcgagtcgtatccctccgagcaatacgccaacactcgggaaacgcacactttgaccaaagggaaaggcatttgtcacatttccgccaaatgttccttttgcggcagaatcaattcactcgagattctcattgattcctatgcgagttattctgctgacaaaaatcggcttttccaaacattggtaaaattcgaatgccgcggaattgagccgacttcgttcgacccccggattggttggatttgcgttggcacagaatcgggctcaattttcgatgaaattgacctcaacgaattggaatgggccgattacgatgagaagaattcttccgccgttgagattaatgacatttcatttcgatttgttagagtttaattttaaaatatgaaaaacaatcattaacagaaa

SEQ ID NO: 88962 - DNA, 890 bp, Heterodera glycines
  SCN-specific regions: Sequence locations=1-779,802-890
ctcttgaatatgattttaaaaaattcatcttccataagatacaaagcgaaggatggccaatgctgaagaggtttgcccaacgtattctgaggccttttcccatgggaatgacgacggttcgttttgcactatcactgagtttaaacggaataaactcgaaaccgaagctcgcaagaattgggatcgcttctacaaaagaaattcggacaatttcttcaaggaccgaaattggacaaagcgagagattgagcaaatgtgcgcaaaagacatggaactgagtgtaatagtgaagcgaaaatgattgaggggaagaatgactcacgaggaaagggggacgaaagtgaacttcaaaaatggaatttaacccacgggactctctttctctccttttctacgccttttgcagcggaatgccctcctcacaaattcacaaatcaggcaacaaattccaattctgtggcctcgtcacttctcgggtttcggttatgatacaaaaaacgacctcacgttagtcgtggtttatatgtacgaaattcacccaactttctgcccaattcttttggttccaaagatttttctcggcctttactttttaggctcctttgactttgcttgacgccggttgcggctgtggcaacactttattcccattggccaaattcttccccaattggactttctgtggcgtcgatttttcctcaaatgccctctctttgcttcagcaaagggctgtacaaattggaactaacattcataccgaattggtggatctgtcgggcgataccctcgtcaatttctcttcgcttcctaaagctgatctgatcactctgatcttcgttctctcctccatttccttggagcatcattcaaaagttgtccagaatttgaga

SEQ ID NO: 88963 - DNA, 852 bp, Heterodera glycines
  SCN-specific regions: Sequence locations=1-10,32-32,55-399,421-852
cgcagttcagtctttttcctcctctccttctgctcatttctcctaattcttctcaaacgtcaaaatgctttctgaaattccgcttccccaccaaaaaggcatcgtcgaccctcgtcttccctgcaaaattcaaattgtcggccgtgccaatgacgtcgcgaaacgtttcgaagtgaatcttttgtcacaaacaggcgaacaccttctccatttcaacccgcgcttcgatgaacattgcgtggtgcgaagcagcacaaaagacggccaatggcaagcggaagaaaggggagggaccaatcccttcgtggccgggcagcctttctcgctcgatctgctggttgagcaaggcctaattgagtgttctgtgaatggcttccaattctgtgaatttgccgcgcgggatgacttctcccaattgggcgctgtttccgttggcggtgacattcagctgaactctttggaagtgtccaccgccgagggtcccgcgattgcccatgaaggcggcgataaggggccgcgcgaagctgacgaggaaaatgcgcaagaacagccgcccattgtgatgccggcccatcccgaaccgcaaccggtgccagccgaaccgactccccagcagccgcagcctccaccggcccaggggccgctgtcggtgccttaccaagctccgctccatgcgttgcttcagactaaccgaatgcgcgtcgtcggtgtcccccgcccgggggcacagcgcttcacagtgaatttcaaaacgcacgacggagagacacttttccatttcaatgctcgctttgatcaaaactgtgtggtgcgcaacgccagcgtgaacagacaatacgcgccggaggggga

SEQ ID NO: 88964 - DNA, 638 bp, Heterodera glycines
  SCN-specific regions: Sequence locations=1-111,133-253,275-638
gtttaacttcttatgtacatccgagagttagaatccccgggtgagctccctctggttttgttaaatgcgcctcgttcttgctgtcgtccgactaaacatgaacaattccgagcagttttaaatctgagaagaactgcgcaacgccttacggtcgaaaactcgaggttgaacagaatgaacgcgatgctggttgtactttttcagcgtcttacaggaggagttctgcctcatcaggccgtgcccgtcgctggtgcttttggccaaaaacaaaaccaacagccggctaatgcttttgccgttccaccggttgtacctgttgtgcctgtcaacgcgaacaataacaacagacacagctacaatgaattacagcgcgaacttgatacattgacggggactgttgatgtgttaacggagcaaaactctcgattggcacatacgaacggtgtcctctttggacatgtttttagaagtgtgccgcctaatgtccctccaccgtttgtacccgtcgctcaggctgttccacagcaccaaccgcacaacgccgcagttgctttgccgcacaatgtcaaccccaacccgccgggagttttccaaccgggtcagcaattgtttgacgacaattttgttgatgcttatct

SEQ ID NO: 88965 - DNA, 914 bp, Heterodera glycines
  SCN-specific regions: Sequence locations=1-8,32-438,487-888,910-914
attaggctgaatgataatgataataataatcattagctaaaaggtcgcgtggacattgttctgtgcagcgcggcattgctttacgttgtgcccattttggagctgaacgacgcggacattcagcgatcgatggatgtaaatgcgatgggcaccattaatgtgagcactgatcaaccggttaatcagtgatgtattttgacttttaaattctcggggtagtcccggccccgctttaaattgtcctttttttcttttccaatttggcattttccattctcttcccaattgctaatggctttttgtcagacaattcgcgtctttttgcccgaaatggaagcccggggcaaagggcacattgtcgcgatgggctcaatcgcctcacattttggcgaagtgttccaaatggcgtacaggtggtcaatgggcaaagatgaaaagtatttttgtaattagatatatttttttaatattttaaaaaataattttgtgtcagtccaacaaaatttgcggtgcgtggcgccatggaatgccttcgggtggagctgaaggaacgcgggctggaggacattctctgcacgaccatttacccattttatgttcgcactcccatggtcacttcaaagggactccgtccggtggcacgttggttgccctttctgacggttgaagagtgtgccaaaagtgtcgtggacgcaattttgaaggagaaagtgaacgcgtgcattccgtggtggcttaactcttttgtggcgcttaatggcattttcggcatcaatatgaacaatgtatcgagggattttctcgacattcatttcgaaccttcgaattatgaggacgggcaaaaaagcttcggaagaattcgaaattcgggtgaaatcggacgaaaacggcgccaaaaaaggggacaatacaaa

SEQ ID NO: 88966 - DNA, 652 bp, Heterodera glycines
  SCN-specific regions: Sequence locations=1-652
gtccaattaagcacaccatccacaaattttatccgagactgttttattgttttcggcaataactccgacgacaccttctccaaatacgcgaatatttgacgagatggacagacgaattaacaaaacagcgcggaacagaacgtgcagcatggtaacagtgacaacaaatggcaggcagcaaccgagaaagatagactatctgatcaagaagtttgatgcacttggatctggacgaccgccgatgccaacaagcgaaagtccgtcgaccagcgtcgattcccaattccttccggtcaccaaatctgcttcaacaaccatcgcgtcggcacttggatctggacgatcgccgatgccaacaagcgaaagtccgtcgaccagcgtcgattcccaattccttccggtcaccaaatctgcttcaacaaccatcgcgtcggcacttggatctggacgatcgccgatgccaacaagcgaaagtccgtcgaccagcgtcgaatcccaattccttccggtcaccaaatctgcttcaacaaccatcgcgtcaaatccatctgactgtgcgctaactcctcagcagaaatattgccgcaaaagagcactgatggagccatcgcaacacgaattggctatcatccgaaatgttctcagcttcgat

SEQ ID NO: 88967 - DNA, 626 bp, Heterodera glycines
  SCN-specific regions: Sequence locations=1-554,576-626
aaatggtgactgttgctgccaatgataaaaacgtagatgagcccaatcggtattgtcagtcaaagggttgtaaaaaacctgtggaaggcaacctccgttgtccaacctgtgtcaagatgggacgacccgatgcattcttttgctcacaaacatgttttaaagcttcttggttggaacataagttgtgccataaagacgattcgtccaatatcaacgagtacaacccgtggcctttgtatcaattcagtggaacgcttaggcccgccccacaaagtgcgcgccgcgctgtcccggaacatattccttggcctgattatgcgttgcatccggaaggcgtttcgttggaggaacgaaacgcacgaaacagtggacaaattcgggtgttgaacgaggaggaacagttgggaatgcgtttggccgccaaattgggccgcgaggtgctcgacgaggcggcacgtgccattgagcctggcgtgaccaccgatgagattgaccgtgttgtgcaccaagcgtgcattgaacgggagtgctatccgaacccactgggctactacaaattccccaaaaattgttgtacgtccgtcaaccagggcatttgccatggcatcccggataaacaggcactt

SEQ ID NO: 88968 - DNA, 652 bp, Heterodera glycines
  SCN-specific regions: Sequence locations=1-652
attcactttctagtattacgccgacttaaactttctcagaaatgacatcaaaaattgaatctactatcgccagcagttttcgaaaatttcttttttggtttcgttatgatggttcaaaattcccagccatggcaaagggttctgactctcgcaacgggccaagtgtcatgcaggtggtcgaatcgtgtcttcaaaaattatttgctacagagaattcggaccaaatcaaaacgttcgctataagcagaacggatgcgaaagtgcacgccattcgatcgccgattctcatcggattgcccgtcgcttgcgattggttcagtcagtcagaattggccaggacagaattccttctatgttttaatgaccaaattcgcaataatggatttacgaatgcgatcgaattgcttcacgttgaccccgtcgcaatgggatttcacccgtgttttcatgtttcctataggcggtatatctatcgtcttcgcgtcatttcgacagagcaaagccttaattacccaaatcgcttcttcgcccatttgtcccatgtaattccctcggacccttcgctggcgtccctctccgaattcaattacagttggaccattccgccgacttttaacatcgaaagggcccaatttgtgtgcgacctcctgaa

SEQ ID NO: 88969 - DNA, 643 bp, Heterodera glycines
  SCN-specific regions: Sequence locations=1-448,470-643
ctttataaatggttaaatgattttttattgcaggattggtagttttcagattccaaccgcagcaaaacggcggcggcgactcggcggacaaaattgggccggaccaaatgcgtgagcgcacagatcgccgcctacaaaatgttggcacgcaatgcctcgtgcaccgctcagagaggttcgtacaacgcaaatcattcttcggattggcacagcgacaattttgcgggtttagaaaccacaatttttccgtttttgaagtccacttaatttttaatgggtttaaatgttaaccatgtaaagtttggcacgtacattgccggattgaattacatcatagtcttggttttcctcatgatttgtcacaaatttggctctatttttcggtccatgattcggaattgattgaagaacgtcatattaatggttggagatccaagaaccatcgcaaaactattttaaaaaatatgtacactttgccattttttgcgcaggtgagcgaccggaaacgggacgacacattgccgctgccgtatgaatatccgtacgagttgccggtcgggcgcaaattgccgtacgaattgtccaaaattttgctgatccttgagcagcggacaaacacacggacaacggacattccgacacc

SEQ ID NO: 88970 - DNA, 811 bp, Heterodera glycines
  SCN-specific regions: Sequence locations=1-169,192-230,252-790
caccacttttctgtgctttttgtcctctcttttttctcttttcccttatttttcgccgtttttgtttcatcagcagcggaacaaaatgcgaatcttcaaaagcaacaacaattgttcaccattgagggcaaaacggttgtcaatgccgaattgcagcggataaagccaaattggaaggccggggaagaggatatttttggactacggaaaattcgttgggtttatcagacaggacggctctttcattgttcccgacgtgccttccggctcctacattctcgaggtggccagtggcgactttcaattcgagtccgtccgtgtggacatcacaaattcgggcaaaatccgtgcccgtcgtctcaacttggtccaaccgaatgtcgtctccacattgccttaccctgtcaaattaaccgcacggcatccgatgagatatttccgagtgcgcgaagaatggcgtgtcactgacgtgttgatgaacccgatgatgctgatgatgggcgccgcatttatcctcgttgtgttgatgcccaaattagccgctcaagacccgaacgtgcaaaaggaaatgcaaaatatgcagctgccaaaggttgacatgccagacatggccgacatgctggctaacatttggtcatctggtagcaacaagaaaggcagccgtaaacagatttcgtcgggccagagcacgaaacgtgtcacacgatgaatcatgacaaatcacaaagaccagccaatcatttccttttggaaattttattttgtagtcagtgcataaattttttaaattaaaaaaaaaaaaaaaaaaaaa

SEQ ID NO: 88971 - DNA, 462 bp, Heterodera glycines
  SCN-specific regions: Sequence locations=1-354,383-462
tgacgctgctcgtgcgctaatggaccgttacccgccgactgtcatttgcgagtttcgagaagagtaccttcgcatctgcgacaggcataagcggctaattgcggtagaacggctgcaaaaacggatggagatggaacccatcagaagcggtggtgcccgtcgttcttctgcctttctcctccctttgctccaaagggacaacatttacgcgttggctggtgcgggtgccgtcgctttgctcagcgcagcaattgtccattattggacctactgattttgggacggtggagactcaacaacatacaaaacaacacatgcacacatacattccacacagaatatattacccatcacatatatataaatacatatttatttctcattttctcaattggaatgatttatgtaaaattaacaacaccatttaatgtaatatgtgaatgaacaataatgtgcttaaaa

SEQ ID NO: 88972 - DNA, 629 bp, Heterodera glycines
  SCN-specific regions: Sequence locations=1-467,489-585,614-629
tggaatactatctgaacctggccaaacagcttgtgaatgcgaatgcgcacattctgtcgattaaagacatggccggtgtgctgaagcccgaagcggccaaacttctcatcactgcacttcgtgaccaacacccggatgttccgattcacgtgcacacacatgacacttctggtgcaggtgtggccagcatgatcgaatgtgcccgtgcgggtgcggacgcgatagacgcggctatcgactcgatgagcggaatgacttctcagccttcgatgggtgcaattgtggcttcgttgcagcggacaccgcactccaccggtttggaaatggactcgatttcgcgatacaacgcttattgggagacggcacgtcaattttaccaacccttcgaatgcacggtgacaatgaaaagtggcaactcggatgtgtacaaccacgccatccccgggggtcaatatacgaatctccaattccaggcattttctctggggctgggcgagaagttcgacgaggtgaagaaaatgtacgccgaagcgaatttggcacttggagacattatcaaagttactccatcttcgaaaattgtcggggacttggcccagtttatggtgcagaacaaactcacgaaagaa

SEQ ID NO: 88973 - DNA, 655 bp, Heterodera glycines
  SCN-specific regions: Sequence locations=1-120,142-655
cgcattttaatttcctaaaataacaaatttctcctgctaattcctataataaatcatggattctccgccaacatccacctcaaaattaatgcaaatcccattgctttcggccaaacggcgaaaagaagtgctcaattttcaatggcctttcccgaaacatcccggcttgctttaccgacttggttcaaatgccgtaattttagctgtgttcagtttggcaaagcttgttttttgctttaataaaattctcgttcaacctgaacaaaagaagctcgttttggacttgctcaatgatcggaatcgtccgttggtcaccatcagcaatcataggtgcgtcgtcgatgaccccctcatttggtcaatgttcacatttcgcgagtttttgtccaatatttcccgatttcgttatattctcactgcccacgacatttgtttcaccaaaaaatctcacattttttttttctcacttggccggtgtgtccccgttgttcgtggtgctggcgttttccaggagggagttgatcactgtgtggatatgctcaactccaatggttgggttcacctctttccggagggacgagtgacaacggaaagtgggccgattaaggggggcattggacccattaatttccgaaatcgaacaaacccgccaatt

SEQ ID NO: 88974 - DNA, 654 bp, Heterodera glycines
  SCN-specific regions: Sequence locations=1-654
accagcggcttctgccctcccccgcggcggcatttgtcccctctccgaatggcactgtctctgtgccatctttgccctcctctccaacaacaagaacaacaacaacagcgatgatcagtgtgccggccatcgcaacagtcactgcaacttctttggcttcttcaagggtcccctcttcaagcagtccttcgcccgtggcaattcatccgacaatttccaccaaagcggcgacttcgtccgccccaatcattttgctacccaacaaaaggagcaaagaggggcaccaatcgcagaagcaaacaatggccaaagaaatggcgacagattttgccgctgaaagcaaaggggggagagaaagcgaaattcgaagggcacccgcgagacaaaacgcagaggacgaatggacgaaggccaacgagttggacgagaagggcattccgccgacacagcgaacggcgccgaaattgagcacgacaacgccggcgacaacaacagctcatttttgggtgatcaaagacccgcgagaagcgcgccgagagcgactgttgcagctgcgtcggaaattggacccaaacccggaaccaccgaccaccacaacaacttcggctccgctattgcctttatcgccccaatttgaactccatcgcattcgcg

SEQ ID NO: 88975 - DNA, 1015 bp, Heterodera glycines
  SCN-specific regions: Sequence locations=1-572,596-993
acttcagcgggtactgctacaaggcgttcaccaacgcggacaaagaagtcaaatattcggaagcgcagaagatttgcaagtcggacggggccgaactcgtgtcgatgcactcggagttggagcgcgagtttgtgaatgttgtggcactgactgcggcgaagaaatacgaatacaacgccaaggtgccgggattggccttctactggaccagcatgcagttggagtgggacgagaagaagctaaagaacgccagctgggccgacatgacgccgatggactacttgagcccgatggagtggggcacgaagaagcgtccggtgtacgtggacaactcgaacggcggcgagtacaacaaagaaaacgaaaactgcgtgttcattggccaatggccacgcgagggcaagcagtacctgaagttggactcggcagtagacaagtacggtctggacgtgctgtggagagacgaggtgtgcgagaagccgggcgaggactgtccgcgcggcgccgtgtgtaagaagagggctacggtgggcgaatgctacggcacgggggcgtatctcctggacgcggccgaggaggaggagatgaagaagctgctcaaattcatcactgtcggatccggcacttttgtctatgctgaaaagaacacatacatggtcctcctgctgaaggacttgtacggcaaacagatgaaggaggaggacaggaagaaggtgtgcgcttactacaaggcggagtacgtcactgtaaaggccgagccgaacaaagtgcaagaatatgtggacaaagtgttgtccaagcagaagcagatgtacgcggatgcgagcgaccacatgctgtgtaagttcagcgggacactcggcggatgcggcgactattgcaaaacgggatattgagaagggacggacggaagggaaggaacactttctcattagcatttagtcgtcctttgttttagttaaaatggtgcgctttttctctctgatttattgcataaataaaaaattttaaaaaa

SEQ ID NO: 88976 - DNA, 789 bp, Heterodera glycines
  SCN-specific regions: Sequence locations=1-135,157-637,659-789
ccacaaaagccaaccgacgctgttgccgcgggcgaatttgctgcgtttctcccgcgaaatcgcggaatggaacgagcgatgcttccccggatggatcaatcggcgcctgcccgccagtgtcacggaggacttcaaccggtgccgcctctgcggtttggacgtacggcaaacatcgcggcacattgcggagtaccatcctgaacatcccgctgcaccagtgtccattgtgcgagtacggcgcggccgaggcacggcttgtgcaacgacacatgcgcaacaatcacacgctgaaggaatgcgaggcaagcgaacggacagacgaaagggtaaaaaagacaaagggacagacgaaatttaagggcatggaacccatcgccaacgtggagaagcacagagccgaattctcggagttgcacaaccaatgcttcccgggcagaccaaaacggttgtccaacattacaattgcggacgaaagcagaagggcaaagtgccgaggatgtgctcaggtgagagacagtgagggggggggggacaaattgccatttgatggggaaaaattggggcgtttccaaggaatgagaaaatggcatttccgtttccatccattcttttgagttcaaagcccccgcccgagactcattttccaaattaaacttttgcccatctcagactatcagtaagaagcgtcgtctgctgcatttgctggagaagcatctgaagaagcccatctacaagtgcaagtactgcttgttcacctccacccacgacaaagcgacggtggacacccat

SEQ ID NO: 88977 - DNA, 480 bp, Heterodera glycines
  SCN-specific regions: Sequence locations=1-284,306-368,406-444
ctccccacaaattacccaattctcattgacaaacctacgaaaaaatgcattctttcaagctttttgcatcgctctttcttgtactttgtgtggtttcacttgtcatctgccaggacaagccagcagcagcatgcaaaccgcccaaaagtgtgggaagaggcaacttggcactcacgcgatggtggtgggacggccgtagttgtaagcaattcatctacaaagggcagggcggcaacacaaacaatttcccatcaaagaagctttgtgaggacgtatgcaagccctaaatgaatgaatgatgaatgtgatgagtcggacggagaaagaatgtgctgcaacccaagaagagaattcaaagaaaaaaggagatggaaatgatttaaatttgtcaaaaaataaataaattcatagcggtagaaaatttttgataaataaatcatttttaaaaaaaaaaaaaaaaaaaaaaaaaaaaaaaaaaaa

SEQ ID NO: 88978 - DNA, 1228 bp, Heterodera glycines
  SCN-specific regions: Sequence locations=1-277,299-676,698-793,815 -1228
ggtcggccaccaaagggattcgttccgcgtcggttggtgcgaaagttgtgccgactttggtgtgccgccctttgtgtgcacgactgtcgctacaccgcgatcaccggattgtacgtggagaccgccggcttcctgggatcggcggggcctccgctcgcgcaaatgcggtacagaccgccaaccaaatggcaaagatcggcgccgggcaggcggcagaacagcagcggcgatgccgtcggccgtggattggccaatgttgcaatttttgacaacccttggccagcctggcccccactggaggcgcccgtgggcgcaaatgccggcacgccgttgcctcgggcagcaactgccgaaaactaaatatggaacaactctcagcggtacagcccgaaaataaaattgaaattgaacagccaaacgaaggagacgctgacggagaacagcaaccggcggaaccgattcaattgatcgataaggaaagagaatatttagcggtaaaagctgcgagtagggcagtgatctcacatctctcagagtggagcacgccgattgaaatgcggttcgcaatggacggcaccgtcgaaacaaaacggaaaatgcggaggcgtttttgcatcgaccgtcaacaaatgctgcatgatattgaatgtatgtatgcgccaaaaataggtataaaacagattctcaatgtggacattgtcgggtgccaagacgaaatcagccaagctactgaaaatgtataccaaatggtctacgacggaggtttcttccgcaaacaaactgggttatgcaatttcaaggttctcaagcctacaccaaccactaaaaatgttcttgacaatgttattaacgggattttgcatggctgtcttatacatgtccaggaaacgattcttaagaataaggaaatggtaaaaaaattggccaagtgtttggccgagaaggaaaacaacagaatgggcgaagctgaaatttccgatttcttctaacaatacaacgcggacaaagtcgcaaccggtcaaaaaaccgatggaagtgatgggaacagtaaagtgaccgatacaatggaagtgtagacccgatcgatttgcatggaatgcataacatttttaaaaaaatcttattttttgttaacaaatctcaccaattttcacattgaaaaatttttatgcgtcagaagtgttttttaaaaaaacttatgcttcataaatatgtattttggtaaaaa

SEQ ID NO: 88979 - DNA, 883 bp, Heterodera glycines
  SCN-specific regions: Sequence locations=1-32,54-324,348-393,418 -473,495-657,681-845,867-883
atttggtccgaagtcagtcagctgaagggaatgcctctgctggtcgccggaaaccgtactgcgcgtagcgcatacggtagctgccaagagtgttgctccggcggtgcccaaggccaacccggacaaaccccgcagacgccttgcgagcaagtgcacccgcctccatgcaccccgtgccctggcggtcagcccggtaacaatggcccacctggacccccgggagcgccaggagcacccggccagcccggcaccggaggaggacagccgcaacccggagagcccggcccacctggacccaatggccagcccggacaacccggacagcccggagcgcctggacagcccggacaacccgcaagcccaccgccaacggagcccgctcctgcaggcccacctggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacacgaagacgttaagaaaagcgattctgatcagtggaagaaaaagcagaaaaacagcagcgattgccctcccctcccccggtgcccttctccgtccccatttcccactgcctttctttcccttcctttttttattttgtttagcttttccaattctcccaaattccctcccccccccccccctctgaatttcttttctttgtaatcgccgctatgccaagttgcaaaacatcagcaacaaataaagaatgaatttcaaaaa

SEQ ID NO: 88980 - DNA, 601 bp, Heterodera glycines
  SCN-specific regions: Sequence locations=1-211,233-264,378-601
ctcctttgttactcgatgatcaaagcttatcagcgttttattctccgctttttttttgtttctcttttcttattgtcaattaatgctcagcgatacggtagccacagttatgggagcggaacatacggaacaaattattggagcagcagttacggtaactcaagaacacagcccagctatggatacggtgggcaacagagcagatacggtacccatgaacaaaacggtggcgaaaatggacaattcgagcgacaaaacgcatggagaggaggaggaggacaatggggacagaatcagcagaattggggacagccgcagcagcagcagggagcaacagcagctgtagaaggaggatggggacgacgacagcagcagcaattcccctcccccgcgcccccaaaaacgcaaaacaattgggacaattccgacaatttcgccccttcgaccgcacaaaatcgcggaaaattgcgcgtcgaccttccgccgggtgcacccggcacaatggaggcagcggacgccgatcagtcgagcaaataaatggagaaaaatgtggcaactttgtgccatttctgtaattttatccttttgcctttgggaggaa

SEQ ID NO: 88981 - DNA, 640 bp, Heterodera glycines
  SCN-specific regions: Sequence locations=1-27,70-544,577-640
gccaaggggttgcagccttggcgcagtacgacaacaacaacgaccacgacaacaacggtgacaacgacaccgattccgcagcgaccgccggcacccgtcgtcacccctccggcggcgccgccacgtgccgttctgcccgatttgccaccacaaaccgtgccaacaaatgcgagattgcaaaactttggcccatcggcgaatgagttgcagatgaaccgacgggtggacagctccacagacaacgatggacaatcagcatcgacactcagacaggcaaacaaaggggggacgagaaggggcgggacgaaaagacaggataaagcaaatagggcacttcacatgcgattggcacggttacgccaaagtcagctggcagcaaagcgcgaatttgaacggaacatgcaaatgaaagcaaataatgccgcccaatcaccggcatcgaattgcttcgacagagctccatggtgttccggatggatccaatcctcgccgttgatctgtcgtacatcgtccatttacatgcgccaagactgtgccaagtcgtgcgggttctgcagcagcagcagctgaagcgggcacagctcgccggcggacttcaaaaatcagcagccaagcgaaaagaaagatctcatcgttacag

SEQ ID NO: 88982 - DNA, 627 bp, Heterodera glycines
  SCN-specific regions: Sequence locations=1-627
gtttcgctcgacaaacaaacgccgaaactcactgagcaaatgatccgaaaatgccaagttctgcccatcgatttgccgcgtggcattgagacacagcgcgacaaagggatgattcagaacaataacccattctttcgtgctcacggtgttcgtgttgagacgaacatgatgcaagcagaggcgcaacacctttaccctccggcactcggtttctcggcacaaaatgaacaaatcgaaccgaacaatcgtggcgtgttggacttccgtttggctgaccgtggacaaccgttgccccgtcgctatttgcttccgtgtgaatttccggaggtttggactgttgtcatcgtgcaaaattctattcgcatggaccaatgcagatacttttgtgagaatttgatgcgatgtgctcaagcacgcggtgttcagatgggaaagccaagaattgatcctatggaagacacttcgcttaattatgttcgtgaaagattcgacttttattcaaaacatcgctgtcaatttggtcttttcattgcgaccggaaaggaatcaactcgtgttggcgacgtgcaccatgtgttcaaactgcaggaagtcgaacatggtgttctgactcaacatgtctcgcct

SEQ ID NO: 88983 - DNA, 626 bp, Heterodera glycines
  SCN-specific regions: Sequence locations=1-15,62-76,98-626
ggagaggcaaaaccgataatttaaaaattaaatatccaaaaataatattattgtatatattctccatcatttttttagaattattgtaaagctttcttctcatcaaaacattgcatgccttcccttttttcagacttatgaccgggaaaattgcattttaacgccagccccttgcacaatttgcgcatacgccgcgacccatggccaacttccggcaaaacttttcgatttcaccaaagaagcggtcgccgtgttggagtccattcggttcatcaacaattccggcgtcgcatacttggccgaattgttcagagggcaattgggcaaaaaggcagtgaagcgaaaagtacggaagcgcaagcaatccaccgacaataaatgaccatgtctttaggtggatgacaatggacacggacgactgccaattttcgcaatgggcagagggttgagtgaacaggtggaaaattcgttttcttaccgccacaatcaaaaaaatattcaaatgcccttgaaggactgccaacgtttcatccgtaagcttgtgatcaatgggtatttggacgaacggttggtcaccacggcacaccaaactgtgatcggctacataagcgtagcgtcgaaagggc

SEQ ID NO: 88984 - DNA, 629 bp, Heterodera glycines
  SCN-specific regions: Sequence locations=1-629
aattcgtgttaacaaatgatataatgaagcctctgaaaattgacgtggatttcccctcgaatagtcatcccacttcccaagaattaaaccaagattgtattcctttgtacgaaatgcttgaattcgaggaacttcaattcccaaactattacctttccgaacaattgggaaggggtgcccatgcgacagtgatgccgtgccatttccatgggaagccggcagcggccaaacttttcaatgccaacgtggacttcaaaacgatccaaaaggaggccaagctgttgcacgagtttcgccatgaaaacatcattgaattgtacgctcttttccacgggacaatgtccggattggtgctggaactgatggagggcggttctctgagtgaatgtgagtcaaattttggcatttcgaaacgcactgacaaatcactgtgccagcagtaattcaccagcgcaaaagcatcgtttatcaggtggcacaaaactatgcaaaaatgaccaattgttaacagaattgtcatgtgattaattggactttccaagtggccaaagcattggaatatttgcacaagcttagtttcatccatcgcgacgtcaaaccctccaatatgttgctgtctcttgattatg

SEQ ID NO: 88985 - DNA, 1046 bp, Heterodera glycines
  SCN-specific regions: Sequence locations=1-289,311-957,994-1001,1040 -1046
gcatttttcggcgttgtaatgtcaacggttgccacggtgatttgcatactcagcgtgccgctggcctaccaaaacttccagcagattggcaccaaaatgcagaatgagctcgagttttgcaagcagcgttcagggaacatactccgtgagctaacgcgtacgcaaacgcttgcccaagtggtcggcatcattggaaacgcacgtggcaacggcgcagccaaggccagaacggcaaggcacctcgtttacggcgaagcgggcgtctcgggttccgccgcgcaagccggcctctgctgcggctgtggcgtgtccccgcccggattgcccggacctcccggcccggtcggacagcccggatttgacggagtgccgggagcacctggacaaacagggccaaatggccaagccggtgcgagtggtggcggatcctttggcgcgggctgtggtgaatgtcagcctgcccaacccggtctgcctggcccgcccggacttcccggtccttccggaaacccgggacttcctggcccgaacggaggccaagggccgctgggaccgcctggtccacctgggcctgatggtcaacctggtgagtctggccagtctggccaacccggagcccccggcagaatcacagggtacggcccgacagtcgtcggacccccgggaccacccggacccaacgggtacccaggtgctcctggccaaccaggactgcccggctcgtttggacagcccggggggccgggacagcccggcgacgcgggaaagcccggcacgcccggaaaccccggagggaacggcggtccgggagttgccggcgaaattggaaatatgggcacatgcgaccactgcccaacgccacgcaccgccccgggctattaaacggaagaaaacagaacgaacaaaggaaattcgacgcagaaaacttctattttccgtaggaccagacgaaattcgttcagaaaatgtttattttattgtgctaaagatttatttgtcccaaaaatatttttagtagatttaaataaaataattaaaagccaaaa

SEQ ID NO: 88986 - DNA, 735 bp, Heterodera glycines
  SCN-specific regions: Sequence locations=1-176,199-735
aaatcaaaaaaatttgagttttcatccccaaaacgatgtcggtggtggcggctttctctcgtcgtattttttgcccactcataaaacgatcatttacaaccatttcacctgtaagaaaattcgatgctaaaatttgaatgttttctcttcaggcaattgctgtgcctgaaattgctaaaaaattgaaatgcacattaattccaggcgatggtgttggacctgagcaagcctatgccgtccaagacattgtcaaggcgaccggaataccaattgagtttgaggaagtctttctcagcgaagtgtactactcgagatcggccagcattgaagatgtggtcgactcgattgcccggaacaattgtgtcgcattgaagggggccatccagtccagccttgacgacaaaacggatgggttgaacacgcagctgcgcaaacggctggacctgttcgccaatgttgtgcacatcaaagccctggaaggcatccgaacacggcacaacaaaatgttggactttgtcatcattcgcgagcaaacggagggcgaatattcgcgcatggaacacgaattggtgccaggtgtaattgagtgcttgaaaattatgacgcgagtaaagtgcgaaagggtggccaaatttgcatttgattatgcgactaaacatggccggaaaaaggtcaccgccgttcacaaagccaatataatgaaattgggcgacggactctttttgaatgtgtgca

SEQ ID NO: 88987 - DNA, 640 bp, Heterodera glycines
  SCN-specific regions: Sequence locations=1-124,146-640
agaacaaataatattttcgattcttaaatatgtttcgtcgttttatttcatccgctccaaatgttgcaaaagttttcggcggagttggactgtccacagttgtggccgctgcaattcccgacgttgaattgaagaagaagccggactggtaccaggagactgtgcaccgcctggagaaaacgctcaagaaacttagcacatatgcttacatcgagaacagtgacattttggaagacgcaaaggacattttgatgcgttgtgagaatgtgaataattgcgatatttcctggcgtctcggtcgcgctctgtcagaaaagggtgacttgttttctgttgttgactccgagaatcgaatcgaattcttcgctaaggccatcccccatttccaaaaagcgtttactctcgagccgaagaacggaagcgcaggggcacacaaatggtacgccatcactctgaagcgactgaggctgatcacttcgcagcacccttatgtgaagaacgcgaacaaagaagtgattgaacacttggaaaaggcccaccaaatcgacccgaaggacgcaatcacttgccatttactcggggtcgaatgctttgagaatggccgttacgacgaggccatgaaacttttccaggcagccga

SEQ ID NO: 88988 - DNA, 538 bp, Heterodera glycines
  SCN-specific regions: Sequence locations=1-30,52-538
aaacaatggcggtgagtcatccgcagcaaaaacagaacgggcgacacagcggtggcggcacagtgccaaaacacattggcatcggtcggctgccgacggaggacaatggcaccaccagcggaggcaatccgccgcatcagttggacgacgcggacgataatcactaccaattccaattgccgctcgcttttcggtcatcgctggtccatccaacgacgacaacggcacaaaatgttcagcaccatcaattgcttcagcagccgcaactcaacgccaccattccctccatggaatgtgtttccgtcattcatcccaaaagggagcaacagttctccgcttctgttgaccaattcgtagacggcgacgacgaccaattcaagacggagccgttggatttgtcgctgtcgtcagcacgtacaaaggcaaacgaaaacggcacaatgggagggaatggcgcaacagtcgctggcggcatccagcgcagaaaacggacgacaaacaaaagacaaatggcggaggaaatgtgcgaaacgacggg

SEQ ID NO: 88989 - DNA, 1038 bp, Heterodera glycines
  SCN-specific regions: Sequence locations=1-163,187-466,489-578,600 -682,705-982,1011-1038
attgagcagcccatttcgcgtcacttgcgccgattggtcacttcgatcacccttttcttcaccatcattttgcttgtcgtctatgttccagttcgggtgatcaaatggctttgtccttcgacccttccctacgttttctcggggtctgctgacactccactggttgaatattcattcgaattggttcttttgcaggttataatgcccagcattttggagtattccaaagcattttctctgctcaaacgaactgttcgcatttggtgtcgtgtcgttggcggatggctttctttggacagttatttgcttcctgcggacaaagagaagcgaaacggcggtcagcagcacagggaacagcaaaggcagcgggcgagggaacggttgttgaggggcgaccaggaggaacagatcggactcattgaagcattggaagcgatcgaagacaattcgacggatgacgaggaaaggcaggagagtgaggaggagggggaattggtggagaatggaaatgagcgggacaatgttgtggatgacagtgaagaggacaacaccgaagccaatgggcaacggaaaaccgaagatggacacgaggaggagggggaagtacgtgttgagaaagagatggcagagaacggactaaaagcgaaaagcgcggtggaaaactgtgaagacaccgcggaagaccaaaagagggaagtgaacaacggaagacccactggggagagaccggaggaactttttttttatggcatggagcaggacaaccagctgaatggacgaccagctgtggtgggccgacaggaacaacaaattcagcaacgtcttcagagggcacagcttcatcgggagcagcgcaatttgggcgctcaacatcaggcactcctccgcttccgagactcctccgtacccgaagaatatgtccagccgaacctcttcccccttcgcatttcgcttcttctttttttcgtcgccctccccaccattgcaatttctttgctcttttttcttttaccgggcacaattggtcgctttttgctt

SEQ ID NO: 88990 - DNA, 641 bp, Heterodera glycines
  misc_feature (617)..(617): n is a, c, g, or t
  SCN-specific regions: Sequence locations=1-542,564-641
tcgttacaattttgttccaattgatgaaactataaaatttcccgtctttcattgctgcaatggatctcatcaggaatctttccaccaatcgtttggtcaaaaagcgccgaatgagccattaaaaaaacgcgattcttctgtagaacttctcaatgacaataattcatttttcaaaatacgcgattcttcggcagaatttcacaatgatgtaaagctgctcggatgttggaggacagtctcatcaagggcctttccacgagtttatcgatgacgattttctattcgagaaggcggagcaacacccaccaattgtcgttgccaacccatcagcaccgaatggcccattcaaaatacgcgattcttcggcagaatttcacaatgatgtaaacctgctcggagttggaggacaaaaggatgtgttcagaaaattgaaggacgtgtttggcttttcctatttccgcttcaagcaaaagccggcggtggtcgccgctcttttggggcacgattgttttattgtgatgccaacggggtctgggaagagtttgtgctaccaactgccagctgtgctccatcccggcgttacaatcgtcgtttctccgcttctttccctgatgcangatcaaattattaaattgcagaat

SEQ ID NO: 88991 - DNA, 657 bp, Heterodera glycines
  SCN-specific regions: Sequence locations=1-551,573-657
gcggtccaaatcttttacatttacatttgtgcagcaatcaccatcaaatttgtctaccaggaatcccgtcgctatttgtgtccaaatgtcaacagatgtgaacttggccccctgtgaactttcattcgctgttgaccaatttgatgacccattaacgcggcaagcaatcagcggtgcagtcgatcaagcgcggacattgtttgcacagcgacacacggctatcccgaacattgtcgacacccaccacattcttgtgtcgcgttctccgcatggctttacagaagggtcttcggtgtctgcgggttcatttgccgcctttttttcactcatgatcaaccgttgctttcgaatggacgacgtggccttttcgggacaaatcggactcgaaagacaagtgcagtatgtccagcaaaattgtggagaaagttgtaggcatgagtgacttcgggttacgcaaggtcatcgtgcctgacggtaatcgtgatggatccttcgccacatttgctgcttatttgccgcaacagatgtcttaaaaaagtgtagctggacgaattcgttttcgtcgccttccccccgtacattgccgccgaagctgtgcttttaactggccaaacaagtgccgaattttatgccgccattttttataacgcacaaaaa

SEQ ID NO: 88992 - DNA, 638 bp, Heterodera glycines
  SCN-specific regions: Sequence locations=1-7,43-220,242-396,418 -600,635-638
gtttgagaaatttttaaaactaaaaaattaaaaaaaaataatggaacaattggacagtacgctgaatgccgctaaaaatgagacggaacgattggctgaacagttgaaaaaaagtgcagaacaggcccaaaaagaagtgcgtgaacggacactgcaccaggacccgtatttgcgcttggtttaccaactccaaacagcccatctgatcgcattgggcattgaggtgctcactctgtacttgggatggcgcgacgtgaactttgtttggctgctgttgccgcttttgttttgcgctggcgcaatttggattgtctctcagcgatggtaccatcagatggacggacgttcggactttaacaaagtgctgagcgctgacaaaatgccagttcgtgcaaaggccgcttcatgtcttgttggcggctttgttctgtctctgcttgcccagtggaccgctccgacaatgggcagcacatcgatcggactgcttttcagtctctcgagccacgccgccgttttggtcggtgccgtctgttcggccatcgaactgtacgaaggggtgaagctgaagaatcgctgattactgactaatcgatcagaaacaggcaaaaaggacaaaaaggaagaagaagaagcttctc

SEQ ID NO: 88993 - DNA, 662 bp, Heterodera glycines
  SCN-specific regions: Sequence locations=1-662
gagcttgaatatttccaccacgaatggagtgcatcggctgcttggctttccgaacttcgttctctgttttgctcagaccattcagttcggccaactttggtcagggagcacgggacattggttcccgtcacaatgtttcgtcacgtcattcggccctccttgaaaaagctttggctccctttgtaccgcgtacggcgaaggaattggccgaatatttggccaaaaatgtcctctaccattctgtcggcgatgtcctcgtggtgcacaaaccttacggcgttggctctttgggctatgttcaaaaggaatttggcatttttccgacaacgcaatacaaattcaaagatcgaatggacctatttaacggagtgaaaaaggatgattcggttactttggaggatgcaattccgcacttaaaagaaatattccacgagccaaagttacacttttgcaccggtctcaaacgttgggtgtccggccccgtggtgcttccctgctctgagaaggcttttaaaaacatcggtcacagccttttccaaggagagtccatcagtcacagcaatgagcattggacagcccagcacatgcaccgagcattggcaatttgcatttcgcgccctcccagagacgaaggtgccgtccatggctacgccacgttccaa

SEQ ID NO: 88994 - DNA, 636 bp, Heterodera glycines
  SCN-specific regions: Sequence locations=1-259,290-559,582-636
ggacgatgaaaagcatgtggattaaccctaattaagccaatgtctggccattcaaaaaacgacactttttaaaattccgcattttagggggcaatcaaaaattccacattcttttacatgacaatccaagaatccgttgaaggaaaattcaactggtcaaatggcgccgaatgctcaatttattagtaaattatacaccgaactaagtcaaaccagccaaaagattgtcgaacttaataccacataaattgactttcactgaaagcattttaaatgttaaaaaatatatcaagttcatccaattcgacaatccatggcatgagaattgggacaagaatgattgccaaatgatgaggaacaacaaaaagcatcattttcaaatttcatgcatattaagcggtgcgatagtggtcaggtgattgattttattcattcacattttgtagggatgacaagtgtttattcccgtgtttgtttgtccgtcaattgtatgtgtgatggatgggtcaagaaactaataaacgaagacaaaataaatatccgtgttcaatgggagagcgagcgagaggaagagagaacaataatgatgataaagcatttttttttaaattttatcatttgaatcaatcaattaat

SEQ ID NO: 88995 - DNA, 636 bp, Heterodera glycines
  SCN-specific regions: Sequence locations=1-636
aattgtgcgaggccatgggaacgaatgttcatctgcggaggaagccgactgctgggaaattggaggccggaaaaggcgttggaaatggccagagaaacggaggacggcgaagagaatcagtcgcagcagaaaacgaacagcggaagaaatcagtcgtcttcgtccgtttggcgtgcttccattgagttgggccctgaggacagtcagcgtcttctgcgctttcgctttttcctcggcttccctctccaaatcgacccttctaattgccaatcgtccctttctttgctcgtcgttcgctgggaagcgaaaatgtccccgcgttgcattttgccatcgattgagtccaattctatgggcgaatgtaacaaaggagtgaccagcgaatttggcagttacggcggccgcgatcgattgataatggacgggtggctgcacggaagggaacaacgtcaaattttcttgcggatgttcggcaccgcactgcgattcttcgaccctaaactttcggagaggcgttttctgattcgggtgactccgtgcgacgttcgaatggacaaagaattcgattttgccaattccaatggccccgtcggttggcgcactccgtccctttacgttcactctttggattcgctg

SEQ ID NO: 88996 - DNA, 644 bp, Heterodera glycines
  SCN-specific regions: Sequence locations=1-42,100-302,330-644
caccggcgccgaaacgccagcgccgaaacgcgtgggtccccggtggaagcccctttttcgaaaattttttgagattttaaaaagccaaaaaataagttataaggttttaaaaatcgctctgatcatgaatttgactgttgacttaaatgataatgctctgagataacgatggggatgcggagttgctataaaagcgcgtgatggccaacacattcccatcattcgcttttacatatttttttgttgaattgccaacaacttcttctatcgtatggcttattcattgtctcttcaaccgtggccttcgtctgcttctgcttcttctgttttgtcagtgttcgtcttcgtcctgctcttcgcccgttgctgctcccaatcggcggatgccaacagcagtttttcattgcgcggctttgcctgtgcgaagaaagatgccgcagtgcacggcggcacgttcactgttgttggagagaagcggctgtgagtcgctaatcacgaatatcacattaatttcgaccaatttcgaaccccggacccgaattcgaacaaaagttgaaaattcaaatttcctttttcatttatgttttttggcatttttcagtcgtgttgatccatcgcaactgacaaccaatgaaggcaacgca

SEQ ID NO: 88997 - DNA, 753 bp, Heterodera glycines
  SCN-specific regions: Sequence locations=1-249,272-753
ttttcatcttcacaaatctcagcttgtcaacaacaactcatttaaaccatggaccaccgctataaggccattattataggcaaatccgaccagcatctgtccgacatgttcctgaaactgtggctcatcggcgagtggaaatgcgtggacatcaaattcggccgatatggcgggtacaatctgctggacccggtcgatgtcggcgactttgtcgagctgtacgacggtggtggaccaattcgaaggcttcctccgggaccggcactgcccaaaacgcgaatcctcgacggaagcaatggcactcgcagctgcttgaaggtcaaagtcaacttcatgccgttggattttctgcttttcccggcctcggcgaaggagaaaaacctcagaatggcaatgagcgccgaactcggaccaatcccaatcgccaacgaaaacagtttcaaattgcattgcttctaccggggagtggcgacgctttttttcgccaaggacagcaaagaagaaatgatcgcggaagtgtacaacacaccgtggctgatcaaaagcgacggcgcgtcattagccgaatcggacttttccaccatcgtccacactttcgctttctgccaatcgcaggacgttcatcgtcagggattggtggtggacgcctcgctcaaagacgttttctttgtgcactgtgccgaacttccggagatggtcagcctgcgcaaagacatcacgggcggtcgaattgcagtcggcgattggattgaa

SEQ ID NO: 88998 - DNA, 628 bp, Heterodera glycines
  SCN-specific regions: Sequence locations=1-399,421-628
gtcatcgaaaaaaaaagcgaccctttgcctatctcacgcaacacttccgtcacaattgtacttagctatgacctcatggtttccaaggccaaacaattgaaaagcaattccatttatgttgttgtttttgatgaatgtcatttgctgaaggagcagacaacgcagcggacaaaagtcgcatttgaactttcgaaaattgccaatcgcgtcattcttctcagcggcacaccggcgctgtcaaggcccagtgaattgttcacgcaagtccgaatgattgacccgaaaatatttcctagttgggtgaaatatgccgtgcgttactgcggaggaaaaaagggacgttttgggtttgaggcgaaaggaaggtgcgcactttgtctaaccccgacgaattaaaaactgtgatggataaaattatgataaggcgtttgaaaaaggatgtgctggacgatttgcccgagaagagacgtgaagttgtgtacctttctggcgatgccattgatgccaaaattcgggagttaaaaaaagctcgggatgcgtgtgaacaagcgaacagatattcagatgcgaaaacaaagaaagagacttttgcggagtattatgttcaggttgcgcctttcttccccct

SEQ ID NO: 88999 - DNA, 720 bp, Heterodera glycines
  misc_feature (5)..(5): n is a, c, g, or t
  misc_feature (18)..(18): n is a, c, g, or t
  misc_feature (20)..(21): n is a, c, g, or t
  misc_feature (28)..(28): n is a, c, g, or t
  misc_feature (36)..(36): n is a, c, g, or t
  misc_feature (41)..(42): n is a, c, g, or t
  misc_feature (60)..(60): n is a, c, g, or t
  misc_feature (63)..(63): n is a, c, g, or t
  misc_feature (67)..(67): n is a, c, g, or t
  misc_feature (69)..(70): n is a, c, g, or t
  misc_feature (73)..(73): n is a, c, g, or t
  misc_feature (86)..(86): n is a, c, g, or t
  misc_feature (90)..(90): n is a, c, g, or t
  SCN-specific regions: Sequence locations=1-400,445-477,505-720
acaanggcgcgacaaaangnncaccggngagcgcanaaacnnaacggaggaccgaccagngcnacangnngcngcaaggaacacancaangacgccttttttttttaacaataatgacgttatgcccagcgtaatggccgtgctgacccagatgaagatgttttgcgacgacttgatcagtggccgatggaccggctggacaggcgaacgcatcaaggacgtggtcaacatcggaattggcggctcggatttgggcccgttgatggtgacggaagcactcaaaccgtaccaacaaggccctaatctgcatttcgtgtccaacattgacggcactcacttggcccaggtgctcaaaaaggtggagcctaaaactgtgctcttcatcatcgcatcgaagacgttcacaacccaagagaccatcaccaacgcggagtcggcccgggaatggttcttgcgcgaagctgtcgacacagcgcacgtggccaaacactttgtggcgctgtcaaccaatggccaaaaagtggaggatttcggtattgacaagaagaatatgttcgagttttgggactggattggaggtcgctactccctttggtccgccattggattgtccatcgctgtgcacattgggttcgacaacttcgagtctttgttgggtggtgctcatctcatggaccaacattttaaggaggagccgctcgagaaaaatattccggtcat

SEQ ID NO: 89000 - DNA, 643 bp, Heterodera glycines
  SCN-specific regions: Sequence locations=1-187,209-342,366-578,600-643
caaaagtggaatggacgtatgggcggacattgcgaaagcggattttatggatgaacgattttcgagggttattacggctaataaggcgtacaacctcttccagaattccattgctgaacttgatgaacgttcgttccgggctcaggcggccattctcaacggactgttgacgcatcacttggatttcatccatggcaaatgtgtggatttgcgcaagattgggcttttgttggaccattttgaccgattagtcctccgttcggaatgtcttttggcccaaaatgcgaacatttcgttgctccgttgtctggtcaagtgctctttctattgtcgtttcgctgatttcttactctgttcttccatttaccaacaatccttcaacgaattccgactgcttgcgatggcaatgttttgctacggtttggcattgaaatgggcatgccataaatcggtcaaaggaagtgatggagcggatagcgcgctcctttcactctgtgccgctgagttgacgacactgctcagaacgaatttgcacgcggactctcagttggaggcggaaatgcacgaatgcgacaggaacatgctcctctccttcctccgctgttattcttcatctgtgccttataaagactgtgcccaattt

SEQ ID NO: 89001 - DNA, 748 bp, Heterodera glycines
  SCN-specific regions: Sequence locations=1-59,84-748
gttcattaatgaaacggcattccccgtcccctcaagtaatggcacgataaactgcccattgctcctctcctctctttcctccttcgccacttgcacagcgactcggcaattcccgtcgcgggcggaagcaattaggccaacccatcgccgctttcattagcatcgcaccgcttaagtcagtcagtcacaaaccgacaaagaaacggcaaaattctctcgcacattattcagaaaagtcgaggtgagttgtcgaatttcgttgtttattttattcaatttattcgggaaaggctctgccaaacctccgaacagcgaaaaattcaatcggaaagtgagtctcgaggaaagggagtcgagaggggacgagcaaaaggtacggcacggcaaaacaccacggcacacgccggtcgatgagatcggatcgggatcggactatttcagcgacgaactaaacattgacggcgcctttgcgatgaacatgggcatgcccgcgggcgcgacggaagtgcccgagggggtcgtgcagctgaatgtcggcgggacttgttttctgaccacaattgacacgctgaaaagggacagcggagcactgctgtcccaattgttgacgttggaagggttggagaagaacagcaaagtggccaagcgaatgagcaacggcaccattttcatcgacagagacggcgaactgttcgcctatgtcctggattacctgcgcaccggcaaattgcttctgccggagaatttt

SEQ ID NO: 89002 - DNA, 635 bp, Heterodera glycines
  SCN-specific regions: Sequence locations=1-99,197-405,427-522,544-635
taatgtttttactgttgagaataaccataataattttttctgtcttaatttcttggtttttggctccattctaattccgtagtgtggtgatttcaaatgaatttatataaataatatttagagtaatataaattttaattaaaattttaaaattaattattttaaaaatttatttaaaaatatgttttaaataattcatttgtgctctcgacattatttgatatttaattgcgaccgaatccagacctataataaaaaccgaagggccaagaatccaaagttgaacacgatagtgatttcggtcgcacgtatcaacaaaaatggttcttcaaaaataattcggatttccataatcatggacggcaaaacgatcaaattcattgccgacagtggatcagacatcaatattattgatgaaatcgcatacaaatgcatcggatccccgacgctaggaaaaagcgacgaagagggcatttttttcgatggacgccgctgccaattcatcggcaaaggattcgctaccttcaaattcaaaggaatcgaagtcaagcaaccattttatgttgccaaagcgggagcacttaatttgcttgggtcagcaacaatggataagtttggattccttgaaggaatca

SEQ ID NO: 89003 - DNA, 654 bp, Heterodera glycines
  SCN-specific regions: Sequence locations=1-268,300-399,430-460,506 -559,582-654
taatcgatgaatttcctaaaaaatgccctgttataaattgccaaaattttcaacaacaaaaaaaatggcatccaatttgaatactgtaatttaatcaacgcgggttaccgtaccaatgcgcggggcgcatgggtcggaactctttcgagcagcacacggtggctgggttactgtatcgtcgtcattatggttgttgaaggtgttcagttgggcaccaattcgtgaacaaatgccatctatttgcaacaattatatataatacaaagatatttttaattttgaacattttttgaataagtttgagaggtgaaaatttgtgaaaaaaaatttaattttcgaaagggcttgaaataattcccaaataaattaatccccattttcagaattatcttaaaagccaaaaatttatttttaatagttaattaatttgcatatttccgttatttgttaaaatgttgagattaattattattaaaataaaattttatttttattttttaatttacagacagattgtaaagagaacaaaacaatacaaaaccgacttggacagccaaagttgtactgctgctggtgctggtattggttgttgttgcctcttgacacaaatacgggctgaattggcaaaccgttgggcgggaattgcaacggggc

SEQ ID NO: 89004 - DNA, 1193 bp, Heterodera glycines
  SCN-specific regions: Sequence locations=24-37,71-329,362-367,451 -451,481-532,655-657,685-692,768-839,907-1042,1078-1193
gccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaggatttcggtccgattttattggttttgctgaccgagataatggttaacagagacaaacggggccattcgtattgctacgtgagaggtgaaattcttggaccgtagcaagacggactacagcgaaagcatttggcaagaatgtcttcattaatcaagaacgaaagtcagaggttcgaaggcgatcagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttctcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccgatttaatcgcagtggcttgaaccgggcaaaagtcgtaaca

SEQ ID NO: 89005 - DNA, 1005 bp, Heterodera glycines
  SCN-specific regions: Sequence locations=1-82,104-413,435-1005
ctgtcgacgattccaaggtgtttaaagtggatgagttggattttttggccacaaacactgacagagccatccaaagaatccgttcttttcaacaaaaacatgcgccgttgctgatgaaacatggagcaaaattggacgcaattgtcactgatttggtgctgcaaccgatggaagaaaaaatggagacggccgaagccgaagttaggcatcaaacagaagatatagctgtggcctcctccacttgtgagcccgagctttcagtccatgcccaatttcttttgactgacacattaaacggtctgaaaagaacgcttgacgacatggcccaggagcacaagcatcccatccatcatctcatctcgcgttgtgggaaggctatcgacactcgcttcttctccgatttgagccgtttgttgaaaaatgaaaaggaaattgagacggactctgacaatttgcggcatgcaaatcgtcttattctcgaacatttgatgggacttggacggaccgaagtcgccgatgtcttcctccaggagtccgcaatgtcgtctttggaagtcccagacatagacaattttgaaaccttgagaaacatcatggactccttcaaacggcaagactatttgccaacaattcaatggatgaaagcgaatcgaggcgaagacaacgaccgacacgacttgctgtttcgccttcaatgccagcatgtcatccgattgttggaaacaaatggtaaaagacaagctttgggttatgtgaaggaaatgcaagacgaagagaaggaaaagtacaaagaagaattgaaacatttgatgttcgtcgtgatgacccacccgcagaagggcccccacgactatttgttcaacgagggccgtcgctttgaattggaatggaaattggccaatgcgataacggactatcgctcttcactgtccacgatgcttaatgctggtgccaaaaccgtaccctctctcatgacaatgcgagcctttctgaatacttcccgag

SEQ ID NO: 89006 - DNA, 912 bp, Heterodera glycines
  SCN-specific regions: Sequence locations=1-912
taaaactgtaaaagaatgacggagaatcgccgcgcggcacgtgaaattcagcgacaacagcagaaacagcagtcgttgctgaagaaaattgatttttgctcgtccaatgtgttcgatttgttggaccgtcccacggttggcacttcgttggcaccgatcagtgccgtgtttgatgcgattgtcgatgcccatctctttggcaaaaatcggtacattgatcatactgtcgtggcctttctgcaccgcattcttcgcctcttccgtcactcggccattgcccttaaaatggtcatttggccgcagtccgtccgcgcatggcacgtcatggcccagcaaatttggcccctggcggcgtccaatgtgtgccagctgagcgtggacagttatgtgttctcccgtctccgtgagttcgtttcgccgtccgtcctccgcgactgtgccaaccttcgccaaattgagtcggacggactgttccctgaaggcccacccgacgaccatccgcacgcgtcggatggccaagcgttggccaaatggctgcacacgccgcgcgcggacggcaggccgaaactgctaaatgtggaggcgatgacgggccaattccacgagcaaattgaacgactcaaagaaaataagcaagaggacggccgaaacaagtccaagacgccgaaaaataacttttattggtaagtttatccctcattttttgtgccattttaggcctttttgttcgcctcgtcgcccgtcagtttcgccatccgtttgtcgatgcatttgcccggtgcgtacgttccattcgccgtggacaatggccaaacgcaggaacggctgacattctgttgcattgacaaaagcgattccctttggctgttgaagagggctccgctcggcgtcgtcgctggtcaacaaatggac

SEQ ID NO: 89007 - DNA, 727 bp, Heterodera glycines
  SCN-specific regions: Sequence locations=1-727
gtcaaacgcaacacgaacgcggcaccaacgcggaaaacattgaaattttgaaggaccgacggcgaacggcttccaatgccaagcgaagtgaacgccgccgcgttggttctgtttgcgatgaaactgttctttgggcttgacggggaagaagacaagcagcagtcgcgcgatggcacaaatgaagcgactcaatgcgccgacgatgacagtccgtcgccggtgttcagcttcgaccattggctgctgcaacttcagctgcgcatgcactgctggcagggcacaacggttcagaaggtgttggacaacacgttttccgcctgccaattggagcgttccaacatcgaaattccctatcgtcgtccaaccgccggcttttgccttggcggttcgcgactgttccatcgctgtcggaggcaaccgtttgctggttgtgtgccgaatgcgctccacaaccgtgttcagcctcgtctctttgagcattcctttcctcgacttcaccatttgccggttacgccttcggttttgctgccaatttccaacgaagagctttacgccccccttcagttccaaagtgtgctgaatcggccccttttggacattgtcaaccgcagccattggaacgaagccgaacaaacactcgtcgaacagctcgaccgaccgaacacaaaaatatttttccggaatttttataattccaatttgagcgcgtatttgcctcctcaccacg

SEQ ID NO: 89008 - DNA, 624 bp, Heterodera glycines
  SCN-specific regions: Sequence locations=1-600,622-624
gagatttgttacacgttaaattgctgtctgtgatagcaattcaattttttccatatttgcaaatcaacaccaacatcacgacgagcgggacactgaacgaagggagtggcggtggtaccggcactgctgcccctggtcaaaataatacgaatggtgacatcaccggaggttcttctgctgccgctgctgttgccgggaacgtccatcggtgtcaatcgcccattatggaagcagaagttgccgaagacacgtccaacaaaatgttcccttctcatgagcaatcgcaacaactacagcagcaaccacaaggagtcaagaaggaaagtgttggttcttccaattcgacgacttcttccacacgggtcgcttccgttgtacatccaatagaaaccacgaaagattcgaaacccaagccatcggtcaaagacaacacaacgatcagtccacaggcgcttaattcaatgctaagcggctctcctctaataacaactccgtccattgcgcctcagcagcgtcatgcgccaggggactacacagacgcagcggtgactggcgggaaaacgcgcggaggtgtgccccatcatttgcatcagtaccagcagcagcaggtggtccctcatcagc

SEQ ID NO: 89009 - DNA, 573 bp, Heterodera glycines
  SCN-specific regions: Sequence locations=1-228,250-468,492-573
atttttacctcctcccctcaattgaaaaaagttttgatcacttataaccagatcgatactgatcacttcactgaaaactcagtgctttcgcctcagggaaaattgatcaatcactttgcccattcattcttcacattcggctgatcacaacggtgaaaagcgaacatttcccagcagattgtaatcattaaaaaacagctttataagcttcaaatgcctccccttcggaagcggcggatgaggaaaagccgtggctttgatgctcttcggatttatccacctctcgggccttacctttatcctccctctttgcggcttagttagccttatcccctgtgttgtggcttaggttttatccccacttgtggcttagctttatcccgtccccctcctttatggcttacaattagctgtatcctccccgccccttcccactcatctccgtgtctaatgtccattaaacgatcaccccacccccgcccgcccctcggctgtgggctcggctcggcttttccaatccaatatttacccaccacttggggcttcttcgtcgcctcgggggaggggtggggg

SEQ ID NO: 89010 - DNA, 826 bp, Heterodera glycines
  SCN-specific regions: Sequence locations=1-427,449-713,736-770,792-826
tggactctctttttaataatttattcaaataaaaatcaaagcgatggtgaccaatgctcagaataggcccaaagtgttcatcgttggggtcgggatgaccaaattctacaagcccaaatcgtcgggaaaagattaccccgagttggtgagagaggcagccaccgaggcgttggaggatgccggactcaaatacgatcaaatcgaacaggcgacggcttcgtatatgtacgggggctcgtgctgcggacaaagggcactgtacgaaatgggactgacgggcattccgattttcaatctgaacaatgcttgtgccagtggttcttccggcattttcctctgcaagcaaatcatcgaaagtggcaatgtcgatctgatgttggccgttgggtttgagaaaatgaatccgggcagtttggaggcgacgcagggaatggagggggacagggcactgccggtggacaaacacatccagctaatggccgacacttacggcttacaagcagctccgatcacttcgcaaatgtttggcaacgcgggaagagagcacatggaaaaatacgggacgcgcagggaacacttcgccaaaattgcctacaaaaaccatttgcattcggtgcacaatccaaagtcacaatttcaaaagaatttctcactggacgaagtgatcaacgcgagaaagatttacgattatatgggccttttggaatgttcgcccaccagtgatggggcggcggccgttgtgatttgcagtgaacgatttttggagaaaaacccgcgtttgaaaggacaagcggtggaaattgtgggcattgagttgggcacggat

SEQ ID NO: 89011 - DNA, 802 bp, Heterodera glycines
  SCN-specific regions: Sequence locations=1-33,62-67,107-157,180 -186,220-381,414-802
gacggcttcgctcaatgctaatcagctaattgttcactaattaccccaaataacaaaactgtctgcttctcccaacaatggccaccaaatgccttccgctcgaactgttgttcgaaattgtgcctttcatccctgccgaaaatgccgtcccgaatgtgctctcgtcctgtcggctgctgtacaactttttgctgccacgtgtcatcaaatggaaagagacaatgaaaaaaatgataaaagagcttcgagatgaagtgttcggaaagatcgactagcttcgagatgaagtacgggaccgcttcgcacttatcgaggaccgcttgacacttgtcgaacgggaaatacacgcaatgaaaaaccaatttgaggggcacaccatcaatcaaagcgctggtcaaatggaaggaggaggggcaccgacgggcaatgaagaatatctgccgctgccgccacagatgccgcttcagtccggccactacagtggtattgaaccgccttccgttgtgttgccaagtcgtttgcgtgtagaagttagtggccgtactcagacatcaatttccctcacttggatgtctcattccaaaattggtatgacgatcgcctcgtacgtcgtgctcaaaaaaagcgacttaggattgtggtggccgatcaaaaagcaaaaggcgattaccattcgtacatcaaaatgctcacttggatggatgacattgagcgcttttatccgcaactggcaaaaaccttcacaattggcaccacatacgagggccggtccatccgcggcataaagattgagagcccagtt

SEQ ID NO: 89012 - DNA, 779 bp, Heterodera glycines
  SCN-specific regions: Sequence locations=1-84,109-682,705-779
caattcctgccttgtttatgaggaggtctcccaaccgaactgattttgttgcaaaatgcctctcattaaggccaaaagcctcagattattgtttttccaaaagattaaataccctaaaattccataaaagcaataaaaaacccttaaattcccttttcaaaaaattcttattgacaaatacattgttgaaagacatcacatcttggagctctgttaagattgccttacttctgatgatcagagggggcttctctttttatttaaattcctaatatgatttttattgccatattttagcttatctcgaatcaacgtttgcccagtttatgttgaccttggaggcattggcccatttggacacttttcattttgtcaccctccaggcatgctcatttctgggctgttttcaacaagagcaaatggcattccgattaaatgcatttgggtccatcatcggtctcgttgtgtggatgctaattgcaggtaattagctactaatcattgtgctattgtatcttagggtaatattgaatagggaataaataataatatttttgctcaacacatagcgtcactccttgcttaggccaactacttctgttcggtttcgtcccatgtgccaaacggttcgacccggtcactttgcacttcttcgacagttgcaattggccaaatccgaatgcgcgtggctctggatttgccttgctgaacatttggcttaccgtactgctctgtagcgcattttccatttacgcaattgcactgtctcatgtgcgccg

SEQ ID NO: 89013 - DNA, 599 bp, Heterodera glycines
  misc_feature (579)..(579): n is a, c, g, or t
  SCN-specific regions: Sequence locations=1-599
tgagaatcaaaatgcatctgacccaaaaattgcaaaaatagccaaaccacttcagcctcgaaagtatccatttgtcgaacttgttcctttgatgggtaaaaatcatcttgacactgtctcagagagagttcgcggaatccatccatgtgttgaagaaagacataatttgtttgcatgtttgaaaaaatgggactacgacgacatgaaatgcacaaaattctccgattcattattcagttgtatggaatcaaacaaaaaaattgtcgctgcacacaatgagcaaagaattaagggagagcagcccttgcacatcgtcgatgaaggtagcagtgtgaaagcggaggcgtccaacatactccaagcagacattgaccggcttttccgcaaatggaaacagcccgaacttggcacgatccaaaccaaagttatgaagcgccgcggacacatgccgtactacgtggactacttccaccggaagaacatgaagggatggcgcgcctaagaaaaagactcaattgttttgtaaaaccttagttggatttcagctgaaacttttcaaatggcataaaattgatacgngagaagggaaaaaaaaaaaa

SEQ ID NO: 89014 - DNA, 612 bp, Heterodera glycines
  SCN-specific regions: Sequence locations=1-241,269-612
ccgacctctagtaaaattcattctcacaaatcaatcaaattgttgccccattttgtcactctccatgattcacattgccatcccttcccatcgaacattggccgaccatgaagatccgtacaacaaatttacggtttacgatatccacgtgaatggcgccttccatgccagtgtgcggtacaatttgctgtactcattgcacgaaaagctgatcgacctgttcggctttcggttgaatgcgcccgattttccccccaaaaaattgtggaaattggacgcaaaagcgttgaacgagcgccgggaagggctggccaaatatttgcaaggagttgtcgcgaaccccgatgtgtcgaggcaccccgtcatggagcgtgtttttctcgattttcaagtggtatcccccacattttcaagaagtccttttctgctgcggtaagccgaatgacaaaattggaaatttttctgcccgatggacggccggtgtacgtcgaatgtggcacggacgaggcgaccaatgtcatcatggagagattttgtcacgcgattgggctgagtgaaaagaatgccaaattttttggcatttttctgtgccgaccgcgccgtggacgggga

SEQ ID NO: 89015 - DNA, 591 bp, Heterodera glycines
  SCN-specific regions: Sequence locations=1-591
gtaatgaaggcgagcgaaacaatgacaaattggtcggaacagtttcaagagtacgacccgttcatcactcaacctcaccccaccaatccatgggtctcggatgatccttcattgtgggcgctaaatgcagacaacgtggaagtgccgacagaacgaagggttaagcgatggggcctaagcgtcatggaactcgtgcgcgaccctatcggacggcaggttctcgaatcctttttggattccgagttctcgtcagagaacctccgcttctggtgttgcatccaggacctcaaattctctcccaattgtcaagttaaaacaaaaggccaacacattttggacgagtttcttgctcccggtgcgccctgtcaggttaacgtcgactctagaacgcttgaagaaacattacgatgcttggaggagtcggaccaagcattgcgaaaccagaggttcgctttctcagtttcggaggaacacgtgttcacactgatgagcaaagactcgtacccacgttttctccgatccggcatttacaaggctgttttggacgctgccaaggcaaagggtggcagaaaacggatcattgacctgatc

SEQ ID NO: 89016 - DNA, 773 bp, Heterodera glycines
  SCN-specific regions: Sequence locations=1-59,81-224,246-773
ctcatttcgggtgcttaaatagcggcgcgtggggaaggtcgttgtcaaccgcagatactcattcccttcccacccatccatcgacgccgcacaaaatcatcgtccgctgcttggtgacatacgcgcgtccgacgggtgagaaagcacccaagaagtggcatcgtcttcgagtgcgtcggacccgacaacacaattaatcatttcatcactgaattctgtcagaaaaacaaatgaaggcacagtggaaaatgcgacgaaaaagactgacaacaaagaattgagcaccgacgaggatgagcagcaaaatgtggcgagcacttcgacgccggaggacggagaattttcaaaaatcagtcgtattcgaaagcgccgctacagtcaggcacgaatacagccgacgagagtgaaaaaagtaatgcaaagtgacgaagacatcggcagaatggtggccagtgtgccggtggctatcggcagtgccatggaagtttttgcggagaaattgttgctcgcagcggccgaaagtgtccagcacagttcaaccaaaacgctctctccaatgcacatcaaaatggccgtttctcgcgttccgcaattttcttttttggagcctatgttgagggatgttccgatgaacccgaaaatggccccctcttttggacagcaatcgtcttcaacgtccaacggcgaatgaggcgatgctttccgtttaaatacctctcacattggacatccatttaacaaggctttactgcgattggttcagttaatctgta

SEQ ID NO: 89017 - DNA, 654 bp, Heterodera glycines
  SCN-specific regions: Sequence locations=1-272,295-654
gaagtgattttggccgctgaaactgtgtacgactgcgtgcacagctgctaccagcagaactgttcacgggccgcgttcactcacttccctcgcagcgtttgtttgatgcattttggaggcgaagtgccattggaccaaaagtgcgcggaggtcgaccgactcggcacgacttgggatttctcgtcggtgcccgaagtggtggaaattaaatgcgtgaaatgtgccggaagaaaggagtccgtcgaaaaaagcactgacaatgagcaaaacatcgcaaaaagacacttttccaacgacgaaaatgcggtgggacagcaggagacgacggcacggcacattctcaacccccaggggctcactttgaaatgcgatggtcgcgtggaattcgtggcttcgcccgttgccaatttgcacccgctgaacatcaccaacgatgtgccagccgacacagcagccgattgtgcacgaaagtgttttgaggcgattcattgcactttggccgcgttcattccgacgcccggccatgagtcggccggtggcatttgtctgctgacctccgacgcgggggacgtcgcctgcgccggcacttccgtgcgacactctccgcaacacgcctccaccgttccgtttctgatcaaatgcatccgttgctcg

SEQ ID NO: 89018 - DNA, 653 bp, Heterodera glycines
  SCN-specific regions: Sequence locations=1-653
gcaatgcaactcaatggataagagcggaactcgaaaactcctggccactggaaataattcggcatgtcaagatcgggataaagaatccagtcaccgacccatattcgtacaattataccgcaaatctgatcgatgacattgtttcgccacgtgggcctttcggttacgtctcccaaattttggtcacgaatgacttcgacagaatcgaaaatttctggcagaggtgccctgcgagttattgcgcggtcgtaaaaggttacaaagggatcaatttttcattgtttcggcacaaagtggggcatttgacaagggcccacaaggcagagcgatggtttgaaagaaaccgtgacaaaatgtacgacatcatccttaaaaatgacaaaacatccgatcttggcactttgatgcgagcgattgaaatggaaattggccctgtgacttcgccagatttgttccactcctatgtaattgcccacgtgagtacaatgacggcaaaagcttgcgtggtgcccgtgggactgtccttcagccaattcaccaattattccggttacagtatgattgaggcctacagtcactaccgattcccaaccacccacgacgaacgttttaaattgtttttgtttatctaagattgagcacttttgcttgat

SEQ ID NO: 89019 - DNA, 629 bp, Heterodera glycines
  SCN-specific regions: Sequence locations=1-267,320-375,455-549,571 -602,624-629
gctcacttccctcctaatttgtgcttccctttgtccaaatgaccctcattagcaaatgttcgcttctcctccttttcgtcgcgcccttttcccatgcgtttttctccggctttgaggtttctcccaacgcggcacgtctccgtcggcagtgcggttgcggcgggtgccctcctccgcccagcggcggtggctctgtccaactcggcatcagctgcgactcgccgcgccctccaccgccccctccgtgctgcggttgtcagtcgtcttgcggctgcggtggcggcggtggcggcggatgtggcggcggttgcggcggcggtgccattaaactgacaattggctgcgactccccacgccctccgcctccccctccgtgctgcggttgcgggtgcggctgcggcggcggatgtggtggtggcggttatggtgcaaatggcggcggcggctgcggcggttccattaagctgacaattggctgcgaaggcccaaaagccccgccaccgccccctccgtgctgcggttacgggtgcggctgcggttgcggcgggtgccctcctccccccagcggcggtggctctgtccaactcggcatcagctgcgactcccctccgccccctccgtcctgtggc

SEQ ID NO: 89020 - DNA, 634 bp, Heterodera glycines
  SCN-specific regions: Sequence locations=1-634
gtctctttgtcgtgtgatgagcgggactctgagaattggtgatcagcttaatgtcctccgacattcggcgtcctccgaagatgtttggcattctgtgaaaattggcactctttttcttttgatgggccgtgaactgctccccgtagagtgtgttcctgctgggcggatttgcggcgtcgaagtatccgacgggcgttggataggcggacaaacgctttgctcgagggctctggccgtcactgaagtgccgcggatgagttggcatcaaaagttcgccgaaccactcgtccgcgtgacggtaaggccgacaaatgccggaatggccgaaatggaggaattgcgaagtgcactgcgacaattatccgtgttggactcagcagtgcgcgttatcgagcaggaagacggagatttggcgatgcttacggctggcgaagtgcatttgcagaagtgtttggaggatttgaaattactcggccaaaccgaaattgttgtctcagagccaatcgtcccatttttggagacactaatcccagacattcgtttgcccttctccagaattttaaaagatcatgaaacagaatgttttttgcgacaattttcccttcgcataactctaagggctgttcctctccat

SEQ ID NO: 89021 - DNA, 796 bp, Heterodera glycines
  SCN-specific regions: Sequence locations=171-172,546-627,649-796
ctgaaacgcccggaccgcctggacccagcactgaaacacctggaccgcctggacccagcactgaaacacccggaccgcctggacccagcactgaaacgcccggaccgcctggacccagcactgaaacgcccggaccgcctggacccagcactgaaacacccggaccgccttgacccagcactgaaacacccggaccgcctggacccagcactgaaacgcccggaccgcctggacccagcactgaaacgcccggaccgcctggacccagcactgaaacgcccggaccgcctgaacccagcactgaaacacccggaccgcctggacccagcactgaaacgcccggaccgcctggacccagcactgaaacgcccggaccgcctggacccagcactgaaacgcccggaccgcctggacccagcactgaaacgcccggaccgcctggacccagcactgaaacgcccggaccgcctggacccagcactgaaacgcccggaccgcctggacccagcactgaaacgcccggaccgcctggacccagcactgccggaacttcctctacaaagacctacactgttccaacaactccaaaaccacctccgtgttgttatggctgtgactaccctgtcgactgccacacttctgggaaggattgcgactattccccgcttcagccgccttatcaaagcgacccttacccggttgggaagtgcgtcttcaaaaatgtcacttgcgccgctccaaacaccggcaaagtgctcttcatgaagctcaacaatgaccccaactccgtcgtttc

SEQ ID NO: 89022 - DNA, 646 bp, Heterodera glycines
  SCN-specific regions: Sequence locations=1-646
ctgaaagcaacgaatgaagttgacttatataaaccgctgaaaagttatattgactctctttctgaattgacggaagaacttcgaatcgaagccaatgatgggcttacggagcttaacaaattacgaaatcgtgcttgttgccaacctttggacaaacatcagagttcgcttgatattgttgccaggtattatgaccaactttgcgcgatggaaacgaaactgccaataactccgacacagaatcccgtcagctttaagtggaaagatgcctttgacaaagggtcgctgttcttttcgcgcgcttcgctcactcttaacgacagttctttcgaaagggcgtgcgttctctttaactgtggcgctttgatgtcggcaattgcttccaaccaacagacgaacactgacgaagaactgaagacagtggcgcatttgttccaacagtccgctggcgttttttccaaacttaaggacactgttctcgcttcggtccaccaggaaccgacttcggatttgttgcccgacactttaactgcgctccttactctgatggttgcgcaagcgcaagaagccatttatatcaaagcggctaaagacaagctaaagtcgacttctctgcttaaaatagctgcacaatgcgcggatttct

SEQ ID NO: 89023 - DNA, 642 bp, Heterodera glycines
  SCN-specific regions: Sequence locations=1-642
cctcgtgccgcgacattctgacgcgtgagactcgcttcgccgaactgttgtacgcacacgcggcacagcttgcgttggccgagccgcgtgcgctcgttgacgctttgttggcactacagcagcaacatgcgtcgttggacgtgttgcaattgttgcccgccttccaacaatgcctggacaaacgcctgccggaccggcaagcgttggcggatgcgattttcgtttttttggattatttccctctccaaaatgcgtctccaccatttgtcaacttcaccattcatttgtacgccgtttttcggccccaaaaactgctcgtccatctgcaaaagtgcgccggcgagtcttcttcccaaccaccgtccgctttgactgcgagacgcactcacaatcattgtcatttcgatgtcgcccaagcacttcgtatttgcacagaaaatggcagcattgcacgagtgttctgtgtttttgctttgcctcgagcgtctttacgaggaagcgacgcgtttggcgttgcgtcacgttggcctcgcgtgtgccaaagagtgcgcgcgacgtttggacgccgactcagccgcagcagacgcattcgccccaatcgggcatttggcgtcctttcatgggccgggggatgaggaggat

SEQ ID NO: 89024 - DNA, 664 bp, Heterodera glycines
  SCN-specific regions: Sequence locations=1-543,565-664
ttccatcacataaatcaccatgcgctgcttattcgccctggtgccgctttcccgtgccgttttgcttccatttttcgccgatgcggtgccaccccccgccgctgtgcgatctgcgcgaccggccgcgcgacaagcggtggcagcgcaacggcaaccgcccgcggggatggaaaggcagtgcaaatgtgcggagattaagccgtgcaaagaccgctatcagaagacgatggagccatgcttggacacgtgccaatctcatatcacttcgctcggtggcaacttccgccaggtgaaggcgtgcttcaccccaaaagagagtctgctcaattcggcgatgcgatgcaccgaaagacagcacgacaacgcctgctcccattcttcagctgctcaatttgtgccaaagcgatacggccaaacattggaaaacgaagcgatggtggaaatcgatcggatgatcggccgaatggggctggacaagagcgggtccatgaagaagctggtcagtgtgagcaagaaactgttcggttgtctgaagcaatgcatggcgaaaagggcgggaaactgcgaaaagcagctgaagtgtggccttctgttgccctcagacagtgccatggtacaaaagaccaaaagctgtgccctgaacaacgggtttaacaccgcaacc

SEQ ID NO: 89025 - DNA, 669 bp, Heterodera glycines
  SCN-specific regions: Sequence locations=1-154,188-190,263-281,363 -363,423-439,476-495,563-645,667-669
gtttgaggtcaactgtcaaactaccaaagatttatttttgctgaatcattcccaacaatggtgaagcatatccgtggtcgtccattgggacaagtgcgtattggctttggtgatgccgaccccctttgggactcagagaatgaaaagtacaaagtgctgtgccgaagcattcatgtttccaaggcagctctgtacattggttacatgcggctgttggtctccttagtgtccagtctcttttttgcgtaccaatacatgatggccgtcactggccaattgtcctccgaccattggattaaccaagtgactgctcgctttatgtcacaggcaatgatgtccatctgtttgcaagtgattgtcgtcgtacttatggtccacggtgtgaaggctgagaagaagtccttgttgcttccttttattgcgtatgctgcgatcgcagttttggctggttcgatcaaggttatgagtgatttggtgtatttggacacgagcgtctacaaaaacaatgaggcggagagtcgagccgccaaagtgcaatttctcactaatctgttgcgcactgtgctccaggcctggtgtctgtctgttgtttggcgttgctatggttacctgaccgaaaaaaaggtggcacgtcagattcgtgaacaactcaactcaactgcgaccgca

SEQ ID NO: 89026 - DNA, 661 bp, Heterodera glycines
  SCN-specific regions: Sequence locations=1-252,274-661
gtttgttgttgttggctgtcccattgttggtggtggacacaaagcaagaggtttccgaggcacaacagctgatccaaatttgtcgtgaatatttggtgggccttctgttggagacggcacggaaagaattgccacgcgactccgtggaggatgctaaacgcaacttggagatggccgcctatttcacccattgcgacattcagccggtgcacaagattttgacactgcgcaccgccgccaatctgagcttcaaaaacaaacaaatgcgccactgtgcttcgttctgtcgacgctgcattgaattggctcctaagccggaaattgccgcccaaatgcgcaaaatgttagcggtggcggaacgcgacaacaccaacgcgttcgagctcaactacgacgagcacaacccgttcgtgctgtgctcgcgctccttcgtgccgctgtaccggggcaagccgcagacaaagtgtcccttctgcggcgcttcgtatgcgcccacatttgccggctctgtttgcgacgtgtgcgaagtggcggaaattgggcgagagacgtcgtcgaatttgatgatttctaattttaaataattcactgttaggcttttttcatatgtcccactaatattggtgataattggcggttgtttttttccctctcccaacac

SEQ ID NO: 89027 - DNA, 574 bp, Heterodera glycines
  SCN-specific regions: Sequence locations=1-450,472-528,550-574
agattgacaaaatatttcacagctttcattcacttcgacatgtccgtgtttagcagttcggatggttcatgcaaaagcatcaacagtgaggcggttttcgagactgctgaagatctcggggaagcattgaatctcgacgccggtgttgttgagtggctaaaggaagcgccgcgttcggatgaggacccgattttggtgcttgattacaccgatttgttccatgctcttccaggaactctcaattacaacaaaacctgggtggcgaatctcttggtgggccagaacgccgaaaaaatccgtgacaacgtcttcaaattcaacacctggacggacctttactctgcgcaagaaaatttgaagtcggacccgctccttcgacgtcttttctatttcccgaaccctctgattgcgcaacaactcaacattcctgcgaatcctgtgatttcgtccattgttatcacatttttctctgatgtgtctggaaaatttcaaacgaatccatttgatttcttcaagttctagagatgtcttgttgttctcttgttgtgttaaataaagatcttttaaattggtg

SEQ ID NO: 89028 - DNA, 636 bp, Heterodera glycines
  SCN-specific regions: Sequence locations=1-636
gattgttgccccaacccttacccggacatttgctattacttctccatcaaacgaaacccttcctactacctgttcacgctgatcatgccgtcggcactgatcaccaccattacggtggtcggctttttcacgccccattcgaccactggagaaaatacggagaagtgatgatggtatcggacaaattgcccgccacttccaactcagtgcccgtcctcggccaatattacattggactgatttgcatccaattcacggccacttatgtcacaacttggactttgggtcttcaaatggaaactcgggacggacaattccccgccgtttgcgccgttggcttatgcgagtgaacgcacacggcaattttttcgtgcgccaccttttgggccgcgagttgcgctgcacgcagcagagcattcggaatcgaatgaacaaatttgatcagctggtggaccgggcggacgatcggccgagttttgtgtattcgccgatgggctcaacttttgacagctcggcatttgcacgaatgaccactgcctcagcagtgagtgttcagcaaccgatacagctgaggcaaagagcggaggacggcaaagtgataatggcggaaaagtgccaaaagcaaacgaacggcgc

SEQ ID NO: 89029 - DNA, 1166 bp, Heterodera glycines
  misc_feature (1141)..(1141): n is a, c, g, or t
  misc_feature (1144)..(1144): n is a, c, g, or t
  SCN-specific regions: Sequence locations=1-668,690-1137
taaatattgcacatttttatcacatttaaatgtctctgtcagtgttggaccaaattaagcagcattcgaccattgtggccgacactggcgacttccacgcaatcgaagtgttcaaaccgacggatgccaccacaaatccttcattaattctcgccgctgcaaaaattgaaaaatacaaggaattgatcttaaaggcagtaaaatatgcgaaagaaagggcggcggggcaatcgaaggaggcggtgatagaattggcgagcaacaaactttttgtgcttttcggcaaggaaattctgaacattgtgccgggtcgagtgagcacagaagtcgacgcgcgactttcctttgacaaagaaggctcaatagccaaagcattgagtctgatcaaactttacgaagaggagggcattgagaaggagcgcattctgatcaaactcagctcaacttgggagggcattgaggcagcgaaggttctcgaatcccaacacggcattcattgcaacatgactttgctgttcaacttttaccaagccgtcgcttgtgctcaagctaaagtcacgcttatttcgccttttgttggtcgtattttggattggttcgttaagaattccgacaaaaaagagttcgaccgaattactgaccccggtgtgcaaagtgtgaagcgcattttcaattattacaagaaattcggacacaaaacgcaagtgatggccgcctcatttcggaacacggaggaaataaaaggactggtcggatgcgatcttatgacgataagccccgctttgttgggtgaattagccaaagattctgaggcggttggaccgatgatgaccgtggaaaatgcaaagaaatgcgaattggagcagattgaggtggacgagaaaatattccgctggcagatgaacgaagacgcaatggcggacgaaaagctcgcggatggaattcgccgctttgccgtcgatgctattaaactcgaagagttgattcgatcgaacctttgaattaaaaagtatttgttgcctcttttttacgagtgatagaccattcccagctcattcaaattgttaattatccgaatttatttgccaatttaatacaacaatttattaacatacaatagatatatttattctcggtaaanaanaaaaaaaaaaaaaaaaaaaaaa

SEQ ID NO: 89030 - DNA, 640 bp, Heterodera glycines
  SCN-specific regions: Sequence locations=1-102,143-206,228-584,606-640
gaaaattgcaaaagtttcctaatcatggcatcaccatccgatttggacatgaaaatggtgccacaaaatggtgacttcaagcacgatgtttctgaagaggtgcagcagcagcaacaacaacaacatcaagagcagaaacaaccgaacgatttggtgaagaacgatgaggacggcggaggggcagaggccggccaagacggcacagcaccgacagaaacagagcaaaagccaagccctgtaaacaatacgataccactccaaaaggagttggaaagcgacaccacctatgatgacactgacacattcaaaatgttcatgggcaagagtttgtccaagccggtggccgtcatactgatgcgcatgttcgacgagctcggcctgaacacggacgagtttgatgagcgtgccgtggaaatgctggccacattcccctttgagcaggccaatttcatcctcaaagagctcaaggactcgcaactgttcggtgtgcagaacaaaccacaatatttgatgtccgtcatgcgcaacttccgtgaacgacttcgaacaatgggcgtccaacaggcgatggaattgccactgatccccggcccggacccggaaagcatcaagacattaataaccaaatccggctaccaat

SEQ ID NO: 89031 - DNA, 706 bp, Heterodera glycines
  SCN-specific regions: Sequence locations=1-217,241-706
aataaattcactagtaattttttgaactcctcccatggccacccttctcgaatatccggcttctgttgtggagcaaatttcggtgaagctgtcagcgccaaacttgaacaccatcgcaatggcatacccaaaagttgaagtgccaaaatattcgcgtgccactctttcggctggcattgtccattttggggttggcaatttccatcggagccatcaggccgttttcctcagcgaactgttcaacatgggccaagacttggactgggccatcattggcgcgggtgtgatgccaacggacgagcgcattcggagttgcttaagcggacaagactttctgactacggtggtcggtcaggacgagtacagtaatacggtccagatcactggcgcaatgattgacttcctgccgattggcaatgccgaagcgattgtggcccaactttctgatccggcaatacgaattgtgtcgatgaccgtgacggagggcggctatttcatcaactcggccactggcgaatttgacccaacccatccggcaattgttgcggactcaaaagatccggccaatcctcgcactgtgttcggactgattgtcaccgcgctgagccgtcggcgagcaaacggaaccgatccattcactgtgctgtcatgtgacaacataaccaaaaatggtgaaatggcacgaaatgcgtgtgttggcatggca

SEQ ID NO: 89032 - DNA, 638 bp, Heterodera glycines
  SCN-specific regions: Sequence locations=1-591,619-638
ccaagtttgagtttagtcgtcgtctttggattggtgggacgccgctactgccgcccacggttggcggagtggggcgagagcagtagacaatcagggcttagccaccatcagcagcagaggggagtagcgaacgatctgcgcgcgcaagaagtttatgcgcagtagaatgacaatcgaaacacatcgaaaacggatcaggacagcggaaattccgctgctttttggtggccaaggaatgagacgccgtcggcaatagcagaaccaagcaaagaaaggtctgcaattgaaacaaaaagcgtgcagaaactgcacagagtgtgccacgacaaaaagcagcgaaagagtggacagactttccaagagtctgctggccaaagtgccgttgtgcgatctgatctgagcgctgcgtgctgtcagccgtgttaggcggatggacaacagaacagatgtggaagccactgatttctgactttttgattatttagtgctttgcaactacccgcatcttcttcctcccttcacatcatgtatgtgttccctgataagcattcatggttgtgttgttggagatgagattatttccttcgatcgttctaatttttgttgttgttgcactccctgtactttggtcagggcac

SEQ ID NO: 89033 - DNA, 746 bp, Heterodera glycines
  SCN-specific regions: Sequence locations=1-746
ttttggcgatcattgctgcggcactgatgacactggcaaaatatgtggatgtttattatttgatcaccattggacgattcattattggactgaacacggggttcaacagcggactgtccccaatgtatttgatggaaatttcaccaagcaatttgcgtggctccatcggctcacttcaccaattgtttattaccatcgcaattctcgcttcacaaattattgggcttccacaaatttttggctcttcaaatctttggccactgatatttgcgtttactctggtgcccgtgttgttccaattgtgcgcacttccattttgccctgagtcgccaaaatacagtttgattgtccaaggaaggaaagatcaggcggagaaagatctgaaatggctccggggaggcaatgatgtccatgccgagttggagcagatcaatgaagaagcggttgcaagccgtgcccatcccaaattgagcatgcgtgccatgttctgtcccccgttgttgtggcccctcgtgttggcagtgttcatgatgttgtcccagcagttgaccggaatcaacgcagctatgttctattcagctggcattttcaagagtgccggacttcaagggcaatggccaactgtggccactatcgcaatgggaaccgtgaatgtgctaatgacttttgtgtctgtcgttttggtggaacgccttggacgtcggactttgcatattactggcctcgtgggcgtgcttttgtcgagc

SEQ ID NO: 89034 - DNA, 615 bp, Heterodera glycines
  SCN-specific regions: Sequence locations=1-592
gtttgagttcatattattgtatggttggtcgtgttcagcattcaacagcatttaaagttcgaaagtggttcagcgtcttcgtttggcccgtttttgttatcagttatatccttggcgacaaataccaatattggcaattgaaaaccgggagacgaaagaacctttttgacgaattcgcatttcttcaggaggcacaaattcgagagcaaaaggcactttataacagtccgtacgggccgagagcctgagcaaatacaccgttttttggatttatctgtcaatgggcaccttcacccttaaatatttcttcaaaaaggccgttcttgagcgcccgtggtactttttccccgcctttatcaccattagttggcttgaatattcctactataaacatggtcaatggaagattggaatgatgaagggacacagcaaaatgtggagagaacgccgtgaagaaatcttacgctgggacccaaatgccgacctgtggaaatattagagaggaggacgaattggacagacttttcgatcggacttttaggcgccactgatttgatttgttctttaaaaatgataaaaacaattgtttgagaaaaaaaaaaaaaaaaaaaaaaa

SEQ ID NO: 89035 - DNA, 640 bp, Heterodera glycines
  SCN-specific regions: Sequence locations=1-310,332-640
gtttgagacacatttctaaacgctcaaaatgactgatattcaggcatatgctggcccatttatagtgaatgacgtcgtttcctattttttaaaggatggcgtctggtactaccgaaacgcgttcattccgatcaatttggagtgcaagcagccaccgccggcggagattgtcaaagagtggatggacaagtacggttccgcagcgccaaaatcgacaaagcaggccaaacaaaaagtggccacaccattgaaaaagtcgtcacacaaaccgaagctgtccagtgccgacaaggacagcgaaatgctcaagaggaagaggaagcatgagcagatgctttccaattcttcaacttcatcatcatccacatccaaaccgttgcctgtctctgcacaaaaagtggtgtcgtcctcggcactgccaacgccgggtgcgccgtcgccaaacattcccaagcaaaaacagccggcaaaaccctcctccgctccaacaccaaaaacggcactgtcctcaaatgctatcaacgaaactccaacaaaggtttgttcaactcaaaaaacgcagccgcaaaaagtgtcgacaactgtcactgacgaagcaccgccagcgacagaagttgccccggccccgctggtcatgatc

SEQ ID NO: 89036 - DNA, 649 bp, Heterodera glycines
  SCN-specific regions: Sequence locations=1-649
agtcttttcacaatgtacagcaacataagcagcagtggatgggttagcagtgaccacccgcaacagcaaattggcaacttttattcgtatgatgcggacccgactttaagccccaacggtggtggatacaatgcttattttgactatccaaatcagcaacccgccgcttcatccaattctaattttgtcccacttggctctggtcgccctttcccgcacacaatcagtcagcacgcacaactcagtttctctgacaattcgaatgcaaattttgttccgcttggctcgggtcattttctaccagaacgagatggtgatgtcgtttgctacgaagactcattcgaaatgcaaaaaataggacgaaagcgacgtcgagggaggaaatccggtcgccgtgctcgaatggacatttatggtgctggccaaccggcaactcatgattttggggaaattgtaaattacgacgattggcaacaatgggacaacggctggggaggacagcaacaattcgaacagaacgaagcggcgtcaaattatggccaatatggcattgaaccgagccaaaactacgaggactacgaaatttattacgacaattacgagacggaccaaacgaaggaactctggcaagaggaattggaacagcaaa

SEQ ID NO: 89037 - DNA, 650 bp, Heterodera glycines
  SCN-specific regions: Sequence locations=1-377,417-650
tgagaatgcaatcagccgaagagacaatggcccttgttgcagttacaaaatttcgcgattatctgcgtattaacaccgaacaacccaaccccgactatcataaatgccgtgatttcctcttcacatatgcaactgaattgggattcatgccctgggaatacgaatgtgtgcctggaaagccaatggtcgggatgacttacgctgggtcggaccaaacattgccatcccttctcctttacagccataccgatgtggtgccgacttttccggaacattggacttacccgccttatgaagcgtttaaagacatcgatgggaatatttttgggcgaggagcacaagacatgaaatgtgttggcatccaatacatggaggcgttgagagaaattttatttgaaaatggccaaaaaccatttttaaggacggttcacattctctggggtccagatgaagaaattggcagccacgacggaatggaaaagtttgttcatacggacaaatttcgttctctgaacatcggttttgcgcttgacgaaaggttggccagcgaaacggacacttactcagttttttatggggaacgatgcgcgtggtggctgcaaatcacttgtcctggcgcccctgggcatggttcgcgattccttgaaaac

SEQ ID NO: 89038 - DNA, 849 bp, Heterodera glycines
  SCN-specific regions: Sequence locations=1-596,618-674,696-849
cctcgtgccggagctaaaagcctaaatttattctcgctaaacaaaatgtcgatgtcaaaatcgtcctacacctacaatcggaagacatttgaagatgcggaattccctattttgtgtgagacatgcctcggcccgaacccgtacctacgcatgagcaaagacacacatggacctcgaatgcaaaatttgtgagcgtccattcacaacatttcgttggatgccgggcagaggggcgcgatacaaaaagaccgagatttgtcagacatgtgccaagttgaagaatgtgtgccagacttgtctgttagacttggaatacggccttcccgtccaagtgcgtgacacggcactccaagtcaaggagaccgtcccaaaagtgggggccaatcgcgactatttcatccagaatgttgaccgtgctttggaacaaacggatggcacagtgccgtacggcgagttggcgaaactgaccgatgcgggcaccaacgaaatgttgcgcaagctggcccgaaatcagccatactacaaccgaaatttgccacacatttgctcattctttgtgaagggcgaatgcacccgtggtgaagagtgtccgtacagacatgaaaagcccacagaccctgatgatccattgagtctgcagaatatgcgtgatcgctactacggaatcaatgacccagttgcggacaaactgatgaacagagcgaaggccatgccgaaattgacgccgcccgaggatcagtccattaccacgctgtttctgggcaatttgggccgtgaaagtcgtcttgtggttaccgaagcggacattcgcgattacttttaccaattcggcgaaatccgtcaagtcca

SEQ ID NO: 89039 - DNA, 488 bp, Heterodera glycines
  SCN-specific regions: Sequence locations=1-13,39-380,403-439,469-488
caagtttgagggcaattaaataattattttaataaaatggcacctcctccacccccgccaaaaagcaaatcgtcaattgaggaggatcaaactcagcagcacgagttggcggcatcgcccgaatgggcacaaaacgatgtggagcaccccgtagtgaaagtgttcggcttccaaccgaatcgattgggccgggaatggccaccgaacccacaacagcccgaagacacacagctggggcaggccaacaaacacaaaacgttgggggacattgactggatgacaagtcctgctgaagcaacgccagtgcgagaacaaattccactcagaggtaaacttaatgctcaatggcctccgccagaaaaagaataccgcgtcgaagtgttgttgccggagggggtcaaacagtgatccgctgctaaaagtgatcggaaaatagcacagatttataaaaaataaaatatggaataaacactcgaaactttgaaaaa

SEQ ID NO: 89040 - DNA, 1119 bp, Heterodera glycines
  misc_feature (923)..(923): n is a, c, g, or t
  SCN-specific regions: Sequence locations=1-143,165-1119
agttgatgctgttaattcctcggagtgtgcgttgtttttatggcggtttgttggatgtttcgtcactaaatgtggggaatgccacgcggatggaattgttacgaatcgctttttccacgccattcgccgtttcccattgttttttgtcggtttcgtccgtccgctgccttcaaacatttgaaaagcgtcagcaaagccaaattgagagggaagcgtccgaactttccaaattcattgactccctatgcaatccgaacgcatttaagaggcgtcctgatgcactctttgctcccaaacgcattggaggaatggatgtcgcggctgtcagctttttggattcgttgaatctaaccgaggaaaacatttcgaaggaggccatctcgcgattcagcaaagaggtttacaaaatgtccgctattcaactttctcagctgttgaaagcgactagcaaccgcaaaattgagcaccccgtgttgatcaaccacatttgcaccgcactgaaagaccgtcctttgcctccgtctctccgccacatttgtcaaattgctttttacttgtccaaacattcgttcctcgataagccgcttctcaacagaatcaaagaggattttttggtttatgtccgaaatgaaatcatctcgaaaacatctttttcacacattgtgatcgccttcgctttttttcgtctgactgatcgacatttttggcaacaaataatccaaatcatcgaaacactggcgaatcgccctgaatattcaactgctctgattgaatgcgttaattcgttggctgtggtaaatgttcatccgaaattggtgtcttccgttgttgaaaagactaaaagtctggaaaaggacggactttttttgggaaaatggctgcaattggtccattctttggctatccttaactctttggattcncaaatggccgaaagtgtactcaaccggaacttttttgaacgtttgtctgaaatgcaaacggacaaagcgatcagtgaacaccttgcccaatggaattccatctgttaccgaaacatcgctgcctcagcacgtttcgaattgccaaaaggcgaagtgccgcccatcgacggtcccttcctagcggacgccgacccga

SEQ ID NO: 89041 - DNA, 725 bp, Heterodera glycines
  SCN-specific regions: Sequence locations=1-15,37-725
taagaatcgggcagcaactttttaaatttgcacaaaataattttcacattaaatgacgtcagaaaaagaaatgctgtgggacaaggcgtgtcttctcacgcggttggtcgcctcgtcggtgcgactgtccgaagcggcgggcggaattattaaggacataatgaaaagtggcgacctgaaaattgtgaacaaagaccaaacaggacaaatgaaggatttgcaaaccgaggccgatcgttcagctcaaatttgcattgaacggtcactgcgtgcgaaattcggcgaaaatcttacgattattggcgaggaagacattgcgcccccatcgacgccctttcaaacgcttcaacctttgccatcttcacatcattttcacattatcttcaatgagaatgccaccacggcggtgccgtcttcggaagtgctgagcaacgacgaaagagtgcccaacgaattgcgcagcatcgaaatgaaagacgtcgtcgtttgggtcgatccgttggacggcacttccgaatttacaaagtcaaaagaaaacccggcgctcctccgccaagtcactgtgctcattggcatcactcacaaaggccgaccggtggccggcattgttcatcagccgtattatgagggacaacaaacggctgacggattggcaccgaacggtcgcaccatttggtcgattgtcggagttggtacttttggccatcagaaaacggcacaacaaa

SEQ ID NO: 89042 - DNA, 657 bp, Heterodera glycines
  SCN-specific regions: Sequence locations=1-657
attggaatgactgtcttacaaaacaaacagtttcttctctgcccatcactgtttttcagggctgtccaactccgtcgaattaggggtcgtcctgtttcgcgttcgcgcatttcgccccctccgtccggcgaaggcattcaatgggcgcccgccaccaatgcttttcgcgtcagcaaagacggcgagccgaggccgttaccgtcggcattcattgacgacgacgaccaaatggacccaatttcgaaggccaaagaaaatttgcgggggcccgagaagtacaaagtgatcaacgcggtcagaaagaagcgaaagcatttgctgcagctgaacttcgaccacattccaattattgaccaagttgttctgatgtttccaagccaaggggcgcaacacttacaaatgggcaaaaaggtcattgacaatccgagcagtgcgcgactttttgaggaggcaaacgaatttctcaaattcgaccttctcagcctctgtcttaacggaccaataaacaaattagaccaaacattctatgctcagatggctctgttcgtttcttgtatggccgcttttgagaaattgaaagttgaacagcccgacttggtcgaccgactcaccgattgtgccggttttagcattggtggaatttgtgctcttgtcgca

SEQ ID NO: 89043 - DNA, 548 bp, Heterodera glycines
  SCN-specific regions: Sequence locations=1-83,105-481,503-508
cttatttcgtttattgttttttttgttgttgttcatttggtccattgtttattttattctaattatttccataaagtgcatttcccccctaattgatttgttcagtgaattaaatgtcttccgccgtttcgtcttccccagcagtgctcactcggttggattggctcaaactgtacaaagcgttgcaaagggcgggttcagagttccctcaatacaattaccgtcacttcgcacgtcgtcgaatccgcgactatttcgagcagtacagcaagcagacgatgaccagggagaagctgtccgaagtttaccaggaaggtcagtccgccctcggcacaatccaaaggcaaagtcgaatctcttctctgtacccgactcgtccgcttgtcattgagacgattgatgaaaaaaaggagggcgccgtcctttgatataatgtcgtgacatattatttttgttgaccgttcttaattctatcgtgcgcctttttgaaataaaatatatgaataacaaaaaaaaaaaaaaaaaaaaaaaaaaaaaaaaaaaaaaaa

SEQ ID NO: 89044 - DNA, 650 bp, Heterodera glycines
  SCN-specific regions: Sequence locations=1-97,119-650
ccggaactgatcgtttaccccagcaccgatttcgccacgaatacacacagcattgagcggttggacgcgctggtgttcgggccggggcttggccgacagaaacacacacaaaatttgctggcggacgtcgtaaacttcggcacgagcaaacaaaatctttgtttggtcattgacgcggacggtctgttcttcgtcaaagaatgttcgcaactgttcaaagggtgcacagacaaagtgatcattacgccaaaccacagagaatttgttcggctttatacccaaatgttccctaaccagcagaagggagaggacaccgacgaattgaaaattcaatgcgaaatggcggaacaattggcaaagcatttggaagtgactgtgatgagaaagggtcggtggcacagaaacgcaaccgaaaaatatgaggagagattgacataatctccaacggttcctcccaaacgcgaattgtccaagcggaaacttcgatgcgccgttgcggtggccaaggcgacattctcagcggcgcgacggcacttttcgcattttgggcaaggaaagcctcagatgccgacatttattcctccgagcatttgctggacggggcggaggccgcttcgcttttggtgcgcaacgcatcgctacggaccttt

SEQ ID NO: 89045 - DNA, 662 bp, Heterodera glycines
  SCN-specific regions: Sequence locations=1-171,193-297,324-662
tgagctttgacaaaatgagtgtaaacgtaaaacaaaagaagacggcgccgaaaagagacgtttcgtcgtcgccgagccaatcgtcgacgagcgactcgagcgaagcttccaacgaatcagtggacgaagcgaaggaagaaacgacgccagccaatgacaaagtactgacgaagtattccatggcagctgaaattgtgaataccgtcctcaaagaactcatttcggaggtcaaagaaggcgtcgaagtgggccatctctgctcggttggagacaaccgattgcttgaacttaccggcaatctttttaaaaaggagaaaagtgtgcagaaaggaatttcaatgcccacgtgtatttcggttgacaattgcgtgtgccacttttcgcctctgaagagcgaacctccagtgctgctaaagcagggccaattggtcaaagtcgatttgggtgctcacgtggacggatacatcgccaccgccgctcattccgtcgtcgttggtgcctctgcggaaaataaaacgaccggcaaaaaagcaaatgccattttggctgcttacaacacgatggaaatggtgctgcggatgctcaagccaaccaagtcgttcaaaaatgctgaagtgactgatcgtattgggaagtttgcaaaaacatacggaacgacacct

SEQ ID NO: 89046 - DNA, 738 bp, Heterodera glycines
  SCN-specific regions: Sequence locations=1-242,301-491,514-738
attaatttccggcatctatttctaccaatcaccgagccccagacccgaattcgaacaaaaattcgaaaagtcaaattttatgaattttgagttttatatcaattaaagattaatttccggcatttatttctaccaatcaccgaaccccagacccgaattcgaacaaaaattcgaaaagtcaaattacacacacacttattgtgctttactaattgtatgtactttgtctaatattcctttggtaatttatttaattaaaaatatattttattgaaaatatttttctattaaatttaatttctcataatttagaaattgccagtcgtggagatttgattgcattactcaaaacctaacgatacgatgtgtttttcaagagaaaaaatggcaccaagaatgccgttaacggctgtcggtggaataccaaaaagcaatgcaattggtctctgtttgatttgcaaggaactttcttttggcaaacactacggttgtataagttgccttggttgtaaaactttctttcgtcgtgctgttatgcacaaccaggacactgtgtgcaaaaagccaggcttttgtgagttcgaagtgtcggctcgtcgactttgtcgttcgtgtcgatttcggacgtgtctcgacgatgtggaatgagtcacagaagcactccaaccaaagcgtgatttgatcggccggcagagacgtcgacgctaccaagcagttgcatcttcggtcacccctccc

SEQ ID NO: 89047 - DNA, 1072 bp, Heterodera glycines
  SCN-specific regions: Sequence locations=1-599,621-726,748-1072
atgctataatgaagcctctgaaaattgacgtggatttcccctcgaatagtcatcccacttcccaagaattaaaccaagattgtattcctttgtacgaaatgcttgaattcgaggaacttcaattcccaaactattacctttccgaacaattgggaaggggtgcccatgcgacagtgatgccgtgccatttccatgggaagccggcagcggccaaacttttcaatgccaacgtggacttcaaaacgatccaaaaggaggccaagctgttgcacgagtttcgccatgaaaacatcatcgaattgtacgctcttttccacgggacaatgtccggattggtgctggaactgatggagggcggttctctgagtgaattaattcaccagcgcaaaagcatcgtttatcagaattgtcatgtgattaattggactttccaagtggccaaagcattggaatatttgcacaagcttagtttcatccatcgcgacgtcaaaccctccaatatgttgctgtctcttgattatgtcgtcctgaaactttgcgacttcggcacaatcgctaagcatcggacggacatgacgagcacttgtggcacggccgcatggatggcacccgaagtgttcagaggggagagttacgactttcggtgtgacgttttctctcttggaatttgtctctgggaaatgctcgcgcgaagtccgccatttgccgacgctcccgaactaaattccttggccgtgttgtgggaggtggccgagagcggactccgcccgccgccaattgaaggagtagccgagccgttgcagcagctgatggtcagatgctgggccgacgagcctaacgatcggccgccgattgacgaagtaaaagagatgttggaagcacttttaaagcaattgcctcacggcgcattgtctccgttcgtcggtcgccttttgacgggtcgtccgtcccccgtagacttttctccccaagcacggaccaatgattgaattgtgcaatcttacaatattgtttcttttttatatgtttctgcttttatattattgtttttctttttaattttcaaatttgt

SEQ ID NO: 89048 - DNA, 824 bp, Heterodera glycines
  SCN-specific regions: Sequence locations=1-345,367-608,631-708,733-824
aaaaagagacttctactacactgggtgacagaaagcacaatagagatcccaatgtttctccatttgctgggactgccccattgaaaaaattcatccaaggacatctcgccaacatatcttttcgaaaactgaaatttgcaggtcgtatcggttgtattacaatggattcggaataatgtgaggaccgcgccattcatctttaggataacgcaatattcaagaagaactgcctgagtgtcacaaaagcgagtgatttaccgaagggcccaaaaacggcttcaggtgcgcaaaccgatgaagctgaaaagagttgcaaaatgctcgttactccgctcttcgatattccctatgaagaacagctcaaaatcaaattcgaccattccaaaaaagtgttggaattacttcaaaagaaattgacgcaagcgcacgcaacgaattctttaattgcgaaggaatccctccctaaaaatgttcttccctctccattaattgaacaatatcgcaacaaatgcgaattttctgtcggttattcgtccggcgacaaccgttctgcggtagttggttttatgagtggcaaaatggcgaacagacagtccaatgttttggcgccggatgagtgttcgaatctcacccgaaacactcggtcaattgtccgccattttgaggcatttgtacggaaattcggtgaagaaccattcgacgaattcgaacggaaaggcttttggaaaatgttgactgtcaaggacttctcgggcgacacaatgattatcgtgacggtccatccgcacccgaacagcgaaattaccgataatgccaaaacaaag

SEQ ID NO: 89049 - DNA, 633 bp, Heterodera glycines
  SCN-specific regions: Sequence locations=1-120,142-275,298-355,378-633
caacgattggaccaacaaattcccccctcccccaaaattatctgtccaaatcaaatcacttcctcgtcaatgtacaaatgcttctgcttgtgcttctcctaattttgcttttcccttccgaatctcttcaggctgccagttttatcactttgcattgtcaaggcaatggcttatacgtttcgggacgatggaatgaaaacggacagacggcggatttgccacttccatccgaactcacaatgcaacgattagctcgtctaattaagtgcttatttatctgttacattttctttgaaggttcgtgtcgagaaaaaacaaagatggcaccgtttctttcatcagcaattccaatcgaatgtttttgacagttttgccaaatgcatttggacgcattgttttggctcagcataatcaaccgactgatgggtccaccaaattcaaattaattccctacacggacggcacttacgcaattaaggcagcttccattggcaaatacttgagctgccgcaattacgcctatcagctgttcgccaaccgggaaaaggtggaggggcccttcgaaaggttttacttggacattgtgacgacattggcggaatttgtcaccgcaagagttccgctgaaattgcg

SEQ ID NO: 89050 - DNA, 639 bp, Heterodera glycines
  SCN-specific regions: Sequence locations=1-639
gtttgagacaacattattttttaaaaaaatatccatccaacttaaaatggcttctccttcacaaggccgaggtatgtcgaccatcttttacagtctggctgtgtgctatttcgggcttttgtttctcggcgctggccacgctttgatgctggggtcaaagaccaccgaatgtattgcattttgctccaggcaaacatcaccggaatcgtacagtacactgacgagacaaatgtgagccgttcatcaaatttcactgtgccaaatggcgggtctaccaaaattgcctacccgggcgcggctcaaattgcccagccattgtggccaacaccaacagcaaatgaccatcgaatttgtgccggatggcttcaaccacaccgagttggaagctgacaatacttggtatctgacgctccaattcaaccgcaccggcacaaaggaacagggcacgtttttgctggccaattacacactcgatgtccgtttcttcaacgtgcaaaatgcttcatcccattacaatggcacttatttgtacgcgaaggcgcccagctttaagccggaatggagcgcaacagtgcaaaacggacagccaaatatccttacctgctcaaagaatgggcttcatttggatgaaaagtcgtc

SEQ ID NO: 89051 - DNA, 601 bp, Heterodera glycines
  SCN-specific regions: Sequence locations=1-455,481-601
gttaattatgacgggtgaaagcgcatatgaacttgttttgttggttaaaccagaagtatttatttacaaaattcctccactaacgggcaacaagggctacaaggcagccgattggaaattggacagtcccgactgggtgggaaggctcaggctaatttcaatcggcgacaagctcgagattcgacttgaggacaaaacttcaggtgaactgtttgcgaaagcgccgattggtcagctgaactctgtcgactatgaatcggtatccgactcatcccgctattttgttgtccgactgcgcaacgacaacgcccagaccgcatttgttggcatcggcttcgctgaccgagctgactcatttgacttgaatgtggcgatccaagatcatttcaaagcggtgaaaaagtgcgacgattcggcggaggataacgcagaaactgtgcccaagttggacttgagcttcaaagagggacagaccatcacggtcaacattgggaagaaaacgatcacttccaacaacaacagtagcagtgctgtgcccaaccttcggacatcgctcggcggtagcagtgccgtgccgcttttgccaccaccgcctgcctct

SEQ ID NO: 89052 - DNA, 889 bp, Heterodera glycines
  misc_feature (543)..(543): n is a, c, g, or t
  SCN-specific regions: Sequence locations=1-353,375-889
ctccgaagttcaattagtgctccaacatctgccccaggagtatcagagattcgaggagaaactggaacgtgcccgtgccgaaatggcccaactccagcaaaatccacaacagccgccctatttgccacccgatgcgatgccccctccgcagcagataatgccaatgcccatccgacaggacttttacgtgagagccctcttcgacaacgacccctcccgcggggatgcggtgctgccgcaccgttccctcgcctttcggtacggggacattttgcatgtgacgagtgtgggggacgacgactggtggactgcgcgaagggtcgccgaaaatggggacaaaggccccgagggaatcattccgtccaagaaaagggaggagaagcgcgagagacagcggcgcaaacaggtgaacttcaacgcgggcagtcaaagtttgggcagaaacgcgtcaatgagtgccggcggattcggcggcggcggcggattggacggccgacgcggttctcgcagccaactttccttttctcgcaaatttcccttcgntaaatcgactgagaaactgaacgaatatccctcggacggaggcgaaacaggcggcggcactatcgcagatgagccaattcattcatacgttacggtagaactgcgaacagttaattacgttcgcccggtcgttgtgctcggggctttgaaggatcgcataaatgacgaattggtcagtcgacaccccgacagattcagcagctgtgtgccacatacttctcgcccaccgcgggaaggcgaagtgcacggacgcaattattatttcgttaccaaggccgaaatggagagggacgggaagagcaaccttttcatttgagcgggccaattgcaaaacaatttgtacggg

SEQ ID NO: 89053 - DNA, 838 bp, Heterodera glycines
  SCN-specific regions: Sequence locations=1-702,724-838
gcgatatttgcaatgcatatgacgttcttttcctcgtggacaccgtcgcctccatttgtggtgcccctttccatgccgatgcgctgaaagttgattgtgtgtatgccgcaactcaaaaagtgttaaactgcccgcccgggttggctcccatttcattcagcgaaaaagcactggagaaaataacgaagcggaaaacgcgagtgccctcattttatttcgacgcgttagagttgggcaattattggggctgtttcgacgagccgagaagataccatcacacggcgcccatttcgttggtttatgcgctacgcgaaggtctttcagcagttgcccaggaaggaattgggcacatggtaaaccgacacaaaatcaatgcaaaacttttgtatgacgcgtttgaccaattgggactggaattgtttgtccaaaaagagaataatcgtttgccatgtctcaccaccgtacgcgttcccgaaggtgtcgactggaaggcggtgcaagacaaactgatggcccaaggatttgaaattgccggcggattgggaccaacggcgggtaaaatatggcgcatcggaacattcggaatcaattcgaacccggaggacattgagtcacttaaacaagcattgaaaggagcactttacgaacaagaggaaaagggacagtcggaccatttcaaggcggccatctgatgacagagggaaaaatggcaaaataaattaagacggttaattaacaatgggtagatcattaacataatatatcttttggttattttggcacatttcactatgaacatgtcaatttttaaaaaggacggacaataaagttaaacggc

SEQ ID NO: 89054 - DNA, 641 bp, Heterodera glycines
  SCN-specific regions: Sequence locations=1-535,558-641
gcataacattgattttccttgatattcttccatcatttgggctgagacaatgatggaaatgacaattctcgggaatcggattagcattaccgcggacggcgccaaagtgtcgccatttggcagcaaaatggacatgggggactattatgttgaaaataacaagctgagaaaaacacggggattgggctgggtaatggccgcactttttgtggtcgccgacatggcaggcggaggcattgtggcattgccaacggcggtggtccgatgccagttcttttccggttatgctgggccaatgttgggaaatattattgcgccgtttcccggtttaccgtactcactgtcgaaaaccgtacgctgaaattggccttaaggccctcgggccaaaaattaggtgactgccatacagtttcaaaaatacagtatcaaattgtatctaaacattgtctgtatttgccaccatttccagaactatcgtatcgatttgcgtcaacgtcacccagtacggtgccaccaccgttttcctgctgctctgtgccaaaaacattcgtgacttcatccgtgcctttctagacaaggagatcagcttctgctatttgatcgtggtcattgcgcttgtgcttttgcccgtcactttgctc

SEQ ID NO: 89055 - DNA, 518 bp, Heterodera glycines
  SCN-specific regions: Sequence locations=1-68,95-213,251-333,386-518
gtcagccctcctggcaattccaatcaaagcttcttcctctccgcttgcttcttcattcatactcatcagctgtttctcttctctctctgctcttaaaaatgattggctcaactgctcggtgtgttgcgcttttgctgctcggcgccacaatggcacaagcattcctcacgacatttaacgttgcaccgaacgcctttcaaaaccgacgcggatgccgaggaggaggaggcggcggatgcggcggagggtgcggtgctcctccaccaagcggtggcggtgccatcaaactgacgctcggatgcgaagggcctccgcctcaagcgcctgccccatgcggatgcggcggaggatgcggcggcggttgcggtggcggatacggcggaggatgtggtgcccctccgccaagcggtggcggtgcgatcaaactgactctcggatgtgaagggcctccgcctcaagcgcctgctccatgcggatgcggtagtggatgcggttgcggatgcggcggagggtgcggt

SEQ ID NO: 89056 - DNA, 546 bp, Heterodera glycines
  SCN-specific regions: Sequence locations=1-22,46-332,354-441,463-546
gccgatcatcgattgagtgctcttagattctgtctttcctttcctaagttttcctttgcttgtttttttccatttcattagatagtctttcttttcattcaaactgcgtccattgtgaatgttttccaatggataaaagggtggatctgtcattgatgagcttatgtgtcaattgcttaatgatagtaatttataatatgaaaccctttcttaacagggccaatgctttttagtttataattgcctcggccttaattatgttcgcggtttgtctccctatgcacgaaaagtgtgccgcagtggaggcagtccgccaattggtttgcctctcctcagtgccaaattcaattggccattcggctcttggccaaactcagtctcttcctccttttggcattccgcggctccattgttttggccgatgcctttcctttggctgtttttcagctccatcttctgctgttcctctcttcgatcatctgttcgactttgagccgtggacggcggcgtgtgactcatttcagtgatcaccgattgattgctagg

SEQ ID NO: 89057 - DNA, 652 bp, Heterodera glycines
  SCN-specific regions: Sequence locations=1-347,373-652
cagagacatcatcgaattctgcaacttcctgctttaagccaaacaggaaccagtcagcggatatttccaatttgccaaattatctacaacaactccaactcggtcctggcggtagttcgaccacgagaagaaccgggcgtttcgtggaggaaaggcggcttcgtcatgttaagcaacagcccagctatagctttgaggtttccggcacttggggtcagcgcttctcgagttgccaatttctggacgtgtcggaggatggacgaactttgattggatgctggacttcagagcaaaacaatcttttcgaggggcactgttctcgtgtgctatccttcggcgtcactgttgacccaaacacagccaaaaaagacactcagcgaatggcactcgccgaagatgttggggacatggcatcactgttggactccaatgggaaataccgctgcaacacctatggattgtgctttgagccaatagacaatgagatttgcttgggctcttccaaccgaattctcattgacatggtgcttgccccggctgaccgtgacgtcacttgccttctctttgccactgctcggtctttttaccaggaacaacaacattccgtcggatcttgtccaaaaattgtaaccaaatgcacggttaacttgcg

SEQ ID NO: 89058 - DNA, 431 bp, Heterodera glycines
  SCN-specific regions: Sequence locations=1-284,306-376,421-431
agtctccgttgccggcagagagacgcaaacagtcggagacggaccgaaggcggcaacagtcggccaaaagttcgccgacacgcgaaatggcgccatttttttccgttttttaccggggaatcagcggaatcagcagagtgaccaaatcgcagagtcgcagcgaccttttggaaaaggacggggaaagggaaggggacaaagccaaagctgaagacgacgcaaacgcatggggagagtcggaactgtacaaccgccgataaacctccgcatcccttgaccaaggcgaagggaaattgtgccaccgatgggcacggagtttgggacaaagccaacaaaaaaagcggaatccgatcaaagtcaaccgccgatttgcatgccgcgaaggcagcagcagcagcagaaagaaagaattggagggaaagggaccaaaa

SEQ ID NO: 89059 - DNA, 651 bp, Heterodera glycines
  SCN-specific regions: Sequence locations=1-57,79-99,121-651
gaagtaagaagcacttctctgtacagcttgcactcctgcaaaatgatgttcatctgcaggtccgactcaatgttccctttttggcgcagctcatagcaaagtgaaaatatccttcaaaatgttaatcatcggttttgttagcataaataatgattgaccgaccaattaattggcatccaatattttgggaattcgcttttcacattttccattaggtccaattctggtagcttaattaatttgcattcgaatcggatgattccattttgatcaatgtttgtcgttcgactgacttggatcagttcggagtcaaccagtgactccatgtttggaaaacgctttcgcacttggatggaaatgtcgcggaggacgagcacttgggtcaaacacaaataccttttaaattgcaaggagtttaaaaatatattattgttagctttattgcccctggctcacccattcatttgctgcctaattacctaattatgttcctcctaattgcccttatttgggggctgtcaccacggatataagtgccaatgaaaaatgcagggctatcgacgaagccgatattttgaaagatttgcttccatctgagaaaaggcagaaaataacgaattatttgtctgtaattaataaaaaaggttttac

SEQ ID NO: 89060 - DNA, 579 bp, Heterodera glycines
  SCN-specific regions: Sequence locations=1-579
gtctgattctgtttattatgaattttgcttgttgctgtcatttttcaacagttgcacaacgttatttttcgagcagtcgtaaacaaacggaacaatatttggaacgacaggccaacgaccaatactcgaggcgggccagagaacactcataccgtgcaaggagtgcctttaaactcatgcaaatcaatgacaaaatgcacttcatcagaccgggtaccaataataattgtgagtcagcaaatgctcggctcaaacactcattgcaggactcgttgcgattgacgcgggtgcagcgcccggctcgtggtgccaagtgctcagcgagttgattttccctaacaatttcgcaccaaaaaaaagaaccaaagcggatgaaagaacggacgaatgtccgtttgatggaactgagcaacgccaaggatatattttgggcgtcgaccttcttgtccggccactccttttccttctatcgcatttcctccgttttatttcgcccctttcagacaataagtccaattgaaaatgttgatttactgtgcaaagccgacttcaccagaagagccactcagacagaaatca

SEQ ID NO: 89061 - DNA, 687 bp, Heterodera glycines
  SCN-specific regions: Sequence locations=1-687
atttagctaataattctgcaaatgaagctcttttgcccttttgtgtttctcgttctgctgtccgccactgcttttgcgttctcaaatctgaacaaaacgccaaagactgtccattgggaagacgcgtgcgacgagtgccaattgatcatcaaacgcgttgtcaatgtcgccaccgacccggaaaaagttgccgagttgaagatccttctgtcggcactgtgtcaggagacctcctacgtggaggagtgtcgtctgttcgtcagcaaattggaccttttcctcggccgtctgttgccctttttgagggatgcccaccacgtgtgcaaagaattgcggatttgcaacaacggacggctccaacagttccacgtgctcggcttacactttgcacgtgtaaatgcttcgttccaacgtaaggatttgatctgcgaggagtgtcaattggctgcccgggaattggcacgtgaagtcagtgagccgaaattccagcagtacgtggaggaatggctgcaagggaatgtgtgtgtccatctcggcactttgaaatcatcgtgtgagcaaatgttggacgaattcctcccggaaatgtggcgagaaatggaggacattctctcggaccaaaaaaagttctgccaggatttggagctttgccccgcgggcatttcctcgccgagttcggcccgacgc

SEQ ID NO: 89062 - DNA, 937 bp, Heterodera glycines
  SCN-specific regions: Sequence locations=1-125,147-414,436-892,914-937
cgagaataattcacctgcagcatagaagggcaaagttttattgtgagaaaattggtggactgattgattttttgtggaaaagccaccaattagtgcaacaataagcagcagcggaagataattggaaagttcgtccacaacttcaatttgttcctccgatgggctccgatcccccggccgcggtcgcttcctttccctccgccggttcggcaacctttgcatcgcttcacaatgcccgccacaattgcatctccacgtgccactacccttgtcattctgccgcagcttctctgcgatcgacgcacgaccaaatgagggcgtgtattagcattgatttgttagtcgcgtgccaaagggaagtgaactttttgcgaatgatcgacaggaaagcgccggtgctttacgaaaaagtcgttgtggagaatgccatccgacgatatgagatgtgttggttgccggcacaagctgcaaagccaaatctgcacaacattccgccgttggatgtccattggatttggcacacccacatgctttccccaacgcattaccgcgaagattgtttggccatctgtgggacagtggtcgaccacaaattgctaaatgcggacgaaatccagcagagatatgagcagtcggtgtcctcgtggagcgaattctgtccggaagaaccgtacgactttctgcaaagtaacgaccgcgtccgcgagcagtaccaacaaaaaagcaaatacgacttggcggaagcggtgcaacggcagcgcaacttcaactaccaagtgtctttgccccatttcaccgccccgcgctttctgaccgatgccatcgatcgctacatcaaattcctgcagctgaagcagacatacgccgaccattttctgacgccatgttacgacttcgacttggtgtggcacactcaccaagtgcacccgttggacta

SEQ ID NO: 89063 - DNA, 690 bp, Heterodera glycines
  SCN-specific regions: Sequence locations=1-51,216-216,299-299,357 -357,446-446,522-522,612-690
attcattccaccttcttccacttccatcatcatacatatcttctgcgaatcctccctccccttcttcctccgctgatggccaaccccaactccgaccactctctccccctttccccctctccctccccttcccattcttcccactccttctccctccgttctgtttttgcccaccacttttgctttttctgctcaaattctgtgctcatcgccctagtcgtgttcactttgtcactgctaatggcatttttgctggggaaacggcgctcttcgcaaaacgaattggcaaaacggcgcagagacaaatcgccagaaggcattgaattggaggagaatcccgaggtgttcaaaagttcgttgctgaaggactccaaagaacacatcatcagtacgtactttcctgatgtgcgcacacttttcgatgctttccaacgcggtctcaaagttgccgaacattcggcctgccttggctttcgtccggcaaaaggttcgccttaccaatttctcacttacgctgaggtagccgttcggtcgcagtcctttggccatgctttgatctccaaattgggccttcagcccggcaacgaaacatttgtggccatttatgcgcagaactgtcccgagtggatgatcacggcgatcggctgtacccgccactccatggtcattgtgccgttgtacgacactttg

SEQ ID NO: 89064 - DNA, 955 bp, Heterodera glycines
  SCN-specific regions: Sequence locations=1-919,943-955
attttgtttttatttgctgtatattttacaaaatgtccgtctcgtggggcactcaatactccaaactgaaaacaaatcttcggctggcagcaaatcgactccgattgttgcagaagaaaaagactgagcaggcggtgaaggcgcgctgtgaaattgcggactttttaagcacggacaaagaggacagagcccgaattcgcgtggagacaatcattcgcgaggattttgtggttgaggcctacgaactgctcgaaatgtattgcgaacttttgcttgcccgattcggcatcattcagcagatgaaggaattggacgatggcatcgccgaggcagtgagcagtttgttgtgggtggcgcctcgcatcggacacgaaattgcggaattcaaggtgatcaacgacgagctgacccacaaatacggcaaacaattcgcggaggccgcccgtatgaaccaattgccggagccgagccgagtgtcgcccaaattggtgcagaaattgtccgtcagcgcaccgtccaaattgctcgtcgaaaagtatttggtcactattgcgcaatcggcgggcgtcgatttcgcgccggacgccaaagtgatgcgtgaagacgacgacgaaattgcgcgggcggaacgcaatctgatcaacttcatgaacgaggagcagtacgggtggacggtccgtcacaacgacgacccaaacagcaaaggcagtggcggagggcatttcgctgctgccgtcgctggcgccgttggccccgccgatccgttgatgaaccagggcagcaacaacaacaatggcggtggtgctactgcaatgcctatgccaccaaatggtagcggtgcgtttgccatgtccccctccacgtttgtgccgtcgcatccgtctcccctcgccacttcgtcgtctcctccgcccgaatacgcgccgccgcctccgctgccggcccatggcgctgg

SEQ ID NO: 89065 - DNA, 725 bp, Heterodera glycines
  SCN-specific regions: Sequence locations=1-58,80-104,141-375,397 -421,450-684,720-725
ctgagtgcctaaaataacttgttaatacaatttggtgcgtttcatagcagtttctgaaaaaatatttatgaattaattttgctaaaaaaataaaatagtgaagctttaaaaattaataaaaaattttaaattcaaaattactggagttagcatcatagcagtgcttttccttgtctttttgatgccctcgcaaaatctggttcgcttctgatcagtttataaaaataaaagttaagcctaaaatttttcgcatatttaaaaagcaattaaaaatttttagattttttattcatctccctttttgatagtgaaagcatctgagtgcctaaaataacttgtaaataaaatttggtgcgtttcagagcagtttctgaaaaaatatttatgaattaattttgctaaaaaaataaaatagtgaagctttaaaaattaataaaaaattttaaattcagaattactggagttagcatcatagcagtgcttttccttgtctttttgatgctctcgcaaaatctggttcgcttctgatcagtttataaaaaaaaaagttaagcctaaaatttttcgcatatttaaaaagcaattaaaaatttttagatttttattcatctccctttttgaaagtgtaagcatctgagtgcctaaaataacttgcaaataaaatttggtgcgtttcagagcagtttctgaaaaaatatttatgatttaattttgctaaaaaataa

SEQ ID NO: 89066 - DNA, 643 bp, Heterodera glycines
  SCN-specific regions: Sequence locations=1-292,314-643
ccacaagtcaaaaaatgtttttccactcgccattaccacgaacaccggtgctccgacgttcgacgctcagtggcagcggccaagtcgaaattggggccgcacttcgtcaccaattggccgaagtgtttacgccgccatcaaacatttatcaggtagctccacaacgtgaacaatcagttgacgacagcggtggaccatctgctgcagaaacagtgccattaatagagcatcaacttttgatggcggatcaggaccagctgaacaacaacattgttcaacaacaaaatctgtatcagcagcaccagcacaattttgtggcaccgtccatcttggtgtcgtcgtcgtccatggagaaaagtgcgtcggcacaggacttggccggcacggccgcagcgctgatacgacggcaccgcagtgcgagcaaataaactaaaagatttttcctcaacacaccggaagctcagtgcgtacaattgtgctcaggaggccaaccattacaattcaggaagatggacgcattcttattgacaatatcactgcccgttgggacggattgccaatgccaaaacagcccacacttttggaaggggacgatgttggcacactgttgaccagccaactgattgaagaaggcgaggccaag

SEQ ID NO: 89067 - DNA, 1289 bp, Heterodera glycines
  SCN-specific regions: Sequence locations=1-85,112-191,213-584,608 -620,644-1039,1062-1289
agagaatggccattgaagcggaagaatttggtgagcagcaggagacggacgaagttgagcagcaggaaaatggaagtggaaattcggaagaggaggaggaagaggaggaggcaccgcaaatccgacggcagcagggccaaattcggatgatgaccagcagtggcgaggaaacagtgcaagcgaccgaagcggccgtgccgccccccgccgcccaacaggcgcctccgcagtcgccagccgcgaccgctgctgccccacaatctccggcgccaacacaaactgcagcaccggcatctccgggctcggccgccgctattccgcagtctccagcagcggccggagccgctgctgcagcacaacaggcggcgctggaggaagccaaacgacgccagcaagaggccatggaaaaagcgcgggcagaggcattgcgcctgcaggaagaggcgcgggccagggcggaagcggcacgccaacagcaccaacaggccgctgaacaagcccgtctccaggcggaacaacagctaaaagcgcagcaagaggcggccaaacgacaagcggaagaacgagcgcagcaactcaaagcgcaacaacagcaacaacaacaacagtctgtacaagttcaacagcaaaaacaacaacaaccgccaattagcccttccgccacggcacaacaacaaaaagcggcgccggctcccgccgctcaaccgccggccaaagcaccgcagcagccccaagcgccaaaagcagcggttgccccggcacagcaacaacaacagcccaaagcggctgcccctccaccgccaaaggccgccgcggccccgcaacagcccaaagcgactgccgtcgctgcgccgccgaagcccaccgcccctcccgcggtggcacctcaaaagcgcgcgccttcgcccgttgtgcgcgaagtgcaactgcccgaagcgccgacccaacccatcttacgacacgcagaatacacgccgaaattggtggacgcatctgtcaacaaactgccgccagggcaagagccggatgaggaacaattggaggcgagcgcagtgccccgaaatccgatcattgaggacaatgcgtggcaagtgcagcggcgtgtgcagcccgaatatcagccggtccaacccgccaaattaaatgcgactggcgactttttggtggagagtgaggcaaagaaatcgattgtgcccgaggcggtgggctattcgaagacaaaatggaacgaattcccagaagaggaagagaaagagcgccaatcggtgccgaaagtcaagcgcaggaat

SEQ ID NO: 89068 - DNA, 677 bp, Heterodera glycines
  SCN-specific regions: Sequence locations=1-181,203-284,308-529,552-677
aaaagatggaagacctttacgaaaaatgtctaaagaattcgcgtccgacccatcggaaaatggaggagaatttgtacgacatccgagttttggacgtgaaggcgaaactggcagaaaatgagctcagacaaaaaatgactcaaatggcaaacacatggaaaaagacgggcaaagacgaacgaaagcggaaatatgaggaaatcgaagaacaattcgctaaggccaatgatttgtgcaatgaaaagattcaactcgccgagagcacttatgaaatggtggactcattcatccaaaagttggacaaagagacgagcagtttcaacgcttttgtaaagcgctctaaaaggacggctcaatcaacgcccggaacatcgaaggaaaacattgccgatgagccgtccgtcgtcagaaggcgggggactgcgccttccacttcaatggcaacaaaaagaggcggcaccacgggacggacgagcgcaagggaagggacgagcagcgcaacgaaagcggagagtgtgcgcgtcgatggggcggccagcagcagcggcagcggaacgcaactcgtcggcaaaggggacatgccaattgacccgaacgagccgcgctattgcacatgccaacaggtttcctttggccatatggtcggctgtgacaacaaagaatgtcccttggaatgg

SEQ ID NO: 89069 - DNA, 643 bp, Heterodera glycines
  SCN-specific regions: Sequence locations=1-159,183-192,216-239,261 -269,293-486,520-643
acgagtcaaatatctggactcggacgcccccccccaccactttttcccttttttctagaaatttttaacaaaaaataaattgcattcaatttccttaaagacgatgaccaatggccggacggatggactgcggtgacaaaggatggacgtaagaaaatgaatttttattatatatattttttgcggggttacaatttttccccaaaaattcaaaatgctttcgcgttacttaatttcggataaaaatgttaaaaattttcgataaatccaaaaaaaaaaaaaaaaaaattttccccaggcgcttcggctcaatttgagcacacactgctggtcaccgagacgggctgtgatgtgttgacagaacggtcagtggctggcgctcctcggccatggttccgagaccagcttgaacaattgggttacaacagaaaaaagcggcagcagtagtgccactacgaatgcggatgttgttgttggaaactgattaattttttgtgtgtatgttttggctgataattcacaaaatttagcctttgatgattgaaagtattatctatcctttcttccattacatacgtacccccatatatttttggaaattcagcagttaaacgagaggattaaaatttgttttagggtcaaa

SEQ ID NO: 89070 - DNA, 934 bp, Heterodera glycines
  SCN-specific regions: Sequence locations=1-898
aggcaaacacgtaaaattgcaatttggcaaaatatttgcgtattttgtatcagtggatgtgtcggatttccgatttctaacctttttgggctcgaaattctgttttccataattttttgagggcctcggcacttatcactgtttataattccaaaagcagtaaatgggtcataagttgctgaatactgcggaatgccttggcatttccgttttgacatttgcacaattttctaccaactcggcctttggccaatgccaatttcgcgaccagtcatcgctttgttcgtttcggctccccactcattcactaatttgtaagttcacaaatgctaagcttcaccacctttttggccaatttggcctttaactcggccaatcccagcgttattcactctttgcatgcgatgaatattaattggatttttgacaatttgccgtataaaagggagggcaaacgaaggcaaaagcacacgccgtccacaccattcaatcaaaaccaaccaaatccccactcattagctcattatgaaatttgcccctctggctttgcttgtgatccttttggtgtctttggtcgctgccgtctctgctaattccaacaacccttttgatgcggacgcggccgacaacggtggcatgaagcgcgtcaaacggcagcaacagcaatggcgttggagtccgcaacagcagcgctgggtgccaataaacattgcgaatgtgaacattgctcagaatggataagcgcactgagaaggagccgaaccgaccgaccgatggacggacggagacgaagacaaaatgccaagaatatgtgtgatcagtgacaaattcaaacccaatgccgcgccctttcgattgccaaagtgcaaaaatgccactgataaataaacaaagtgagaaaaaaaaaaaaaaaaaaaaaaaaaaaaaaaaaaaa

SEQ ID NO: 89071 - DNA, 973 bp, Heterodera glycines
  SCN-specific regions: Sequence locations=1-38,92-116,140-196,251-973
cgggccaaaccaagtttaaagcgccagtgcgacggttccgttcaatgctaatcagctaattgctcactaattaccccaaataacaaaactgtgcctgcttctcccaacaatggcccccaaatgccttccgctcgaacttttgttcgaaattgtgccttttatccctgccgaaaaagccgtcccgaatgcgctctcttcctgtcggctgctgcacaaacttttgctgccacgtgtcatcaaatggaaagagcaactgctaaccgatttgatgagtttctcggcgatcgtcaacaatctctcggcgaaagtggacaatctatcgggcgtcgtcaacaatcactcggtgaaactggacaatctatcgggcgtcgtcaacaatctatcgggcgtcgtcaacaatctctcggcgaaagtggagacgattgagaaaaaaatgggagaaacgactggcaaggcgccaaacgaacaaaaagagcgaggaaatggacacaaagcggtgatgggcgcttacaacgaaaacaatggcaccatcgaagtgccattacatggttacaacgtcggaaaggcgattgttgaaaggattttgaacacggaaaacgggacggtgcatttgcacggaatgcgcgaaccaatgtcactggcaaaggccgtcgaaattggcttttttgacaacctgtcgctgactgtggttgacccgaacaccacgtcaaaggctgtttttggacgaagcattggaacggaaagtgctggactcaaatggccgattgcagcaccagcaccggcaactgacattgggcgaagcgaatcggcaaagacttgtgcgtcttgagaagggcaaaccaactagtaaaaaaaaaatcatcaaactcgaatctgacagttccaaaatgtccattcatctcgacaaaacgtccaacagcatttccaagacgaccgtcgaacccgacaaaacgtccaacaacacttccaacac

SEQ ID NO: 89072 - DNA, 3442 bp, Heterodera glycines
  SCN-specific regions: Sequence locations=1-619,688-706,754-771,978 -1019,1054-1102,1162-1275,1299-1330,1387-1387,1477-1483,1545 -1559,1589-1625,1653-1869,1902-1910,1954-2331,2357-2370,2408 -2531,2662-2708,2751-2794,...
  SCN-specific regions: Sequence locations=...2822-2834,2869-2885,2993 -2993,3025-3031,3060-3221,3252-3442
atagagaatgaattaacgtggtcgattggaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttgggtaccttaagagagtcatagttactcccgccgtttacccgcgcttaagcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatttccctagcctggcgtgggaatgttaacccacttccctttcggcaaccggatggaccaactgcgcaagcacagaaaagtcgtcatccgtagtgtgttacggcgttagccggtgccttaggatcggctgacccacattcaactgctgttcacgtggaacccttctccacttcagtcttcaaggatctcacttgaatatttgctactaccaccaagatctgcactggtggaagctccggccgggcccacgcccaaagccttcaacgcaaccactacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatggttcgattagtctttcgcccctatacccaagtcagacgatcgatttgcacgtcagaatcgcttcggacttccaccagagtttcctctggcttcatcctgctcaggaatagttcaccatctttcgggtctcagcgcatacgctctgtctccgccccatcgcatgcgatcgagacgggactatgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatgaccggcttttacaccgagaacgcacaagtgagagcctgagctggaccgaactggttgctggtacgtgtcgcacgcgaccgccaccgacccccagctcgagtcaacacggacccgaaaccattgcacaattcacccagagtaaacagcactcccccgatccgggtaccagaccccaaaaggctg

SEQ ID NO: 89073 - DNA, 633 bp, Heterodera glycines
  SCN-specific regions: Sequence locations=1-633
aattgattgtgacttcaactagttcaaaaaccgtattttgcttttgccccctcactatacattaatgtcctccacaattgctcccgtttcttccgccgatggcaccgctgggagtgccgccgccgtcgccagcgctgggccctcctccgtcgagccgatgccgccggtggagcagctgatggagggcattgaggagaagtgcccgccctcgttggaccagcgactgaacgccatggacgaggtggacatgcgcatcgacgacctgctcaccgtggtggccgaagtgatggccggtctggacaaggacaagccgctgtcaaaggcgaagatggaggagctgtacaagaaatacgaactgaagctggacgaaattcagcggggcatcgccgaacagctcacttacatggaacaggtgtgcgtcggcgccgagcaccagggctcaacttaccattaccatcaggtggcccaactgagtgccgcacggctgcactctctgcacgcgcatttggccatgctgagaaacaacatggacaacggtagcagagaaagcggagtagatggacaacaacagccaacaggagcagcagacgaacagagaaaaaatagtgaaaaaaagggaaaggaggagagaca

SEQ ID NO: 89074 - DNA, 656 bp, Heterodera glycines
  SCN-specific regions: Sequence locations=1-214,236-656
gttaccaatctgtaatggacccctaccttcaagaattaataaacaaatggttatgctgggacaagaatgaaacgactcgaacagaaattgaacgactcgtaaaagagaataatgtgcacgaattgcgacttcggatggttgggaaattgtcttttgggacggcaggagttcgaacgcacatggaggcgggctttgccagactgaacgaattgaccatcatccaactgtcccatggaatggcacggcatttgacaagtgaaatgggcgaagatggcaaaaagaaaggcgttgtgattggcttcgatggccgacatcagagcaaacgttttgccgaattggctgccaatgttttcgtgctgaacggactgtccgcctttctcttttccgccgtcgtccccacccctgtcggttcgtttgccgtcctttctttgggttgtgctgcgggcatcatgatcaccgcttctcacaatcccaaggaggacaacggcttcaaggcttattgggccaacggcgctcaaattctgagcccacacgacacggaaatttgtccaattgtcgcggaggagtcaaagcccgaagaaacctattgggacacggtccaactcggcacaagtgcctgtctccactcggccgactcggttttggagaaatatttt

SEQ ID NO: 89075 - DNA, 573 bp, Heterodera glycines
  SCN-specific regions: Sequence locations=1-2,24-550,572-573
acaaagcgagcagaatgactactgaacagggaaagaacgaacaacagcagggaaagggcatttacgagagcaccaaggaaagtctgtcgaacgtggcggaggggacgaaggaatggctgacgagtgccaaggacaaagtggccgattcgctgacttctacgaaggacactgtgaccggcaagtcggcggagatgcgcgacagggcgtccgacagttacgaggatgctaagcagggggcgcaggaccgttacgagcgtgccaaggagtacggcagtgagaagacggagcaactgaaggactatgccaccgacaagaaggaggaagcgggcgagaagatggagcagaacagggagaaggctgctgagaagtgggacgagacgaaggaggctggaggcgagcgtatgcagcgcgccggtgacaaaatcaggggcaaatagaaaggatgtccaacagaatgaagagcaaatttatctgatctgatcggactctgtgagcccaatttaactgctctttttattggaatatttgttgtccatcttctcatataaaatttttgtgaatgaaaacaattca

SEQ ID NO: 89076 - DNA, 1401 bp, Heterodera glycines
  SCN-specific regions: Sequence locations=1-60,82-289,311-1285,1308 -1401
caagtttgagcaatttcttttctcttccaaattcactttccatttgccctccttccctagccaatttgtcccccttaaaaatggcactcgtctccaaatggcgttccgaccctttcgggcgttctgactggcccagcctttggcgtgatcgcttttctcgcgactgggacgattggccccgcgattggccacgcccgggagaactgatggaacgtttccgttcccgcgacttcgaccgcgaccgttggtggcgagattggcccactgattggccccggatggacgcaattgtgccaagattttcttcacatttggaccgtttcgaccgtaattggcgtgacgaccccttttggcgcgatttgtacccgcgttgggccgagcccatctttaaagatggcatcgacgtcaaaactaacatcaccaacgacagtaaccgtttcgcagtcgaaatggacacttaccaattccgcccggaggaacttcaggtgaaaacgatggacgacactttgctgattgagggacggcacgaagatgttcgagacagagacaattacaccaaaatgtatttcgtccgcaaataccaattgccggccgatgtggagtcccactcgatcagcagtcacatcgacagttctggccgtctgagcgtcgaggcccaaaagcgttggcaggccgtggaaggcgaacgttccattccaattgagagcggctcgcgtcgtcagggcgggggctacgggtcgcgctcgagctcatactcgccgcgcgatcgctactacgccgactcaggccgagggtcggccaacgattattacagggctgagagccgtctgaacggagcggcgaacggcggcggtggttacctttcgccaaacccgcgatcggacggatatcgaacggaattcgagaaacgcgagacggacgcgaacggaatgcgacacgaagcgagacgggaggaattccgcgaggagttccgtcgcagcggatcggccgctaatgttcttccaccggcctcgcctatgctgcgcaccgagtcgcgtttgagcggcgcggtcggcgccaatgcgtcatcaggcgaagaacgccgcgaatcgtcgcacttccgccgaacggcttcagccgcctcgcgcgagtatcggtcgggtggcgctttcgctggcggagaaaatcttttgcggacggcggaggaattgggcgggcgaagttcggcatttggcactcgaaacgtgccaattcaccgtggataaagacaatgtgagggggaagcgcccgcatggacgacacataagacgaacgaacagacaaaagacgaaatcactcccccccactcactcatttgccttagagtgtcaaagggcagactgactgataaataagcccgatcactttttattgcttcaaatt

SEQ ID NO: 89077 - DNA, 1178 bp, Heterodera glycines
  SCN-specific regions: Sequence locations=1-206,228-997,1019-1130,1152- 1178
cgccgcttaaacttcaacccgtacaaccgcccgttcaatatgcgcaacagcggcaccaaacgtcggcgagcagtacaacaacaacggcaccaccatttggtgaagcgatggaattttgcaataaatgctcgtacagatactcttgaaacatgcccagatgcctttcaacgtcgtgcaaccgatggcaatgactctgctcaatttgcctctcatcagcgtcatccaccgactcgcaaaaaagtttatctgaaatcttcgcgcctgccttttctcaaccaccgacaacaattggccaccgatgctccgcctttacaaaatggcctttcgtcaattgctgccgcggttccatcgtccattgaatctgtggcgaatgaacgcgactttatgtgcgaatggctgatgcagtcggagggggacgacgattggtcggacgaggagggcacagcagcggggccaattgagccgtgcgcgaggttttttgcttccgcctcacaaatggttttccacgtgtacaacgaacatttggtgccgcttgtccaacagcacagcgacggcgaaccgccgaggattcgctgtcgttggcccatttgcgaaaacactccgcgcactctgtgtaatccatcggtgcttccctacaaagagtacgtctatcacattcggcaacagttcgagcgcagtagggaacggacatccgcgcagaatgcttactcagactttgccgcacaggaagcgatacgacggcacgcatttgccaatttgcgcaaagagattacggaagattcggagggtccggtgacgcgaagcattcgcctcacttcagcgctcattctgcgcaacatttgtcaccattccgtcgccggacgtcgcaaactccgcacgcatgagagtttcattagttggctgtcactctcacacatggaatcagctcgtacattggcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttcgtctattgttaattgcaagcgttccttctccgtcgcgaatttgagcaattcgaatttctaatct

SEQ ID NO: 89078 - DNA, 930 bp, Heterodera glycines
  SCN-specific regions: Sequence locations=1-182,208-930
agcatataaaccgttaaaaccaaatgaatagcagtgaagaaacaacggaaaatgttgggatgggcggaaataaggacgaacggcagacaacttcaaaagatgagaccgacgaaagcagcagcgaaaatcaacggaatgaacaacgccaacgacaaatggacagcgaaaaggaggactcgaggttcgaatgcaatatttgtttggacatggccaaagatgcggtcgtttcgatgtgcggccatttgttctgctggccatgccttttccaatggatggacacgcgtccctatcgccagctgtgccccgtgtgcaaatcggcgattagcaaagacaaggtgattccgctctatggtcgcggtggtggggacagcgacccgcgcgagaaaattccaccacggccgcaaggtcaacgcacagaggagacaaatcagggctttcccgggatgttccattggggcggcgacaacggcggccatggcggcggcggtgtgcaattttcgttgggcatcggtgtcttccccatttcctttttcgcctcctttttcaacacaaatttcggaggcgccgaccgaaggccggacccaccgcccgtcggaagtcgtcaaatgttggaggagcaattgctgtctaatacgttcctctacatcggtgtgctcattttgctgtggttagtgttcgtctgatgaccatcaaaaaagaaaagaattgtggcgatgtcacccatcggtagaccatttgctattccataaattgtcatttttctaaatacaatcactgaatgctctcggcattcccttctcctctctctctctctctacacaatttgtgtgtctgtccgtctcccttttcttgtcatttccttccaaatcaaattcatacctttgcccgttgttcgtcacaaacagtacatttttaaacttctgctgctgc

SEQ ID NO: 89079 - DNA, 652 bp, Heterodera glycines
  SCN-specific regions: Sequence locations=1-652
aacgcaaatgtgcgaccgcaactgcaaggagtggacaacgccaaagactgtttgacaccgtcgacaacaggcaataatcaaccgacacgagaacagccaaaactgatggacattgacgaaaggattgggatggacgacgaagacaacgacgacggggacagattcggagaagcagcagaggtattgggtggaggagacaacgctaaccgagttggtggtgagagagtcgtgggtaacagactgcggaaacggcgctccgtttcctgtgagccgacagcgaacagtccggccaaaatggcaccgcatcagccagccgatgaccaatccgctggttgtctgctgcagcgcacccaaagtgtcaatgccttcgctgttccctctgctcatcaacaaaatgccgtcgtcccaattgcctcttcctcgcgtatttcgtcgagaatgccctcctccgtctccatttgctcatatgccaattctgaagtcagcgcgcggaaacgttcgccctcgggcgacggcagtctttgttcaaaggaggagcggagtttgtcgttaaccactccaaaaattagcatttccatttgcggaaaggctttgtatgcgtgcgcaagtggtcggttggacgatttggcagctcttctcaagggacatcccg

SEQ ID NO: 89080 - DNA, 632 bp, Heterodera glycines
  SCN-specific regions: Sequence locations=1-18,41-632
gcttattcttctaggcaacgaattgttaaatcaaacaaacggctgaaatgctaattgcttatatccccaaacgaattcatctcaatttgaatgtggtcggtgctgcacttcgtcagcgtatgccgttttctgcggctgtgcttgaccctcacgatcagctgaaagattcagacaagccgatgtcggagcagatgaacccttcattctttaagatggtcgattactacttcgacaaaggcgctgctgtcattgagccgaaattggttgagaacttcaaagcttcgcatgggaaatcgaaagaagagagggtcagctctgtcaaagggattcttgcggcgattaaacccgttaacaaggttctttacgtgaccttcccgcttcgacgcgatgacggatcttatgagatgattgaagcatggagggctatgcactcagagcatcgtactccaacaaagggagggattcgcttttcaatggatgtgaatgaagatgaggtgaaagcgctgtctgctctgatgaccgccaaatgtgcagttgtcgacgttccattcggtggagcaaagggaggagtgaaaatcgacccgaagaaatactccgcttatgaaattgaaaaaatcactcgcaggtttacc

SEQ ID NO: 89081 - DNA, 1778 bp, Heterodera glycines
  SCN-specific regions: Sequence locations=1-63,85-114,136-1196,1232 -1778
aaaggttacgttcttatgcccagagaatggccatttttataattaatgacatccgaatccaccaattttttaggccatttgaattggtgttgtcaacgtggcagcaaccaacggctgtggctgtggtccctggtgacaaccacgatggcaatggtctgctccatgccgcgtcgcttggcatttggggtgtccacgaccggcagctgaactggcgcaactttgcacgatgtgctgaaattcgggagccgaaaacatgccatctaccggcgttggcgctggcacgagtccaagaacaatttcgcatcgggcttggtgctgtcggaggaggaatggcgccgggaatggactaaagtgtacgagtcgttggagtgtgtgcatgtgtttgcgctcgcgcacattttgcaccggcccatcattgtgtgttggtggacaccattctgcgcaatgcgaaggccgaagaatgggcaccgattccgtttggcggcaacgcccgcccaaacagtgccatcgctcggagagttcagcactgagcactggtgtgcaggccagcgtccactttggagcacattcgatggtcggtgcgcaaaagtcgtgcacttctgtcgccaaactgttgtggctgctcaaaattgcctccgcctgcccttccgaaaagctgatgaatgccgtggatgagctgctgttccgctacgtggacaccattcagccggcgaattgctttttttggttgaacgaactgatcactgatgtgcaacagcggaggggcaacgcgatggccgagattctaaagcgagtcggtctcctgcagccgcaagaagtgttctgcgcattgtgcatcgaacttgggccaagccatgttggccgttacattgaacaatacataaacaaactacaactactagtacttgcttcttcgggtgcaaatgcttctgctgctgccgtttctcaccatccttgcatggcaattgcaacacaacaatcatcatcatccgctggagccctaattagcggtgaaaaccgacttttcgatgtgttggatgcctttctggagcgccatttaacgcaaatttgcgtgctgagccaaatgttggacgaacttgacaatttcagcattcgtccagccgagatcacattggacaaattccgtcactttctctccatctgccattttgatcagttcaccaaaatagccgatttgacgaacacagcatctgatcctcagctgctgaagagtctcggtgaatggctgtaatctcccgaaattgtgatggccgctaatgctaacactgacgaacggaatttgatgcgtggcgtccgtcctgcgcaaatgggtcgtccaaatcagtgcccatttgcgacaaacgttgggaaaaggcccaaaacggctagtcgattcgagtgcttttctggaccaattcaagaacaaattggcctcaatcaacatattcgatggacattttaacattgattttgccttattttaacactcaaattgcgcaattgtgccactctttgacgaggttgtgcgtgccgactcggtgtttcgtctgttccatgtccgttcattaacactgcacggagttttgtccaacacgtgctgttcaccggctccaactgtcgtcttttccgctgttgcccatcggcctttcatcgcgtcaacaaaatgccaattcggattattcggcgcacaattttgctctgttcaccgccattctgagcgacatgatcaatgccagccaggtgtagtgcggacgccgttggcactgactgtgatgaga

SEQ ID NO: 89082 - DNA, 586 bp, Heterodera glycines
  SCN-specific regions: Sequence locations=1-68,90-272,299-338,369-586
tgtaaatcgcaccgaattctacagacctaatttggctataatcttgtttctggcatgtttgggtttcgtttttgggaataaaaaattgtcaaaaattggtggaactccctaaaaatttgaatccatcaaattttgtattttaaaaatttggtacaaaacttatattacatcccaagtgttattgcgaatgaattttctcaaggaatattaaatttcttttctattacgcctttaattatgtatatgccttttcttttatgactaacacagacataaaattttatttatttttttatttgtgtcttttgccgtgcgaaaatttagtttttccaattaataaattaacattttttaatgaaagcatttattgaattgaaaataataaccctttttaatttatgtgaaaaaaagtctaagaaatttttaagcgttgtggagacttttttttctctgttcaccgcggtaaattttgtgtgcggcgaagggtctgcccccaccgaaatttttgaaaatcgtgtggattttaatgtcaaaaattcaaacaatgcaatgtttctaattcctaaattttaattgaattttcggt

SEQ ID NO: 89083 - DNA, 926 bp, Heterodera glycines
  SCN-specific regions: Sequence locations=1-246,268-926
atcatacctaacaagtaagagttgaaactttaaaagcttttttattgcacaaaaatcatggttgcttcttcattctctaataatggcaaaaatattttggaatcgccgttcaaactaacaggagaatgcaaattgctctattattgtacaaacgaattgggtcattttttgaaccaaacatcaaatgctttaatcggcaatcctctgagaatagttccgtttgatgggcttagctctccacaaaagcaagtctgtacaaatacatcaaattctttggaatttaattgtactgagcgatacatttcattgactaatggcactgctctttggatttacgatttacagaaagggagcacactacgagaactgcatgaccatgatgggaacatcagtggggtcgcctggcacagacaaagtccttggctcttggcaagtgtgggcgacgattgcacgttgcgcttgtgggatttaccttcgcatcctgctcaaattgcgattcgccgtgcgactaagccatacaggcgattggaattttcgcccgattgcaattacatcgcttgtgctggtgaacttgtttccatttatgatttatgcatggcccaaaatgttgtccatatgctttcgtgttcatcggtttttgatattaatcgtcttaatttgttttatattttcagtcgtcagctgtgcgtttcaacccttcagagtgccttttggctactgcggatgatgatcggacagttcgattttgggacgttgacacaggagaatgtgtcacacaaacgcccattttcaatgccaaaattggtcaaattcattttgaaccaaatggaaaatatttaattgcggtcacagagaaacaaatggcttcgattcgttgggaaccctttgaattggtttcgcagttcgacctttcgcatcagctgcat

SEQ ID NO: 89084 - DNA, 532 bp, Heterodera glycines
  SCN-specific regions: Sequence locations=1-198,220-448,470-502
gtaagtacatgtaatactgctcggtacagacaaagcgctgccctaaaacaaaaatggcaaaaattggacgaaaaaaaagaaaagaaaaaataaataaaattaccatcaatgatcaaagaagcacagcgaaaatggttgctgaagcaatacgcactggtgaagaagggcgcaattggtgagtagtcgaacataaacatcaccggcacgggtttaaacgcgaacttagggcatagtttgacgacaaaaccaacgaaatttgcatggttttaccgggccatcgctgtccaatgaactgtttgcgtcgtttgaagttgaaggtgacccccaaaaggccgaagatgaattttgagaccgacgatagaacattctttttgcaggaggcgacgcaaaaatggaattttgacgatttgcatgtaatggtaatgacgagtcattttcttcgaaatcattctgttcatttttcacaaatgatggctcccaatttgaggatgacggcggcggctaaaaaaatttaaaaattaaatattatttt

SEQ ID NO: 89085 - DNA, 634 bp, Heterodera glycines
  SCN-specific regions: Sequence locations=1-76,98-591,613-634
caagtttgagatttcgatggatgccccggccgatgcccccggggtgcatttgtttggcactgtcgtccccaaagaagtgttcctcgcccaactcttttaccttctctacttcgcctcctttggctctctgtttccgcttttggccgtttactttaaacaactcggactgtccgctgcccaggccggcattttgttgggctcgcgtccattggtcgaattcgtcgccagccctttttgggggagtttcgccgaccgtttccgcaagggcaaactgttgctgctgtgctccctctgttcaatggtcgttttcactttggccgttggcttcgtccaaccgctcactccttattgcgttgtgctcgaccaaaactctaccggcggcgaatgcaaatttttggtgccggccagcgaaattgtcagaggaggcgcactcggatacatcaaaaaagttgccggcattggacggcgccggaggggcaaaaccaaaaaaaagaattcgaccttaacgaattgtccgtttagacattctgtccatcatcgatttgtccaccttcgacagcaaaaattatttggtggccggcaaagcccctgaatatattaccaaagaaaaggtgtgcaattacgagaaggaggt

SEQ ID NO: 89086 - DNA, 1125 bp, Heterodera glycines
  SCN-specific regions: Sequence locations=1-163,185-380,402-415,438 -744,766-1125
aaaatatgcaatttacgccaaaatagatcgattttaatgcgtattttgaaaaaaaaattcaactttttgttcgaattcgggtccgggggtcggaattgagcaaaaccgagtccggattcgtaataggaaccctcgaaaacccccggaaactgattttaagcctaaaataaaaaagttaaattaggtacccccattcgttacgattgcccaataagcatttccaatggcattattttcgacatttgttacgacaggattgctgataagtcagataaaaggcatgaatgaataaattttttcccctcatcacctaaacgttccattggaaaggttcgtttgtgctcgaattccctcaacaaaaatgcttcgtcgtacatttttcggttcagcgcaaacagagctggagcttctgcgcttcattttttaaagaaaatgacaaaaaaaagttacttttctaaattaaaatcacttttgaacagggaggaaacagaggacaggctcgacttttgctctaacaaataagggtcaaacccagtgttcgacaaaattggttaaaacttcaaaaaagtcattttgcgcgctaattcaaaaatatagatcagttacctttttggtagtgtttgtatcagggatgggccaaattgaaaaataaaaagcgaaaagcgaaatttgcgaaactgaaaaatgcgaaatgaaaaaaaagcgaaatgcgaaaagccaaaatatgcgaaaatgcgaaaagcgaaatttttttaaaaaattttaccaatacatgtaaataatttttttccatattcatacaaacgctttttttttgaacaaaagttacgatttttatttacatatttcggtagatatttttgaggttttgtacatatttctttcacatttcgtgattttttttaacgaagcccaaaaacgcgaagttttcgcccgtccctgggggtgaaccgctggcggacgattccctcctgcagcagaagggtgattaactttgacaatttttgaaacattatatataaataaatcattcaaatttatgcatcatttgtgatagtgtccccttctctaataatcccccaacattcgaatatcatccgatcactgatccaactgatcaatcag

SEQ ID NO: 89087 - DNA, 635 bp, Heterodera glycines
  SCN-specific regions: Sequence locations=1-22,44-67,89-212,234 -234,256-395,417-635
attcaaattccgccatttattcattaaatggaagaagctccaaaaaatggacgtcatcagcagaagaataaaaatgagcagcaattgaccgcttccgagcttcgtcattacgaggcggacttcgacgagtccgacccgaaatggaagtgctggcccgaaaggaagcacgtccagaaggtcgctttccacgcttcggtggcgaccgtcgtgttggctgtgctgctgctactgctcgcgcttctcctcctccgtccgctatttctccgtctgtccttcgttagcctcggcgtcgtcctttgtgccgtttccgccatggcattcttcgctaatttggcccaaaatgacttcctcttcgtgccttaccttttcgttgtgtggttgctgactattctgagcttcgccttcttctttttcttggtgccaatgttcggcgtgcccgacttttggcagaattgggtgctcgtcgcgttcggcatcgcccagggccgccattcgctgtccgtcgtccgtctgatcaccgttttgggcgcagctgtttccttcgcttcgatttgtctgctcactttgttcaatttcataatgctccgcgcaagaaacttcgcaatcgccaaaagagtggcaattaaaaaaggata

SEQ ID NO: 89088 - DNA, 803 bp, Heterodera glycines
  SCN-specific regions: Sequence locations=1-85,107-624,646-803
ccgcctttcccccctcctctttttgtccgttctcacattctccgtccgctcacttcgaattctgcaaattgtgcccggtttcaccaattcccatgtgctgttcaattatcggttggcccaaacgctggcggacatgggacattcggtgactctgtggacgcaaatggaaatggcaatggtttttgctggcgacttgaaattgcccgagggggtcattgagcatcgtgtgcccatccatttccgtgaccgtctgaaggtggaggggctcaaagtgttccaggaaatgatctttgcccgtggcactccgtacgagctgtggtggaccggccgcgagtttcaggaaatgcgtctggaagcgtgtgaacaaatgctgaacgaagcggacgcattgcgccaaaaatgggccaaattcgacttggccattggccacttccacgacttatgccctgtgatgttggctgagcgagtcggcgtgaaaagggtgggcgaaagttgcgcgatcaatgattctcgagagtctcgggaaaaagttccgacttcgagaatcactgatgggttgggtcactcacggcacttcactgtacgacttcaccgctgttacgcttggcattcgcactttgccctcctttgtgccgcatccgctctcctcaaatggcgacagaatgagtttcactggtcgacttaaaaacgtcctttggcatttgtccggcattgaatttgtcaatttgcccgaagcccttctgcacgacgagaacaaaatgtatgaacaaatgtcccacggtcgtgacaatctgtgggcactg

SEQ ID NO: 89089 - DNA, 716 bp, Heterodera glycines
  SCN-specific regions: Sequence locations=1-716
aaaaaattccaagccaaggccaagccactatagcagtatagtgccaaaaattaattgaaaatattaatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgacaaaaattaattgaaaatattgatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgacaaaaattaattgaaaatattaatttgtattccggttattcttccgtaaaaaatgacgccaccttagccattaggcctagaaaaaagagctctttcgaatggtaccttcaaatcaaaaaacgactgtcagggagctgagctacagaaaaaaattccaagccaaggccaagccactatagcagtatagtgccaaaaattaattgaaaatattaatttgtattccggttattcttccgtaaaaaatgacgccaccttagccattaggcctagaaaaaagagctctttcgaatgg

SEQ ID NO: 89090 - DNA, 572 bp, Heterodera glycines
  SCN-specific regions: Sequence locations=1-219,241-572
attcaatacaaaataaattccaaaccaaacaccaacttttccctgctgatggctgaccaccagcacaatgacatcgaactggcggaggacgcctccgccactgaacaaggcaccaaacagaacgtgtcggttgcggtcaaatggttcttccacggaaactggcgacgttttcaatgctccgagtggacttacagcgcacttcaggctgaaattcgcaccattgagcccaacttcagtggccaatttttttatagagacgccgatggagatgcaattgttttcacaacggatgccgaaatgcgtgtgatgctcgaccactttcagaagaaaatgaacaaagacacagtgacactcgaaacgatgggaggcgaaggaactgttaagaccggagttgtcaaaacgggttgcccttacatcaacaaaatcggcaaaatgcgtgacgtcactaatggcaatggggacaagtcgttgcatccgcacattatgtgcgatctttgtgacgggggtgtggtcggcattcgttacaaatgcatggtctgtccggactttgacctgtgcgaacaatgcgagaa

SEQ ID NO: 89091 - DNA, 736 bp, Heterodera glycines
  SCN-specific regions: Sequence locations=1-103,125-209,231-736
ctgcagttgtcctcacttcgactgccttccgtgcagtggctgtgcatgccaacaacgatcagtgtcagtccggccatcccggacaaactcgtggtcaacggggtcgacctggtcaaccgggaccaactgtccgtctctcaaaatcgcgagttgcagcggtacatcgatgccaatgcgcatttgctcggcttcctggacaaagacaaagagcagcagcagacggacggcggaggcgacaaacgaacgccactcacaatatcagtgacggagcaaaagttcggcccaatctctccaggacaaacctcgggaatttctgacaaactcccgccgtcttccgctgcttcgtccttctcatcgcctgcgtatggtcggcctccgtccgccttcgccgccgcttcactgaaccgcgcggggtcgccctattcaatgggcggtggttctgagtacggcggcagacggaagggcgtcagttggtcggacgtcgtggaggagccgaagccgacgactcggacccggtccgactcgcccccgccggcgtcattcattcgccattcgatgccggcattgggcaaagacagtccttcgggatatggaacggacgaaggacggcactaccgaaacggcgcatcggacgatggcactttggacgggggacatgacggacggcaaaactatgacagataccgtcattcttcacagaatccgttcgatcgtgccgatggttgggtttcgtcca

SEQ ID NO: 89092 - DNA, 642 bp, Heterodera glycines
  SCN-specific regions: Sequence locations=1-436,459-574,603-606,640-642
gtccaatcaatagcttaaaacgaaaaaatgtcttcaaatttgatgggttcgccaagctgctttttccatccaacagctgagcaggcagcggcagcagaagaagtggacaaatatgaagtgttcagttggcacggagatttgagcgaccaattggcagcacaatttttggtcactgatcagcagctgttgaaggaatgccgagaaaaacttgccaactccgaattgagagagacgaaattgctgagcaaaaacggggaattgaatgcagagaataaggctcttaaagcagagttggagaagcaaaagatgatgacggaacacagtcaaattaaggccaaagtggagaaaatggagcaggaaaatcagcagcaattggacaaaaaatacgtttcattcgatgtgttcaatgcattggtggagcgaatcaaacgtttggagaaccagcagctgaagcagaacaaagaggagggcaaaaaggtgacgtcatcgggcgaccaatcgccgccggcggttgtctcagcgaaagttgcaaaggagttgccaaattcgaagaaacaaaatggttgggatgccaaagtttgccacaaagacatcgaaatcattggggaaaagcaattgacgatcaattgcaagggcaacaga

SEQ ID NO: 89093 - DNA, 624 bp, Heterodera glycines
  SCN-specific regions: Sequence locations=1-397,420-624
gcggcgcgcccaagcactcatttacaaattataaaattcgttaattgcatatccatttctatttaaaattggctaattgttagttaaagagccgttaaaccgctgcagctgaaagcatttaaatttaaacttcgtttttgacaatgtcgctggtcgaattaagcaaatcccggtggttcaatgggtatcagaaaattttcgaacataacagtgcccagttaaagtgccgaatgcgatttggggtttatttaccggacaatcagccggaaagcaaattgccagtgctcttttatctttctggtttgaaatgcaccgaggaaaattttgtcgtcaaaagcgccatgcagcgattcgcatccaatcgaaaaatcattgtggtcaatcccgacacgagcccccgtggcgttgtcactggagacggcgatgaccccagttttggtgctgcagcaggattttatttggacgcgacggaaacaaaatgggcacagaattatcgaatgtattcctacattttggatgaactcgtgccactcgtgttcagcactttttcagtggagaaaaataaatgcggaatttttggacattcaatgggaggccatggtgctctgaccattgcgcttaagc

SEQ ID NO: 89094 - DNA, 679 bp, Heterodera glycines
  SCN-specific regions: Sequence locations=1-1,23-445,467-679
gtaattttggaaatggctggcaatttctggaagagttcccatttcgaacaatggattttggataagggcgaccttttgcgagagcggggcgaggatttgaaggtgtacagcgaggaggagtatcagaagctgatgatctttttcaccaattttattcaggagatgggccaatgcaaagagagggaattgggcacgcaatgcaacgaaaacacgcgggacagacccatccaacggatgcaggccatcgcaaccgcttgtgtctatttcagacgtttttatgcgagttaggcgctctttcaaagacatcgatccctttctattgtcgatgacctgcacaaatttggccagcaaagtggaggagatgggccatttgacacacaccaaactgaccgcgacattccaacgggcgatgaagaaatgggcactcttcgacccgcaacaaatggccctttaccaccaaatcaaacaccaccacatcagcgagacggaattttgtctggttgaactgctcgactgctccctcatcgtctaccacccctaccgaccgctcctccaattcagaaatgacatgaaaaatgcgtccgttcaaaatgcggaacatctctaccaagacgcatggcgagtgtgcaacgacagtctgaagagtgacgtgccactgctgtacccacctcacatggtc

SEQ ID NO: 89095 - DNA, 649 bp, Heterodera glycines
  SCN-specific regions: Sequence locations=1-427,449-478,500-500
ctcatatgtcatctgcaaaaaataaaaaatccattgagaatgtaatcatcagtgttcggaatgagtttggttatctgaaccagctctgggacactgtttacatggacttgccaacccgggaattccgcgtggaagaagcctgcgaatttatgttcaatctcctacaggtgatcagaaaatcagaagagaaagtggtccgtaatattgtttctgacttggaaatccgccgagaagcagtgaccaatctgtttgaattttttggggttgccttctttcgacgagtcgcttttcccgcccaagtcgatcgcattgctgaaagtgcttgattcggaaaaaaaccgattggaagcgaaaagggaggaaattgtggggagccaagcgaggctgacgggaaaatacaaagcattgtgcgatagggtgggaacaacggcgcgacaaatcgaaggagtgcacgacagaattatgtccgaagatgagttggacaaactcaaaggcgaggtggacgcgctgcagacttttgtcaacaaacggctcgagaaggcacttcagctccaagcggagagcaaacgaatctttgagaccattcgcccgtccatcaatagtttcaatgaagactacctccactttttgcgtgttgacttggacagcc

SEQ ID NO: 89096 - DNA, 639 bp, Heterodera glycines
  SCN-specific regions: Sequence locations=1-639
gcacattcgatcatttttaccaattttatgtgttcagtgttaatcgcgactccatctcttcgctcgacatttaccagcgcattctccgccatcgcaattatttcgttgccttagtgcacaaatcgcttttaccgcctcaaattcggctgcccttcgttggctctgtgcattacctttcgtccggccttcgctttaacatcgaatggcttctcttctggggtccgtggtccccgtggaagtcgtcgtacgcattaaaagacgaatttaaggaaagggacaatttggaaaggattgctcgaaatatgcaaatgaatctgctggtgatgagtgtcgtcaacttggtctttcttccgtttgtcgtcgtttaccaagtgttgttcagctttttctcttactccgaacattttcaacgggatcgccacattttgggcatgcgcaaatactccaattacggacgcgagaaattgcgccatttcaatgaaatggacagcgaattggacgcccgcctaaatcgcagttacgaattcgccgttcgttacaccgaccaattcgtttcgacacagtccaaaatcattgccaaaaacattgcttttattgccgctgccgttttcgtcgtcctttgctctctcacggcttacg

SEQ ID NO: 89097 - DNA, 926 bp, Heterodera glycines
  SCN-specific regions: Sequence locations=1-170,192-268,290-307,400 -676,707-926
atcaatgatcgcccttaccattgtcgctattgccccaaacgatttacgcaaaagagccatttggaccagcacgagcgaattcacaccggccttaagccgttcacgtgccaatattgtgggcgtcaatttcggcaacggtctcagcaattggggcacgaggcaacgcatatgaacagggaaaggcattccatgggcagcatggcgatgagtgccgccgttttgggcggcttagtgggcgcggccggcggatacggcgacgcggcgctgtgcggcacggcgagggagcggacgacgcatttggcactgaaacaaccgcagcagcaacagcaggagatggcacaagcggccgctgcacaactaacggcggacgaacagcggcggcagcaacaacagcaacagtcctcttcgcccacccgaccgttgggtttggggaggccaaccgtcgccggaggggtcggcggcaacggcacgcgccattttcaacgatcgcaacagcagcaaatgcatcagcagcagacgaacatggaccagtgttgtgccgggggataacacttcgccaatggcacacgcgcagcagcaacaccaaatgaactccttcaacggattgctgagggcagttcagtccaacgatagtgccgcggtggacggactgctcggcctccgcggttccatggcaatgaaacaacagcagcagcagcacggccattccgggatggagctgaacgaacagctccaacttgtcagtgcacagctgatgaaccgatgatggaccacaaacactttttggaactttgagcataattaagtccaaatgattgtcggccaattgaccattttgaccagtattttgtcttcataaatcgcgtcaattccgcattttctaatcatttttctcattagacacaatctgtggttacaaatggaca

SEQ ID NO: 89098 - DNA, 629 bp, Heterodera glycines
  SCN-specific regions: Sequence locations=1-62,90-583,605-629
caagtttgagtttcccaaatgcttttctccccgtccactgttctgctattgcttctgatcgtcctccctttctctctttctttcattttaatccctcaaaatgtccgccaaatttcccccgccctttcgtcgcgtcccttccgccgatttggccatttttctgtcattgccaaacgaaacccaattgttctcatccccggcgacgggggaagtcggctaaaggcgaatttgacgggcaaaccgtctttggtccattacttttgccagcgacagaccaacgatttcttcgcgctttggctcgatttgcaacaatttggcccttttgtcatcgattgttgggccgacaatatgcgcctcaacttcaacagaacgagcggaagggcgcaggatttggagggagtgaaagtgcgggtgcccggctttggacacacgcgaaccgtggaatggattgactcctccaaacggtcgccgagccgttacttcgcgcccatcgtcgcctccctcgccaaattgggctaccaacgcggcatcgatgtcatcggtgcaccgtacgactggcgaagagcgcccgaggaactccttcattattttgttaaattgcgttcactgattgagcaactttaccacgc

SEQ ID NO: 89099 - DNA, 649 bp, Heterodera glycines
  SCN-specific regions: Sequence locations=1-317,339-649
attaatattttaattcaactttgacttttcattcaagaatgtcaaacattgcctttataagaattcaaaaagaatgcaaagaaatcattttatgtaaagagttacaagaaaatggtgtaacaattgaacctgtaaatgagacgctttttgaaatcattggaaagatacgaggtccaccagatagcccatacgaaaacggaatatttattttggacgttaaaattccacaagaatatcctttccaacctcctaagactggtgctatatgtttggatattctcaaggaccaatgggcggcatctatgactctccgaacagtgcttctcagtgtgcaatcgttgttactttcaccggagccaaaagatccacaggatgcaattgttgcgaaacaatgcttaagtgaccctgcattattcagatccactgcaaaatattgggcacaacattatgcaaacgctccgggggaaatagacagaaataaggcaaaatgtgtgtccacattacaggagatgggagcaagtaaggacgccagtatatccgctttaagctgctataattggaaccttgcaaaagctaccgaatttctctttacataatttattggttaataacatcattttgaataaatgacgccttacaaaaaaaaaaa

SEQ ID NO: 89100 - DNA, 692 bp, Heterodera glycines
  SCN-specific regions: Sequence locations=1-4,26-550,572-638,676-692
agaaagattgtttcaatttgacaatgacatcacaaaacgaaggagccgtcccggctgaagagaccaaaaagctggtcaaggagaaggacgaagccacggatggcttttacttccaacaaacgatgtaccgtatcagagacccacgcgtgtccattcccttctactgtaacgtgctcggaatgcggctgctcaagcaattggacttccctgagggaaaattctcgctctttttcatgggctacaaagatttggacgaaatcccttcggacgatgcggcccaaaagaaattcgccctctcaacccattcgaccatcgaactcactcacaattgggaacatggtacggacttcaagggctatcacaacggaaactcggaaccgcgtggattcggtcacattggcattgctgtgcccgacgtggactcggcttgcgcgcggtttgagcaattgggcgtaaagtttgtcaaaaaaccgaacgaggggcgcatgagaggcttggcattcatcacggacccggacggctattggattgagattttcaatccaaacaacatgtgaaaaacgaacccaaaagattgagaattggattttcccattggcgaagcaatcaatttcgaaaaatcacaatagagcctagacattatttatttttatttataatcgaataaatatttatgacttgaaaagaaaaaa

SEQ ID NO: 89101 - DNA, 630 bp, Heterodera glycines
  SCN-specific regions: Sequence locations=1-630
aagcggccgctgaacgccactttctccgattggcttcagttattcctctccaaacggcgccctcggcacaaatgctattttaactttgcggcagcaacgggcgccaatcggagtcggacgatgcaccaaatgcaccaaagttgctacgcgggggtcgccgggcccaacggaggaccgctccgaccgtccgtctctctctccgttgtccacgagagcagtgcgctcggctcggacggcgaaagcatcgaagtgtcgccgtgtacgagcgatcagtcggcgggtggcggagacggaaatttgggggaggggcgacagacgacgaagacggaatacattccgaaggtcaaacttcgccaaaagccgaaccgacgctggagcgaacaagacatccaaaagcgactgtcacttcctccggacattcgtctgccccaaaatgtgatcgacaaattgaatagaacgccaactctggacaatccgttgacgcggaaaagcaaaagggcgtcgctgaacgaaatcggattcggcaaattggagacgtacaaaaaaatattcgatttgggcgagggaacgtacgcgacggtttatctgggcaagagtttgttgactggcaaaaacgtggcactgaaggaa

SEQ ID NO: 89102 - DNA, 651 bp, Heterodera glycines
  SCN-specific regions: Sequence locations=1-651
gagggctatttattatcaggcatttgtctaaataatggacattcgacggcattttatgtgccaaaaattgttttgtttgccccttttaatgataatcacttcattttgtacacggtcatcaaatgctgaacttagtcaaaacaacaaaaaattgtcctggattattggcaaatggaggtccgaattttctggcaaagtgttttggcccagtattccaacaatgacttttggcgaagagcttattgttgcggaagcaccgctcgcgcgaacatcgggcgttcaatttttaaactggagtgcccgtgcctggtcccattcaaccaaagaccatttccatgacgaatggggctacatcacggtggagaacaacgggaatgcaacattgatgacagccgggaataatgggttcaccacgtacgaagtgggcgaagtgaaaagcaacaaaatggtgttgacattaaaggacattggacgcatttccttttcaagagatctcccggttgaggatcttcgcagaacattcattaaacatgacgacacttacatggaacaagtgctcgaaatgcgaaccgcaacacatccaagagttggatacatggagcacacgcgcgtcatttacacaaaaattacatgaaaatttggaagatttac

SEQ ID NO: 89103 - DNA, 524 bp, Heterodera glycines
  misc_feature (509)..(509): n is a, c, g, or t
  SCN-specific regions: Sequence locations=1-455,478-524
ctttattctaaaactatttacctatacgtatattcctttgttttaaaaatcaaaactttaatctattcgtcagatgactgctttcaaagagttcgtcaatgggttaataaagactaagccggttgtgatcttctcgaaggagcattgtcctttttgtgtaaaggcgaaggatgccattaattcgttcaaactgaagccgggcgcacttgaaattgtcgagttaaaccagcgcaatgactgtgaccaaatccaagactttctcaaggagctcaccggtgcccgctcggttcctcgcgtgttcatcggtggaactttctttgggggcggagatgacacagtcgtagggcttaaaaatgggatgcttgagaagcaattgaaggcggcagatgctttgcaatgaaattacaatagaatagagaaatttgaaaagtctaattgttttagtcaagtcaaatgttatctttttgctttcttttaaattattaaatggctcaattcttcaaaaaaanaaaaaaccaaaaaaa

SEQ ID NO: 89104 - DNA, 719 bp, Heterodera glycines
  SCN-specific regions: Sequence locations=1-177,200-719
gagcagtccaattcaactgcatcgcctcacattaaaataacggtcaatgaaacgggcaaacaaaaaagggacaatgagcagcacaatatggaggcggttgacgatgaatttgttaatcgtttattgaaattgtcttcgcgcttagacaatttaataaatgtttttggaaagaaatcttccattaaactgaaagaagatgagaataacaacaaaaaatttcattcgaattcgccgaatgttgtgcatgctttaattgggccaacaagttgtgccgtctttcccatccatgactatggagaagcttttcgcaagaaatactttggcgagattttgcagtgtaatttgcgttcctctgacagaattctctttgacattttgaagaaaattggcgacggacgaaaggtttctttcacttgcgacagttcgcgtgtcgcagaaaacagtcgagtgatagtcagactcaatttggaatcgaacgaaataagcattcttcaaaaggaccaaagcaaaatcgaaggtgaaattccggtttggaaattcatcggctctttggttggcacttattgtgcggatgatcaatcggttaatgagttgacggaccaatggcttgcgctggcctcgtctgtccgaattgatgaactttcaagacagatgagcgttcatttgggggcacacgatttcctcagctctcaacacgccatttgcttgcccgatttggt

SEQ ID NO: 89105 - DNA, 656 bp, Heterodera glycines
  SCN-specific regions: Sequence locations=1-352,374-559,599-656
caaaattctgcacattggcaatttgatatgcaaattgttgacggatgtgctcccaccaacatcattaaagaataataatggaccacgacgacggcgacggcaagcgggcaaagcggacggcacattacgcagatgcacccgcagggagtaccgtatgctcagcgatgaccaacggacccgctttcataatgcactgttgcaactgaagcgtggctatggctcatatgaatacgaccgaatcacggcactccattccaatatcaatatgatgccatccgcgcacagtgggccaacatttccattatggcacagagaatacaataaacgcttagaaattgctctccgttctatcgacagttcggtgtgtgttccatattgggattcgaccttggaccagagattaccaaatccaagtcattcaattatgtggaccgaattattcatgggctcaacagacagcaacaattttgtgaacagcggatttctagcgaattggattacttcagatggcaaccgcgtttctcgaactatgggcgcggatggagggcagcttatcaatgaaacagaggccaataatgtgatgtcaattcaagaaatcaatcacatctttgcttttgcgggaggaagacccagtcaaaattgcgcaacaaatccgg

SEQ ID NO: 89106 - DNA, 567 bp, Heterodera glycines
  SCN-specific regions: Sequence locations=1-244,277-567
ccaatgagcagattgatataaaaccgaaaattgaggtgcgcaaaagccacgaagagaagaaaaagaagcgacgccattactcatcggaagaagaggaagaggggacggaagaagaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggaggagaggaaaaaacttttgaggcttttctgaaaggactggatgagaaaaaacgaagaaaattaatgaaaaaaatcatgaagactgaagtgagcgatgactccgatatcgagaaggacaaaaaacagcgaaggaagcaaaagaaggaggaaaagcgcaaggcggacaaaaaacacaaacatcgcaggtcgtcgagtcgggagaccagcagaaagcggaaggaggggaagcaccaccgccactgaaaaagggaagcggactcattcttcggattgccaccatttgtataataaaatgtaatcgctttttttc

SEQ ID NO: 89107 - DNA, 891 bp, Heterodera glycines
  misc_feature (870)..(874): n is a, c, g, or t
  misc_feature (876)..(876): n is a, c, g, or t
  SCN-specific regions: Sequence locations=1-18,47-755,777-891
ataaggggttacacatttccctttctcctctttcctctctgttgttatcacaacacaattccaattcgtcaacagcttcttcactcatcgacgagatgacttcttcaagatcgcgaacgcgtcgtgcgacttccaatactgcttcaactactgctactgctggccgtagacgcagccgttcaagacgccgtacacgtgcagaacaagtacgagaagcgactcgccgcgcgttacgtcagaacaacggcggcaacgcgaccaggacgaggaagaagcgcggggcagcgatgcgtcgtccgcccaagctcaaaccgctccgtggaaggccgaggggatcgcgcaaatcgagggcggcgccgcgcactgctggacaaaagcgtggccgtggacgtccgaggaccgtgaaaaaaggccgtgcccgacgggggaggagcgctgcccagcggcagacgacgacgactgcggatgcagccaccaacacggacgcgcactgggtaactattgcggagttgagggcggcgaccaacactgaggcgaccgctgctgcgactgctccgacgacgaccgcggatggagcggcggcgactaacaatgatccaaccggagcggcgactactccgacgacgaatgcggcgaccaatactgaggcgcccgctgcgactactccagcgacaaccgcggatgtggcgttggattagcatcatggcacaacaacagaagaaggataagaaattgacatttatccgattgatcatttgaattgtacatatgtatttcgttgatgtgtgtgtatcatgtatcaatcaatatctgatcacttaaattgtatgtattggtgatatgcgtgtggatataaactaatcaaagtcnnnnnanaaaaaaaaaaaaaaa

SEQ ID NO: 89108 - DNA, 1222 bp, Heterodera glycines
  SCN-specific regions: Sequence locations=1-10,32-49,71-93,116-197,220- 383,405-675,697-898,920-1186,1208-1222
cgacggcagccaacaaagaagaggaggaacagttacacgaactgagcagcatttgcaagcaagtgatctccatttttaatgagcaaaacgggtcaaaaattggaaaagcaagtggagcgattttgagacaagccaattcaaataaatacgtactggaggctacgcccggtccttcatcatcttctgcaatttcttccgcactttttgaaacaaaatattgtacagcaatgtttctacaaaaattctctgttctttcgtttgagaaaatcttcacgaaggatgcctattattatcgaattaaactcagccaggaacagacttcgggcacggcgaatatgacattgagaagaattgcacgggaaattcaatcgctgcaatcgaatctcatgttgacagcgagcacaagtgcatttgtgcgatcttgtgaggaacatttggatgcaatgaaggttttgattaccggtccggagggaacgccttatcagaacggctgtttcgaattcgactttttcttcccatccacattcccgcaaacacctccgcaagttcatttgcgtaccacgggcaacaataccgtgcgattcaatccgaatttgtacaacgaaggcaaagtttgtctctcaattcttggaacttggcatggccgtcccgaagaacaatggaatgcggagaggtcttctgtgttgcaagtgatcatctccatccaatcgcttattttcgtcaacgatccgtattacaacgagcctggttacgaacgctatcacagcacacagcagggcgatttgtcatctcgccgttacaatgcaaccattcaagtggcgactgttcgatgggccatttttggagcagttgaaaaggccgccaacggagttcgagagtgctgtccagctccatttttggttgaagagagatgagatcactgcacaaataaagcgttgggctgatgaatggagaagccaggctaagcaggacaaacgattcgcgtcatcagccaacgaattggagaaattgttgaagcaagtgagcgaagaattggagaagcttaagaaattgaacctgcccgaatgaaacgcggccttgcgattgacatcttattgttagggcagaagcgaatatattctttcttttattggtttataataatcgcggaccttcttaccatttaatgggttttaccactgatctgaaatttggcaattgttttgttcttttgctgctataa

SEQ ID NO: 89109 - DNA, 2021 bp, Heterodera glycines
  SCN-specific regions: Sequence locations=1-67,89-812,835-1576,1598 -1709,1731-1969,2006-2021
caagtttgaggctctaaactttccactattcaatttctcaaaatgctcgctgccaccggaagatggccctcgtcctcctccaattcgggcttgaggattgccatggcaatttgtgccattttggcatgttgttccttaccgaactcaacagaagcggcactggccgaggttggccaacagcccaagggcaacaacccgttgctgtacagtgtcgacgacccaattgttcacttggacgccgacacgtttgaggacactgtgctgcggcccaaccgggaccgggcgtacatcgtcgagttctacaaggactggtgcggttactgtcgccgctttgcgccctatttcaaagtgctttccgaatccatcaaatcgtggccatttgtccaagtggcggccattaactgcgccgacgcatacaatgtgaaaatttgcaaggccaacgacattcctacggtgccgaaattgaagtacttcccgcgcaatgcccggtcatttgaggaaggccaagtgattgaacattcgtacgaatcggcgatggaaatgcgcgagcaagtgcacaagaagatcatggaagagttcaatgccgaaacgggcaaaggcaatgccgatttctacctgcaaaaaatggaggcacaacgccaacacaacaatgagaacagtcaaccggagccgtggagggacatgccgaacagcacacagttcctggcccaactcttcgagaaggacgccaaggatggactgccgttctccctggatttgctgctgtacaagccaagcgtggaggtccgccaagtgctggtgggcagtgccgacgaagtgccacgcaatgtgccaaagccagcgaaaggcaaagcaacggaagcggcggccttcaaattgccttatgtgagggcgatggaacgcggcaaaacggagccaattctggcggagagcctcaatgatcagacattggccaagttgcgtgaattggtgaagccaatgatggtggagttgaacaagacggaacaagccaaggcacaccataaggaaccggtgcaggtggtggactgtgcgcaatccccggaaaagtgcaagcaaatgttctttgtcagcgagacggacatgctgaaggccatccatacggcacttttggacgaagtgatttcatcgggcggggacgaaattaacggggaccgattcgccgccctccggaaatttgtggaactgctcattcagcgattcccgaagaaaacatttgaacgaaacccgcaattgagtgcacatcccaaggggacggcactttcatccatcggaaagcctctgctgcgaagtcaacgggcgtttaaagtgtttgagcaaatgaaacgctttttggacgcaaaagcgggcgacggcaaagtgtccatggacgagtggagggcggagtttgatcaggcgaagaaacaaaatggcgacccgtttccggtcacagccgaatgggagcactgcaagggaacgcgcaccattttccgcggcttcacatgcggcctgtggaccgcttttcatgcaatgactgtgcaagcgtaccttggccaggagcagcaaccgctgaagccgttgaaagcaatccaaggctgggtggccaatttcttcagctgttccggctgtcgtcgccatttcatggcgatgaccacggagaaattcccaatggaggccaaaaatgtgaacaaaccggaagacgtggtgctgtacctgtggaaggcgcacaacattgtcaacaaacgactgcatggggacgaggcaacggaggacccgcagttcatcaaggaacagttcccgccgcagtatttgtgcccgggatgccataaaactccatcgtccgccagcgatggcaatgacccgacggagttggacccggagaagacactacggttcctgctacagtactccaccaacatcaaaccgcgaccgtagccacaccgtatgccccttctgttactgctgattcgtagatgataataaggatgatgatgattatggatgaaaatgaagcttacttgcca

SEQ ID NO: 89110 - DNA, 666 bp, Heterodera glycines
  SCN-specific regions: Sequence locations=1-283,305-341,363-666
cagtccctccaaacgtccattttgctggagcagcagcaaaaagcgtttctgagcaacagtggcaccacccacaacaatttgggaactttattgaacagacttccttcattgaatggcgggtcaccggttgagacggcgttgcatcggaatggagcagtagttgcagaacaaccagtgctcggaaacaatcgtcaacagcaacaacagttgacgggcatcgaacggctgctgaacgtggcggcactgatccctcaactgcacccatttcagcaactgcagcgaacacagcagacgaccacagcgacgaaacatgagggaaacggcgggggaggaggcgcaaatgtgcggaaagtcatggaagagaattccgtccttttctggtcccaaatgcgttcaatgggtctgctggacgatttactgaacacgctgagcacgacattggagagactgaagcacatttatctgaacgggggaaacgcagtcagcgaagaattcgctgcccgccgtctttccggcgtcgctttagcgctcgacctttgcacattattcagcgacaaaattcacaaccgatgcattcaggcaactctcgaaacaaatttgatcaccaaggaattgttggagttgcaccgccaaacaaggaggagcacaagcggcaaagttgaaaaa

SEQ ID NO: 89111 - DNA, 875 bp, Heterodera glycines
  SCN-specific regions: Sequence locations=1-875
gagacccgcaatacgagtgcatcgaattggagaacatttctgaacgtatgcagcaactctcggaccgccgaattcagtttttgctctacatcgacaaaaaattcgtcaaatcacacgcaattttgaaactcaacgagaagaagtatggtctgctgactcaacatgtcacattcgaagtggccagcaaagctcgtgctatgactctgtcgaatgtgctgaataaaatgaacatgaagcttttcggcttcaattacatgcctatgttcccgcaagcgtctaagagcaaattcaacatggatggaggtgatgtgcttgtgattggcgttgataccagtcgtcctccaaaggcaacgccgttcgaaaagttcatgcttcgcaagaaaggggttgagggactcatttctgaggatccgctgattgttggcatttgcgcaaactacctgaaaaacccttacaaattctgcggagattattacttccagccttgcacgcaggacgttttggagccaaatatgctgtcatacaaaatgagctggattttggacaaagttaagaagaaccgttcaaaaccaccatctacgattttcatcattcgcgatggtgttagtgagggaatggttccgaacaacattcacgacgaatttccttcctatgtgagggcgtgtaagaaatatgacccgacttgggagcccaaattcgtctattgcatcgtcgacaagaatcacaacaaacgtttcttcgttaaggggcagcaacaagtcgagaatactgctccaggggcggttattgattcgaaagtggtacgcgtcgacatccacgagttttggatgcagtcacatgttccgctcaaggggacatcaaaaatgccacaatac

SEQ ID NO: 89112 - DNA, 635 bp, Heterodera glycines
  SCN-specific regions: Sequence locations=1-98,120-132,154-509,531 -589,611-635
tcttctacgtcactttgccttctgttgttcgctgtgttttatttgattgatgcgcgaactcaatccgtcgcggtgaaaggacgtctgctgtgtggtacggcaccggcacgaaatgttcgggttaaactgtacgatgaagacgctggtgtcgacccggatgaccaacttgatgccggatattctgacccaaatggcaactttcaactttctggccatacctcagagctgacgaacatcgacgttgtttttaaggtctaccacgactgtgacgatgggattaagcccggctcgcgcaagttgaagttcaaaattccgaattcatatgtcacggacagtgcgacgccaaagaaaacgtttgacatcggtgtgctcaacttggagactgtgttcaaggacgaggaacgcgagctgatcgtgaccatgaagaagaagcggagaagccaccgttaccaagactttttggacattttgccatgaaaaagtttcgagaaaatgacaaattgccaagaaaattattttcaatttaaaaatggaagcggtatttaaaatggaaatattgattattaaagttaaaataaattgtaaccatttaattttacaaaattaattgtgacgttataaaaaaatataaaaat

SEQ ID NO: 89113 - DNA, 538 bp, Heterodera glycines
  SCN-specific regions: Sequence locations=1-3,25-339,369-538
gaaaagactcaggaagctctttcaaagggtgactttcgcaccgcaattcaactgcagccaatgctcaaattcaacgggggcggccacatcaatcacagcatcttttggacagtgttggcaaaagatggcggcgagcccagcggcgatcttttgaagaccattgaacgcgacttcgcttcggtgcagaaaatgcaagagaaagttagcacgaaagctgtcggagtgcaaggctccggttggagttggcttggctacaacaaagagctgaagcgattgcaggtggccgcctgcatgaaccaagatccgctggaggagaccactggtctcattccactgttcggaatcgatgtgtgggagcatgcttattatttgcagtataagaatgtccgaccagactacataaaggcggtgtggacggtggtgaattggaagaacgtggaagagcgctttatgaacgcactgaacgaatagaacattttcagtcgattgtttccaaaataaacagcaaattttgttgctagtaaagatgaatgacttt

SEQ ID NO: 89114 - DNA, 830 bp, Heterodera glycines
  SCN-specific regions: Sequence locations=1-123,145-319,341-457,479 -793,815-830
gtttgagaaaaaaacaaattattcttgacaatgtctgccttctttgtcgtcgctcttcctgttatgcttgcagttttaactgaagcacaaaattttggcggccaaggaggagcgcttaatgcaccattgccatttggagggccaataaatcccggatttgtacaggaacagttgccacacatgcttcatcacccaaatttgaaaagcggcgaagacattgaagcagcatttcaaaacggaggaggacaagtggcgggagtacagcaccagcagtccaacaataatttgccgccaccgcctccgcaaaactttggcaacaacaatttcaaccagcagaagaggccaaagttcaacaatggccaattcagcggtgttcgaagagctcagccccatctgacccaacagcagcagcgtctgaatcaggcagaaactccgtgcccacaggcaacatggcaaaaaattatggaggacaacattaaagccaacgattcaacctccactctgaatgccattcagtcgggctttggcaaggcattcaaaaaccaaattttcatggtgttgtgcactacgacggaggagaagaaacgctttggacaaaaggtccaattggacatcaagggggacggctactgtaacgtggagcgggaggggcgtctcgtgccaagcggccaagctgagtgccgaaaatggcatcacattgaacggattgggcggatttggccaaggcatttcattggatggacgcaaatgattgtctaacattttaatcagtgatatccacaaattttcttacttttttacatattgcaataaattttgcctcttcaaaa

SEQ ID NO: 89115 - DNA, 681 bp, Heterodera glycines
  misc_feature (679)..(680): n is a, c, g, or t
  SCN-specific regions: Sequence locations=1-407,429-511,534-611,633-681
caagtgaccagagggcaagtgtgcaatggaggagcccaaagtcagcagaaccaatttcgaattacggaaaaacctccagcgcatcaggcgccccaatgcgcgtcccagggatgcttcaacgaaaacatttgctgccagctgtggggtttggctggcgaatgtcgccgtaatccgacatggatgaactgtttctgcaaagtcagctgtggaaaatgcataccacaagactatgtgttcggcatcatgcactgactaccatccgcgatgttgggaatgggccgaggaaggcgaatgccgcaacaatgcatggatgtcggagaattgtaaacaaagctgtggcacatgtgtcagccaatatgaactcaaacagatgtgccgtcggggaggccgtggtaagcgtcagattagcatgctgttggaaggagctgctggttctccgcccggaggacattcagaagaccagaaagattcacttggaccgcccaaaactgctgcttcgggagcgaaagaatttatttcaggacaaaaataaatgccgtaaagtaacggaatgccaacataaaaaccacttaaatttgaattctgtttcccttctgacccaataccaaaatcaaataaatcaatcatcaaatgtttctatgtgttaaatatcgtttatgaataaataatttccgcatanna

SEQ ID NO: 89116 - DNA, 643 bp, Heterodera glycines
  SCN-specific regions: Sequence locations=1-643
ccaagtttgagtaacaatgataaatttccgagtttcctttgctgctgcctcttttcgttttggctccggttgtcaatcaatcgtcaatcgcttcgctcattcgttgtcttctattgcttcttctgaacctgatgcgccctcaatgctgacacaaatcccgggcccgaagtcgaaggcactgaaagaagaaatggagcaagtccatcaaacaacgtccatcaatttcttcgcggactacgagcgttcctttggcaattatttgattgacgcggatggcaacgcactactagacttgttcactcaaatttcgtcattaccgctgggctacaaccatcctgaactgatcaaattggccactgatgcacgactaattaccaccgcggtgagtcggcctgccctcggtgcttttccgcgcagcgattttgcccagttggtcgcccgttcgcttcattcggttgcaccgcgcggacttcgccatgttcagacgatgctttgcggctcatcggccaacgaaaatgccatcaaaacggcctttattcattaccaaactcgtctaaggggtggcagtccgccgacagcgcaacatttgtccagttgcatgcgcaacgaggcgcccggcacgccacaactctcttgtcttggg

SEQ ID NO: 89117 - DNA, 647 bp, Heterodera glycines
  SCN-specific regions: Sequence locations=1-449,473-647
gaaaagaaaatttgcctgacaatggaactcgaaatatttaaagacgcctgtggacaaacagcacttaaattggttggccgccacccgatcaccgtcaccgcttctgctgttccggaccttccaacgttcgaaacaattcgtgttagttttttcgatggttttgtcgccgcggttttcaccgaacgaaagaagcaattgtcccgcaatcgtattgaactggccattttctctcaaccgactgatgagtcgaagaatgccttcaaatctttgtggtctcttttcaattcgcaaattggcgcaatcacttctgtttgcaatgcttctgccgctgaccgtcgtaacgccaaaaacacgagcatctacaacctggacccgaatttcgacaccgttcccgactggcttgtggctccgaccttgcgtcgtgttgatggagtttttggcttagagaccatttacaagtggattcacaatgacgaaggaggcgacgttgtcaaaactttcaccatgcatcctccggaggaaggggtcaaaatccccgcaggggattttgaaagatttctgttgagttttttccgttttcgtggtgcaaaaactcccggttacaccgcaaagttcaaacatggtgttgttgacaaatatgttcgcga

SEQ ID NO: 89118 - DNA, 582 bp, Heterodera glycines
  SCN-specific regions: Sequence locations=1-308,330-354,377-471,498 -525,547-582
aaatgaaccaacagaaaagtgcgaagcgggcgacgcgcggacaacgccaaatttatgaagaaaacaagcagactttgttatgctatgtgctggccagcatttgctcttccgttttggtgttctctctcaattactttctttttctgccgcaaaagggcgcgtggattggactcgcgttaagctctgccagtcaagcattttctgtgattcttatgtctatgatgatgaaaaccgtgcggaatgagcgtaatctgctggtcgatgctgggttggacctcaacgatccgaatgcgtttggagagtactgcaaagacatcgtcattctgagtgtgtctgcacagcttctgagtctgatttggaccggcttcttcttcgtcctgctgtccattccctttttcacactttacaaactttggacgaacattctcggcccttggttcttcagaccgactcttgacgacgatgagaaagaggacaagaagaagcagaaaaaacccaaatttgtacatgtgagacgatgaccaattgctgttgttgtttttgtttcataaactcccttataaacaccgagaaaaaaaaaaa

SEQ ID NO: 89119 - DNA, 824 bp, Heterodera glycines
  SCN-specific regions: Sequence locations=1-92,114-243,265-473,495-824
ctaaacaaatttcgaatttattttacacataaagaatattttataatcaaatcaaaatatttaaatttgtaaagaaaaacaaaacaaaaaattccttttaaatataaacattagcttttattttcttcaaatcccttcggttttacgtttcattcattcaaatttttcgtgcaattatggcacagtgccgaccgatcgattttcgaactggaacagatgcgaactgtcagttggatgagcaaatctttgctcagcaaattcagtgccgcctgattctcctcgcaaaactcgcgcattccgacgccgttcagacttttcagaatgaaattctttagcttttccaatcggtacatttcaaaacacaaaagccgttcgatcagactgatctccacgcaattgatcagatgcgcctcgcatcgggtgcgcaacgcatcgacttggaaacggtcggccaatttgagcattcccatcacattggcaggatttggcgatgccattttgggcgagattgcgtccagaaacgcgccgaactcctccccgttggtttcctccaggctcacttcgccctgtgccttctccaacatgtcgacggagaacattttgtggaagacgggcgacacggacatcagaaagtgcttggagacagtgaactgctcggggcccaccttcagcacaacttcgtcctccgagtcgcacggggggcacggattttcaatgatttgatgctccctcttctccaacaagcggatgagaacgttgaaaaagccatcggacggtgccgcgttggcagcgccggcgttgtgctgaagctgtacttgggcacc

SEQ ID NO: 89120 - DNA, 629 bp, Heterodera glycines
  SCN-specific regions: Sequence locations=1-22,45-522,544-629
ggcaaatactcactcaacaagcacagtttgaagaagcaagaaaacaatacttggaaggaacgcgtcggagtcctcatagtattgcaatttggcttctgctgattcgcttggaagattcgcgtggtcggcacattaaagcgcggtcccaattggacattgcgaagaccaaaaattccaaatgtgaccaattgtggctggaagggatccgtatggaattgcgcgccgggcaaaaggaacttgcacagtcaatgcttgcacgggctctccaggagtgcgaacattcaggtcgtttatgggctgaagccattttcatggaacagcgacacgcgagaaaaacgaaaatagtagatgctttgaagaaatgcgagcacgacccgaatgtactgctggctggttccaagcttgtctgggcagaaaggaagactaagaaggcgcggagttggttccaacgaaccgtgaaggtcgatcccgactttggcgatgcgtgggcatacttttaccgcttcgaattgatgcatgggactcaggaagagcaggaagaagtgaaaaagcgatgtttacaatcggagccaaggcacggcgaattgtggcaagaagcatcgaaggatgtgaaaaattggcggaagaaa

SEQ ID NO: 89121 - DNA, 699 bp, Heterodera glycines
  SCN-specific regions: Sequence locations=1-8,30-699
gtagttcgataattccccatttctggtttaaaacacccccccccccccaccttttcctttcgctttgtctcatcttacgcattttgcgcaatttgtcccacaccgaatcaactgatttatttgtcgtcttcgaatgggtttattataccatttctcaactcagcatcagcacctaattcacccactgctgtgatggaatgtgttcgtcaccttctccatcttttgctattactgaccttctctggccaattgttggtgacattggccgacctttacgatgactacgaacagtgcaaatcttctggccattttggggcagaggacggctcgccatctttggtgtgcgactcggagggacggttgacgccgcaggcgctggcccaactgaatggaattctgacggatatggggagagacgcggggtgccaatgtgcagatggatgtgacgggaaaccattttctgtccgattgttggtgaccagcggcgaacgtgtcgaacaatcgggtggcacaacggcactgaatgaaacggccgggcgaatttgggaaagcgaagggatgggcacggagcagtgcgataacggaatgctaatgctgtacattcgggaccagaaaagaatggtcactttccaaggccatcgacggctccaaatttacagcgaccgcgacattgacaatttgcacgaattgacttctcgg

SEQ ID NO: 89122 - DNA, 671 bp, Heterodera glycines
  SCN-specific regions: Sequence locations=1-11,33-671
gtctttggcactctctcccctttcgttttttctcaaaaccgctgaatttgccaatgccaaatggccaattcttcactttcgcgtccctttggcctttgcctttgttcattgcttctcttcatttgcgcatttcctccaattagtacacaacgtgtcaacgtaacgctgttcaccgagtcccaatgccccttctgcacgcgactgcttcgagaacagatttggcaattccattcccgattccccggcattatgaatctgcaggtgattcccttcggcaaaggcaactgcgaattcacgcgcgaccggcggatcatttgcaaatgtatgcacgggcccaccgaatgcgacctgaaccgactgcagaactgtgccatatcgtatttcccacgacggcatattggcttggtgacgtgcattcaaggactgaagaatttggacgaagcctaccggcggtgtctgtcgcggctttcgccccgcacgcaattccgactaaagcaatgcgcggaaacgcaaaccggggaggtgctcaattacgtcagcatgctgaacacgcacagggccggcgttcgaatttggcccaccgcttatgtaaacggacacttttttgatcggagttatccgatggagaccaaaatatgcgaacacacggcatggtgctgaccggcaacttc

SEQ ID NO: 89123 - DNA, 631 bp, Heterodera glycines
  SCN-specific regions: Sequence locations=1-51,73-124,146-333,355 -376,398-560,587-631
ccagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccgcctccatgcaccccgtgccctggcggtcagcccggtaacaatggcccacctggacccccgggagcgccaggagcacccggccagcccggcaccggaggaggacagccgcaacccggagagcccggcccacctggacccaatggccagcccggacaacccggacagcccggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacaccaagacgttaagaaaaccgattctgatcagtggaagaagaaaaagcagaaaaacagcagcgattgccctcccctcccccggtgcccttctccgtccccatttc

SEQ ID NO: 89124 - DNA, 661 bp, Heterodera glycines
  SCN-specific regions: Sequence locations=1-564,588-661
cttaaactttgcttgacaattattttggttaccatcggatacaaatcattttcgttgtctgagcatatttcagaattttccgaatgcggcatttccgactttgaacccgaatttcccattgcaccaaaagtggaaattggcacaaatcatatattcaaaggaaaaacaattgtggatgacaaatcattgccgtggatggcaagaattttaagtggagtctcttgcactgcgacaatcatcgggccccgacatgtgttgacagcggcgcattgtgttgaaggccaagcacttgaaaacttcgttgtgtcatatggaagcgccgatgcttcaaatcaacaacataaatccggcgttgaagcaattaaatatcatccaaaaacacaacattatgaaattaaggataaatttcgaaagaatacaagagcatacttatttttgaatgacattggcgtaattaaaattaaaaactcaatcaagttgtcacaaaatgcccgaccaatttgttttgcatggcttccatctaacaaattcaacaaaatctgatggaaaaagcattaaatatgatgaatattcaaaatttattaacaacactcaatgtgttgttgctggttggggtataaccaaaccgacgtgctctaatgatgatgataaaccactaagt

SEQ ID NO: 89125 - DNA, 655 bp, Heterodera glycines
  SCN-specific regions: Sequence locations=1-54,76-118,145-163,191 -198,388-394,428-436,466-479,502-511,541-554,577-577,605-655
gttgctcctcgtcctctgtccttttgctcgcgcgctctggcccccacactctcaaccacaccccccaccatccaccatgtcggacgaaatttctgcccttgtgattgacaacggttcgggtatgtgcaaggccggtttcgccggtgacgatgctccccgctcggtcttcccttccattgttggtcgcccccgccaccacaatgtcatggccggcatgggccaaaaggactcgtacgttggtgacgaggcccaatccaagcgtggtatcctcacgctcaagtaccccattgagcacggtatcgtcaacaactgggacgatatggagaagatctggcatcacactttctacaacgagctccgtgttgcgcccgaggagcaccccgtcctcttgaccgaggccccgctcaaccccaaggtgaaccgtgaaaagatgacgcaaatcatgttcgagacgttcaacacgcccgccttctacgtgcaaatccaggccgtgctctcgctctacgcctcgggtcgtaccacgggtattgtgctcgattccggtgacggtggcacgcacaccgtgcccatttacgaaagttatgccctgccccacgccatccagcgtttggacttggccggtcgcgacttgacgcaccacctgcaaaccattctc

SEQ ID NO: 89126 - DNA, 635 bp, Heterodera glycines
  SCN-specific regions: Sequence locations=1-635
aaaatggatcatgggccagcgatgaagcaaagtaccctcacttttacgaaccgattcgaaaaacagaaagtgtacggacgtgatggcactcttttctttgccccgtcagttggcactttttaaacgaacggaaacgattgtttgtgatggcactttcaaaatggcaccgcgaggcatttatcaaatttaccgagtatttggatttattgcacaaacgcattgtgttccattggcaacagctttgttacgtggaaaatcaagagtgctttatgatcaattttggacaagattgcggcaggaattggacaaaattcccggcattttaatgatttcccaagcgaattttgactacgaatctgcgtcagtgaatgcattttgcgatgtttttccaactgtcagaccaaaaatgtgcgcgtttcatgtgaagcaagcgataaatcgccgaattcaatcaatgggatttatgcaattgtacagctcaaaagaaccaaatggacttgagtttcagcgccttcccgttcgcttcaactcacgcgccatctcatcacacgctcccccattggaaactttacaacagggcgcattgagtgaacttctcgattactgcaacaacacatggatcaacaacagaatag

SEQ ID NO: 89127 - DNA, 652 bp, Heterodera glycines
  SCN-specific regions: Sequence locations=1-514,538-652
agcaaatgtccattaaaaattatgaattgcgattaagcaaaaatgcagatgagcagtcggaagcattttattgttatttgaagtcagtgattgaagaacggagcaaatgtaggcaaactgtcattatcggattttcaggtggttcgatgcctgcctttttggctcaacagctcgtccgtctctccgaccaaaccatcgcaggtcttcgcctttttccggtagacgaacggcacgtctcagtgaacagcgaggaaagcaacgcgggaacactgcttcgcctgttaccggacaaattccgagaaaatgtgctctcgattcaaccagatgacagtggccttctcactgcccagcgatttgagcaacaattgcgcgtgttgagtcctcagttagacgtgaatgggtggccggtgttcgacttgttgctgctcggccttggtcccgatggacacacatgctcactgtttcctggacacccactgcttaaggaagagtccgtttgggtcgcgcccattgacgactcaccaaaacctccgcctcgacgcatcacaattacaattcccctgttaaacgccgccgcaaatttagccttcatcgccaacggggcatcaaaggctgctgttttaaagaaaatcttgtggataatgataaaaca

SEQ ID NO: 89128 - DNA, 699 bp, Heterodera glycines
  SCN-specific regions: Sequence locations=1-503,526-699
tttgagttgaactgctttactaaattttaatattaaatgcaggacgactggcggagtttgacctacgaagaggcaaatgcgacactcaaaaagtggcgggaagagcacgcgcgacgctcggaagaagtcgtggaaatttgggagtttgtgcttagtcggtacgccgctgcgcttaagggcgaattgtgggcggtgttggaacaggtgaccatcgccgcgctcgaccaggcaagacatgacttggccattgaatgcctgcagcaattgcatcgccgttttccgaagagtacccgcgtaacaaagcttcaagcaatgcgtttggaagccattggcaattacgaagacgcggaagagctttaccgtcgcctgatcgaaggggacgacacgaatccgcttttccgcaagcgttgcattgccattctgatcgcgcgcggtgatcgccagttggccatccgcgaactgaacaaatatttggagattttcgccaacgactccgaggcgtggctgcagcagggcgaactgttccttcaggaggccgactttggccgggctgcgttttgtttcgaggaattgcttctttcaaatccccaaaatcccacttatttgctcaaaatggctgaaattcgctacactttgggtgggaccgacaatgtcgaggatgcacgtgcctattacgagcggtcgctcgccctcgcgcca

SEQ ID NO: 89129 - DNA, 656 bp, Heterodera glycines
  SCN-specific regions: Sequence locations=1-499,521-656
agaattcatttgaacacacacagtcatacgctagtaattacaaatggctgaagatgaggtagatgatcttcttgaagaagcattcaaaaatgttgacgaggcagagaaaaatgggacaaagatggatgatgttatcaagaaaaaggcgaaggaagttggaatcaaaatgagtgacagtgaaggcaaacgtaaacgtagcagaagcggaagcagggagagaaagcgcagacgaagtcgcagtcgcgagaagaagaagagggattcgtcgcgagagcgaaggcggcgttctccgtcagagaacagcaaaagaaaacgtcggtctagatcttgacgtctgatcatattctcctttgtttgttgatgaagacgaagaacggcgtggaacgtgcgttaaagcagaaactcattcctctcatattccacaacctttcttttctttcgttcataaattcgttcgcgccatgccttcattaccctcccataaatttattaatttgctttccaggcacacagacacattgatttaatttttaagttctcgtgatcgtcgccgctctcgttctaggtctcgcgatcggcgtcgttctccaatctcacgtcggcgctcccgttcccgatcacctcttgagaaacgtcgttcgcctgccccgcgtcgt

SEQ ID NO: 89130 - DNA, 636 bp, Heterodera glycines
  SCN-specific regions: Sequence locations=1-186,209-636
gactttttgggcgggtgattttagggcgatcgaatcgatggtaagacagtcgaatgggtgacggagaagaaatttggcgggacggttaaatttgatgccgagattgaggcgggcattttcaggtttgaccagtgtgaagaccatcattgtggggttggcacgcaacaaaagcggaatctaacggacaaatggacaaaatgcacaatttgtcatccatcgcaaaagcacctgtgcccctggcattatcctttgggaacagccattttcacgaagacgcaaatccacggccgaagtccatccagcaatcctaacaaacaaagttttgaaaatggtaaatttaagaaaaaaagacggggaacaatgtaatgataaattaatggatatatgaaaagtaattatgattcagcaatgcaaaatgagtagagtcacaaatgcgattgaattaataaagttcactaaaaccgaactaatcttaacgcatttacattccttcgcatgagtttcagaatattaaagttaaaaacagaccaaactttgtcgaacagttcaacaaatgcaatgtgttctgtcagcagagtgaagctgaagaaaaggcgtcgcgaccgattgagcgcgtcacggaaaatgcgttcgtgc

SEQ ID NO: 89131 - DNA, 535 bp, Heterodera glycines
  SCN-specific regions: Sequence locations=1-535
aagcaaagcgggcaatttggccaaaggggtggacagactgttgaaagccattgacaaggcacacaaaaagctttgtattcgggaaaaattatgcgacgaattcattgaaaacggacgcaaattaacgcgggaatatttgagaaaaagtgccaaagaagaaagtgccgaaatgctcgaagtgttcgaatttgtgccgattgatcatcatggcaatttcgactattctctaatggccaatttgtctttgccccgaacttcgatcgattcgtccgccggcggggcattttcaccaaataataatccttcaatatcgaacatcgccatcaactttttggccgattaccgtccctttgcctacggtgtcccaattacgcgtgattcgccgtcagccaccgtgatttcacgatgcaaatcgccattctgtaaaatgtccgctgatgatgagcgacgactttcacttcggtgccgatgtctccgcttggcttggacataattcggtctttcgtagagagccttcgaggcaaagaatggcaga

SEQ ID NO: 89132 - DNA, 638 bp, Heterodera glycines
  SCN-specific regions: Sequence locations=1-15,37-612,634-638
gaaggctttgttgatgaacatcatcagcagcagcacattagcactagtgttcatgccaatatgcaggaagacggagctgaagttttgcaccacgaggacacttcgccaacccacaaaaaccacgagacagcgacgggcggagagaagggcggaggccaaggccaacaacacggggacggctcttttggggacataatggtctaccaggcgattcacaccattgaatttgcgctcggctgcatctcgcacacggcttcctatctccgtctttgggccctgtccttggcacatgcgcaattgtccgacgtcctttggtcaatggtgctccgcaatggattcgtccaaagcggttacctcggcgccgtcatcacttatctgatcttcattgtgttcggcacactcactctgtccatcctcgtgcttatggaaggactgtccgcctttttgcacgcgcttcgtctccattgggtcgagttccaaagcaaattctacggtggaatgggccaccctttcgtgccgttttcgttcgagaaaattcttgaggagtcccgtcaaagtgaagacagttgattgatgctctgacttatcaccgctttaccagtggcaatttgcttccattcccttccccctccctccta

SEQ ID NO: 89133 - DNA, 647 bp, Heterodera glycines
  misc_feature (598)..(598): n is a, c, g, or t
  SCN-specific regions: Sequence locations=1-347,369-453,475-561,583-647
ccaaaatggttaaattttggttgacattatttttcgtttttaccggcaacaatttgtattcaatttttgcgcacaaaccaaacttttctcagtgtggcatttccgactttgagcccgacttggacaatgtgccaaatgtgaaaatcggcacaaaccatatatataaaggacaaccagtggaaaatgccaattcaatgccatggatggtcactttgctttcattacaaggattatgcactggaacaatcatcagccacaaatacattttaacagcttatcattgcgtttccggcataatttctgtcccaagttcaatccaaatttcttatggaacagtcaatgttgctaatgaaaagcataaaacaaatgcacgcaatattataatccatccaaatgcttctctctcggaaatgcgtgtcaaaataaatggaagcgaatttggaacagattctgtttcaaatgatttagcaataatcgaagttgaaaatgcacttaaattttcaccaaatgttgggccaatttgtttgttcggcctcgatgcatccggaaacgacaaatttggcacattttcaccattaattaattcccaatttattanttgctggttggggcttaactcagccaatgtgccaaaaatatccaactcc

SEQ ID NO: 89134 - DNA, 927 bp, Heterodera glycines
  SCN-specific regions: Sequence locations=1-43,65-171,193-927
ccgttctctccgtgctgctccaccacactcgccatcacttgtccaccgtcaccattctgttcattttcaacattctcttctcaaatgtcctttttttggcctcctttttgtgtttgtattcggacattgccttggacacaaaatacactcgcccaatcgcaaattccaacgaagaagctgaggaagactcagccgacgcatcggccgaagacgaagacacaacgacgccgcaacttttcatagccgaaatactgcaaatccatctgtacaagccgtccgaattcctcaagaatctgatccaggaaacgcttctttcgttggctcagaatggctcactgctcggactcaccaatttgcttgtgcttgttttggtggtcatcaatcgttcgatgagtggcaaaggcattcgcatttcacgtgccaaagtgattgctgtgttcgccggcgtttggctgttcctcgtcgtcagtcacgtgcttttctccgcacttcagtacttcgctgtctcgcagctgcacgaactgttggagttgaccagcagcaaccccagccaatttgcatgtcgacgaagtgccactttcatggtgtacaatgaaatcggagagcgctgcgatcggttggccgtttaccaagagttgggccactttctgctcaaaggtcacactctgttcaccgttgtgctgctgtccatttctttggtcattttcgtaatcactgtgtattgccatcgccgcgtccaaaggcaacaccattttctgaatgaaaatgcgacaaatggcaaaaatgccggcggaaggagcgacggggggacggacagtgaggcgggcggaagcactgtgaggagaagacgtgactcgagcccattccgccggcgtgaaacgctcttccaaactctcgtcctttcgctcattgctttcttcctgtcgc

SEQ ID NO: 89135 - DNA, 836 bp, Heterodera glycines
  SCN-specific regions: Sequence locations=1-836
cttcttttgcacgggagcagacggcgtaaattcggacaatgagcggcttctccgagggcactttccatcgcaattccacgccgaataacacattggccacgactgcggtgccggcaaattataaaatgtcgatgatcaatgatcggaatttgtttggcaacactttgctgtccatcagtccgttgcacgacgaccaaagcaagagcgggcgattggtgcctttgctgatgcgccatcaaaaggaggccaagtcgatcaaccaacagcaggcttttctcggtcgttccacgtccgtgcgcgacagggccgcccaactgcgcaagcccatcgacttggacgaggtggccatcgacgcggcgcccttccaattggtcatcggcacttcgctgtaccgagttcacacacttttcgcgttgctcggcctcaaccacgcttatgtcaccaacagaggccgtctcgtaggcgtcgtcgcattgcgcgagctccgtgccgccctcgcccacatttacacccgcggcgctttgccgaccgcccagtcgatgtcgcgacttcggctgaacagcttaaactttggcctctgttcaactgatcgaagccgcgcgaacagcggcgtagaaggaaacagcgacaatctgaacggaagttcgctgaggacagccatgtcgccaacttcgctcagcggcccattgacacaaagcacgacagtgacaggcgaagaaacatcggatgggacccttcaaaatttatttttgaccgatgaaacgcaacgcattctgtcacttgacgacactttgccaaagtttctgatcacctgccctttgcgttcttatccttct

SEQ ID NO: 89136 - DNA, 451 bp, Heterodera glycines
  SCN-specific regions: Sequence locations=1-421
cacaaaccgacgagggttagcgtcaaagtgatggacgaacgatatttggcgcagaacataaaaattgcacaccaacgactcgctgccattttgttgaagcaaaaggttgacgaggcgacacgccggcacgagtcccatcgaaaattgcgggttggcacgatggaacgggcggagaaaattcggacatacaattaccgggacaatcgcataacggaccatcggctcaaagtgacagtacacggggttggacaattcttggacggtggccaaatgcttgaacaaatggtggacgcactgatcgaaatgtacgaacaggaaagtgtggagcaaacgggggaacagccgaagaatgaggaggaagaaacgggcaaaaaagtttaatgttaaattttttttttgtccaataaagcatcatatttttaaaaaaaaaaaaaaaaaaaaaaaaaaaaaa

SEQ ID NO: 89137 - DNA, 676 bp, Heterodera glycines
  SCN-specific regions: Sequence locations=1-676
gtttactttttctcaaaaacccgagaaacgcccaaaaaaggatgacacaaatgagaacaatgacacatttgagcaaaatacgcaatcgaactcattcgttggggctgcaatttccgctctccaattatcagctaaagacgtggacacgacctttcagggcatcgttgagcagacggtgttcagagggtcagccgatggcaacccatttgcaattcgcgaatgcacgggctctctgcttgtactgcttggccacgctgccaccatcacaattgacaagtgcagcaattgtgtgatcatttgcggcccgtgcagaggcagcatttttatgcgcaactgtgccaattgccttcttctcgctgcttgccaccaatttcgtctgcaaaattcgcgcgacattgaggcgcacttacactgcagcacaaacccaacaattgaagactcggatttgattgtggccccgttgctgatgagatacgacggcttcaaagaggacatggaatccgccagactggacaacgcgccgaatttgtgggacaaagtgcagaatttcaccgcggaaacgggccaattccaacggatgaatttcgacccctttgccaacggtgccattaacagcgaagtggtcagtgatgaactgctggagaagctgagcacggtcatggaggagcccgaggcg

SEQ ID NO: 89138 - DNA, 603 bp, Heterodera glycines
  SCN-specific regions: Sequence locations=1-39,61-369,429-484,506-603
ttctcattcaaaagtgcatttcggcagaataaaaaaccttgaaaatgttggggatgatgaactgtcaaacggagaattacgagttctacgcatcgccgccctcctcgtcggctccccaatttcgtagccatcagcaaccggatgatgagctgttcaacaaccgcaaacagaagaagccacagattacttacacagattgtcgccgtttaattgacggcaaaatgggagaaacatcgtcggcaagagccgacaaaactgtggaaccgagtcattgtggacaatttgactgcgcgacggatgagacgcgagcaaagcaataggaaagaggaggaaaaagcgacggaagaaagagacgaacggcacaaagatgaggaggagggggaggaggaagaaaagcagagggaaggagaggaaaagcagggagaggaaatggaagaagcaatgggcacgagtcggaaacaaagtgagaaaagagatatttgccaaatttattaattaatatttagcaaccaatttgtgtttgtttgttcagagcacaaacgatcattctccggcattctgtcaaaacttatgccgagaaaaaagtcctactaacaaaaaaaa

SEQ ID NO: 89139 - DNA, 650 bp, Heterodera glycines
  SCN-specific regions: Sequence locations=1-85,107-650
agctctaattcgattcaaaggtttgcaaaatcctaatttacccaatctacattaatttctcattttcttacgaatgaccgaagaatctgtaatcctcagtttttcctgactaaatttgccacttgaatgttctgatggctgccgagtggtaattacagcgcgatcggataatgacgcaaattttgttgagattggccaaacacaaacacggaatggcattaacccgaaattcgaggcacgggtttcgttgcttctgcggttggacaaatgccaacagttgcgcattgttttgtactccgtcgatgttcagtctggtcttctgcggacactgctcgccgacgcgcatgttttgctgctggcattgctttgtgccggttctaagccggtcgctgtgccgctggcacttcactaactacaaaaagccccacaccaacagtcgttggtgctggccgaagccgtgcagcaggaggaggcgagcggaaccgccggcggaacgcttttccaatttgtcggccacaatttggaaacgcccggactgctcaccgccccttattttgtgttggaattggtgccaaaaagcgaaactgacgagcgaatgccaattttgctctatcgcagtgaagtggcgcaccaaaacgcaaatccccgct

SEQ ID NO: 89140 - DNA, 968 bp, Heterodera glycines
  SCN-specific regions: Sequence locations=1-570,635-688,843-968
gacacaacggaaaggacggagcccccgggagggacgcgcagtccatcccagcacctcttgaagagccatgcatcatttgcccgcccgggcccgccggtccccaaggacccgccggaccgaaaggacccccgggaccgaagggaagcccaggagagccgcccaaagacggagtaccgggagagcagggaatgcagggtctgcccggtcctgtcggacgcccaggccgcgaggggccgcgtggagcccccggacagcccggacgactcattcccgtccctggaccgcaaggaccgcctgggccttctggacctcccggagaacaaggaccgaagggtcagcccgggcccgacggacaatctttcgaaggtcctcccggaccccctggagatgctggtcgacctggtcgagaagggcgtcccggaggaactggaccttccggaccccccggccaagacggcgagaagggcagctgcgaccactgtccggagccgcgcactccgccaggatatttcgtcgaggcgggcaaaagtggcggacattaccactgaggaccatctccatggagtgtctcttcttcttcccgaacttctccaatttcttctactgctttgtcttcttccccttcaccctctcccccaaggcatacaaaatcggttcagtctgtcgttctcatcgtttctcgaggccatttctctctgaccctctcgctctcattctctcttcttctctgaccccctcatgtgtctctctgttccttcctctctcacgtgtgccccccccccccccactattttgtccgtcttcgccttctctctgtgttatgctgctctctctctctcttttctttatgattgcccgtgccgttgttcgtctccatggattgtcgtgccccttttgtgcgtgttcgtccgtcgtcgtcgtcgtctctgccgtggtgtcccacaaatcgccgtcatatccttgggcca

SEQ ID NO: 89141 - DNA, 656 bp, Heterodera glycines
  SCN-specific regions: Sequence locations=1-656
gtcagccttgggcagcgttcccatcgtttcgacgtgcgctccgtttgcattgcttcggattcctctttttttgtcactggttctcacgactgcgctttggtgtgggactctgagacactctctcccgtcaacaaattaacggaggacgggctttcccaaatcagtgcttcaatcgtcgttttcggtgacaaacaaattgtcttgggcactcgaactggcgcattgtttctgttcgatttgcttagttgcgaattgctcgcgatggacgacaaagcgcacgaatcggcaatttccgaaatttgtgcctttcccgaaaaagatggattcatttcttgcggtaatgataaacaagcacgcttctggcattatgaatggctttctgaactcgatggaagcaaacatttatcgatgcgttctgtgcggcggttggaacttaacgacgaggcattgtgtgcagcactttcacccaatggcaaattcgttgccttcggaatgttggacaccaccgctcgtgttttcttcagagacagtctcaaattttttgtttctctttacggccattccctgccaatttattgcattgacatttcagcggacagtaaattggtggtgaccgggtcggctgataaatcggtaaaaatttggggcctcgactt

SEQ ID NO: 89142 - DNA, 584 bp, Heterodera glycines
  SCN-specific regions: Sequence locations=1-584
tcaatcagttgtacaaagggcaaagggtgctaattgcagcaaaaaatgaacagacgttggatttgtggtgacgtgtggatggacattctgccatcttttgaccgtcctcaactcggcctcaaaatggcattgctttccgaccgtttcgatgttttggtggacaaacatttcgacagaaaaagcgaattgacaatttggagacgtatcagaattgacaaggacaaaggaccaaaagcgaaactgtctgttctgatcgatgacaaatgcgtggcatttccattgccggaccattcgctgcccatcaaaattcgctttaaggagcttcagattgattacattggccattccgtgatcacatttttgagttccaaccagcaaatttgggacagaaaaggcaccaatttggatttgtttatattcgcgacagatcacaacaatattcagtcgatctgggatgttttggcccgagaaatttggcccatttttgcgacaaacattcgccatttggcctttcgcaatggcgatcatttggacaatttgcgcagttacacttcaccaaaaattctcactgatcttgatcaatt

SEQ ID NO: 89143 - DNA, 645 bp, Heterodera glycines
  SCN-specific regions: Sequence locations=1-451,473-645
gtttgagccatttaattcactcaaaaataacttataaaatgatttcacgacttttcctccaaccgaacaaccttccgtctattcgatatttggcaacttctgcgttttccaaagctcgctatggtttccggccttccggtggagcaggacaatatgcatttcgctttaaagaagcttttgctgcgcgtcaggttgcgccgactcttcgtgaacgccttctcggccctaccactggcaaaccatttatcgtcggaacttacgcacttgccggggcttcagtttttggcattggaatgttgtgctactacggacttaccacgactgtcgacagcgctgctgttcgttccaatttatggcctgattatgttcgtcagagacttcagtcgacctacgcttatttggctggtagccttgccttgactgcgggtgctggagtggctgctgcccgtagtcctggaattttggctcttaccagcgctccatcacttctggtttggtttggttctctcgctgctattattggttctggtatcgttgttcaaaaaatcgactaccatggcaactcggctgccaaacatttggcttggttggctcattgtggcattcttggtgcagttttggctcccctttgttttgttggtggac

SEQ ID NO: 89144 - DNA, 651 bp, Heterodera glycines
  SCN-specific regions: Sequence locations=1-45,69-366,388-603,625-651
tttcattggctgaccgaccatttccacttccatttgctgtttcggcacttccttttcactcctttttgctgcaactcaccagtaatgagcagcagccatcgcgagaccggcagaagtccaagaagtgtgctgatgcgccagtacgaaatgctgctgcaaaactcgaacgacaacagcggattccgtgcctggttcgacaataacaatctcttcaaatggcgcattctaatcgacgggccgccgggaacgccttacgcgggatgcaaactcacggcactgctccatttcccggcttcgtactcaaatgatccaccgacaatgaccttcctcaccgacattcttcatccgaacattgaccagagtggcaaagtctgcatcagcattcttcatgcgccgggcattgatccgcttggccatgagcagccgtccgagcgttggaatcccaaccgttccgtggagtccattttggtgtcgatccaagtgctgctggcagagccgaatttcaacagtcctgccaatgtggatgctgccattttgttccgcaacgatccggcacaatacaggaaggaagtgcgacggcgcgtggagagggcatcagcatcgacaccgcgagcgaggtcgtcatcaacaccaccgccggtagcgcagccg

SEQ ID NO: 89145 - DNA, 646 bp, Heterodera glycines
  SCN-specific regions: Sequence locations=1-173,195-547,569-646
caagtttgaggagagtgtttggcaaattggtagtgccttccgcaccattgggccgtcgtcgttttttgcatattttgggcatcgagtcgagttgtgacgacgccgccgttgccattgtcaattgggaggaacggcgagtgttggcggacagacgaagtgcggacaatgacagtttgcttcgcttaggcggcgtttcaccttacgtttccgcaagcatcgttctatgattggtcctctcattgagaatgctttgtccgattctgacctccgttcctctgacattgacgcggtgtccgtttccaattgtcctggcctcgtttattgtctaaaagttggtgttgagcatgcgcttgcttttgccaggtgttggaaagaattaatgaccaaccgtgcccaattaatcaattggctaattagtcctaattgacttagctaattgcctctctcccccttttgccttttcgatgctttcgtcgtcccctgattcccgtccaccatttgcgtgcccactctttggtcgctcgtctgctccatccccacctctcttttccctttctcactctcattgcctccggcgcccattgcctcatttgcaccgttcacagtcctaacgaattttatgttttggctgactctgctggcggaa

SEQ ID NO: 89146 - DNA, 631 bp, Heterodera glycines
  SCN-specific regions: Sequence locations=1-67,89-597,622-631
gactcgtgtttaagccaaacgcacaaatgggccgaccatttttaccattggcattttctttggttttgctgctgctggcggtggtgatcagcaccaattgcgcaaatgcttctccgatcgttggagaggaacagcccatggcaccggaacaaaaagcgacaaaaggcaccaacgacggacaaatgggcgacgacaatcggaccaatcggcgcaataacatggctgctgctcagcatcaacagcagaaccgcaacgccacatccttggtggcacttggctggttgggcttgcgtagcggcgcgagcagcgtcaacgcggtcaacgtggcgtcatgttacgacagccgactgtccagcttcataaacgacggcctccgctattattcgcataacatgggccaactgtctaaatacatcattgaccagattaagcgtgtccgatactcgggctattggtttgtgcatgcggcaatgatcggcggacaaacacagggactccaatggcagtcgcaatcgaacggggacatttttgcgcagacgagtcggcacggatgctattaccacgacacacagacatacatcataatcatccgatactgagaaagaaaagaaaggaaagtaatgttatgcga

SEQ ID NO: 89147 - DNA, 1219 bp, Heterodera glycines
  SCN-specific regions: Sequence locations=1-100,140-442,464-574,596 -1219
caagtttgaggttcccttttctgctgctgtcgcatttccttatagaaagtggaaggatcgatgcttttcgcttattcatttcatcgattttctgctcatcccttcccatcataaacaacaattgcctttggccatttgcttgtggccattacagccaaatcgcaaggacatttcgacgaacgacagaatgccgaaaaacgatcggtccgctcatccgccccattcgcagtcggcgcccgcggaggataacacggaaattgactgtgtggaccgaggcattcacaacttcggacagctccgtttgaattttgagaacagtcgggtgacgaggttgactctcagccacaacaaattgacttcgatccctgcaaatatttctgatctggtcaatctcgaacagctcaacctgtggaacaaccacatagaggaattgccagtgacaatttccgcacttccaaacctcaaattgctcaatgtcgggatgaaccgtctttacaaactcccccgcggcttcggctccttcgcaaaattggaattgctcgacttaacgtacaacaatttacgcgagcaaagtcttcctggaaattttttcttcatgccaacgcttcgggcactttatttgggggacaatgactttgagtcgttcccggaggatattggccatttgaccaatctccaagtgttggtactgcgtgaaaatgatctcattgatttgccacgacaaatgggcacattgcaaaagctgaaagagctgcatattcagggaaatcggcttcaagtgattccgcccgaactgggccaacttgatctgattgacccgaacgacgaaaatgccaaaacacttcgagtggaaaacaacccgtggatcgtgccattgaaagatgcgctcactcgcggtgcccaaggcggcgattggcaaagcggcgttgagtctttttggaattacattcgcagtgacaattaccgtcggttgtacgaaagtcatccggtgggcgtggggtcgccaccaccgaagcgaaacaaagagaagaaagtcagccgagtgaagggaagcgccgcgggcggagcggcggagggctctcgaggacaaagtcgagaacggacggagtgaataaaagtgggagagaaagcgaccgaagggaggagaaacgaccaaacaccaaacgaaaacagcaattcatattgtgcacagtttagggacaaatacagtcattttgtt

SEQ ID NO: 89148 - DNA, 368 bp, Heterodera glycines
  SCN-specific regions: Sequence locations=1-19,41-139,249-368
ccaaatttcacactgaaaatgtcttcttcgtccaccatttttgttgttctgctggtaattgccatctgctgctgttcattaacaattgccatgccagcagcggtcaatgaaattgatagtgttccacttcggcaaaagcgtggctatggctatggtggctacggctatggtggctatggctacggcggtggaatgggcggcggcggatttggcggtggaatgggcggcggaatgggcatgggcggcggaatgggcatgggcatgggcagcggaatgggcatgggatttggacgctgatccgtgaaattaattgcaccaataatcggattgtcaataaaaagataatggaataaaaataataataaaaa

SEQ ID NO: 89149 - DNA, 1707 bp, Heterodera glycines
  SCN-specific regions: Sequence locations=1-542,565-1344,1375-1707
ttgagattggtttttttttaattgaatcaacaaaatgtctaccgaccgatatgatattgtgttgtacggtgcttcaggctttactggccaacatgttcttgaatcattcgtaaagaatggtcatttggaccaatttaatttcgccgtcgcgggaagaagtgagaaaaaactcaaacaaacactcgaagacatcgaattcatcactgggaaagttttgaccaaaattccaattatcatcgccgattcgtccgatgctcagcagctcgcagaaatggccaaacaagccaaagttattgtcaatgttgttggaccataccggttgtatggtgaagcggtggtaaaagctgcggttgaaaatggtgcaagtcacgtcgacatttccggcgaaccagcctggattgaagcgatgcaaatgaaatattcggagaaggcaaaagagcagggcgttttcattgtcagtgcctgcgggtgggactctgtaccgtgcgacttgggaatgaattatttgaagcagtacttcaaaggcactctttcgcatgccgaaacatttgctcatattcaaatcggggaagcgggctattccttcaacgccggcacttaccaaacattgattttgggcctttggcaggccaaaaatgatgatcttggaaagatacgacggtcgattatgcccgagaaaatggagaagactaagtggagacctccaaaaagaggaatgttttggtggaacgattcattggacgcttattgccttcctttcatgggtgcggacaaaagcattgtgcaacgatcgcaatatttcgataacattgccgacaaaacataccctgcttcgctcgagacttacattctcgtcaagagttggttttgggctgttgcgcttatgatgtggctgactatctttaatttcgcggtcaaattcgattttacgcgcggtattctgcagaaaaacccggggatttgctcggggtatttgttcaaagagactgggccgactcgagttcaagcgcagcaggcttctttcacttattggttcttcgggtggggctgggaacagtcgtcgcctcaacctgacgaagccccgactaaacgaatggttgtccgttgcgatggccccgatgccggctacattggcaccgccggttgcattttgtcatgtgccctgactattctcaaagagcgctcggcaatgccttctgaaggaggagtgttcaccactgcagaggctttcaaaaacactaacatttatgaaacattgtcttccttcggagtcacttttcgcgtcgattcgtccgtgaaagtttagaaactgtgcgatgcacacaaacaccaatatttttaatattttctgctgttattttttatatttggtatcccatcaattggaataagtcttacaattagtctgctcatttgacacttttaattaacgatcattcaattgataatgttagtttctcattgacttaaaaaataaatttgtataaaaaatcacaaagaaaaaattaatcggacgaaatttttgaatccgtcaattgtttcctttagcccgccaactgcttttgtgaagttcaaattactgtcccctgtggggccaggccgaccaaacacattcgaattgtttgaattctttttgtcggaaactgcagacaagcagcacttgtaagcatcgttgcattcgtaattgtcgggacagcgaaagttcac

SEQ ID NO: 89150 - DNA, 621 bp, Heterodera glycines
  SCN-specific regions: Sequence locations=1-3,52-160,188-193,215-621
atttgaatttccttttcctttttcttgaaatgctcttctccctttcccatttctcccccatcgttcagtcgcttttcgcctctcttttcacttgggcagtgaccgccctcggcgccgccgttgtttttgtttttccgtcctcgaacagagttttcctcgatgctagcctcggcttctcttctggtgtcatgttggccgcttctttttggtctttgctttcgccggccatcgaaatttccgaaagacaaatggccaaattggcctttgtcccagtcgccgttggatttgcgttgggtgccttttttgtatatttatccgaccgattaacacaaaatttcaatggcagcgctctctccgatcagataaatcaattagagaattggcattcggccaatcagcaaaatggaattcatagtgaaaatgctccattcgattttgaaacagaccgacagaggagcgaaaatcccgaaaacgctggcgaattggccgcttcgttacgccaacgctgcgtaaaagcgccaaattcgaaagggatggccgacaaagagacaattcgcttggatggccagcagcagcaaaacgatcaacagcagcagcaaaagcgctcacaagaacagtcgt

SEQ ID NO: 89151 - DNA, 657 bp, Heterodera glycines
  SCN-specific regions: Sequence locations=1-567,590-657
gtccaataaagcgacctgttaacagcgatgggtcttccaattatccaaatttatatgatcgtcgccagacagttgtcaaagcccatcactggatattttatgggattggggaaagaacacccggcatttcggaacagagtgttaataccaatagggaaaactatcacaaattggtccacaaaattgcgaatgaaaaatttggacctcggctcaccaacttcagtggtaaatgtatcggaagagacagcgcttgaacaggcttcagaagtgatccatcaagtggccattttcggctacactgtcgtggtgttttacgcttattcctatttcacgcacaaagaggagaaggaattggcaagcgccgaggaattgagagagctgagcaaaaagacgagccaggagataatgcgactgaatgtgctggttacggaattgcaggacgaaatgcgaatgccgcggagggaccgaaattggactttcccatggtctggggaaagcaaaagtgcgttgcgtgaaagcgccgtcgttaacccaatgttgccaagtgtggtgatgaccgacagtcagccgaaagaacagaaaaaagacatgaccaaatcaatctcaaggacggaagcattgaataggctaacaaatgccaccgaaacttcatcgtaa

SEQ ID NO: 89152 - DNA, 483 bp, Heterodera glycines
  SCN-specific regions: Sequence locations=1-483
gcaaaacgctcttctaataaccctaatctctgtccaacaagcaattcgatgtctgacatctacggcttcatcaacaatatctcagatcgtatatcacgacgcgtacgtcgcaagcgcccaacggagtctggggtttctggtgtcagcggcgcaccgccgcagactcggaaggacgacaaggcgaagggcggcggctgctccaaaaagtgcgcttgcatcatcgtgtgcagtcattctcacgctcattgtgctcgtcatcggtggactcgtcctggccgctgtcctgacgcctgaaacattcaaaaatgctcctctgttgagcctcttcgtgggcaaaaagaatgggggcgtggatggtgaggagaaagaaaccgaatgataagcgactctggtgtcctattgtgtggctatattgttcaataatctgtatctgatcttattgtacacaccttatgtgtgggataaagaaaccgacatttgtta

SEQ ID NO: 89153 - DNA, 718 bp, Heterodera glycines
  SCN-specific regions: Sequence locations=1-20,42-718
gtttgagatatctttcacacttacaaataataaccataagatctaattaaagcggggggcgtgtggtgtaaggatgtgtcatattgagacctatattttcatggattttgagacaacgggactttttgacgacggccacaacaacccgttgaccaaccccaatcggtccaatgagacggccagagaacgtgcccagaggctggacaacctcatcaagtcagatggaaatcgctttcctaaaatcacggaaatggcttatatgtcggtgccgcgggtgttgttccttgagggaacggagcaaatgtccgcgcgccatttatcatcgatgtcgcaagacggcgaagaaagcattgagccggtgcaggtcgttacgaatgtacacgtgcgacagctgaatccgcagcttaatgacaaggagcggttcaagtacgaggaattgcaacggaaagtgccaagaatggcccggagtcgtccacctgcttcagactgttccaaaaccagcctgtctggttgcgcacaatggtctcaactttgacttccgaattctgtgccacgagttgcgcaagagcgacctgttccgtacccatccgatcccagaacaggtttatttcctcgacacgctttcctgcttttacgaactcgagaaggagtacaaccgcgagatagaattaacgatggaaaatgttgattggactctcgttttgtcccaattccaacc

SEQ ID NO: 89154 - DNA, 657 bp, Heterodera glycines
  SCN-specific regions: Sequence locations=1-102,124-191,214-542,564-657
cagcaacaaaatcaccaatccctggcgtcattcgacggacttttgttcttccgtcttgtaaaggccataagcaacagcagcaggtgtccataggcgacgaaaaggacggaaagacaacgacacttttggtgccaatgtttagccaggagctcgcttcattgcttgcgcctgaacaatcgactgacttctccattcggcttcaatccaaatctaacaattgcatttcccttcgcgttcaagtttgttgtacccttccttcaaaatcagaaaatgaaggtcaaccgttggaagagcctgccgaattggtgcagcactttcccatccgttgcgttgatcctttcgaaccgaaaatcgcaattttttgtgaaaatggaggaaaggcacaatgtttggtctttgggcaaaagtttcgggtgcaattacaactcaaatgcaacggaagagtggcagtgcataatgtacattggaaattgaatgacgcatttgaacatttcgacgctattcctttggattctttgataaagcaacacttcgaaaaactcaaaatttcatctgttgactcaagcgaattcctcaacacgcattctgtttgggtgaaagtaacaaatggcgacggccaatcgccaatgagagagacgggacaaagcaatggagggg

SEQ ID NO: 89155 - DNA, 614 bp, Heterodera glycines
  SCN-specific regions: Sequence locations=1-614
ccattccccggatgctttccgtctggttagacttggcgcccaaatgtgccatcgccgaggcgatcgcctcgggcaccggcacaactgttggcggtactgctcgcacttcggctagcaaaaggggaggcaaagctgcagcagcagcggcggctcccgccggtgttgcaacacaaccacacgacccgaacagagaaatgcgtgacgcgttcaaacggctggacagggcgtatttcttctcctcctactcgcaaatgatttcgcgcatcactcactcggacgccgccacatatgccctgttgaaggaaatgttgtccgaattgatcgtccactttccccaccggagtttgtggctttctcagtccatcgtccgttccacgcgggtcgccgtccgttcaaagcgttgcctggagatttttgaacttgccaagaaaaaagcgcggagcaacaatgacaacaacgctgctgttgttgacctgaatttgctgatccaacaatacgactatttgaccaccttgccgatgagtgtcggtggccaagtggcgcgactgatcgaaatcgccacggacgatgcgaagctctccgcgatgtacatcggatggtgtccattcatttga

SEQ ID NO: 89156 - DNA, 586 bp, Heterodera glycines
  SCN-specific regions: Sequence locations=1-9,31-586
cagcttatcagaataactttcccataataacacatcgccaatttggacattcctcatcagcagcatcatttttgttgagaaggattgctgtgcttgttctgctactgcttccccataatgacggatccccaaggctgcccgggccgccaatcttcgaggccatttcccattatccaagcatttgttacttgcctccagaatccggcatgtgcccgccggcgacaaatcggacaacggacactgatcacatcaaagtggcggctgctacagtagacgattcgcgcgctaccgtaggcgaggggcttgcggacggtgacgacgacgcttcgcaactgcgacacgcgtcaacaccgttgctgacgcgctactattttgacgcggtcaccgctcaatgttatccgtttggtgcgcagacatgtggcggcaacgaaaatcgcttcgaaacgaaggagaaatgcttgacgaagtgtcgcattggcaccgattgatcttttcaaatttttatgtgattcaaattttgttccatcattgcctcgtttatttgacattttggcattcttcagactataaaaaccgggttggcaaa

SEQ ID NO: 89157 - DNA, 689 bp, Heterodera glycines
  SCN-specific regions: Sequence locations=1-329,351-390,418-689
gaaagaaggaacgcatttctctctgttcttttgccgtcccttctccgatttttccctcctccccatttattcatttctcctcccaatttcttcctcaaaatgccctcctccgttggcccctcttcctcttccgatttgctcatccgtctttcctcctcctcgactcggccgttcactttgccctcggcgctttcctcttcttctgtccgtccacctgtgcccatttccttttgaaacgcccttcttccgatggcgtccattggcaccttttgcgctgcgtcggtggccaattgatggcctccgccactctctcgtggcgttgcgcctccccccgccgtctccccgagctgcgttcgtcctgtctgatgctccgtctcctcggcagcgttctcttcgtgttcctcttcctccacatccgtgctgttcatcccgatttgatgccatttcttgtgttgcgacaactcatctggttctgcttttccatgattgctttgtgtgttgcgctattaattgtttcgggatggccaatcggtgataagctttttgctgcgaaccgttggggcaatgtgctgtaccaaattgatacaatcgcttccattagcatcggaatggcgtgggtaatggccccgcaatggctgttgcacagacaagtgcgcgtgcccatggaccaatcgcacgaattctgtggc

SEQ ID NO: 89158 - DNA, 643 bp, Heterodera glycines
  SCN-specific regions: Sequence locations=1-643
ggaaaaataaaattaatttggcctacagttgctgaagagctacaaactagtgctgaacgtcgtcgccttcagcgcgaccgcgagcagcggacaaaagcgcgcatggcgggcataaatcgaaccagcacaactcccgacgagaacagcaaaccaatggagttgacggacaaaggcaaaacacccaaactgaagcaacagacactcagccgattctttgggacaatgacaaaaaacagtgctccaactcccgttccaccgatgggtcaacaacaattgcaaaattacaccaatcctaagcagaagcagccaaggaaacgcagcagtcccggctcattgtccacttcaagctcttcgtcaatcatcgcaatcagctcaacttctcctaccgctgttcctgattcagtttcaccacctttccgtcctctggagacaactgggcctactaacagcaaagccactaaattgcataatgctgaagaaatgcttgccaaggctgacaatgagcagaggcgtgttcaacgctttgtgaacagattgaagaaatcgttcaatgaattggaccgagaatcgctggccaagaatcttgcatttacagcagtccgtctcgacagtgatggtgttgacaaaatacagaactcatttt

SEQ ID NO: 89159 - DNA, 1025 bp, Heterodera glycines
  SCN-specific regions: Sequence locations=1-997
ttttcaaagaaattggaaaatgcgaaacatccgatgattgtcgtcggagcacaagcatttcaaggcgaaaactcctcgtccctccttcaaaaacttcatcaattggccgaaaaactccgttcaacttcacagacgaaacaaaacaccaagggcaacggacagccgaaagtgctcaatttgcttcatgagttcgctggccacgtggctgcgtttgaccttggcttccgtcccttcaatgaattaaattcggaagtgaagagatccatcaaattgctttatctgctcggttctgatgaaaaaccaatttcgaggaaagaattccacccggatgttttcgtcatttaccaaggtcaccacggagacaatggcgcagaagtggctgaccttgttctgccggggggagcgtacactgaaaaagaagcgacttgggtgaacatggaaggccgtgcccagaggggttaccccgctgttgtcccgccgggagatgcccgcgtcgattggaaaatcattagggctctgagcgaagtggcgggtcgcaaattgcgctacgattcgcttgatgacataagacagcgtttgtctgagatcgcgccccatttaactcgttatggcttggctgaagatgcgaacttttctcgtcaagcattaattctttctcagaaagttcccatctcagcatccaataaaaacttggagccgcgacaacgttcgttgtccgattattggctgacgaattcaattgcaagagcctctccgaccatggcccaatgcgtcaaagcttcgcgcgactacgccgttcagcctcacacggacccgctgagactggcgaacccccacgcctaaggaagggagcgaagaaggaattcgatttaattaggtcgcttgtaaatgtcttatttaaattcgttttgattctgttttccatgcgaatcaaaagttgtaaattgaaaataattctctattcgtgtcaaaatgacaataaatatttgttgtgcttaaaaaaaaaaaaaaaaaaaaaaaaaaaa

SEQ ID NO: 89160 - DNA, 887 bp, Heterodera glycines
  SCN-specific regions: Sequence locations=1-6,28-887
gacaaactcaatcacaaacaaaattctcggcggcaataaaaaggctgacaacacttatcaccaccaacagcaaaacaaatcgtcgtcagcagcaccgtttggcggcggtctcttgggcaaaatctcttcgacaatcgcttccgctgtcaattcgacgaatcaacagcattatccttcaactcagccccaacaaatgtcttccggcggttacaacaatcaatcgaattatccgggaggcgcccatccgcaacagtacggcaccggaaacactggcaacgctggtggatatccgcccgctgctccgccgtccgcgggtgcgtaccctccgcaacagtacggcggcattgctccaccgtacggcaccgctggttatccaccgcaatatcagccgacaccgtatccaacttccacaggcgcaatgtccgccccctcaattcgggcaaacccaaatttcaacgcgcaaatgacagcggaattgctgcgcaaagcgatgaaaggctttggctgtgacaaaagcaaagtgatccaagcgttggtcaactgcaacaatgcacaacgccaagaggtcatccgcacgttcaagcaaatgtatggcaaggaactgatcccggagttgaaaagcgaactaacaggcgacttcgaacacttaattattgcacttatggaactgccggcagtgtacgacgccgcacaattgcgccgttcgatggagggacttggcaccaaagagcatattctgatcgagattatgacgacgcgaccaaatgcgcaaatttatgccgtcaaaatggcttatcgccaaatgtacaactcggatttggagcgtgacatcatcggcgaaacttccggctatttccagcgtctgctcatttcgctgtgttccggcg

SEQ ID NO: 89161 - DNA, 643 bp, Heterodera glycines
  SCN-specific regions: Sequence locations=1-643
gtagtgacctcagcattggatgatctgcagaggaaagcgcgtcttttggaaaatgaaatcgatgctcaacttatttctctgaacaagttcaatccttcagacgctctttcgtcttactcttacaactcaaatcagacaaagggtcaaggcaaacgggcggtgttcgattcgttaacaactgacattgaaaataaactctcaaaattgagcgaaataaacgatgcgatgcgcgattgctttgagaatgatatggccgagttcagcaaaacttccgtccaacacattgtgcgacgacaccgcgacattctcagggattacagcacggaattcactcggacaacttcgaacatcggaaaccaactgcacagagaagaattaatggccatcgaatcggagtcatcggtgaataatcggtgcaaaccgacggactatttactaaaggaacacgaaagcataagcagctgtgatcggcttttgaatgaacaaataagcattgcaatgtctgtcaaagagaatctgtacacccaaagcaccgggttgggttcgattggcaagcgtttgaatcagttgacaaaaaagtacccggccatcaaccatttgatgaacaaaattcggatgaagaaacgcaaggacacactcattc

SEQ ID NO: 89162 - DNA, 729 bp, Heterodera glycines
  SCN-specific regions: Sequence locations=1-29,56-591,614-729
tttttgtgtgtaaataaacactaattacctaattaatattttattaattaataatgcaacaattttcaatttgatcatcgactggctgtacatatatccttctatgtcagatcatccacgtgaagagaaacgaatttttgagaaaatttttatctgcaatgacattttgttggattcattgcccttttgtgggcacgcaaaaatcggtttggaatttgcggttgtctcctatagatttgatgtagtggcggacactcatcttaaacgaagaaaatggaagcttggaagtttgagaattgaacgttccagcacgaatgacggagcggaaattgtcaaatgtaacagtgacaagacagttaaacggttgccaattccattaaagccgcttcctcccaatttgatcggtttcaagcggattgccgtttatcacatcaaccgaaaagtgatcgcttttctccaccgcattcaacgccttttcgcaacagatatcacgttggaattggccatattttttagacaacgccaaagttgggatgttgtgacctacgggatttggcccgcgctgaatgccgcccggattgttaaaatccgtttccataacatcaacaatgtcaccgctttacaaacacacatctcgccaaccattctgcacgattgtgccaatcttcgttcaattgatgtcaatcacatttaccggcctctgactgggcaaattggggatgaatttaa

SEQ ID NO: 89163 - DNA, 643 bp, Heterodera glycines
  SCN-specific regions: Sequence locations=1-643
acgggcgaacgaaaagacaccgccacttggccatggcaactgtggccgttcatgtcctgcttgactctcgagttcccgcgcaattccattccaaattcattcactcattcccctttaggtgcatttgtccactctttcggggtaatgtcgagggccatttgtgcattttgccgaacggaaagcccttaaaaagggcaattcgaaaggattttcggcagtttagccatgaagagatggctttgttcctggaagtgatgggccgttacaaatccagtggcctttacactcggctcggaatgattcaccgccgttccggcgttcactcgggcccctccttcttaacgtggcatcgcgagtttctgaagcgacttgagattatcttccgctctcttttcccccaaaataccgacccctccctcggccttccttattgggattcttcgctggacggtgaccttccatcccccgaagactcagtgatgttcagcgaatttcttcttggtgaggccgataattcgggatttgtgtttaacggacttttccccaattggacgacgatggacggcaggcattcgtaccagcgaatgttcggggaccaacaagacggggagttcctgaacgaagcgcgcatcgactgggttct

SEQ ID NO: 89164 - DNA, 653 bp, Heterodera glycines
  SCN-specific regions: Sequence locations=1-653
agatggacaaagatgtcaaaccggaggacccatcggtttctttcggttttttgtccgaggaagcgcgggaagcgatgctcaaaaattgcctcagcggtgcagtcgactgcaaagcgcagcccttcggaatgattcaaaagcggacgatggttttacagcacgaaatggacttcatgagaaaagtgcgaccgtaccaatcaggcgaaatggtacaaaagagagtggaaatggtgcagaaactgaagcaaaagatgctcgaagtggcaggccttgacgaacacgttcaacccgtaaacgacggcaccttccaacacgatgtgctgcttacagagaaacaatctgaagaactgatcaaagcattaaacaacgtgccgaaaccggcgaaaaagcttcaccggtacgggtacgggcaccgcttcaagcgtgcctcgctgtttttggagcagttcgcggcacaaaaatggccaattggacagccaatcgctttcttttttgacccaaaaattgaagagttcgaaaagcagatggtgcgacaagcgcatcaaatgatcgaagcacagacttgcattcgcttccgcccgtccgattcaaagcccaactcggactttctctactacatcaaagtgtccaccccgacattttgcggcctctct

SEQ ID NO: 89165 - DNA, 729 bp, Heterodera glycines
  SCN-specific regions: Sequence locations=1-34,58-100,122-360,391-729
caggaagtttttggcaaacagccaagtaaagctgtcaaccctgacgaggctgttgctatcggggccgcaattcaaggaggtgttcttgctggacatgtgacggacctgttgctgctggacgtaacgccactgtcacttggaattgaaacgcttggtggtgtgttcaccaaactgattacgcgtaatacgaccattcctacgaagaagagccaagtcttctcaacggctgctgacgggcagactcaagtggagatcaaagttttccaaggcgaacgcgacatggcattggacaacaaaatgctgggccagttttctctcgttggtattccgcctgcccctcgaggtgttccacaaattgaggtcgcttttgacattgatgccaacggaattgtgaatgtgtcggcacgagaccgtggaactggcaaagaacagcaaattattatccaatcgtccgggggactcaataaagaccaaatcgaaaacatggtacgtgaagcggaaagacacgcagcagccgacgcagaaaagaaagagacgatcgaggcaattaaccatgcggagtcggtgctgcacgacacggagtcaaagatcacggaatacgcggaacatctcaacgcagacgaagttaatgtggtcaaagagaaacttgaagagttgaagaagaagttggccaaccgtgaaggtttgaaatctgccgaagtgaaggagtcggttaatgagctgcagcag

SEQ ID NO: 89166 - DNA, 922 bp, Heterodera glycines
  SCN-specific regions: Sequence locations=1-7,29-922
cagaagttgattttgaagatgaaggcgattacgagcaattaaatgccaatcagaatagaaaacagaaaaaggccggaggatggcaatctatgggtctcgaccattccgtcttcaagggcatccttcgcaagggttatcgacagccaacgcccattcagcgcaaagccatccctttgatgtgcgacgggcgtgacctcgtggcgatgtcgcgcaccggctcaggcaaaacggctgcgtttgttgtgccattgctgcaacgactgaaacaacgcgatgcacgcggcattcgtgcgcttctcttttcgcccacgcgcgaattggctctgcaaacattcaaaattgtcaaggagctcggccgtttcaccggtctttactgtgcctgtcttatcggtggcgacagtatggacgaacagttcaatgcccttcaccaacacccggacattctcatcgccacgcccggccgtctgctccatttggtggtggaaatgaatttgaaacttcaaactgttcagtttgtcgtgttcgatgaagctgatcgtctcttcgaggtgggttttgcggaccaattaaaggaaattctgaagcgaatccccgattcccgccagacccttcttttctccgccactcttccgaagatgctcgtcgattttgcaaaggccggcctttccgatcccgaattggttcgtctcgatgtcgagtcaaaactcagtgacaaattgtccatggctttcgctttgtgtcgtcaagttgaaaagttgcccgtcttattaaatttgtgtcgggtgttatgcaaacagaagaagaaaaccattattttctgtgcgacgatgaaacacgtggaacacgtggtcgctgtgttccaagaagccaatttggacccggcctatttgttcagtcagttggacccgggcgctcgcaagca

SEQ ID NO: 89167 - DNA, 614 bp, Heterodera glycines
  SCN-specific regions: Sequence locations=1-280,303-614
gtttgaggttaacattaatgagcttaatttatcatggattttacggcaggaaatacgccaaatttgtttgaggtgcttctgcgaaatttttgttccgagtcgtcttcaattcaagaaaaggctgtttcctcaattccttcaattgagcaaagatttgctgaggttgaaacaaatgaatttaaagcagcgttcggtgaattgtcgggtgggacgcttcgtttggttgccgatgatcgtccatcaacttctgcagaggccaatgatcaacagtataagccgattgaaattgtaattggtgatgacgctgagattgttcaacagccctcttcaagttcttctctgatcagttcccatcccgagactgtccaagatgcgaaggtttacgcgaggatacgcgaacttagggaggcggggctgtggagcgcgacgcgactgccaaagtgcgaagacccgccgagacggaaattgcactgggattatttgttggaaaaaatgcgatggatagcgacagattttaccaatgaccgaaaaggcgaaaaaaggagtgggcccgaaagttggcagtcagagcgaaggccgaatggcaccggttgctcagttcaaccaacgaagtt

SEQ ID NO: 89168 - DNA, 668 bp, Heterodera glycines
  SCN-specific regions: Sequence locations=1-492,514-668
ctcgacttgagcatcaacagcacggtcattctgcgtgacgaatggcttctgctcggtgcccaggagggactgttcgccactccgatgagtccgcaacagttgcgcgcccctttccgaattgcgggcgtcagctgcgtctattggatggagctgttgcccgagttcgacatgctcctcgccatttgtggttccgcccgccaattggccgtcatccatctccaacaaatccaccgcgcattcaaagttgcacaacagccgacggtgtcctgcacaaacattgccaacatcgaacaatgccatattgcggttgtcagcaactcggaacatcaccgcgacaaacgcaccattactgatgaccgcagtctgttcaaatgtcgcgcggcgcatcgcacgggcaacggactgaacgccggcgaattactcttcaccgtttccagcgaagaccgagtggaactgcacatttttggccacgccgacgcggcacatctccaacagccgcagcagcatcagcagagtgtcaagtcaattctcaaacggaaaatcttgatccatgcctttcgacaacttttatttattctttcgaacttaatttttgtttaacttttgggattgccacttggcgcttgccttttatgatctgattttgtgcgcataaatctgcttgctat

SEQ ID NO: 89169 - DNA, 1262 bp, Heterodera glycines
  SCN-specific regions: Sequence locations=1-1241
agacaatgggatttcttggcaaattgtcaattggtttgtcggtgatttttcttgggatcgctgtttggttcagcaccagcaaatttttgccaaaggaatatcacctaccaccacctccggcattgactggcctcctaacggtgaacaaaccgaaggtgttagaaaaattgttggagggacaagttcttgggcctgaatcggctgtcatcgaaaatgatgtgatttacacctgcacattggatggaatgtgtttgaaaattgtggacggcaaaattgagaaaagtgtcccagtgacggcacatgcgacaaattgtgatggaaaacgcaaaacaattccaatttgtggacgtccgcttggcattcgtcgattcaattcacaacaattcattgttgctgacgccgtgcttggcttactgctcatcaattttgaagaagagacaaaagaagtgctgttgccaagtataactgttgtggacaagaaacgcttgggcttcccagacgatttggacattgtggacaatgacacaattttgttcaccgatttgtccgcaaaatatggctacagtgattgtgatttggcattttttgagcacgtccgggacggacgtctgcttgaatacaaagtgtccactggtcaattgcgagttctgatggacggtttagcagttgcgaatggtgtccaattgcaccctgacaaaaattctgttttggtatgcgaaacggccatggctcgtatacaccgctattattttgctggccccaaaaaagggatgcagcaaatttttgtggacaatttgcccggtttccctgacaacatccgaatttcgcgcagcgcagattcattttatgtggcgttacctttccatcgaagtgaacagaagccacacatttttgacagacttggcccatggcctttggcaaggaaattcattggcgaacttttgaaaattctgcctgacaacgtcctgcagcgttttgttgtcggatcgacgcatggcattgtgttacaattggatttgaacggcatgattttgcgctcttggcacgaccccgagggatcagtgatttcacacatttcggaggttgatgatgatggaggtgattttctgtatttgtccagttttgtgaacaattacattggaagaatgtcgaaggaatgaagaatccaaaatttggaatgaaaagccgataaaactgcccaatttttcaaaatatttttttttgataaattcttgacttttaaaaaaaaaaaaaaaaaaaaa

SEQ ID NO: 89170 - DNA, 1107 bp, Heterodera glycines
  SCN-specific regions: Sequence locations=1-369,391-461,485-1107
ccaagcgtatgaagtgagtggacagaggggcagaaccatttatcttgttttcacattccatcggtttttcaatcattaaaatttcacagatggaacagccggacatcgaattggagctgcacttgcacgggctgggcatctccctggtcaacaacttgaaaagcgttgaagtcctttacatggtcattgattcattcactagtacatatttaattcaatatcaaaatttaggccatgtctgcatttttacagaagaaaagtgacgaagagtcgctcaaaatggccaccggtttctggtgtcaatatcgtcagaccactcatcagcagacgcttcacgtgaaattgcacaatttccaaatggacaaccaattgccagcctccaccttcccctcattactcgccatggtaccacagccgaaatatatggttaaaaatggttgtttatttaaaagtttttggcataaatgttacaagttttttatttcagatccaaagccattcctggagtgtgcatttgtgatgagtcaatcggaacatacgaacattgtccaaatcaaactgctggaggcgttggtgcaagaatttgcgattcgcattgaccgaacattgctcaacgaattgttggacataataccgaaagagaccattcagacgggatacactcgcgaatcattccaaatggacatggaattgaccgagaaagcgctgaataaaagggcaattcaaacgcgggtgacacaggccaaggcgtattaccagcgaatgcacatttcccctttgatgatccatttgagcttttcccagggccatgttgaggaggagggcacagatagggccggcatccaatgggaatttatgaatttgattctgaaaagtgttggcgttacactcaccgaaatccaggacgtcattttcaagcttgccttcttccaacgcgaggccaccttctacagtcgtgcccaattgcagtccgaaatccaagcccattacacccgccaattcattaaacagctttacgccctcgtgttgggcctcgacatccttggcaatccgtttggtcttgtccgcgacttgcgcactggcgctgtcgacttgttctaccaaccc

SEQ ID NO: 89171 - DNA, 634 bp, Heterodera glycines
  SCN-specific regions: Sequence locations=1-116,138-459,533-634
gcgacctttaaaaccccggataacaacacaaaaaaattttgcaaaacaaaaggatcccccctttttaaaaaattttcaaaaacgaggcaaatggagcgtgaccgtattctcttccaacgccaacgctttcccaccgtcgcctcaattcaccatcagccggcgacttcgtccgcctccggcgttttggtgccaattccgacgacggacggcgccgccgctgtgcccggcagcgccggaggctatcagaggcgatattcgacacatcgagaacagcagctgcagcagaggaacagaagggacagcaaattcagcaggcgtttggccgtttacacttcaccgccagaagacagtgctgccggggccatttcacttcggccgctgaacactacaataatcagcagttcgcccagaacggggagcagcagtgacgccgaattggacacggacgaaattgccaatgcggcggcgacaacggagcgacgacggcgactgcagcagcgacaaaggcggcgactgtcggcggacgacggcgagtcgcaagtgatcgccgcgagtccatcacggcggcaattgcttacacaaccgctgacgaacccggacgcgggactaatcccccaaattgacaagccaatgt

SEQ ID NO: 89172 - DNA, 837 bp, Heterodera glycines
  SCN-specific regions: Sequence locations=1-4,46-554,579-713,743-837
tgctctgtttcatcaactcccttcttctgtcttctcctcctcctcacaacctcttcccttcatccatccgttcaccctccgtaagtcccttttatttcctctacttttgcttctccgtccgcgctgatccacccgttctcatacattccttccttcccctccttctccatcttccgagtctgttttgtgtgttctgctgcagttccattgcaatggaacaacaaaatatcacttattatccgactgaaattgtccacggacaaacgaacggcgattcgcaagaacagtttcacagagaacatgtgtttcattcggatgcaaatgttaattttcacgcgacaaacgatacaaattttggtggtggtggccgccgagcagcttttaggccaagtcagttgcagcaacgtcaacaacacatcgtggttcaacaggggccgacttcaattccgcaacgggtcagcaccaccaacattccggcgagtactgcaggacaacagacggtgcatgtgcagttggtgccgcacaatcaacagggaaatagcccaatccccggccagcaacaacaacaacgccaacaaattgttgttcaacatgcacctacctcaatgccacaacggatcagcaccaccagcattccgacgagcactgcttctggtcaacaaacggtgcatttgcaattggtgcctcagcaagggaacagtccgattcctggccaacagcaacaacaacagcagcaacaacacattataatttcggcgcaacccgtccagaccaccaatacgaccacagaatccgcagatgggaatccgattgctgcgtttatggagtactttgtgg

SEQ ID NO: 89173 - DNA, 617 bp, Heterodera glycines
  SCN-specific regions: Sequence locations=1-589,616-617
tggccaccgtttggagcaaattcgcttctcagctcagttcttggctgtcggaaatgccttcggaaaagcgaaggggtcgcgccgagacgaggccaaacggtggggacggagttgcgggggtgcgcaattcgcggtcacttagcgcactcagccgacggcacaatttggtcagaacgtcaaaaagctcggagaatttgcaccgaatcagcctattgtcgacagcgacgacaattggcaatggacaacagagacaaaagccatttttggcacaattcggactcaatgggccaaatgcccattccgaggaggggtcggtgccgtgccaaaacagccgaaagggatcggtcgaaggccaccaaagtccattaacaccggcaaggacgaagacgaggcgatttccattttttggcaaagaaaacgaaacgacggcagcgccggggggagagggcgaaagcggatattcaagcggaagttcgtcgagaaggaaaaagtccaacggtcgcttcgttccttgcgcttctttcctcggcatttttcctcaatttaaacgcgcggcacaaaagcaatgagcggcaaaggcaacaaaattcaaataaaagcacaaaggaaggaaagaa

SEQ ID NO: 89174 - DNA, 664 bp, Heterodera glycines
  SCN-specific regions: Sequence locations=1-36,61-230,252-664
gtttgagggataataatttgtaaggcgtatacatacaaatatttatttaaaaaaataaatggcttcatctctctacaatttcaagaagatcacagttgtaccgtcggcatcggatcttaaagatgtcgtcctttctaaaacgcaacgtaaaactcccacggttgttcggaagagttggcaaataagtcgaattcgggctttttatgcgcgcaaaattaaattccttcaacaaacgcttcatgacaaactcacttcgataataaccgagtttccaaagttggaggatgtgcatccattttactcggatctgatgaacattctctatgatcgcgaccattacaaaattgcgatgggacaaatgaacacggcacgccatttggtcgatggaatagcgcgggaatatgtccgactgatgaaatacgccgattctttgtatcgttgcaaaatgcttaaacgggccgcgttgggtcgcatggtaaaattgctgcgtcgacagaaatcaagttttgagtatcttgaacaagtccgtcaacatttgagccgactgccaagcattgacccgaacacgagaactctcatactatgtgggtttccgaatgtcggcaagtcttcgttcatcaataaggtcactcgtgccgatgtcgaagttcagccatatgccttt

SEQ ID NO: 89175 - DNA, 1037 bp, Heterodera glycines
  misc_feature (1014)..(1016): n is a, c, g, or t
  misc_feature (1019)..(1019): n is a, c, g, or t
  misc_feature (1023)..(1024): n is a, c, g, or t
  SCN-specific regions: Sequence locations=1-59,81-386,409-1037
cttacaagccaattcgtgtttccgacatgcccattcaattatgcgaacaccgccgtgtcatgcccggcccgtttattcggggtgaaataaaggcggtgaacacttcggctgcccgacgcctgatcagggtaattgtcgagtgattgggtattttacacaacgccttttaaggaatttaatgtgaacacgactttgtacacggggtaagtgcatatgagatgacgacataatattaaatttaaatgcccattttataaagagctaacatctgtgtcaactgctgctcaagacttcgtgatcaccaagaaactaggcgaaggggacggacagaggcgattttatactaccccgaaggcgctactttgtttatcaaattggtttctaattattctttttccctttacttttccttgatttttcagaatggggatgagaatgatgggaacacaacaaagggcaagaaaaccaccactggaccatccgcggcagtgacgcgtcgagcagcgtcaaaagggctaataaaaattcgagtgagtcggttaagaaaagacaattatatttatactggtgatattaatgttagatttgttcggatgagacgatcaatgccctgaagttgcgcatttacgagaagatcgaccagtctccagtcgaccagttgctttacatgggcggacaagtgttggatgggaatttgacgcttgagagggcgagggttcctgcaaacaatttcgacaacccgcttattctgatcgtccagcagagaaggaaaagtggtgacgacgatgacagcgaccagaaagcgggctccagtggtggtggaggatttcatgacaccgccttgtcttgataataatgttcactgagtacaaaactcacacgggcgtcgacacactcatccactttgtttattaatggcttatgccctagttcttgttcacgtccattaagtacgagtactgtttgttttgtcaggtgccgattataattaatactcgataaatacttttattnnnaanaaannaaaaaaaaaaaaa

SEQ ID NO: 89176 - DNA, 655 bp, Heterodera glycines
  SCN-specific regions: Sequence locations=1-228,271-655
gtcacagagtctgcgcgttccattcaaattcctccccttttggcttttttcgccgcttaatccctccaaatcggtcgcttttccgtgaacacttttcgccagctgccgcttctttgcgcacaatgaaatcagattgaagaagctttgaacagataaaaagggctgtagcaaaaggatgaataaaatgggtccgacaagcgaaaacgacggaccgaagaagcaaaagaagggagggagacggagggacggaatgccaaagccaacgccaaagccaaaaggcatggcagcagcatcaacggcacttcgccaactgtcaccactgcacaaagtactgctcgtcgttgtcgcactgctccaatggacaacgacggggggaagggccgctctgcttcaaggttgcgactttagcgaagatttgtgcaccgatggcgaagtctgtttgccggacaggctgttcggccagtgctattcggacgatgagtcggctttggtcaggccgctggtcctcaaccggcccatcaacggcgtccagtcggagctgcttcgtgcggagctgactcagctggccgagctgggactggattggccggacgcacgtgcccagtgcgtgttggcctatttcaaattgggcgtgggttttcgcttggactacaac

SEQ ID NO: 89177 - DNA, 1294 bp, Heterodera glycines
  misc_feature (1271)..(1272): n is a, c, g, or t
  misc_feature (1274)..(1275): n is a, c, g, or t
  SCN-specific regions: Sequence locations=1-34,56-380,402-496,521 -669,697-1176,1199-1213,1248-1294
gcggacaatccgaaccttcgcatcaacgaacccgacccaatgctggtgcttatttatttgcccaacccaccaacgaatacattctctaaattaaacatttttcaggtgacttgtgcgcatcgtaagtttttactgtcacaaattcaataaaatgcaaaaatgaacttcaaaagtccaccaaattgtgtcccctccccatactgaagtgtccgaactcagctgtcctcgggcatgcccacccgtccctctccttataagtaatacatttgtacaatttcccttcccccaggcaacaatcgtttttatttgtttaccaatgtcgaaccgtacgcggaagaagcggatggtgtgttttgttatgcaaaaacagtcattaaaaatcgtttttgtctttttaagggtccactcatagcagagacgtgtacaacgaaaagccgctaaaggaggacatgatcaccgcaatagaagtgagttagggagacgagccaattgtgggaaataatttaatttatttttattactgcaggaagaagcaccccaatcgaagctgtgcaacaagtaattcctaattaaagtgccaaaagcgttcgctcttttagggcaattgtttacacaacatatggcgacattcacattgagtgggttttgtgcttccccatccattcatttctccatttttattttcaaattttatgtatttaagactattcccggacaaaacgccaaggacggtggaaaatttctgtacacacggtaattctcgacaggcatttctctgatagatttattaatgtaattgtttacttttggtattgtttcagcacgacggggttattataacggacacgcctttcacagagtgatcaagtcgttcatgatccaagtcagtgagacgcgagacagagcatttctgactgaattcgctttagacgggcgatccgacgggccgtggcaccggcggacagtccatttggggcggtgattttgaggacgaatttcacccggcactacgacatgacaaagcattcagagtttcgatggcaaatgccgggccaaacactaacggttcccaatttttcatcacaatttgcccggccgaatggctcgacggaaagaacacaatttttggccaagttgtggagggattcaacgtggtacaaaagatcaaccaagtgcccgtctatgaaaagagtgggagaccccgagaagagatttcaatcatttccatttctctgaagagtgtttagcttatataaattcattgctttacnnannaaaaaaaaaaaaaaaaaaa

SEQ ID NO: 89178 - DNA, 834 bp, Heterodera glycines
  SCN-specific regions: Sequence locations=1-6,53-155,178-675,697 -731,753-834
gtcaatgaagagaaagaggaacaagagagggaggaggaggaagaagaggagggagcagcggaaaatggcgatgaaaatagaagaagcgaagcgaacgaattggactcggcctttcccgcaatgatttccaatcttttcggcactcatccgttgcgcaccgaaataaaaaagaaaaggccgtcgcagcgtcgggggaatgccgaggaagagacatttcactttattattgactgtcacggcaaattcgacgcgaaagacacgcgaaattttaattcatcgctggtggaggaggtcagcagacacccggcactgttcgacttcacaagggacgagtacaaatcgaccgaggcacgcaatagacattgggcagaagtggcggaagaaatgcagcaaagtgtggaatttgttcgtacgcgatggaaaacgttgagagaccgtttcaaaaaagaggtgcgaagacagcaccaatgtgtggagggtccgatttggcaacattatgacaaaatgctttatctgttgccgtttattagggacaaagacgattctaccgaagtcggaacaacagtatcaaatggaagtgtcggaattcgttcgaaaaacggcgcgaggagggcggaggggccgacggacaataccgacagggggacgacgctttggcatggcgagcgggaacagaagcgacggacgaacaacgggaatttgctgcacccgtcaccaattaattcgtgcaccgccgccattttggatttggcaatgagtgccgtcacaaaactttcgccgccgccaaccgacgaaatgacttcctcggacggtcgccaatgcgcaatttcggaa

SEQ ID NO: 89179 - DNA, 819 bp, Heterodera glycines
  SCN-specific regions: Sequence locations=1-84,107-276,305-531,556-819
aggatttccgagtcggaggaggaatcggaggcggagcaccagtctcgccaaaaggcggaccgctcgcgttcggaactgcaacgcgagttggaggagctcagcgagcgtttggatgaagcaggtggcgccacttcggcccaaatcgaagtgaacaaaaagcgcgaggcggaattggcaaaactgcgccgggacttggaggagaacaacctgaaccatgagacgcagctgaatgcgttgcgtaagaagcacaacgacgcggtggccgagctgaccgaccagttggagcagaaacagaagatcaaagtgaaggtggagaaggacaagcagcagatccaacgcgagttggaggacgccacgcaaacggccgactcggaactgcgagcacggcaggaagcggagaaagtgatcaagaacatcgagctgcagctcagcgaactgcagagcaagacggacgagcagtcgcgactgctcaacgactttgccgcgctgaagagccgcttgcacaacgaaaacgcggacttggaacatcaagtggaggacctggagaaccaggtgaattcgctgcatcgcctgaagagtcagttggtcagccaattggaggaggcgaaacgaaccgccgacgaggaaagccgcgagcggcaaaccctcgcgggacagctgaagaacgtgcattacgagaacgactcattgcgcgaacagctcgacgacgagcaggagggcaaagcggaatgcctgcgtcaaatcagcaaactgaacgcggagatccaacagtggaaggcgcggttcgagtcggaaggattggtcaagatggaggagatc

SEQ ID NO: 89180 - DNA, 907 bp, Heterodera glycines
  SCN-specific regions: Sequence locations=1-43,66-136,159-178,200 -569,591-875,901-907
aagtttgagaaaaaaaaattcttccatcaatttttcttattagcattttgccatccatacatattaaattctcaaaaaaacactaaaaacactaaaaatgtccgaccagcagtccggctcttcttcctcttccgccgtactcacttcccccaccccttttccaccacaacaacaaaaaccgccgctgctccgccgctgttccatgtcggaaccgcacttggacattgtgccacactttttgaaggaggaaaaaagcgtccacccgtttgaccgtgtgttgtccggcctgttcgacaaaggctccacattctccgtgaacagcaccgattcggtcgaccaccattattcggcaaaaagtgatcgtcacgatcacccgttctccccgaccaatcagcagttgaccaagggcaaaagtgccatcggaatgatgagtaatagtgccgccgtcgccccttcctcggcggacggtctgctgcgcaagtcggccaccagtgcgtcggcactgtacagcagttctccacaacatggcacgacggccaaccatttcccgacaattcctgaggaccagggcctgaccatgtcggctggtcgtgacaaaatgccacagacagccgcctccgccagtccgccgaaatcgggcttcatgaatttcttcggcaccggcggcttcctctcgcgacccgtcacgcacacgccggaggagaactatcgtctgatcatggcgcttgatcgttgattgattgatttgatgagttggagagagagagagtgagctgaagcgcgggcgggagagtgccgtgccgaccaattttttctgttttttttttgtgccgtggacggtcggctgtgaattttttggatttttgggatttggagggcgcgcgcgggcggccggcggcgtgtacat

SEQ ID NO: 89181 - DNA, 839 bp, Heterodera glycines
  SCN-specific regions: Sequence locations=1-49,71-839
tgacgagatggtcaattccgtgtttggcgtcaagcaagaagggaatgtgcctgccctggcggacccccacggcgaattgcgaggcaaaaacattttgcacagagtcgacgaatatgaaatgtcgaaaattgcctcctaaaacaaaatgaccatcgaacaattgaaacagtgtatggaagacgcaaagcgctttttggctttggtacgttctaaacgcccgagcccgcacttggacaacaaaatactgaccgcatggaatgcccttgccatctcgggcttttgtgctgctgctcaggctgtcccaacacgcgcggccgagttccaaaaacgtgctgaaaaagcggttgcattcattcgcagccatcttttccatgggggagaattgctccgatcggcttacttggacaatttgggacaagtcgttcaaataagacatcccatcaaagcgtttgccgatgattatgcttttcttatcgaagcccttctcagcctttactcgctgaacttggatgagaatttgcttcaatgggcgcataatttgcagcttcaaatggacgaacttttttgggatagcactttcgactcgggctatttcatgtcgagggttggcgatccgtcgataatcgtccgaatgcaagacgaacaggacggggctgagccctgcaccaattcggtggccgcttccaatttgctttgccttggctttcttctcgattccgctgactttcgtcggcgtgccaacgattgttttgccggcgcagcaaaacgaattgagaaataccctttcataatgccacgtatgctaatcgcattgcatgccgcaactcatccgccgtacc

SEQ ID NO: 89182 - DNA, 889 bp, Heterodera glycines
  SCN-specific regions: Sequence locations=1-400,422-498,521-889
ctttgacttagacttgtgataattgtgtcattcgtctcatgaccatccatcgttgctcccttctccgctgatgatcatcgcccccattcactgagtccgccattgccccattgatcctccctcccttcctccacatataaatagccagcccaacgaatcaacgctcttcgcttgcatcatattggacatttcatcaagcagtaaaaagtgctggattgaaaggggagagaaagatgatggagaatgaatggagggagtataaaagatgatgatgatgatgacgagttgacgacgaaagcgaccaaaacgcatcaacaaaaacaaactgtcaatacggcaccatacaacaaaaataaaaagcaaagggaaaaacaaacgacgccaaaaggcagcaaaaatagctgagccaaaagtgaagaaaataatggaattggccaaggaactcatcgccgaagtgttacgtgaccgaaccaaacagttttcttcgggagacaatgcaaagttcggcctggcgttggcaaacgccgaccgttttctggccgaaggagcggcagtttccattcatttgatgatggcacacgccaactgcaaagcatcggcgaaagaattttgtgaagcgacacaaacattggaggtttggaccttcaaattgcagagggaagtgccgtacgaagtgagtgcccggccgccaatgctgccgctgttcttgcgccaggcagtccgttcccaattgcatttctcgcctttccgttcttggcttactgcgcgacaacgcgcggggccatccgatgggtttttgcctcttttgcgtgtgtgtgctgcctctgactccgctgctccgcccttttcttccgatcgtctccaatcccaccaattcccgccttgctta

SEQ ID NO: 89183 - DNA, 718 bp, Heterodera glycines
  SCN-specific regions: Sequence locations=1-284,311-620,645-718
gcgctgaggaggcaatttccaaatacaacggcgaatggcaaattgggtcgcccactgatgaaattttggccaatgattatggactcattgtacggactaaggctcgacaccacgccatttctgcgcgacttcgaaagcctttcaaattcgatgggagtccattggtcgtccaatacgaagtgaaatatgaacagggtcaagaatgtggcggtggttatttgaaactgttgcgggacgacgcctcaaaggatttgaagcagttcaacgacaaaacaccctatgtgatcatgttcggaccagacaagtgcggtatgacaagcaaagttcacctgattctgaagcacaaaaacccgaagaacggaacaatcagtgaacaccatgctaaacagccgagcaaatcgctcagtaattactttgaggacaaaaagaaccatctgtacactcttgtgatccgacccgacaacgcgttcagcgtgtctgttgaccacacggagataatgagcggcaaattgctgacggatctcgaaccatcgggtgtgccacctaagcaaatcccggacccggaagacaaaaagccggccgattgggataatcgtgaacagattgcggatccggaagcaaagaaacccgaggactgggatgaaaatcaacccaaagaagttgaggacaccgacgcggtaaagccggacgattggttggaagaggcggaggcgctcgt

SEQ ID NO: 89184 - DNA, 864 bp, Heterodera glycines
  SCN-specific regions: Sequence locations=1-358,380-758,780-864
gtcacaaaccatgggaatcaattgaatgcccaattagttttgatacgccgtgctgctgagtctggagacggacaacaaagcttgttgcacgtgtctgtaaggaggtttctggacgagaaagtgttcccggcaaatttctgaagtcgctggaaacttttcaatatttgtgcaaccagtgtgcaaaaaggtggaggaacagtcggaagaaagcgcaactcacaaaaaagaaggacgacactgagaaggagggagccgaggaacagcagcaggcaacaacatcgaaacctcaagccgacacacacgcgaaggaggaaagtgacgaggcaacactggtccggaacatggtcgatgagctggcgccactttgggaggagctgagcaattgcctgtcacttctcgagaaggccgaagattcgcaacatgcggttttgtgtcttcaaaatgctgccgaggcgtttttcctctcttattcgttggtgataccgcaaactgctcaattggctcaatctgcactccctgaaactgcaccaactggcgattcttcacctcagttggcctcctcttctgcgggcggcaactccggcgaggatgagctgggccgataccagaaggaaatgttcacttttgcggaaaaacatcgatcggtgctcaatcaaattttacgtgggaacacgcagaacctggagggaagtgcctttgctattctcacacacttccccaaattgttggactttgacgtcaagacgaaatacttccacaaagaactcaagaaaatggacgagaggagcagatatcgtcacgaagacgttgcaatccgtgtgcgccggtctcatctgttccgtgacagttttcgcgagctctatc

SEQ ID NO: 89185 - DNA, 642 bp, Heterodera glycines
  SCN-specific regions: Sequence locations=1-203,225-642
gtccaattaagcacactgctttcatacattaagcatgctcgtaattagatagacgttcatatacaatagttgagttggttaccttcacgcacatgctgcaatcaattgttccacctcgtttccatggagtggttctgtgtcgggtgtggcttgactttgtcggggacgctgagcaaccgaaggaaagggaccaacttccacccataaccatatgtaaaacaaaactagccactgaaggacggcgaatctcaaacgaagggggcgcaatactcacaatcaacttgtggccaacaaccgatgggatgttgaaggggaccggaataccctcgctcacttctctcataactcggaagagcatcgaatttcatttcaattttccatttcttacctaatatggttgtccattgcgagagtcgtctgcttgacttatgctggccagtctgcactcattttggaaataggtttaaggcgttttgctttgtttggtggtgaccacctgcagctcactaaaagcgtaaaattttaaaaactggaaaggtcagcttttcaagctcggctcattcgcagcacaaccgaattcttcttaatttcctataaagcttcctcaaatcattcagcgacattatttcgaaatgactgcaa

SEQ ID NO: 89186 - DNA, 850 bp, Heterodera glycines
  SCN-specific regions: Sequence locations=1-191,213-850
gagaagagagcaaacagccccaactttatccttccccttcatctgctgatcttatcttctccaatcgctttcccattcctttgccgaaagtaattttaacaaataaaaaagaccggcaacagaaagagacgcctttcgtccatttgttcgcctctcactgagtctctcttcgactttactccccaaatggtcgttgctgatttggccgtcttccaattggaccttttttggacaattatattgggctttcttatcgcatttgttttggcttttgcaattggagccaatgacacggcaaattccttcggcacgagtgtcggctcccgcgtgctcaccctccaacaagcgtatttactcgcctccattttcgaaacgatgggcgctgcccttttgggctcaattggcggaatttggacatgaatttggaagaattctgaggacaatgcacgacgccaatctcatccacggggacctgaccacggccaatgtgctcgtcctgactcaacggggaccagtcgaattggcactgattgactttgggttggcccaattctcatcaaagccgggggacaaagcggtggatttgtatgtgctggagagggcaattcggagtgcgcacattggcatgggcaaaatgatggatgccattttggacgcatacaaaacagaagggggcggaggggacgaggacggaacgaatgccaaaccggtgctgctcaaattggacgaagttcggcgcaggggcgcaagagagacatgatcgggtagtggagacggcgagaaaaagagggggcgatggacttttagaaaagaagacggcgagaggaagagagggacgaaattgaccatt

SEQ ID NO: 89187 - DNA, 620 bp, Heterodera glycines
  SCN-specific regions: Sequence locations=1-105,143-560,582-620
aaaaatatgtccaaaaacaggggcgaagcgcaaaaaatgccaaaacaggcacactcctgtagaaaaaagcagtaaaacataagaatctaagaatctgggtcccacaaaattatttataatcaaaaacaaattaattttatttcttttaagcataatgagcaacaaagatttttggagcaccagaattttcccctgacagcatgtgctcgaactcccgtttttaggagagtaagagaggtagttaatccgtgtttaatcaattatgaaattcaaaaataaacaaaaaaaatatttcaaaaaacagttattcacaggacctaataaattcaagacttatgtcagtttttataatcttgaacaacaatgaaaactgcatgatttaacgaaaggcaaattaataattattagggtgcaaatttttaccgacaaagaattcataaaaaggggcctaaatagggacgaaaaatgacaaaagcaacatataaataatttgtttttttgccaattatttcattttcattgttgaaaacctaagaatcctaaaaatttatgaattaaaaaaggaaaatatgatgaatggttaaatgatatttgcggtcggataattgtggcctgctgga

SEQ ID NO: 89188 - DNA, 628 bp, Heterodera glycines
  SCN-specific regions: Sequence locations=1-628
gacccttctctgagtacgttcggttccaaaccctcccgggcgcccctccgcctcctaccgatttgcgagaggagcaacaattggcccacgccttggaaatttcttttctgccgccgtatccgcccaacggcattctcgaccaataccgtatccggtggactgtgcacggcaagttcaactaccgagagcagcgagtgcccgcctttgagttggagtgttccgactcgcgaatgcgtggccgcctctgctaccgaatcagcggattggagccggagcaggagtatgagattcaggcggcggcacacaccgaacgcggcgattggtcggattggtcggagccacttgtgaccaagacgacggagcaagacattccggtgctggaacacccgctggagttggaatttgccaagtcaacgagcattggcgtcagatggcgcgggttggaggaaaacctggccgagcacatcaccgggtacgcgttggaatacaagtcggagacggacaccgactggaaggaatggaacggcgtggtacggcaccgggcgcggcagcccgactaccgagcgcatgtcaaaggattgaccgagtccacggaatacttcttccgcctgagggtggtcggcaaagg

SEQ ID NO: 89189 - DNA, 629 bp, Heterodera glycines
  SCN-specific regions: Sequence locations=1-119,141-309,331-629
aaaggcgtcactgctcactatcattgccatcgacaaccgcactttgccagcacataacagccatcaaaaaattccattgccaattgaatgtattgacaaaattgaactgcattacacgcttatcattgtggttgaaggatcaaataatattattcataagctttcctaaatatcattattatttatacagttgtgggtttttgggtaggaaaagcagtttttcattttttacgagatttgttaaattaatgtgcaacacccccaaagtgtatgatgaccaagacgtacgttggagttcagtgagaatgagtgtgtggtggtgtctctgttcgttatggtctccgtccccatttatgtgcatcaaagaactcgcaagtttttgttcaaaaaaataccgaaatacaacaacgggaaaggaatcaaaatttcaaatttttctcacctaccgcgcgttatttgcgcaaaatacgaaattttcagccccaaatgaatggtcaacaccaaaaatggtcatggtatctctcatatggtagtgttcttctgtttggtgctcaccattggttgttggccttcaaatggtggatggacaccatttggatttgtacatttggggggtcttgggctcaaaa

SEQ ID NO: 89190 - DNA, 650 bp, Heterodera glycines
  SCN-specific regions: Sequence locations=1-143,165-196,233-362,384-650
gcacgtcggccataatttataagggtcgagggtcgataaaatttggtatattttaaggtatgaacttggaatttcgaaacaaaaatttattgtttcactgaggcaaacgaaaaaaaaggcaaaaaaaaaaatcggtttgtaaatataaaaatgaaatattgtgtgtgaaaagatagaatcaacaaatgacggatcgaaaatttcttttataaagattttgacaaaaatgaccatggtcatgaccatagctatgagagtgggaagagaagcaaaaaaaagaatcgacatgccaattcaaagcaaaatttaaaaatttactttttaaaatgtaaattgttatcgcccaccccatattagagaaatcctgaaagaatgaaacaattcatttattgaccattttctttgcattcccaggaaattcacttttatgttcgtagctgtatagaatgatcattctttgatattccaatggtttgtgaccaaatttagcatgttttaatcaatttaggaactaaagtgagaattttttaaattttgagttttagactttttattcgaattcgggtccggtattcgaaattggtccaatgaaggtcatattcgtgatcagcgaccctgaaaccccccataaacatgtttccaagactttt

SEQ ID NO: 89191 - DNA, 1051 bp, Heterodera glycines
  SCN-specific regions: Sequence locations=1-51,73-305,327-573,595-1051
gaatcgatggaacaacaccttggccatcatcaacagctccattcaaaccaacttgaaaaaacaaattttggcaatggccccgccggattgctttcgccgttgcacttggaagggacgaggagaggagacccagaaggctcactcggacttttgagtagtgtttccgtttcgcatttgcatcgtccaaatggcggaagtcgaacgagcgatttactcaatggtattagacgcagcagcaacaatgttgcgtacattaaagaagaaattaatccatcgaacgaacttggagggtatcactcggcagcatctgtttcccatcatcatgaggcctacggggatgccggaccttataccctccaggggcctactgcccaggaattggaacggatggcaaatgctgagacgccaccagcacttagcaatgtcgagatcacttcatccattcttgcgtcactttcacgcgaatcgccttcacccaacatacagcagcaaagtcctcaccaaccaacccatttcattgtccaccaaatgtctcgtcaacctcagcaacttgaacatcaaatagttcagcgccacccaatcacatccactccctcaacaacggcacgtcgttcaaaggttaagcaacaatctctcagccaaaaccttggtcaaaactcgcagaattcggatcagcaaattattttagcttcgaatggtagtggaacacagtctggatacgggccgatgggacctggagctggaattcctcgtaccacttactcaacgacagacacaacagacccattgaatgccgaaattgatgacgaaatttacattgacacaaaggacttgtgcaaacgtgttgcgtatgaactaaagcaacattccatcccacaagctatttttgctgagcggatcttatgccgtagccaggggacattgtcggacttgttacgtaaccctaagccctggaatcgccttaaatccggccgtgaaacatttcgccggatgttcaattggctgcaacaaccattgcacatccgtctgagcatattggatatgtacaaag

SEQ ID NO: 89192 - DNA, 650 bp, Heterodera glycines
  SCN-specific regions: Sequence locations=1-95,118-195,225-398,420 -464,486-650
gtgcaaggggtgaacggacgaatccgtcaacaaagaatgtccgatacaatcaacagcttaggcgctatctgcaaatgagaagggagctgacagatagaccaaccaaagtggagttgaccaagggattgagtgttttgttgaagcgagatgggggtgctgatgaggacgacgaactcgtcaacactcacccacggactcccgctccaccaccacctccaccagccacctcatcactcatctcaactatattaccgtcgccctcccagccttcccgatcagcaatcttcctcatctgacgatagacatccgcctcgtccaccacgtcctcagagaacaaagaaaaaccatcaatcttctctgaaacatggtcgtttgaaccaatggcagcaaaggcgtcgtgacttacaacaacaacaaccggtagtacgtgatctcctcgctgaagcagcagctgctccgttacctgaaagtgacgatgacgatgaacaaatgctggaaggtgggtatctgctgccagcaccatcacaaaattatggagacataccagtattgcctgactatgcagatgaaattgaggaaatggacaccgcccaacaaagacttgcaagcagaagaaaattaaaagaggagcagagactagataaaaataa

SEQ ID NO: 89193 - DNA, 483 bp, Heterodera glycines
  SCN-specific regions: Sequence locations=1-237,259-312,334-417,442-483
cgagcttcagctcgaatctgaagaccgatataaccgatttccattctcccaaaaggaattcattgaagattgtccggcagaacgactttacgtccgaatccttcccgaaatgactgaatatgtaattgccctgctcaaagtcattctcgcttcggtgccttcctccaaagagaaaatcgatgctgtcacaattctatccgatgtgctgacacccgaaactgacacaaatgagtaaataaagagccatttattcccttttgggacccttactccgattccctaattatttagagacctttctaattcgatcagtttggaccttgccagtttttcacacacaaatgtattggaagaaactgtccgagtcgcaattgacataaatcgacacaaagaactgatcatcaaatcggcttcgtctcttctcattcttttgctgaaacacttacgtttgaaccacacactccaatttgaaaacttggcccg

SEQ ID NO: 89194 - DNA, 1771 bp, Heterodera glycines
  misc_feature (1745)..(1745): n is a, c, g, or t
  SCN-specific regions: Sequence locations=1-599,622-662,685-979,1037 -1249,1271-1293,1327-1567,1589-1747
ttacccaagtgattcctattcaccacctacctgctgtcctgttgggctagcgttggcaccaccaaatgcccccgtccgctgacgggcacaggtcgttcgagctgacttgtggacgctgcccaacattacggggcagctgcctcacgagccatgcttttggggtgcttccatacgttggagctgtggtataccgctcagtgctgcacatgttaaagcctgtgtatggctgctgcgtggcaatgtgtcggtggcgggctgcctcgcttggttggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgtggtagggcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgctcagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcggaggaaaagaaactaacgaggattcccgtagtaacggcgagtgaactgggaagagtccagcgttgaatcgcagctcctctggggttgcgaggtgtagcgtatagaccgtgagcttgggttggcccgcttgttcaagtttcccttgaccggggctccagagaaggtgcaagacctgtccaactggcggtgcctacccatctttacgtgtcttggagtcgggttgtttgggatcgcagcccaaatcaggtggtaaacttcatctaagactaaatacggccacgagtccgatagcgaacaagtaccgtgagggaaagttgcaaagcactttgaagagagagttaaagaggacgtgaaaccgatgaggtggaaacggacagagctggcgtatctggtctgcattcacccgtttgttgctgtacgttgggctgctagcctccagactggggtttgctgtccttctgttcagtggcgaatggggcatttgcaggcggagtgcgctgagatgctcggagtagctgcgtgagctcggtcttgaggccagcctttcggggtctggtaccccgccccgcccctctccccactttccggtgtccttattgttcttattttttgtagtttccccaattcatccaaatttcgtccccaaaaaactgccatttgttccctccttcgatgagaagcgatcagtgatcactatccgaaattgcaaaagatcagcaaataaaaaaggatagcncgaaaaaaaaaaaaaaaaaaaaaaaa

SEQ ID NO: 89195 - DNA, 638 bp, Heterodera glycines
  SCN-specific regions: Sequence locations=1-638
ccaagtttgagatttataaattttcctgccctaaaaatggtagttgaaatgtcttccggtgctgcaacaactgcttctgccgctgctgttgctggaactgctccgtccgctggccctgtgccctcatgcatttgctcgtccacctcgcagctgttgacagcggccggcatggacggcattccgccggccaaaacgcccgcaaattcgggcccggacgcaaattttcttgccgattcggtgggcgtctcaccgctataccgccaagaagatactaaacgatggcaaaccgccgccaaagtgtaccagtcaagccgaagtcaaatgcacagtccaacctccggcacttgtgcaccgcaccactttcattttggcgaatcgctgacggcggagggacatttgacgcaaaaaattcgccaatgccgaagcagcggttcccccatttcgttggaggacattgccgcggagaaccgacaattccatcggcaaatggacagcggacagcaccggcgggtgaacggcccggcgctgaacggctcgctggagttggaggcaattgcggcggtgcatgaactcgcttcacaggtcaaacaaatctctgtctctgaaattctgccccgcacttccgacctgatcttcct

SEQ ID NO: 89196 - DNA, 800 bp, Heterodera glycines
  SCN-specific regions: Sequence locations=1-282,305-418,443-535,557 -604,627-743,765-800
cgagcttcagctctcatctgattaccgatataaccgatttccattctctcaaaaggaattcattgaaaattggccggtagaacgactctacgccccaatccttcccaatatgactgaacatgcaatcgccctgctcgaagacgatctcgcttctttgccttcctacgaagcgaaaatcgatgctgccacaatatctatccgatgtgctgacacccgaaactgacacaaatgaggaaataaagagccgtttattcccttttgggacccttactccgattcccgaattatttaaagtcctttctaattcgatcaccttggaccttgccagtttttcacacacaaatgtattggaagaaactgtccgagtcgcaattgacataaatcgacacaaagaactgatcatcaaatcggcttcgtctcttctcattcttttgctgaaacacttacgtttgaaccacacactccaatttgaaaacttggcccgttatctcgtcttggccaattgtcttccgctggtgcttaagtttcttgaccagaatatttgtcgatacttccaagcaaagcacgagttggccccgttcaactatcctcagtgtgcactgttttttgtgaggaatggatatgtttgtcctccattaactgcggaaaatgtcgacggttgcggtggttccagcgactcgccttcatattttctgtggcgcaatggcttttcctccatcaatttgcttcgtgtgattaacaaactcacaaagggaaaacagtcccgtacccaaatgttggtcgtttacaagtgggccccg

SEQ ID NO: 89197 - DNA, 874 bp, Heterodera glycines
  SCN-specific regions: Sequence locations=1-75,127-290,313-767,793-874
gtttgaggcgcagcactttccaagctccactaaatttgtttttttgtgaataacagtcagcaaaaacaaagcaaaaatggacgccatcaagaagaagatgcaggcgatgaagatcgagaaggacaatgccatcgaccgggcggacgccgcggaggaaaagtgccgtcaaacgcaggaacggttggagcgtgttgaggaggaattgcgggacacgcagaagaaaatgatggcgacggagaacgaattggacaaggcgcaggaggacctgacggctgccaacaatttgttggaggagaaggagaagaaagtgcaggaggctgaagccgaagtggcgtcactgaaccgtcgcatggttctgttggaagaggagttggacaagcttgaggagcgccttaaacttgccaccgaaaaaatggaagaagcgacggccaattgcgacgaatcggaacgtgtgcgtaaagtgatggaaaaccgttctctgcaagacgaggagcgtgccaatgccatcgaagaacagctgaaggaggcccaatcgctggcggaagaagcggaccgaaaatacgacgaggtcgctcgtaaattggcaatggttgaagccgacttggaacgtgccgaggagcgcgcagaggccggggagaacaaaattgtggagttggaggaggaattgcgcgttgtgggcaacaacttgaagtcgttggagctcagcgaagaaaaggcgttgcaacgcgaggaagcgtacgaagagcaagtgcgtcagatggaagtgcgtctgaaggaggctgagactcgcgcggaattcgctgaacgttcgggacaaaagctgcaaaagggagtggacagactggaggacgaattggtccacgagaaggagcgg

SEQ ID NO: 89198 - DNA, 797 bp, Heterodera glycines
  SCN-specific regions: Sequence locations=1-107,129-137,159-655,695-797
aaaccctaaaattgtccctgaaattcaattgctatgaaaaatttgccgcccgaacttttgagtgaaatgaccctttacatattgtacccaaacaaaaattttccgaacattttttcttcttcctggttactcagggaatttctgattccccatgtcactaaacgcaaggaaatatttaaaaaacgccggaatgaactcgaacgattgtataatggtgcaagacaagagccaatttggctctgtatcgtgtcatcaactgggccagaaaaacaaaaacagactatcgacaacttccttttttatcttgaagaatacctcaattaccccatttcaaatcgaccaaccgtggaagaagagaaggaattgtccgaccgattcctattactggtcaagttcttctaccattgtgaagaaacaattgcctggaagtatctcaaaaccaccacttctcgcaccgttcagcaatttcttgatgagctcagctcattcttcgctttggtcttggatttgtcacccgaacattcgcaacaccagcagcaaagtgaccacgaggcggtgccaactgatcagaccagttcggccgattcggaccttcgtcctctgcccgttgtcaccgagtcggtgccggaagaatcgacttacgatccgccctgggacgaccgctctctgcgtttcatcgaaaccatggctgctttgcaatcgcaccgatcaacaaatgtgctgcccactgttccctcaacatcggccgattcggaccctcgtcctctgcccgttgtcaccgagtcggtgccgacatc

SEQ ID NO: 89199 - DNA, 640 bp, Heterodera glycines
  SCN-specific regions: Sequence locations=1-256,278-561,583-612,634-640
acagcatcattgttgacctgctccatggacagcacaaatcgacgctcacctgcaatgtgtgcagcaaaatcagcatcaagttcgagccgttctgcttcctgtccgtgccggtgccgaccaaggagcacaaggcccaatcgacgatcgtttttatgcgggccgagaaatgggcaaagtttcacgtcacacacaccagcaaaacgacggctggccagctgaagcaaatgctgcgtgaagaagtgcaattgccttccaacacacagatgatcatttattcgacttacagtaaccgaatattgaaggacgacagcacattgtcctccacctacatgtacaattacagtatgaaactgtatgcctacgctgtggagccgggccccgtcattttggtggaaaatctgttcatggccacctctccgccgttgttctttccacgtcccaccaaactgacgcgtcgtgcgctgcttgccgaactggtgccacgggtgcgcgagctgtgcctgtccttgtcgccgacgacgacgactgcagttgaagactgtggtgacgcgggcacttcttccgccgcgccctcctcctcctactgcaccgctttgatcccggcactgcccgcctccttctcgtcgccctcctcttccct

SEQ ID NO: 89200 - DNA, 677 bp, Heterodera glycines
  SCN-specific regions: Sequence locations=1-189,212-630,652-677
gtttgagaagtgcttggctttgcttgccatcattcctgtcatctccccatgcttttcccctctttcggcatgctcagcagtgccatccaccaaaatcagcaccgccgttccgtccattctgttcgctatcattcgccgctgctttcatggccgaagcttttcctcatttccatcgcaacaattccccttctccttttgtcgtgcattgacttcgtaagtgccgtttcggacgacggcgcgccttttctgtccgaccaacagaaacgtggcggtgcgcgcgccttcaatctctttgcttctgctgctttcccaccgccgaatgagaagagaagcggcggacgtgcctttggaggtggcattcagacaattaacgacgatttcgatgctaatttggctggagaactgaagcgtgccggtgcccggttatttcggatgagtgacctttcatctgacggggacagtttcgtgccggaagggacaaaacgcggtggtgccaggcccttttacggcggcggatacattgacggagcgtggaaaagagcgggtggacgatatttcttgcgtcaatttgacgatgtgccgtttggcggcggatggatggccaaacgtggcggcggtcgctcatttttcgaaagcaccaaaggcccttttaattctgcaaattattgggctccaca

SEQ ID NO: 89201 - DNA, 649 bp, Heterodera glycines
  misc_feature (575)..(575): n is a, c, g, or t
  SCN-specific regions: Sequence locations=1-290,313-649
attttgatttagatttgttaaaaagtccaattatcactgcattcttatgattctcgcttcttcgtcaaagcgattagcttgtcaattcctcatccgaaaagtgcctcattttgctgtgacttcctcgagaaaagagtccaattggtctgaagttcttgatgaagcggtccccgccagaaaatcataccgcgattttcagacactcaacggaaaccaacgcgatgctttggccgcatcactcttttttttattagtcaatggtcaccgcctatgggctcaccgggttcttgaaaacacctggtggcgagggaagaggtgcattcgaggggcgctcgacaacacgagaggaggaaaaaagaggcgcgggagaggatgatgcaaccaccaagcgacgacaatcccgaagcgggaaggcggaccagaacgcctcacgaaacagagtacaaaaaaggaggacaagagaagacgccccaaaacaaagacagccgcaccccagccgcggacaacgaagaatcgatcagcgggcgggccaacacgatcggaggcaagaccagaatcaacgccagcaaagtaanaagggcacaacacaccagaagacatgaggcccgggcgacagcgctaaagagggacttagagaaagcgaccgacg

SEQ ID NO: 89202 - DNA, 655 bp, Heterodera glycines
  SCN-specific regions: Sequence locations=1-234,257-655
agcatttctcttacttgttcatccaaatagcccaatttggagttcatttccgattcggtgacccaactttcaagtgatctcgtttttctgcttctctttgaggattcgttgctatcatcggaaggcaagtcttgtacagcaaatccttcctccgattttatcaaattcagaccacatgagttgactttctttgtgttgttcaaaaatgtcaaaagaaaactgacctcatccgaaatccaaatattgtcaagttgtagtcctttacatgtgccaattttcgaaaattcacaggcacgggtagtgttggtgtcccacataagcaatgtcttgtcttccatctcacattggcctgccttgaattggcaattgttcactgacccgaggggactttgcataactgtgctcccatgttgtgacataattttagtcttaaaaagataacaattttcagttgagacaatcgaccaactaaatgagccaattagccacattcggggtgacaaatccaatttcttgtcagtatgcgagagtcccgagtcattagttagcaagcctaagctgcactttccattttcggccatttgcttacattcactctgagtaatttgcaacataagtggctcaaaagtctcttggatcggaacattagtgattg

SEQ ID NO: 89203 - DNA, 830 bp, Heterodera glycines
  SCN-specific regions: Sequence locations=1-47,71-154,176-218,241 -260,282-572,595-830
gtattcgtaatctttctaatagaaattatttcacaaaataaataaatatgggagcatttttggataaaccaaagacagaaaaaacgaatgatgcaggtgttggacgagactacaaatatgttgttgcctcaatgcaaggctggcgcattgacatggaagatgctcaccatgttcaaattaccataagaaaggaatctccgttcgaagaatggtcattttttgctgttttcgatggacacgctggcaacaaagtcgcctttcactccgcacagaatctgctccaaacactgctaaacacagcagaatttcaagcagtgaaggaagaacttaagaccaatggccctaaaatcacggaaaaggccaagtcgcttatccaagacggaattcgcatgggcttcttggagttggactcctcacttggcgagttgcagggaggcggagagagggagagaaacggcacaacggcaatatgtgccattctgaccccggattacatcttctttgctaatttgggcgattcgcgtggattgttaagccgaagaagcaacaccatctttagcacggaagaccacaagccttaccttgaaaaggaacgcgaaagaatcattaaggccggcggttcggtgatgattcagcgagtgaatggcagcctcgccgtttcgagggcattgggcgacttcgagtacaaatcagtccctggcctttgtgtcactgaacaacttgtttctcctgagcctgacatttacatcgttccgcgagacaaagaagatgatgagtttttggtcctcgcctgtgatggcatttacgacgttcttgccaacgaagacctt

SEQ ID NO: 89204 - DNA, 952 bp, Heterodera glycines
  SCN-specific regions: Sequence locations=1-24,46-350,373-398,420 -616,638-952
agaagataaaaaagcggctaacaacacttgcagcagcaacaacaataatagtctatcggatgtcaaacagaatgatgacgtctcatcgcttgactcacttggcgtttttctaaaccgttttcgtcaaatggacacaaaaaagttgcaacaattggcttcaaatccgacggtggtggcgcaacccaacagaccaaacgaaggcaccgcaaaagacacaaacaatgataacacttcgatcacatcaactcgggagaaaatgctcgaagtcgtttatgggaataagctaatgggaaaggagaagcagccgaaatttatgtgttttgttgtggatgcgcaggaaagaaaaattaggataatgagcagagaggagcagaaaaaacaggagagttccgccatcattttggaagaccttacggatgaccaattttctcggtttggcaaatccgtcaaggacaaagaggctgataactccgacgcattcgtccattgtgaaaaatgttctctgttctacgaattctgttgccttgatcatccgctttatcagtgcaaagatcgggtgccttcgtcttctcccacagaaattgaggacagagcggcggccactcttcctgcctttctttttattcagaattcttcaattccctccgctgggaaaggagtgttcaccaaagttgatattccaattggaattgtgtttggtccctacgagggcattctcacacaaaatttgtcggaaatggaattcggtgcttacacatgggaattacgtgtaggatatggaaaaccttcctattacattgatgccaaagaccctcgttatttcaattggatgcgctacatcaattctccgaggaatgagtcggaacagaatctgatcgccttccaataccagggcagggtgtattaccgcgtctttagcccattgaccgatcttcggaactattggtacgga

SEQ ID NO: 89205 - DNA, 648 bp, Heterodera glycines
  SCN-specific regions: Sequence locations=1-77,99-648
gtgcaaaatccacctccttatatacaaaattcgggtgcaaaaattcatgcagcaaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctcttcatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccgccagcgcaggagaagtccccggatcagagcgcctacatgtgagaagatgcaacaacgaccggcggatggatggacgaaacctgaagagcgagcgacctgtcagaagatgcaaagataaagaagatgtcccataatcgtgatctgtatttattgatgtattgtacatttgtatgcatatatcatttgctgtgtattatcactttatttccatctgtgttccgaaataaattgaattgatggtcaaaaaaa

SEQ ID NO: 89206 - DNA, 990 bp, Heterodera glycines
  SCN-specific regions: Sequence locations=1-89,111-111,160-160,182-990
attatgagccacccaatttggcaaatcggtcttttaaaacgcattaaagaagattcagtcgattgcttggagtgtaagcaaaaaaacgttattaatttttcatcttcatcattttttggtttaaaaatatatttgtatacttttttatactttgaaagacttttttattaatacagaatttttgaaaattcctaaaatccgcactcctgcgcaggatcctgcagattttaaatgcatgatttgcaggattaatcctgccggatcctgtcctgtaaaaaattttgaattccaatcctgcaacgggatccgcaaatttgaaatttccggtctctaactattaccccatttttttaatctttttgaaaaaaataagcgaattttttttaaatgactaataaataataaagagcttcaaatggccctatttgctaatgtttttaccacaaaatatcttccaaaagaagtgacacttttggtttttcgccggtcaaactctgaatttttttgcgttcgtcgttcgccaacgatttttgagcagacccgccagcaacactcgaactcttcgccacggaatgaccaaatccaacaaatcttagaccaatttgacaagatgcaattgccctctcaaaatgagcctttggcgacttcgcaacagcaaattgtgcaattgtcggagagactcatccaattggcactgacggcgacaaatttggtgtgcaatttgttgcaaaaaaacggagcagcagcgacggatcaatttaaaggacaaacaaaaatgccgacggtggcgactattgagccgaaaaatacgaaaagagacggaagagcggcagaaaatgagaagggatggacttggatttgtgagaagtgtcgcaagcgcaactcaatcctccgttatgagtgccaaagctgcgaaaagggacacccaacggaagtccagcgcgaggcaatcggtcgagcattgacgggagtttggctgtgtttcaattg

SEQ ID NO: 89207 - DNA, 889 bp, Heterodera glycines
  SCN-specific regions: Sequence locations=1-557,579-889
gaacacgctctacgtgcactcactcgacgggcgtgagctttacaaactgccgttgccgatcgggtcggtgggcggtgtttttgcggaaaagtcacagtccaaaatatgcgtcggcttcgaggcgatcctcgacccgttcatctttttctttggcgatttctcaaaatgtccgtcccgcgagtcgcctctccaactgactgagacgcgtcgcgtgaatgtgcccgggatggactgtgatgcattccactcgaagcaggttttgtacccacgcgatgacggcacaaaaattccgatgttcattggccaccgaaaaggcgtgaaattggatggcagtaacccggcaattctcaacggctatggcggcttcaacattgctcagcctccatatttctccattactcgcctgatgctcgctaaacactttggcattgtatcagtaattgcaaatattcggggtggaagcgagtatggggaaaaatggcacgaggcggggatgctcagccgtaagctgaacgtttttgacgacttcattgcggcggccgaatttctcatcagcgaaaaatacacgaacaacaagaagttggccatccatggcgggtccaacgggggattactgacggcagtctgctctcaacaacggccggacctattcggcgccgtcgtcacccgcgttggcgtccttgacatgctccgtttcaacaagttcaccatcggcgctgcttgggctaccgaatatggcgaccccgacaaaccgggcgacttctccttcatttacaggtactcgccccttcattgtctccgcctcacgaacggcgtgaattggccggcaacactgctgatgagtgccgatcacgatgaccgcgttgtgcctcttcacaccttgaagtac

SEQ ID NO: 89208 - DNA, 797 bp, Heterodera glycines
  SCN-specific regions: Sequence locations=1-106,128-130,152-207,332-797
gtgaagatgagcacaatgaagcaattagtccaataataagccgtgaaattcaggctgacattaaaaaatatattaagtattggggcagttgtccccctaagatcactaaaagtgcaattatttcaaagcctaaaaggtgtccttttccttttgggctcccatttcaaataaaattttacttttcgaaatcaaaacgccaaaattaaactctctctctctctctctctttcccctttatctttctctctccatcatctctttctctttgctctccgactcccactctctcccttctcactcctctctgtctcttagctctctgactctctctttgccacctgcactggacctggaccaaaacactgccacactcgaagagcaagaacgccaacgcaccctggtcttcattggcctcccggaaagcaatgccatccgcccatcggagcgtgttcaggaagacagggaagccatcacaaaaatactggaccatcttgaagttgaggcccaaccaacggccgtctttcgactcggacgatacgacccgcagcgaacaacaccacgcccgctcaaggtggtcatgccaacgcccacacaccaacatgtggcacttggaggatggaagcgcgagcgtgttcggctccgttcccaacagaacctgaaccgtctgttcgtccgtccggcgctgtccaaagaacaactcaaagaggaatacgaagcgcgtctccgaaaacgccaacaaaacccagctccgatggcaccggcaactcagctcccacagacaaatgccccgactcccg

SEQ ID NO: 89209 - DNA, 568 bp, Heterodera glycines
  SCN-specific regions: Sequence locations=1-75,97-265,287-568
tctttactcgacaggtcggtgatccgtttccacggattaatcccatcgaagcaaagaaatcccttctctgcagagagtgcgctgacttcatttgttcagcgctccgccagtgtctctaatcgtcagtccccaatccaaaagaaaagacgccccatcaaaagctgtgcaggagtgtcgtgcccacccacacagcccaatggaaccccaaaagcagccgataatggcatttgacgccaacttttagtcggaggagcaccgtcagctccgccgggtcgcctttttctcgattgtgatctccaccgcggcggttatcgcctccatcgtcacgctgcctatgctgtacagctacgtggcctccttccaaagccacttggtccaggagacggacttctgcaaaacacgctcgcgtgacatgtggactgagatgagcatcttgcaccaggatcagggaggcgcacacggcgtgggcaagcgacagtacgggacagccagcggccggcctccagccgggtaatctccgctgctgcgccgggacataagctaccattgccagccaggagccgcgggg

SEQ ID NO: 89210 - DNA, 572 bp, Heterodera glycines
  SCN-specific regions: Sequence locations=1-156,184-401,423-572
gtgcatcgatgcaaaaaatttacgaaagaccggaaaaatacaatggtggaggacgcgtcgcgacaattccattttctaacggagctttgccaacaaatcacagtttgtattctttgcctggtcggtatccgaagggcctttgcggcttggccaatttgggcaacacctgcttcatgaacagtgccttacaatgcctaagcaatattccggaattggctacttttttcatcaacggagaatattccgaacaaataaatacccaaaatcctctgggcacccaaggcaaattggcacaagaattcgctgaacttctcaagaatatgtggtcaggcagatattgcacctttagaccgtttcgactcaaatgcgttgtcggaatgttcgcgacccgtttcaacggatttgcccagcaggattcacacgaatttattgcatttcttttggatggccttcacgaggacttaaatcggcggattaatcacagacaaatttctaacaataggatggatgaaactgaaaaaagggaggacaacgaggaagagggacaatgtgccgaagatgggaaaagtgaa

SEQ ID NO: 89211 - DNA, 657 bp, Heterodera glycines
  SCN-specific regions: Sequence locations=1-657
gtcagaccaccctttttctgtttatgcatggcatccgccgaccaaaaaaacacttcctccgccaccgcttcgtccgccgcttttgccagcgaccccccaaaaatgggggcggaaacaatagcaaagccaacggcaccaccgcaaaaaatgaacacgcattttttgaacagcagtaccacgccacagcaaacgcaccaccgcaacaacagcaagcagccgccgcaaccgcaacaacaaccgcagacggcgcgccgcaactccgctgctcgacggcacacgacaccggacatggcggcttcggccgcatacggaatggtgttgtgcggcagtgatgagatggagcagcggtacagaggacgcattgagaaagtcaaatttggcgttcccgtcaacgaggccttttgtccggacattccggcgacacttttggtgcttttgctcaaagtgaacaaagagggcccgttgaagaaggacatttggcgagcgccgggcaaccaggcgcaagtgcgcaaactgtcccatattatgcaacatggccgcctcgtcaacatttcaaacatcagcgtgtacacagccgcttcggtgatcaagcgttttcttgccaaattgcctggcggcattttcggcgtggaaaatgaacggcaactgttcgaggtg

SEQ ID NO: 89212 - DNA, 600 bp, Heterodera glycines
  SCN-specific regions: Sequence locations=1-513,535-600
aatcgagcccgaactcgaagtgctcggctgtcggtggtcacccagaccaaccgaagcagcgacgtgaactgccgaccgaattgtccgaattttcaatttttgatcacccgagaagtctgactgagtgaaaagccaggccttcagtgctcgcacgccagcgtccttcattagtccgtcggaagtcactctcatattgtcaaaggagttgccgaatcggaaaagttcgtgaattgatcgcccttttttcgtcacccagacgggaatgaaggggtttaggctcatcattggtccaagacgtgcgaccagttcttcgtattcgtcgtgcttgtcatggacataaggcgggcatgtccagaagaacttcacgtgtgcaaaacgacggcacagattcgcgatcatttcgtactgttccatcatcatttcgacagtctctcctctcagaagagagtcgcgtccggcaatgatcagagctgccttcactttgctcgacagtaccactggcttcagagtgcgcactgtttctgccaatgttccgtttttgggcccaatcactgccgtttggtccaggatttccaacaattggtgagctgactgatcacc

SEQ ID NO: 89213 - DNA, 648 bp, Heterodera glycines
  SCN-specific regions: Sequence locations=1-32,54-191,278-648
acttccttctgcctcttccttctcccataatcattttccttcttcctcttcctcaacttccatgccaaaatttcctgttccatttcttgccaattctctcaaaatttcttcacccgtttgtgctgatgtgactccaaccgaaaagaaagcaacgacaatcagagaagttcggacacaaaagcagcaaatcaaaaaggaagaaaaaagcgaagcacaaatagcgcaggaaaaggaaagagaaagggtcaaaagagagaaggagagggagaagaggaggacaaagctgtccgacgcattttctgctctccgttcatccattccgactttggactacaaaacgcccttttccgataaaatggactgtgtaaaacggcttcttccttttggactttattccgagactgaactgtccgatgatttcctacaaaaatttgatggtgaaatgcaaaggcattccgaatttttgtgcgaacggatggattcgttgaaagaacgtttccaatccattttcctcacagaatcattgtgcgaaatgaaagagcagaggaaccttttgctccgtttggatgttgaatttgaaaaggcccaactccaaaaagccaccgaagcaaagggagcatcttttccatttccaattaactcgtcaag

SEQ ID NO: 89214 - DNA, 661 bp, Heterodera glycines
  SCN-specific regions: Sequence locations=1-124,155-178,201-618,656-661
aaaacctcacctcatttgaaaacgcctcatttttctccatgtttaaaattgttttattgtatcatatttattctgcttttatttattgtaaaccattgaagaataattgtgacggaatacatcattacaattttttgttgttgttgtttgctgtattaggatatattccttacaattcgttaattaatgcattttttaaattttgggttttaatttgtcaaatattcgattatttgttgtgcattttattcctatgggctgaaatgagttggctgcccaatgagaatcttttggatgtgttcgcttttttgtccgatgttcgcctcctccgttcggtttccttcgtttgccaccgcttttggcgtttgtctgagttggcacttttcaaatttcacccaatggtggccaaaagtgttcgcatcggttgggacccaaagaatgcttcgcactatttctttgttcaaagtgtaaaatgtgccgtggctctttcgaatttggcactttccgttggcccatcggacaattcgtcgtccaattggcccccctctctgccgcccccaaatattgttggaatccgacgcattcgaatggaaggtcatcagtttaattccgttgaattatttaaaatttgtaaacattttttggtggcattttttgttaa

SEQ ID NO: 89215 - DNA, 824 bp, Heterodera glycines
  SCN-specific regions: Sequence locations=1-160,200-824
tgtgcttttaacagataaaaatgttttcaacatttttatgcctaaaaatttcgaccccccaaaaattgaattggcaaattctcatatttctcgggctccaaaccgagacaaatattctcaaaactaagttcgagtcttgactattcccttcgtgttttggccaaaatttggtcccgaatttttgggccaaaatttcaattctcgaattttctgggtttgggccaatcgcatctctcgctgctcaagaaccgggccttaattcttgaggcccccgagtttctgccatagtgaattgccaaattaaattctaaattcctggaccatgcccatggcggtatgtgactgcgtgacggcaccgtcggcccatcggcataactgtgccggtgccgcgcgtgcggtgtggacacaaaggaggacggtgccgtgccaacgcccgctgaaaattctgccggtgccaacgctccaaacacttcggcgtccatgcgcagcaacatttcgttgagcactttgaagagagggcgtgcgtcgtgttggagttgcgcattagcatcaaacaaaatgtgccgaagcgcgtggccggcaaagtcggggtgaagccgactagtgatcagtgggccaagcgagaggaaaagcatcggaaatgggccgttgggctgcgagtgcgcggacgactgaggcccatcggtgggctgcatttgtggcggtgtttggacaatcaaaatcagaatgtcttcgccacattcgcccaaatgccatcgttcgcgcaacacttgcgcataattatccgcaaaagcggtgaatgagtcgaacagattacttaattg

SEQ ID NO: 89216 - DNA, 592 bp, Heterodera glycines
  SCN-specific regions: Sequence locations=1-198,291-592
ggcgcctctcggcaccgccggacccccttctttcccaagagttttttggaataaacacgccgcaaaaaagtgatgtgaaaagtaaatctgaattcaaataatattcgatcatttagtccaaaatgattaattctttgaaataagtgaagaaaatttgtttgaaaattttcattaatttaatttagctctaacttttggattttattaaataaaaaacaaaataaaatttaattttgtataattttctcttggaataaattaaatttgaattttttgaatttttaaaatttcccggttggtcccggtcccgaacaaaaatcgaggtcccggtcccggcttctcaggtcccggcaagtcccggtcccggttttgcccaaaattcccggtcccgcttcactctagtaaaaacctaagaatcctctccctactcatgattcagctccaatttgcgaatcttttaaatgtttttgctattgtcaatgtccgggcgctatactgtgcttttggttcgcacctttaaaatacgtccatttttcagttcttacgggttttctagcaaggaaatacggaaaagcttttttgacttttttgt

SEQ ID NO: 89217 - DNA, 596 bp, Heterodera glycines
  SCN-specific regions: Sequence locations=1-596
aatattcagaaggcgaactacacagtgccacgcaagattcagtcgcttacctttccgttgatcaaagctggtaggtcataacattattcgacggatgcgaattgaaacaaatttaggacacgacttgaagggtcatgcagagacggggagtggcaaaagtgcagccttcctgcttccgatcatcgatgccgtcatgaaacttaaaaaaggtggccattacaaatcgcggcgctgctgtccgtttgcccttatcgtggaaccaactcgtgagctgaccgttcaggtgtacgaccaggcgaggaaattggcagaaggttagtgctcatttcatgaattaaaccaggcaggctttactgttttctttgaagagtgtgatgtgtctgtgtctcgcgcctacggaatgtttctgcgtcatgttaaccttcgtcaaatttctacggatggttgtgatattttggttggcactccgggacgtctttgtgactttttccaatcaaaaaatgtaaaaaaaaactatattattgtctatctcataattttagcttttgtgcgaccaaatcaaagttcttgtctttgacgaggctgaccaattgctg

SEQ ID NO: 89218 - DNA, 647 bp, Heterodera glycines
  SCN-specific regions: Sequence locations=1-176,198-647
ctttggcagcacattccagggtggtcgcggacccatttttgcatactttgaccatccgacacgaggatggaaacacttacgaagttaatttgttggaagaacaagcagctgatcctgaagccgcggcctacatttcgtttgtcagggatggggaatttccagctgatttggatgagaaagaaaaataattatttgctgtaggcactgccaattacaaattaatttcgggaattctttattttgaggacaagggttccccccccaagaatttatgtaccaatttcattacgtgggctcattttcgaatcgtttcactcctctctattgggagacggtcatttaaattacagaaaaacaattgccaaatgcaaaaaatatttttgcggaaccaagaaagtatgaacttagaaaaaggaacagaacttggaaagatttagtaaattattgaaacttattcgactactttcaatttttattttttcactttggtttttcctctcttcccgccactcaatcaaaatcaatgtcatccaaattaataatggtatccttttcttttgttttcttttgtggcacatgcccctttttcttttgtctcgctctttgttcccgcttccgtgccgcgagctctgcgagacggttggcat

SEQ ID NO: 89219 - DNA, 984 bp, Heterodera glycines
  SCN-specific regions: Sequence locations=1-415,437-984
aatataatgaaagccaagcaaattggacgcacaaacactacacggatttatcttcaccgattgttcattatccttcttctaccaattcgccatccatttcgccttttctcccccaatttcgttctctttcgtccgctcccaaccgtccccaacaattgtcctcctcatcttcggcttcttccgattcgtctttgacttcttcgaccgcctcgtccactttgaattccacgaataacacaaccgaaagcgaggaaccttttcacggccaaagccgcaagggaacgtcgcaggaagagagccgaaatgagacacatgcttctcgcctggacgattccatcctcaaccgtttgttgcacatcgaaccgccaaatgggaacaagcaaaagtcgttgaacaacacatgccatacatttgtgacgaacagccgaaacgaaagcccaagcgatttccgttggattgaaacggccgatggacttggagaaaacaatggaagaaaaagctgtgaccataacattggcaaagagttggacaaattgcgcgacgattttcactctttgcaatttttgcatgctcaaaatggtcgtcagactaaagaccgattggaaactctggagaatcgcatgaccgaattgaatgttaagctgagaaggttggacatacaaacggagacaaatgtgggcgaacaaaaagcgcagatgacaagtttaatggttaaaaacggacgattgtgcgaaaagcttggcgaacaccaaatgggactgaaagcagttcaaaatcggattgaattgctggagcagtgccatctgcgcgagttcgttgcgggtcttccgcccgttcatgaggacggctcattggttttgtctcaatttgaaaatggcaattatttcgcagagatgaaaatactgttccagtcgggttctcgcttttgttcgggctttgccatcaaaagctcggcacactttcgcaattatccgtcgaatttat

SEQ ID NO: 89220 - DNA, 638 bp, Heterodera glycines
  SCN-specific regions: Sequence locations=1-253,275-638
ctatgacagtgcggccaatcaggatgcagctgtaagttcatctgttgtttaatctgtcaaatttatcaattattttgtttcaaggcagcatttcatcagaacagtgccgactacgaagcaatggtccgagagcatgttcttcaaaatgcgatgccgcaatgagcgtttcgaggacgaagaaacgaaagcgaacgcaacaaaagaccaaaatgacttagacttttcagcagagacacttaattatgctaattaattgtttgtttgtttgtaattagtcgtcagccctccgtcgctttcaatgctttgagccaatctttcgcgagatttcccaagccctgacttttcttttgttgagaccgtttttctcccaatcactgcccaaataaatgaaaaccatccgccgatcgttttgagcttctttcttttctcgcacaatcccatttctgacagcgcgccgtcgagtggattcatagagtgtgcatgtctctcacatttccttctgtctgtgcctccccctcaaaaaggtgcgtcagccgtcgtcgttctcccaaagccttccgccggccaatcgatttgtgaccattaaattttgtctggttctttagccccttgcccacttctcatcctttaatctaaac

SEQ ID NO: 89221 - DNA, 605 bp, Heterodera glycines
  SCN-specific regions: Sequence locations=1-184,206-393,415-544,568-605
ctcttcaacttcggcatgatcagtccctgttcttcttcctccattcactggccattgaattggcgtcccttcgctttgtttgtcgtcctttttggctttttcactgcaaatagtcaaatgtttgtgtccgcttctgatgacaaacgaaacagcttcggcagagatttccttcccttcggcaaaagaattgccaactccgaagaaaactttcaacgcgattttatggcatttggaaaacgttcgccaaatgaggccttccaacgcgaatttatggccttcggaaagcgaggggcaccgtctgatcacttccaaagggattttatggcattcgggaaaagagtcccggacggatttcagagggaattcatgacatttggaaaaaggagcagtgacattggcaggggaggatcattcgacagggaattcatggcatttgggagaagaaagtgaagccgaaagggagagacggcgcgagagaaaaggacggcacgcactgatctaaggatgggattgatctgatcgacagaaaacagcaaaataaacagattcaaatcaaaatattttctgagacgaaaagcggatgacagtgaggatgttgataaaag

SEQ ID NO: 89222 - DNA, 626 bp, Heterodera glycines
  SCN-specific regions: Sequence locations=1-626
ctaaaacagaaaacatctgcgaatacaattttcataacattttgtcaggtcactgatggattttgaaaatgttggcacttccgtcgctgctccatttttggcaccattgagcggaatcgttgtcacatttaccggattgagcaaagaaaaacggcaagagttaattggtttgctgcacgaaatgggagcgcaaagtatggcggcgatgaattgcaaagtcactcatttgatcgctgagagatgcgaccccgaatctgagaaatacaaggcaacttttccagaaacaaacggcgccgttttgagttgccttgcaaccacagctatttagttcgctttaaggaagctcggcgcaggaaattgccggtgttgttgccttcatgggtttttgctgccaattccatggaccgccgtttaaaggacactttaaatgtcatcacttcagagaaacaccttgacactcataaaactccactttttgctggatgtgtatgtttaataatcttccttaataaattcggtgcagccttcgtaaattgggtttcacgtcttttacttatttctattgacttgtactctctctcacttcagggtcattcaataggtatattatctttttatttgcataa

SEQ ID NO: 89223 - DNA, 1176 bp, Heterodera glycines
  SCN-specific regions: Sequence locations=1-351,373-1176
ccaattcattcgttttcccttcttttttcttttcctccatttctgtcaatttgattttgatttctcttggaaattctctgaaaatgccttcctccgattttccgatgccgtacacttcacggctcagtgagccttgcttggcaccaggccaatctttggtcttccaagggtccgttgattcggatgctcgtcattttgaactgtctctgatcagtggggtgcctaactcaggccaagagcgcatcgcccttcagatttgcttccacttcgaagtcggcatcaccattttgaactcgatgttggaaaacggcgaatggggcgaggaggagtttcattcgaatcccttcttccatgggaaaccatttgatgtgcgaattcgagtccacgagaaaagattcgacttttttgtcaaccaagtgccgtgggctgtgttcgaacaccgcacggatttccgaaaaatcgaccacatccaagcgtcgggcgacgtttcgctgtccgccgtccattggggcggccgatacttcgaaatgccgtacgaaatgactttccacgaccacgcgctcgaaagtgggcagcgactgttcgtttatggcattccccgcggcgatttcgccgtttcactgatcagcgacagtttggaggagctgttcagaatgagtgcactgttcgacaagcaaattgtggtccgaaatgcccaaacggacaaagaatggggcgccgaagaaagtgaaggaggccctttcccgttcagaaagggcgaggggttcgacttggtcattctgaacgagccattggcactccaaatttccatcaatggcactcccttctgttcatttttccaccgcaccatcgatgcccacaaagactacaaaaaggtacgcattagcggtgaggtggaattgaccgggatggaagtgagtctgtgctgggaaagtgttggaggagtgtccaattgctgcaaatatccggagggaagggcccagcggacgaacgcggccggggagaacgtgcagcagccgattggactgagccgttgaaaaagcgcgcggggaaaggctaatgaatggacggctaatgtcgttcggtccagcggaaacgccgtttgatcttccgctaatcattcgaaattacattaatttgatcagtgatcactcatttattcccatcaattttgtg

SEQ ID NO: 89224 - DNA, 653 bp, Heterodera glycines
  SCN-specific regions: Sequence locations=1-195,222-391,421-564,586 -588,612-653
gtccaatgtatcccaagcaatcattcaattccggactgctcgacagcttcgtcttccgttccgttttcactctccacaaataggggctgctcaatgagtgaaaataattttcggtcatttgccgtacaatgtgccaaaaattcgtcgcaatgccgtccttcgtccaccatcacttaacgcttctgtgcctcttcctcggcgccctttgcgccttcggtgccgtcccttcgctgtgccaacttttgggcgcccctggcggatgttccccaatcgccgttctcagcgcggcgcaacagccaaacggcggcggcgccgcggcacagtttcagcagccctttgggccggcttttggctgcccgctgaatccgctgggtgcttttgggcgcccatttcccccaccgccgccgcccccaccgccgggcatcggaggccaatttccatcgatgcaaggccagaccgtgaatcttagcccaaatttcatgggcggaggccaacagcagcagcaaaatgggggggaatgccttcggcacaatgggcggcggcggcaattgcaattgtggcacgtgttgtcagcagcagcaggagacgaacggcaacagcaacaacaacaattttattggcatgccaacagccaacgaatttaccggcttcaa

SEQ ID NO: 89225 - DNA, 800 bp, Heterodera glycines
  SCN-specific regions: Sequence locations=1-800
ggtaatcacttaattaatatttgctcgtgtgtctggcgatgtttgatcaacaacagaatctgacccttccgggcccttcttccgtttatttgccccccaacgacagcgaaatgttcggccgaggccaaaacgaatcggcgattgtttctgtcgtctgtgaggagcattatgactattatcagccaacagaaaaatggcttctcggcgtcgtggcattgcctttcattctgtgcggcctttgtgccaatggaatgtccgtcgccattttttcccaccgccaaatgcgccaacagtccgtcaattggtaccttctcgttttgggcttcagtgatttgatcgttttgctcggcgccttcttcgttctcactttgccgaggctaagcgaaattttgcactggtggagagggacggcgataagttattattcgacccctttgatgtattcgctgatgacaatggcgcaaacgaccagtgtttggatgaccgtggccatgtctttgcatcggttcgtcggcgtgtgctttccctaccaatccggcaccgttttggccacacgaaatgtcaaatcactgattgttggcattctttttgtggccatttttttcaatggatgccgattttttgaggtcagcttccaagtgtgtcggatgaagccaataaatgtcgaattgcccgtcctccgaatgaccgcactcagacaaaacgaattgtaccgcaaagtgttctatgaatgggcgtacactttgattatgttcgccattccgttcactattctgattgttgtgaattcgatggtgatt

SEQ ID NO: 89226 - DNA, 944 bp, Heterodera glycines
  SCN-specific regions: Sequence locations=39-850,872-944
aaaagaagaaaaggggggaggaggagaaaaagcggacaatggacgctgaaaagagcgcattaaacgaaacagtcccaaccgaaagtaccgccaatttgactacaatggaacaaacggtccctaaagtaaaggaagtgaaaccgaggaggtcgctgttggcccaggcatcccaacaacggcctccgttgccacgcgcatctgcgcaaagttcggccagtgcccctacgcaggttgctctcccacggagccattctcgctcccgaatcactccgtctgctcgtccggtgctcagttctcgcgaaaacacttccattgcactgaaaggaaccgcaccaatgtctgggatgacccgtcgttcaatgaccacgaaaagtcagtcggttgaacacgtcgcagtcgcacaaaaacatttgtccggcattggccgaaacatcgcaaacggaaggacgaaagagtcgaaaagtgcgaatgcatccgacagacagcgaaaggaagtcgaagacgaactgaacaggacgaagcaaatgctgaaacagaccacaaaaacattggatgtgttcgctgtggtggcatcacattttgacagaaaattggacaatgccaacaccgaatcggctgttctgatggctcaaaagggcgacgaggcggcgcaacaccaaagggccatcgccgagctggactgcaactggaaaaagcgacttcagcgggcgaaggaggaccatcgagtggaattcgatgaattacgcgcaaaaatttcttctgaacaagcggaaaacatcacgaagatccaactacagcatcaaaaaaccgtgaacgaattggaaaaacatgtacagaaactcggcaaaaaactggcggaacaagaagaaaaacaccgaagggaattggccgaatcggcgagtcaatcgacaaatagacttcacaaagaattggagagtcggaat

SEQ ID NO: 89227 - DNA, 633 bp, Heterodera glycines
  SCN-specific regions: Sequence locations=1-110,133-488,511-633
atttgaaatcactccgccgatcattcacaaaagctcaaaaataatcccccgtaaagcgaacacaaaatgagaatgacccaagacgcaaatttgagcactttttgtgcccttttcactttccttctgattgttgaaggaactttcggcatttttggcattggcagcagtgacaatgacacaacgacgacgacgacacagggagggggagggacatcgacgacgacggcaaaaccaaagggaggagggacggcacacgacgaaaaccattccgatgactcatcaattcgcggcaaagcgcgcgagaagcgacagcaaacgaaccaacagcaacagcagccgaacttggagtctttgcccgtatgtgctaccggacagtcgcccattgcgccaattccgcccgccggccccgtccttccgatcggcgccattccgcccaccgtcgtttgtctgaagtgccgcccgcccaacggcccattgtccgggaacaatggcgcaaatggcaacaacggcacttaaaagcatttgccattggacgctttgtgaatggcaaccggtgaagaaaaaagagaactaataaatgccatggaaaaagcatttggacgaacgctgactaatcattgcttcttgttttct

SEQ ID NO: 89228 - DNA, 913 bp, Heterodera glycines
  SCN-specific regions: Sequence locations=1-325,347-739,761-913
ggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggccacaaataaaataaaaaatggctaatatgtaaaattggcgtccagaaatttttagactaatccgaagcaaagcacgaatgaattaaagaggcgaaagaattcacagtatcgtttctaatagggaaatattgacagaatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaaaaatgaagttgatgcctcatgaaactcggaattggttatgtttagtcgaaaatatccttacataatactc

SEQ ID NO: 89229 - DNA, 596 bp, Heterodera glycines
  SCN-specific regions: Sequence locations=1-391,424-534,556-596
ccctcaaataaatgggccttttccgtgtgctcatctacggcattattctcggcgtttacgccagtgcgttgttttacgatgtccgctttatgccgcggctgggcgtcgtctggtgggtggagaagctggtgatgttgtccatgctgaatttgtctctccaatcgttttacgctttgctttgttttgtctgtgcgctgttcgattggaacgaagaatttgtgcacggcgaacagcacaaaaaggtgaaggcgacccacgtgcccagctattggcggcgcagtcggctccaccgcatttgcgactttgtgtacgccaccgccgcatttcccgtcggaatggcaagttctctgatgttttgggctctttatgtggccgaccctgagttggtgatgcccgcctgggtggccaagctggtgcctgattggcttaatcacgtgtctcacacggcccccgtcgcttttgtattggtggacactttgctgacttgtcaccatgcacccgatcggaagattggctccactgttgtcgtcgcacttttccttttctacgttggaataattatatccgtccgtctgatcagcggtcattggctgtac

SEQ ID NO: 89230 - DNA, 576 bp, Heterodera glycines
  SCN-specific regions: Sequence locations=1-284,310-535,557-576
ctctatagccttttttgggtccaagaattcgaatatcttttcggcaccttatcccgaccctgatcccaacccttttttccttgcatccatagcattttttggacccggaattcagtatttcgaaaattgacatcccgaccgtggtccaccaatctcccttttccccaacaaacattcttaacgcaacaaaatttggggctggctctccattgttcaactctcatcaaaaccaatgaattttgcttgggcctgacttgtcccgtcccaactgagtacacaagagagccaaaaaataaaacatttttcgtttgcccattttggcggattgaaaatgttcagtctccccgttctccgttcacaaacacagctccccccccccaatctcaaatttcgcgcatcaaccaatttcactctcggttagtttcacaaataaacaattctttgccaaccccgcgcctccggggacggcggacggggcggggatcgggcgagatgagtaataaataccccaacccaacccccgcccccccctctctttttaatgtcatataattcacacaatgttcttcacttcct

SEQ ID NO: 89231 - DNA, 1220 bp, Heterodera glycines
  SCN-specific regions: Sequence locations=1-727,750-1059,1081-1220
gtccgtccttcgactttacccaaccgatgaagtcgaatacggcgaacagacaaaaacggagcctttgagtgccacaatgttcgaagctctgagccgacactttctcggcattgattttcgcgagagaaatgccggacatcgaattgacgaacacatgcgcgacgaagggttcaatgtgaaggcgtacatcgacggacattccggactgatctttgggggcaatcgatggaattgcggcacgtggatggacaaaatgggcagctcagaacgcgcgggcaatcgcggagagccggcgactccgcgggacggcgcggccgtggaactgcagggactcgccctttgtgtcgcccggggactcgaccgcctctgtcgcgacagggcattcccttacaacggaatgaaaggagaatcgtcgtcctttttgtcgtggtctgattgggctgcaaaaatccaacattcattcgaacaacactttttcgtcgaccacaattgccagtcggagttcgttcatcgccgtcccatcgtcaaagattctttcggcgcttccctcgccttcgctgactttcaacttcgtcccaatttttgcattgctttgaatgcctctccggacattctcccccctgaaaaagcatgggccgctttggaaattgcaggcgaagttttggcgaaaaatgctccgtacggaatttgtactttggacccaaaagattgggcttacaacggcaattacgacaacgacgatgatgggacgaacagaatcagtgccaagggatggaattaccaccagggaccggaatggctttgggttgccgcgtgttacatgagtgccaagttgaaagtggcctcgctgctgttgcacaagagtggtgactcatccgcttggctgtccgccgtgggcgaaattcgacagcgattattcgccctcgagcaatgcttgaaccgaagcgactgggcctcgcttcccgagctgactaatcgcgcgggggcattctgcgcccattcgtgccctgcccaggcgtggtcggtcgggtgtgtgatggaaacgctggacactttggaagcaatggaaaaagaaggaatgaatttggaaggacgaaaaagcgatcgaagggcaaatgacaaacagaagaagcactgatctgacagatcacttcactttcaacacttacttaggcattgttagcactgtgaacttattgcgagccgttaatcttcggcta

SEQ ID NO: 89232 - DNA, 1729 bp, Heterodera glycines
  SCN-specific regions: Sequence locations=1-104,126-141,196-315,338 -1729
cattcatcaagcgaatatggaacgagtgagagaggacgaatatgaaaaaattggtctgatggacattaaacgggaaataaaagccgaactcaatgaagcgattggtcgccaaacggaagatggcgaaacggagccaaaggcggagagagagcgcgagaggaaaagcgacagagagagggagcgcaagaagaagagcaagcggacttcgcgagaccgaagccggtcgaagtcgcgggaacgcaaacgatcacgcgaacgccgacgaagtcgctcgcggtcgaaggaacgccaccgcgagagagagcgaagccgagaaaaggaaaggggcgaaaagaggtcgaaagtgaagagcaacaaatattgggatgtgccacccgctggctacgaacacatgagcccgaaggagtacaaagaactccaagtagtggtcgtccattagaattgcgcaagggtgctgaatcgatggattttttagcatttaggtcttctgtacggtgctttccgaagcattttggcggaattttaacttttagcactcaatttggtcgtctcgtcgtttttcagatttaagatactccgccaaatgttaatcgatatgaaagtcttttaggttttaggggaaaacggtgtcctgctgcatttttggattcatcccaacccaatagcttatagggtgaccgagcacaatcacctcgcaacaaacgcagaatagcattcccactttcttgaattcaccacttttattttagctaccggcgccatccctcgggccaccctccaatcgtctgttccggtggtgggcccttcggtcacttgtcaggcgcgacggctttacgtcgggaacattccattcggttcaaatgaagacgcaatgctggacttttttaaccaacagatgcatttgtgtggtttggcacaggctccaggaaatccggtcattgcgtgtcagataaatttggacaaaaacttcgcgttcattgaattccgttctattgacgagacaactgctgggatggcatttgacggtataaattttatgggtcagcaattgaaaatacgacgacctcgcgactatgtggctccaaccactaattacgaactgcttggcagaatgccagtctctaacattgttgtggacagtcctttcaaattatacattgggggactccctaaccatttgaactcggaacaagtcaaagagctgctgagtgcgtttggacagctgaaggccttcaatttggtgatggacacgaccaccggaatgtcaaagggttacgccttttgcgaatatttggaccagtcgctcactgaccaagcagttgttggtctgaatggaatgcaactcggcgacagtcgtctattggttcagttagccgctgctggagcacgtcaatcggtcacccatccgagcactgcggttcaaatcgcggggattgacttgtccagaggagccggacccccaacggaagtgctttgtctgatgaatatggtaactgaggaggaattgcaacaggacgaagtttacgaagacataacggaagacattcgcgttgaatgcaacaaattcggaaatgttgtgagcatggaaatcccgaggcctgggtacgacgagcgtggtgttggaaaagtattcgttgaattccaatctaaagaagaatgccagaaagctcaggccgcattgactggacgcaaatttgatagccgagtagtggtcacgagttacttcgac

SEQ ID NO: 89233 - DNA, 969 bp, Heterodera glycines
  SCN-specific regions: Sequence locations=1-716,739-969
cgttcgttctctttggcccattgaaagtgtctgcgatgtccgccgcctttgaacgtttctttgtcgcgtgtgatattcctgccacaatggtgcccaaatatgcgagtcgattcgtcaaggaacgcattcatcccgcactgatgaaagacctcggcaaagacgatttgcgtgagttgggcgtcacagcgttgggggaccaattggcgataatgcgctacataaagcaatgcgaagggaatccgccggagtttaattcggtcgaacaatcaaagcgaaagtcggagtcgcgcggaagggaaactgccgattttgaaagtgacgaagatgaaccgatgctggtcgactcaaactcatcgagcagtttcaaggcccccgaccgagaagacatttaccacataaaaatgccaattggaacattgccgaaaacgcgtaaaattttggaaaagaatcgctctcttcgcgacagaggtgtgcttaagcgtggcgtttctggggttcgacggtccggcattgaactgaacaaacctctgaacacaatttcgactcggtccaaagtcatcggtcggaaggcaatcacgcttcaagacaccgacatcacttcctcgacggcatttgtccctttggggtcaatgcgaagcgattcgatctctacgaaaacgaccgttgtggccgacaacactggcaactcgagacctgtgagtttggcaaatcgttttgcctctctctccggtgctgcgccaaacattctctttcaattggggaaagtcgtcagtccctccgtacaactcatcccatcgcgtcgccccctcgtccgatacagcagtgacattgacgacttctccacaaccgccgagccattcagcgaacttacaacagaaatggtcagaaaagtgcgcaagaataacagcgtaacatttcaaccgccggcgttccgtgctccaatcgccgaacgtattcaaattggtggac

SEQ ID NO: 89234 - DNA, 674 bp, Heterodera glycines
  SCN-specific regions: Sequence locations=1-438,460-674
aattcgattttatctttgggttcatatttctcggctatctaaatgccaatgctgaatgcgtccttcgataaattcaatatttctaattcggataaaatccgaacccagcggctcatatcaatgagtgaaagttgcgaagagtggaaaacatgcaccaagcgagaaacatatgcacttctcgaccaggagctgaacaaactgttgaccacgtcaccccccgagaaaatggagtattggaaaaatttactcgatggatttatggatctttttgctcgtttcttgcgcgccaaaaccaccgtcgaatggtccaaaattgagccgttgcccgaaggggcaataacgccgtattcgaagcttgaacaaacaccgcgggaccgtgtccgtgaactactcaatgggttggttgtggtgaagctgaacggcggactcggcacttcaatgggctgcaaagggcccaagtcgatcatttccgttcgcaatgagctgaccttcttggacttgaccctgcagcagattcagagtttgaatcgtgaattcgaagtcaacgtgcccttgggactgatgaattcatttcaacaccgaccgacgacactaagaagctgcctcaagacagaccccacatgtttaaggtagagggggcacttctttttgcccaagtcgagataccccctgta

SEQ ID NO: 89235 - DNA, 875 bp, Heterodera glycines
  SCN-specific regions: Sequence locations=1-652,674-875
ccaacgtcaaaaaggcagaaatgcgacttggacagctaaacaaaacgttgtcgaaaaagcggagtgaactgcagcaaacttcgcggcattccctttctcaaaacgacaccaaaagggagttggaagttggcatcgaacagcttgaacaaaagttacgcgccctatactttgatccgcagttggaccaccagcttgagcaggagcgtgttcaattggccagagaaagagggcaatgtgcgcaagaattggaccggtttgaggccagaaatttcaaactgcgctttgactatacaatgccttacaacggattcgaccggaacaaagtgaagggcgtcgttgctaaactgtttaaaatgaacgaacaaagatatgccacggcattggaagtcgttgcgggtggtcggttgtttcacgttgtgatcgacaaagtgaagaccggcgaggatttgcttaaggcggggctgccccgtcgggggacaatgcttccgctggacaaaatcagtgcaaatgttctcgaccagcggctaattgggcaggcaaaacgaatggtgggcgaggagaacgtgttcttccccggagagctgatcgaatacgaacgggaaattgagctggccattctcagcgtttttggcaattgcctgatttgcggggacatggaccaggccaagcagctgacattcgaccgggccataaactgtcgtacagtgacattgtccggtgaggatttcaagccgaccggtgtgctgactggcggattccggaagccggacgcgtcaattttgactgcgctcaacgaaatcagtggacaatatgaacggatccgagagcttgaccaccgaattggcgcaattgaaagggaactcgcaagactgagg

SEQ ID NO: 89236 - DNA, 1611 bp, Heterodera glycines
  SCN-specific regions: Sequence locations=1-56,90-270,292-481,503 -1146,1174-1505,1527-1611
gatttgtgttgttcgttttaatatttttcgtgtccactgattttactgtgcatcgaaaggacagaaaagaaggaaaaggcgggcaaaggaccgaccgaccgaagacgccaccgccgcaatgcccggcggatccttcccgccccttcccccgacgacgtcagccaccgccaaacccaccaaacagcgtcaccaaaagtcctcttcttcctccgcttcgcattcgcctcattccgactccgtcctcttcctgcacacctccgtcaacagcaccaaacagcagcaacaggaacaacaccggcaacggcccgtctctgtcccaccgtcaattggccctggcgtttttgcagaatttgacagcaccgaaggcggagcagcaacagccgctgatacgatgaattttctcactgagaagagttcgacaacccccgcaatgtccgctttgctcggccgacagccgacgatcaccgaagacgaagagaatgagcgggaggaagacgaggagcccatttcaatgcctgattttggtgctgcggtgacgcgcattgtttccgatttcggcgctggtcgtgtcaaaagtgaggcgcacgaggaagtgattatgatggaggacgatgtccgccaccaacaacagcagcaaatgccgcgttttgctggcaaattaattggcgacggtggcgaatgtcgcgatggaagtgccgaaggcgccgcccattcgatacatttgaaacgggaggaggaggacgccgcgggagccgaacaacagcggcagagggaagaagcggaagacgcggcggatttgggcgcggacgcactcaaagcacggcgagcagcgcggcagcggaaacgcgagccggtggtggtcgggtgccgcacattggagaaggcaatgcgaacgacggccgaagacagtgacatgtctccgctggagcaattccttctcggctccacgctgctctcccgtctctgttccttcttcgaaatggcatttgccgaagcacagcgccaacagcgcgggaaattcaaattgccaatcaaagactacggagttggcactgacggagtgatgagcgcgacatttccgagttaccccatgcccccgtccctcgcttcttcctcgctgcccaatgcgctcggttcgcccggcgaccattctgtccaccagcagtttcacccctccacccattgtatggttcgtctccaactgttcgtctgtccgcagcagttccgtttggtctccatgttggactatgccaccggcccccaatgtccggctgagtcggacgtgcgcattttcgagcgatatttcgcccgcgaagtcgtccgtatgaacaacgaattggccgtgttcgctttcgtcactctgtgccgtttttgtcacccgccaattttcgcctcctttgcccaactgatgatggcccaaatggagtcccaaccccggtggccatggcgtgtcgaattggaattggtacacaatgccgaggaatcggcccaacccacgggagcgaactctcatcagcagcagcagaagacgcaaaagatcgtcaaaaacagcattcaggtgcccgacatgtgcaaacgctttgtgtttgtgatttggttgaggccgcaatg

SEQ ID NO: 89237 - DNA, 662 bp, Heterodera glycines
  SCN-specific regions: Sequence locations=1-68,127-212,243-339,391-662
gcgtattaaaaaaaatttgctccttccaaaagtgttttcttaatcgtttttaaagcatgtttctgatgaattttaagaaaaataatttttaaaaaatggcatttttaatttcataaaaaaaattatgaatccgtgtacaattggcagcatttttcacatgttcttcaaaatgttaacaattcgtcaaaatatagccaattttttcaccgcaaatcattttttaaatttaattttccatttaaacaaaaattattatcatgaattgaccacaaaacacagtccacttgtccatatagatcggaatttttggatgataaatgagctaacaaaaaagggttgataattttctaataaattttgacatttttttatatataattaattaaatttgttcgttaattattttaaagcaattcagatttatcatattttgcaattgctctatgcgcattaactgtgttttgccctttctctggtacccactttctcgtttcttcgtggccatttcgcaatttttttttgtggatacttttgccggattctgaatttgttcaagaattcaaaaaaaattgtgatggtcaattttttgtaatgagtcggaataatttttgccataattactcatgctttaatttaaatggattttaaccaattttatttgt

SEQ ID NO: 89238 - DNA, 486 bp, Heterodera glycines
  misc_feature (201)..(201): n is a, c, g, or t
  SCN-specific regions: Sequence locations=1-21,44-60,100-108,130 -363,390-432,482-486
aattaaatacaggtctgataaagccttttttgatcatttctttctttgatctttttgggcctgatcatttttgtttcaaaaattattttccataaatttatcgccaatcacttaaaaaattcataaaaaccaaatcctgtacgaaagaccgaaaaatcgccaattttaaaacaccacggcaaatttcaaccaaaaactgcnccataacttttgtcaaagtcaaataaattagacattcttggtatcattcgatagccctaacatttctctattagctaagctaaatttcaaaaaatttggtcaagattgagcaaagttatggccaaagcacaatgtaacaggttttcacacatttttggccataacttttttaaaaccttttaaaattttgcatgctaatagaggacacataaggctatcgatagtatcaagaaaataaaaaataaacattatttatgaaagaaattttttaattaaaaatgaaat

SEQ ID NO: 89239 - DNA, 1606 bp, Heterodera glycines
  SCN-specific regions: Sequence locations=1-781,812-878,923-1052,1083 -1095,1117-1166,1202-1205,1231-1266,1288-1298,1345-1358,1392-1606
gtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatgcagctcgtctgtgtgttaaagaaatttggcgagttaattgacttgtgtaaatgttgcctaaggcacaaatgctgtggggaactcagcactggggatgctgaacctaaagttggtggtggtgttggtatacgagtgagtggcgtattgccatggttgacaagccctatgagttcgtggatcggaactccttgcctggggaccagtgtgcttgcattcgaaaaaacacgagacataagcgcccgaaggcctttggcctgaggaagtgtcctaaccgggaaatccggagtgctcgtgtgagtgcctgtgcactgccctcggagctgtgtccagcggcgagatggttcttcccaagtccgggaagctcggatgcctggccagcgctgtgtcattaccacttgctcggtcgccttcgccgcccatgcgcacgcttgcgctgaacggagttgtttctgctgaaactatccgtctttacaagacggctgtaatagcggcgcttggcaacgctcgctagcagctatctggttgatcctgcctgaactgatgtgttcatttcaaagattaagccatgcatgtgtaagtttaacctgccagacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgccctccgggcgtccagtgttgactcagaacaactaagctgatcgcacggtcttgtaccggcgacgtgtctttcaagtgtctgccttatcaactttcgatggtagtgtatctgactaccatggtgatgacgggtaacggaggataagggttcgactccggagaaggggcctgagaaatggccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcaaagtgcttcaaacaggcgttttcgcttgaatgctcgtgcatggaataatacaagaggatttcgctcccattttattggttttgcttgacga

SEQ ID NO: 89240 - DNA, 751 bp, Heterodera glycines
  SCN-specific regions: Sequence locations=1-288,310-399,421-505,527 -684,725-751
caagtttgagatttattcgtttcgtttttgacctgtatttccatcacaatcaactgaaaaacggcaatggatgattcggttggttttcttagcataataaatcttgcatttgggtggtcttccaccccttacgacagtaaaattagtctgttccgttcgtttacagttatcctctcgacggctcccttccgacttctccttctaaaaatttcatccaatcttctgtataattttttctatttccgtatgcttaacagctgtaaattcccaaaaatcatcctccaagtttgtgggaggggaattcaaaaattgatatggatgttgaaactgaaacacagggtagaacattttggccgacgaccaaatgggaaggaaactcccagccgaacttttgttcgaaattgttctctgtgttcgaagagaacatgcccacgcgagcatttgcctctcgtcccttgttttatgcaaattaatgctacctcgtgcttcattatggcggaaaatttgggtttcagtatgattttggatgtttccgctttttttttttaattttcgttgttgctgtttggacttgtctttttatttttgcactaacaccattttctgagctcgtgagctttcttcaattctattattttatttttggtatttatttaaatgtttttgtctaaatgtggtgattaactcttctttcttccttttctcatttccattagttttttattggtttttttgtgcgtttccttttgtg

SEQ ID NO: 89241 - DNA, 676 bp, Heterodera glycines
  SCN-specific regions: Sequence locations=1-32,86-617,671-676
ggcacatgcgccaatttcctttttggcattggggcgtcaaagacgacggcgccaatgacaccgacgacgacggcactgacgacgagcgcgggcagtcctttcgcctttggctcgtccgcctcgaccaccgcttcccccggcgccaccacaaccaccgcctcggccactctcccgcttctctttggcactcagcagaaaacgacggcacccgccgctgtgccttcctccgtccccgccttctctttcggcaccgccaaattcccttcttttggctcctccgccgccggtggcactctcttcggttcgaccaccgccaacaccctcacgacaagctcacaaccacacgttaacggtggatctcgtaagcgatcggctgcacaatcagtcgatgacatttcgccgtatggaaagagaactgcgtccagttcattgacggagacaagttcaatcgccaacgcccctctgtttgggggagcactaacgatgacgacgaaaccaaacacagcaattgatgctccgtttctggctaattcaactgctttttcatccactacaattaccgccactgcaattccttcggatgcgggcacaggcgccaatttcctttttggcattggggcgtcaaagacgactgcgacaatgacaccgacgacgacggcactgacgacgagcgcgg

SEQ ID NO: 89242 - DNA, 663 bp, Heterodera glycines
  SCN-specific regions: Sequence locations=1-372,394-663
gagaagcccgacctgaacaacgtggactatgctggactccgctcggacaacagcgaagttcggcgcaaacagttggacaacatcgcagtggccgcgttggaatttcagccgaagggcaacacactcgagaccacggaagtaaaaactgaagttccctttctgattcgaggcgacctccgcgagtatcagctcgtcggactcgattggctagtcactctgtacgagaaaaatctgaacggaattttggcggacgaaatgggccttgggaagacaattcaaaccattgctctgctcgcccatttggcttgtgaccgtgccgtctggggtcctcatctgatcatcgtgccaacctctgtcattttgaattgggaaatggagctgaaaaagtggtgccccgcattgaaagtgctgacatatttcggtacagcaaaggaaagagccgagaaacgaaagggctggtccaaaagcaatgctttccacgtttgcatcacttcttataaattggctacccaagacattcgcgcgttcaaaaagaaggcctggcaatatttgattttggacgaggcgcagaacatcaaaaatttcaaaagtcagcgctggcaaacgctgctcagaattcagtcgcgtcgaaggttactgctgacgggaactcccttgcagaat

SEQ ID NO: 89243 - DNA, 640 bp, Heterodera glycines
  SCN-specific regions: Sequence locations=1-640
aacgtaggcatcaagaataaatatgtgttgatggacgtacgcatttctggagcattgaatatcgtgagtatgtggatgcgtacgcacgcatctaccgtataaaattaatctaccatagtcatgtagacaacgtacgcatcaagaataaatatgtgttgatggacgtacgcatttctggagcgttgaatatcgtgagtatgtggatgcgtacgcacgcatctaccgaaaaaccttaatctaccatagtcatgtagacaacgtaggcatcaagaataaatatgtgttgatggacgtacgcatttctggagcattgaatatcgtgagtatgtggatgcgtacgcacgcatctaccgtataacattaatctaccatagtcatgtagacaacgtacgcatcaagaataaatatgtgttgatggacgtacgcatttctggagcgttgaatatcgtgagtatgtggatacgtacgcacgcatctaccgtatacattaatctaccgtagacatgtagtcaacgtacgtatcaagaatacgtatgcgaagatggacgtacgcatttatggagtgttgaatatcgattggatgcttacgcacgcatctaccgtagaccacgtacgcattaagaatacgtatgcgttgatg

SEQ ID NO: 89244 - DNA, 680 bp, Heterodera glycines
  SCN-specific regions: Sequence locations=1-423,446-555,577-680
atttatccaaaaaattctacaaaaatagctcctgatcaatcattgttgccagaaaaaaaagttaaaaaaatatgggctcaactgatcaaacgaaggcattgttttccacgctcatccaacggccaactctcactgatcagctgttgcagcgaccacccttcaaattcatccacgacattgtgcatgagacattacgtgtgaccggctttttggacggtctgttcacgagtgatgagcttgactcaacaaaagccggctcgtcgcgcgacaataaaatggcctttctacaaaagttaattgacgcgctgaacatggacggtcaccttgacgacgtgaagccagcaaaaattgtggccggcaaggaagcagaaatgaccaatttgttgctgcagtcatttgcctctgaggccacaatgtacgcgaagcaagacaacaacaagcagcagcagggggatgtagcggtgaagaaaagtgcttcccattcctccgcttcatcaaagtccaaatcgactactgttgaagcggcttcttcttctccatccgcatcaaagagtaaaaatgatgatgacgagaaaaggaaaagcaaaaaagagagcagcagcaggagggacaaggagaaaaaggaggaagagcatcgtcgttcatcattaacaaagcatcgatcaaaggacaaagggagc

SEQ ID NO: 89245 - DNA, 372 bp, Heterodera glycines
  SCN-specific regions: Sequence locations=1-236,259-372
aaaaaaatcatcgccaagttagaggaacggatccgagccttggagcaggaattggatggcgagcagcgccgtcaccaagaaacagacaaaaactaccgcaaggctgagcggcgtgtcaaagagcttgatttccaggtggaagaagacaaaaagaacacggaacgtctgacggatctgatcgacaaattgcagggcaaattgaaggtgtacaaacgccaagtggatgaggcggaagaggtggcggccaccaatttgggcaagtaccgccagctgcaggcacagttggacgaggcggaagagcgtgccgatatggcggagaactcattgagcaaattgcgagccaagaaccgctcttcggcgtcaattgcgccg

SEQ ID NO: 89246 - DNA, 857 bp, Heterodera glycines
  SCN-specific regions: Sequence locations=1-857
aaaagacactgtgataattagcaggtaaaacattaattggctttttccttcctcaaatgataatccttttcttttctcctttcgtcttgcacaaattttgcgttttccgttggaattcgaaaggcactcattggagaagggagatcatcccgaaatccgagagggaattgcccacgcgcgacaatggttcgatcgtcgattacaacaaattcgaattgtggagacgggagtacgaggaaggggttgcccaactcgagcaggaacatgtcaagaagctgaaagagttggaggaatcgttcttcaaagagttggatgaacagaatcggtctctcgacagtgaagtcaatgcgttggacattgccattccgccgcttggcaatggcgaggaatccctggcgaattgtgccacgcaattgggacagtgccaacaccacccgaacccactcagtgccaatcacggcataacaaccgcaattagcggcaaaaaattcctcagaagtcgacagaacgacgtgattccctcgtcgagtgttggtgccgagtcggcgctgcatttgggtgccattggactgacagatgcagcaggcacagcgaagagacgtactcagacgaagaaaagcggctcccctttcggattccttggcttcggcagaaccgaaagcgctgtcggtggttttgctggtgccatcggtggagggccgaccatcggaggaacgtccacttcttcgctgatgctcccttatcttttgtcggaatcggccatttcggaggacgtccattcgttgggcagcgactcggccaaccattgccatttggcggaacgttcgtcagcagggtgcggcggactgagtcaagac

SEQ ID NO: 89247 - DNA, 765 bp, Heterodera glycines
  SCN-specific regions: Sequence locations=1-42,64-81,103-109,139 -252,275-410,440-765
ggcaaatgcaacaaaaccaacagcatcagcagggcaataccatggaggatggaaatgacaatacggtagtggtggtgatgggacagcagggcgggactacggtagactgggacagcagggaggagcagcaacagcacttggacatggagacggcacgcacatcgcgcaccgaggacattatccattatccctcaatggacacgctaattgaccaaattctgttggcggacagcagcgaggagatgagacggaacgacgacgacgacgacgacgagttcaagcagtacaccaaccgcacatcggcagcagcagcagacggaagtgccgacgagtggacaaccgcgcggaatgggaacagcgacagatgcgaattggaagcggtcgtctcttgccatccgtccccgtgttcgtcgtcctccgcctcctcctccacttccggctgttccccaacgcgtaacattccgccgaccgctaccgtcttctccgccaccgtgcctctgccgcccgctgtgctgccgttcggtgccgccaccgcgccctccacctttccgccagccgtgttcttcactggggccgccagtgatttgttcatgtcgtcgcaggactatgcacacgaatgcggcacagctgctgcggcgggtggcggcagcgattccgcggtcgccgctcgtcgtcagactgcgctggcggtgcccgcctggccgcgtccgctgggcgcactgcccgcgctcacccaatcgctgtttgatgcgtttgtggtcactt

SEQ ID NO: 89248 - DNA, 1216 bp, Heterodera glycines
  SCN-specific regions: Sequence locations=1-9,32-1062,1093-1216
ctccgtttcctttccaatgggccatttctttcccggcaccgtttccttcccaattcctctctatatgctcgggtccgctcgttgctggtggcattttggtgccaaacagcctcgggtgttcgcctcttcccatgcccaattgaccccgcccgaagggatcgaatcggccgacctccgaatgcccggagtcagtcctcaaatgaatgagtcgtatttgtgcagtgcgttccctttggactccgagagggaccattttatcgtgggtttcgagccggtgctctcttcacggcacattcaccacgtcattgtctacggatgcgaaatgcccggcagcgaagacaaagcgtgggattgcggggagatggcctcgccccggggcagctacagccattcgcccgtctgtgcctcccaaccggacattgtctacgcttgggcccacaatgcccccgagttgcttctccccgatggggtcgcttttcgcgttggcggttcttccgcggttcaattcctcgtccttcaagttcattatatgcgcgcggaggaggatgacacttccggcattcgaatcattcacacggatcggccacagccgcggcaggcggcgacgcttcttttggccactgacggacgaattgggccgaaaaggaaagaacaattggaagtcgcatgcgtcgtcgatgagtcggtggtgctccatccgttcgcctttcgcgtgcacacccatcgccacgggcgaaaagtcggcggatgggcggtgcgcgaagaaccaaagagtgggacggacaaatggacacttttgggacagagggacccgcagctgccccaaatgctccaactggtagccaaccaatcggtgaccatcacccaaggcgacgtattggcggcacgatgttcgatggaaaacgaagagaagcgggaaataaaaatcggaccgacgggggaagacgaaatgtgcaacttttatttgatgtattggaccaaaaatggacagactctcgagcagaatatgtgtttctcacccggcccacccatttaccgatggacgaaaagtgccggactgaaccacaccccaaaaaggaaatgaaagaatcaatgggagcgcactgcgcagatggggaggacgaacccattaaattatgcatcatcatcggttgatatatgtacaacaaagaaattcacatgttggactgaaaaagcaagccaaaccgaccaaaaa

SEQ ID NO: 89249 - DNA, 919 bp, Heterodera glycines
  SCN-specific regions: Sequence locations=1-407,436-874,896-919
gtttgagttaaggattttgactgctttctttattctgttcttccaaaaaacatggcgcgtggacccaaaaagcatttgaagcggttggccgcaccaaaaaaatggatgctggacaagctgggcggcgtttttgcgcctcgtccaatgtgcggtccgcacaaattgcgcgagtcgttgccgctcattctcttcctgcgcaaccgtctcaaatacgcccagtcgtacaacgaggcgcgcatgatttgcaaacaacggctgatcaaggtggacggcaaagtgcgcactgaaatgcgcttcccatgcggaatcatggatgttatctcaattgaaaagaccaacgaaacttttcgtttgttgtacgatgtgaagggacgatttgtcatccaccgaatccaaagtcgtgaaggccagtacaaactgtgcaaggtgaagaagcaggcggtcggtgacaagcaagtgccgtacattgtcacgcacgacgcacgcaccattcgctacccggacccgcacatcaaggcggatgataccgtggtgattgacattggcactggcaaagtgacggactacgtgaagtttgatgctggcaacatttgcatgatcactggtggacacaacattggccgtgtgggcattgtcggacatcgcgagcgtcacccgggctcctttgacattgtgcacatcaaagacgccgctggccactcattcgctacacggatgaccaacgttttcatcattggcaagggtgcaactccgttgatcagtttgcccgcttccaagggcatccgtttgtccattgcggaggagcgtgaccgccgtcttgcgcagaagcagaaagtttgagcctgatcccgaagaacccatttttctgtcatggatgttattgttttgtttgttggcataaagaaaaagagtgttaaaa

SEQ ID NO: 89250 - DNA, 1148 bp, Heterodera glycines
  SCN-specific regions: Sequence locations=1-249,272-563,585-703,749 -942,964-1148
gccttatacaaacatcaaattcttaaaaaatgtcaacaatcggagtccatgaaatattcaaactgtcgcaaaaagaccatcagcctcccgaaaaaaggagcaaactcagcgatggatcgacacaaattgtgccgtcggttgcgacagcaaaaaatggaggcgacattttggaagcattagaaaagtcggaagacacttcagaactcaacgaaattgacgaagcgtcggtgaagcggatttgttttctgttggagcgaaaacaggggaaaaatgcggaattgcgcataaaatacgcggaagagcctccgaaatttatggagtcggaaattgaattgaacaacgcaattcaggaaatgcacgtaattgcagcggagccccaattttacgatgtgctcgtggaacaggggtcggtccaactccttctgcaactgttgtcccacgaaaacaccgacataatagctgcagtttgcaatttgctgcaggaactgactgacgtggaaattctgcacgaaagtgaggatggtgcgaagctgttggtggacgaactgatcaaaggccatgttgtggaaacactggtgcagcagccgctggtgaaactgaacgagcaaaaccaagacgaagcggacgccgtttacaacgcgatgaatgtgggggaaaatgcgagtgattcgtttttggcatttaaacggggaaaacgattttcaaaaaggacatggactaatatttccccaatttaaaatttccccctctttttatttgccttttgtttcagttgctcgacttccatccccaggccaatgatttgtgcgtctcccagggcctcttcgattggctgatggtccgcgcgacaaagcgaaaagtgttcgacgccaacaaattgttcgccagccaattgttcgccatgctccttcagtcgtgcgagtcggcacggaaaaggctgacggagaaaagggatggcattgacatgacattgcgagtgggtaataccaacggaatgccatagtttaatttgtataggcacttgccgtgtacaaacgacacaacccgggcagtccggacgaacacgagcacatggaaaatttgttcgacgctctctgtgccgcgcttatgtacgtgccgaaccggcaggtgttcctcgacggggaagg

SEQ ID NO: 89251 - DNA, 687 bp, Heterodera glycines
  SCN-specific regions: Sequence locations=1-196,218-687
aaataaaacaaataacaattttttctcagactctttcaccggtaccgggtccgccatcattgagaccacgcgcacgagggactaccgagaggtccgcaagaggaggaggacggagcaggacaaccgacaagcaacattccatcgacctccaaacaacagaaggacaaagagacgagcggagattccaaaatcgcattgccacccccaaaattggccataatcgttgaggccaccgaatcagcaccccgcggagtgatttgcccgacacttcctcccatttgttgcgcaatgacactggactggcgtcagtgtgagcagcatcgaatcggtgaaggtggtgtttacgtgccattccccggcggtgaacaatcgacgtgttcagaccgccaaaatcagtccgtcttcaccaactgttttgggaaccggaggacgggaaaattttgaattgagagccgttctgcgacagtccttcagcacatggttgacgtgcgcaagaagctggagttggaggtcaaaattgaccctgccatttttgtcgtttgctccggcggtgcctttgacccaacaaaaacgacattaatcgccgaacttggtcaattgaaactgaacacttaggacgagccgtccacaaaagcatacgaacatataaccgatcagagattgcgttcattggtggcaaggcatacg

SEQ ID NO: 89252 - DNA, 664 bp, Heterodera glycines
  SCN-specific regions: Sequence locations=1-20,42-664
gaatcattggccgacgatgggacaaagtcagggaatccctcagtctccgccggaggggccctcccaggaaaacaatggccgaactgcgcagccgaatggagccacggacgagggcattttccgtgtcaaagtgtccaattgcccaaacacttcgccacgcaatttgcgccagactttccaaatgcaacacaaccggcgccagtcgagaagcaaaagtttggaaccaaatgcggcactggacattcgaacaattggacacagaaaatcatcgcggttcgggacaaaaacggagttaaaaaagcggggtcaaaatcaaaacttatggaatccggaaaaagcggcaacacaaataattggacagcaattacagaatccacatactcagcctccaaccattcaattgcaaactgtttcaattcatctgaaacaattccgtaaccaaaatggcaaaaccgatctgctggaagacaacaaaaaagatgggatcacgggcctatccgcccatcagattcaaatcctacagaagatttgggaacgctctccggaagtggagatctctgactgtgcccgcaatattatggcccacctcctccgctcaaatgcccaaatgtaccaattcttcgatttgctcggcctcagtgatcgcgaaatttcgagcagtcca

SEQ ID NO: 89253 - DNA, 580 bp, Heterodera glycines
  SCN-specific regions: Sequence locations=1-14,68-580
gcgcatggtaaaagaaattaaattttaataaatcttaattaaaaatctaaatgtttaatttttaaaacaggaattccacccatcatctacttggcgttcaacaaaactgttcgtcgtgatgtttacattatgcttgtccgtccgcttgccatggtgttaccgtgcattaccgtaccgcccgagctttccgcaacacaaaactttggctcaaattcacgcgtagccggggccggcacacgaattgtgtctatttctttaaccgtccaataactacaatgtggtggagccagaatttcgaagacaaaaaaattcacaaataattaatgcatttattaattggataattaatttgttgtaattgtctaatgtccagccgccgctataccaccacaaacatcattattacttttgtttatctatgtattataataacaaatgaatgttgacagcatatttgagtagaacaaggtcggaattttcgaaaagttcaaatcagaccatgaaaaactatcattaaatccgccattttgcgttttctcattaatttttaaaaactaaactattaaattaaagcaagaat

SEQ ID NO: 89254 - DNA, 1169 bp, Heterodera glycines
  SCN-specific regions: Sequence locations=1-115,137-415,437-448,471 -1169
caatgtttgagctgatgcttcactgtctgtcaagtgcagtcgtcgatcgtcagcaaatggccgtccgatgtttgtccgaacttgtcaagaaaatgggcgagcgaattctggaaattgttttgcctttgctggaagaccggctgagacaaggcggcgtcaacgaccggcgtggtgttgcactcgcactgaacgaaatcatcggaaatgtccaccgggaaatcgtggagaaccacgcctcctccttcatcggctccattcgcatttgtctgtccgactccgacagttccgtccgcgacgcggcggggcaagcgtttgccgcttaccactctgctaccagctatctcgcggtcgagcaaattgtggccccaatgctggacacttacaacaaaactggcgagccgtttatactggacggactttgctctgtgatggctggacctaatgggcgtcagctgttccaaagtctgttgccaaaattggcacggtcgcctgtcaattcggcggcactttgtcggttggctctgagcaccgacgctatgaagagaaatttgaacaaagtcatggaggcaatgcttaacggggacatcaacacttcagttgatgagcatatccaaaattgcattccggtgcttctcactttggacgacgaggacgacatgcgggcgatgttttccttgctgttgaagttcgcatcgaagaaggaaagtgcggaggtggcgtcgctgttgctcaggacgtacattgacgagtgtgacggaatggaatattccgagtctcaactggacacgcttttctgtggtttggtcggcctttacaactcggacaaccccaacgttctgcaaaatgccatcgaatcgcttgtcgctttggtcaagcaaatcgacccatcttcttacatccaattgtccttgctgctgaagagggcaatcaaaggattggcgaatgacacgcgcgaattgtcgtcggacggttgttcccgcgggttatgcgtttccaccgggtggcagccgtttttggccattctgagagaggctcttctgatgggtggggtcgaaatcaaagaagtcgctgctaattgcctctcgcaactcatccctctgagcagtgaggcgggacttagaccccacgttgtgaacatggccggtccattattcagaattttgggggac

SEQ ID NO: 89255 - DNA, 741 bp, Heterodera glycines
  SCN-specific regions: Sequence locations=1-741
gcatactttttacaacttcgattcaacatggagaatgaagatgaaacgccaaaagaaccgccctatggagcagaatatgcaaaaagtaatcgtgcttcttgtaaaggatgcaagcagttgatttcgcaaggcgagttgcgtatggcggttcgtttcccttcaagatttttcgatggaatgcaggaaaattggcatcactttgagtgtttctggaaaaaagctcgtaaaaatgatatcaatgaagcttctcaattcgtggaatggaatggcttaaatgggaggaccaagagaaaattcgggcgcgaattacggagctcaaagagtccgatgattctgcttacacacccaaagccgccgtaatgacaattgagcacgcgaaatcagggtcatcgaagtgttacaaatgcaaaaacagcattgcaaaaggggaccttcgtgtttcaagcaaagcgtccttctaccacctcgaatgttttcattcacttggaatttttcaaaaaagtgcggaagactcaaatggatacaatgacttaaacgcggatgagcaaaagcggttggatgagttatttccaaaagcaacacaaacgcccgctgaggaaggaattaaacgaaagaatgaaatcagtgagacggagacaccgacgagcaaaaggatgaaaagtgatggagaaaataaggaacaaacagaggcactaaagaaacaatccgaactgttatggaatactcgaattgcattacgag

SEQ ID NO: 89256 - DNA, 765 bp, Heterodera glycines
  SCN-specific regions: Sequence locations=1-555,587-705,730-765
agaaattccgaattccctttcaaaaaatgctttctctgctttccattttgccaattgttctcgccgcgttcgttgcgccttttgcaaatgccgtcttttcaacgcccagcgttacgctgagcttgaaccccaaagagattgaactgctgatggacacggcacaaaattgcaagaatctgtcggacgaccagcaagtggccgccttccaagtgttggcagaggagcagggtggcgatttgaaggcaagcattgacaacgtgctgatgaaagtgaatgtgtcggacgaccagttcaagcagaacattgaggaggcgaagcagaagctgagttcgtctaaggctaaggagaccgctgatcagctcgaagacctctttttggacggctccctcccattcattgacaaagtgaagaagtccgtcgaacttgttcaagaattgcccgaagaaatccgaacggaatgtgaacccgtgctgatggtgatcaattcgatcacgcgatgtcccttcaaagaacagtgcacaccgtcagaagaaattgggggcggaaacattggcaatgttggccagggaggaggaggaggaattgggctgcaacaggggcagaacaagcagggacagcaacaactgcagcagaaccaacaggaacagccgtgcttccacatcaaactgctcaaagtgtgcaccatttcgaagaaccaaaaagaatgatgagagggagggaagaggaggaaaatgccacggcacggaatgtgaccaacggacgaca

SEQ ID NO: 89257 - DNA, 1226 bp, Heterodera glycines
  SCN-specific regions: Sequence locations=1-301,324-456,479-1226
gttggcacatattcttgaagtgtgtgccgaaatcgtttgcctgtccaaagggtgccgagtcggttactcatcgcccagcactttgcacgaccgtgccgtgaagattaagaggggaaccactggcgattgcgttgaactgaagccgactttgattgcttgcgtgccggcaattatggacaaaatcttcaaggctgtttcggatgaggtgaaagagaagtcgccaattcagcgtgaacttttccgcatttgttacgaaagaaagcgcaatcgtttcgaggaggggtacaccagtttggtgatgaacagcttggcatttaacaaaatccggaacattctcggaggcaaccttcgtttcttgctttctggcggtgcacctctcaatcctgagactcagcgcttcatgaacatttgcttctgttgccccgtcgttcagggctatggcctgacggaaacttgcggtggtgccactttggctgatgaacatgaccttagcaccggttcggtcggaccgccgcttaggagctgtgaaattcgtcttcgagaatggactgaagctggttatttgccttcaaactcgcctcctcagggcgaagttctgattcacggggccaatgtcgcgttgggttacttcaaaaatgaggaaaagaccaaagaggacttcgtcgagttggacggaaagcgttggttcgccaccggggatattggagaattccgcgaggatggcagtctctgcattattgaccggaagaaagatctgatcaaattggcccacggcgagtacatcgctttggggaaggtggagacggcgctgctgaccaatccgaacgtggacaacatttgcgtttatggcgaatcgcacaaggactatctgattgcacttgtggttccaaatctcaaaaacctgcaagtccttgctgaaaagaatgacgtcaatgagccgagtattgagagaatttgagccaacaaagaaatgcccaagattctgcagaaggaactccacagctttgtttcgggcaaattgcgtagggaggaaatccccagaaaagtcatcatttgtgcggagccgtggactgccgattcgggaatgctgaccgaagcattgaaactgaagcgcaagaacatcgagaagaagttcgaggaggaaatcaggcagctttatgaagagaactgaattgacttaattgctcctcaagacatatgatatcaattattaaaatggtattgat

SEQ ID NO: 89258 - DNA, 600 bp, Heterodera glycines
  SCN-specific regions: Sequence locations=1-600
gaagaggaagagagaatgagcagttcgcgcgccaacaaatttgccgttgcatttctcgatgatgagcaaactgacgagacgacagaagcaaatagtgaaacggaaaatgaggaaaatttgacgaatgaaagtaaacaaacgaaggcgaaaaatgagggaaaaaacaaaaatcgaaaaggcacgaaaaaacagaaacgaacaaaggcggagaaagcgaaggaatttgggacatcagaacaaatgccaatggcgacgaaaaagacaatgccaccaaacgaaacagcacagaaatctaatttggtggatgatccgttggaaaggcttttgaaggtcgacttgcgcagtttgaacccggacgatgaattgcgacgacttttgggccgaacatttggcgctgagcagcgccgacggggcggacaacaacagcagcagagacgaattggggcggcacaattgggcggaagtcgactgacgaagccgcggttggattggccaccgccaagacaaattggattgcaaatgatattggatgatgaaaaagtgatgtcgacggcgacttccgccgacactctctcgaatgaagcagaaatgccacttttg

SEQ ID NO: 89259 - DNA, 644 bp, Heterodera glycines
  SCN-specific regions: Sequence locations=1-461,483-644
gtttgagagatttatttcccgcgaatatgcaaatgcgtgtcgaatggaatgaacagcaacggcgtcgactctaccgaattgcgctcaacttttttaacaaaacgccggaccttggcgttcagctgctgatcagttggggctttgtacggaacagtccccgggagttggcactgttgttcatggaacggcgcgggatcagcaaacaaatgatcggcgagtacctcggcacattgcgctcacaattccataccgccgtgctaaattgtttcatcgaacaaatttcaatgtacgacatggaaattgacattgcacttcggcaattgctcaaacacattcgacttccattggaagcgcaaaaaattgaccacattattcaggcctttgcacaacattacgttgcgtgcaaccggaacagactgtgcgcattggacacgccggactcgatgtacattttggcatttgctgtcatcatgctgaacacggatttgcacacgccgtcacttaaggactcgagacggatgaaattggacgaatttgtgcagaatttgtaccgacttgaggaggcacgacatatggacagaggcaaaacaataaatttttacaattgtcggtatttacactaacaaattttccagtaattcaaa

SEQ ID NO: 89260 - DNA, 687 bp, Heterodera glycines
  SCN-specific regions: Sequence locations=1-43,66-209,278-302,324 -375,397-579,601-687
gatattgttgccgactgttcagacaatgttgccactcgatatttgatcaatgatgcttgtgtgttgagtggaaaaccgttggtatatggaagtgcgcttggttgggagggccaatttactgtctacaacaatggaacggtttgaagcgaggaagcaccaaaatgttgagggcggggtggaaggcggatttaaaatatagtttctggcactttttttaaaaagattttctttaaaatttttctaaatcaaagaaaaatatataactaaaaaaaattaactgggttttcttaaaggttttatgagccattaattaagacaaataaggcgaagccctttgtctgtttttttaaattgctttctttttaagaattgtccttgcttccgctgcatttttcctgatcccccaagtcctgaacatgtgatgagttgctcagaggccttagaaatcatcaaaattgctgtcagcggaaaatgttttcaaaatttgatgatttttgacgacaacttttgtttccattttagcatcatttgccggaaatttgtggatgtttgaccggtttgaaggcatatcaaaaagaatttctttgagagagaaaatgtcgaattgtgcgatttgcagtgaaaatccaaggattacagaattacaagactatcaaaagttctgcaggtcggatccatcagataagg

SEQ ID NO: 89261 - DNA, 675 bp, Heterodera glycines
  SCN-specific regions: Sequence locations=1-160,298-461,484-559,581-675
gaggaattcaaacctggaagatgggaataatgatttaatacataaatcaccggatcattaaactgaaatgcttctcgacaacgcattaaaagcttcggctgtcaacagcggcggcgaaatgccaaaacggatgagttactcgtcggtggtgatggcacgttcttcctcttcatcctccgcttcttcttccatctcttcttcttcctccaccgctcctcctcctcctcctccccttccgaaatcctcttctgcttcttcttctttctcctcatattcgtcctgttcatcttcatcatcattagcagcgaatcgggaattcgtgccgaaaaacaaaggggaaccgaaaaaaatgccgaaacgacaccagcagcggtggaagcgttggcgaaccgtaacgtccgagtccgcgttcttctaccggtcgtccagctcctcactgctgtcgctggactcggccacttccaccaccaccagcagcagcaattcgtccggcattggcaccagcgacgcggaaacaccgccgttggcatttgagggagagcagcggcaacaacaaaagcccaacaccagcagcagaagtgggacgagcaaaacccaaaatttgggcggaggcccggcactcaaatgggcggaaacggaaaaaaacagcaaaaagtgggcacaaacagcacccac

SEQ ID NO: 89262 - DNA, 698 bp, Heterodera glycines
  misc_feature (646)..(646): n is a, c, g, or t
  SCN-specific regions: Sequence locations=1-86,125-533,556-698
agatgtcagacagaaaggacagtgtgacaggagggaaacgaatagagcaggaacttgctgaggacggccgtcctgtttacatcgtcgtattgaccattttcttaaaagggtttttctttttgtatgacttgctcgtctttattccgttcaaattatttgctgatcctgaactgaaaaaggagcgctctcgtgaacaaaaggccgttccgattgatgggaatccggcttcaccatggcgacacgtcgacaccattggcactgctctgtacaccgaactttttgaggactgtccgacgctcggcaaaatttgggacaaagcggcagagttgcaccgtgggcacaattgcatgggaacgcgcgacattcttgaggtcatccaagaacgacagtcggacgggaaaaccttccagaaattggcacttggcaaatatagctggatggattacgaacatgttgatgaagtgatcgtggaaagcgcttctggactccacaatttgggcattgagcaaggacaaaaagtaatcatttacgccgagaacaggaaaggaagggatgatctccgccatcccctggcttcaaattgggcccttccaattgtcaccgtttatcccacgcttggtgacgaggcaattgcttttgccttggncgagtgtgacgccgttttggcgtttacttcacgtccccttctgtcgaaagtt

SEQ ID NO: 89263 - DNA, 950 bp, Heterodera glycines
  SCN-specific regions: Sequence locations=1-95,117-212,235-278,315 -493,515-525,590-777,816-950
gcgataagaaagatttattttgatcggcaatggcggcgacatcaaagctgcaaaaaagtggacgaaagcggttgagatacgattcagaggagtcatctgatgatgatggcattggaggagatggggccactgttgcaatcattccgacgccgagcatcgatttggtcctgcaaaatttggcaacaaatgcactcgcttttacagcggcgcccgaaatggaggagaatgaagagcagggcgatgccattcaattggattgcagtggttccagtgcagcggaagaggaacaccaccaccaccaacaacaaccaaatgggcaaaccgttagcagcggttgctcctccagcagtcgtccgtccactgataaggagggggaacaaaagttgcggagaatgcaagcgcaagcgcgtcgtcagcgtgtgagcaagtggaaaatcagtgagacggcgcaaaggaagaagcaaatgcagaaaagcaaaggcaacaaaggagtagggggaggaggagcacttgtatactctgtccgcagcagcagcactacagccaacaacaatagcatcagcaaaaaacccccgaacaaaaagaagcaaaatgtcgctgatcgaactgctcgcaaaaacaacatcggcggcgcgggcggtgaagaagcgccagcggttacaaaaacggccaaaaccttggctgaactgcttcaatactcaaacgtcgttgcagcaaatctggaaaataaactcacttcaccgacgacttccaagaatgatggtcctccgacggcggatggtttcacatttacagcagcagctcaggaagaatgtccgtcctcgtcatcgtccaaatcaattgccacgctcatcaccgaccggttcacgccaaacagaggcactttttaccgttatacaccagcgccagtggttacaccggcggtcgtgcacaaactcttactcaacgct

SEQ ID NO: 89264 - DNA, 694 bp, Heterodera glycines
  SCN-specific regions: Sequence locations=1-61,84-694
gtttctctagctccattccctagcatgaaaatggcaattcggagctttcttggccccgcttgctgttcaccaactggcgccgctgtattgctgctgatttctggcttggctaataccgtatcattggcctccattgccacgggcaacggggcacgccttggcatttttcgtccgacacgcagcatttcatatgacggacaacaggaggagacggaatatgaagtggagcccggctttgaaaagcgttcaatgacgcttggccgtctgtcatttcggcctggaaaacgttggtcctttcccgtctccggtgcttatgcacacgatcggcaaaacagacgctatgatttgttgctgctcagtgaaaaacagccgtcatatggtttggcaccgtctgaagtggaatacaatgtgccaattcaagccaagcccagtgtcgtccgtcacatcaattttcgtcttctgcccgagactggaaatgagcaggaaaatgatcttgccgagattggccttcgagaatctgcaatgggcaaacgaacagccgcattaggccgagttggttttcgacccggaaagcgaagcatggctgttggtcggacaggctttcgtccaggaaaacgcagcattgcaactggccgcgttggatttcgtccgggcaaacgcagcaattcaccaggtggctactacgtgacacttg

SEQ ID NO: 89265 - DNA, 674 bp, Heterodera glycines
  SCN-specific regions: Sequence locations=1-674
gtgactcggtgccgaacgccggagggtattggtcaacgcctgcagcaaaagaagtgcggaaactcgtgccataattatgccggatttcaattttcctcccccactaattttggcacaaaaattactaaacgccgctccgagtgagtgctgcgcattgtggtgctggtcgatgctggacgggtgccgaaagtccgccaaatgtgccaaggacggagtcatgggcctgagttggtgcagcggtgagccgtccgacggacgcggcgacgaggagacactgttccgcgcgaaggaagggcgcgagcggcgccggaagtcgtccagcgttttctgagaacggaccgatcgaatgaaaatgagggcaatcattgtgagctgatcaaaagaagcgattgtcctacgtaaactgttcatgatcagaatacggaagcattctcgaatatatcaattggtctttgaattattatcaaaatgttgaacattatcagttgctcaactgatatctgagtttgaaacattgggccacaggccgtagccagaaaaatttcggaggaggaatttttctctcttttttttgctcttcggtcaaaagttttttttctcctatgttatttttaaaaggctccgtcgggttaagaaaagcgcttagatcttccaaaaaaaaattgcccgttttt

SEQ ID NO: 89266 - DNA, 686 bp, Heterodera glycines
  SCN-specific regions: Sequence locations=1-177,199-686
gtaagaataacaattcgtccaaaaatgatgccacgaaatcagatgatcgaaatggtaagcagtcaaagacattcgccgatttcaaggatttcgactttgatgatcgtttgctactggctatttccgagatgggttgggaacgtccaacaccagtccagtcgtccatgattccgttagctttggatgggaaaaacattttggcgcgggcacgaacggggagtgggaagacagcggcatttctgcttccgctcatccaaaaaagtatccaacttagccagaattccattattcgcaagagcaatgggcctttttcgctggtcattgctccgactaaagaattggcctctcaaatttttgctttgctcgaacgactgagtgaatcgttggtgttcatccattcgcttaatttggcacaatatgcagaagcaaatgatgaaatgttggagaatgaatcgttggacgttttggtgtcaacgcctggtcggcttttggctgctgttaaaaaagtgccaaaattgctgataaacgttgcccacgttgtgctggatgaggcagatttgctcttttcatacggttaccgcgatgaaattggtcgtcttaaaagtgcgttgccgccccactttcaaactgtgatgacatcggcgacactcaacgaagacatgaccgaactgaagcgcacctttgtt

SEQ ID NO: 89267 - DNA, 723 bp, Heterodera glycines
  misc_feature (686)..(686): n is a, c, g, or t
  misc_feature (688)..(692): n is a, c, g, or t
  misc_feature (700)..(700): n is a, c, g, or t
  misc_feature (702)..(702): n is a, c, g, or t
  misc_feature (711)..(711): n is a, c, g, or t
  SCN-specific regions: Sequence locations=1-148,170-285,311-319,350 -393,415-686
ctttttaaacttgacagacttgaaacccgtagaaaagttattgatcttaccactgcttttaaaataatcaactgtcatactcatttagaccctcaaaaactttacactttctcaaaaagattaagatttaattgtattagattaatatctaaacacaaaaccaacaaaaccgaaaactcatttattaatagaacaataaaacaatggaacaatcttgattctaaaattacggcatcatcttccatatgtagttttaaaaacaaagtcataaaatgggttaaagcccctaaatacaataaaaatatttacattgcatgagaaaaatatttttatttatatatttatttatcactatgtcgttgttgtgatctgactttattttcatgtgtgatctccatatattctccatttttgtattcaccgatcttcagagtaagaggctaatgcccttctgtagatattttattgactgaataaataaaaataaatggtgtacggacatttcgcctactaagccaagaagccctaggcaggcaccagcagcaggtgtagcagaacaactgcggacatgtgtgaagaatgatttagaatagatgaatgttgatgaaaaattcggtgattgttttttagaaagaacaaaggcattggaaattttttgggttttgcggaagtaaagaattcattcnannnnnaaaaaaananaaaaaaaanaaaaaaaaaaaa

SEQ ID NO: 89268 - DNA, 607 bp, Heterodera glycines; identical to SEQ ID NO: 55360
  SCN-specific regions: Sequence locations=1-118,141-351,391-607

SEQ ID NO: 89269 - DNA, 1438 bp, Heterodera glycines
  SCN-specific regions: Sequence locations=1-1398,1431-1438
gagatatctttcacacttacaaataataaccataataccgaattaaagcggggggcgtgtggtgtaaggatgtgtcatattgagacctatattttcatggattttgagacaacgggactttttgacgacggccacaacaacccgttgaccaaccccaatcggtccaatgagacggccagagaacgtgcccagaggctggacaacctcatcaagtcagatggaaatcgctttcctaaaatcacggaaatggcttatatgtcggtgccgcgggtgttgttccttgagggaacggagcaaatgtccgcgcgccatttgtcatcgatgtcgcaagacggcgaagaaagcattgagccggtgcaggtcgttacgaatgtacacgtgcgacagctgaatccgcagcttaatgacaaggagcggttcaagtacgaggaattgcaacggaaagtgccaagcgtgcttctcaaacaatccgatttgacatgcaaatgcactttcgctcaggaatggcccgccattcgaccacctgcttcagactgttccaaaaccagcctgtctggttgcgcacaatggtctcaactttgacttccgaattctgtgccacgagttgcgcaagagcgacctgttccgtacccatccgatcccagaacaggtttatttcctcgacacgctttcctgcttttacgaactcgagaaggagtacaaccgtgagatagaattaacgatggaaaatgttgattggactctcgttttgtcccaattccaaccgaacagcgaaactgtcgttgcaactgccgagatagaggaaactgtacaacaaaatggcactgcttctgagggaacacaaaattccaatggtcacaaaagcaccaccgttcttcatcgattgttcgatcagaaatgttctcttacatcaaatgccaacggattgccaaattctcataagaaaataaatccaatcctacgtcattggagcttggctttgccgctgatcatgttcatgcgcaaaacgcattggtcgccggccaaacgccgctgcattgacgccaaattttttgagagcaacaatcgcggtgaatggaatttcaatggtaaccatgccaggcggttgttgtgcggacgtggcaatttcaaactggagaacatgttcaagaggtttttctccattgccccgcaatttcatcgggcacaatcggactgtgaggctctgttgcaagtttgcctctcctacggcatggattttgtgaaatttgttgaccgaaattgttcatatttccccgactgcttttacacctcctccaaaaagactcagactttaaactcacttaacactgacctttgatgactaactctttttttcttgtattttcgtatgattttatttttactcttttcttttgtaaaaaaaaaaaaaaaaaaaaaaaaaaaaaaaactcaagac

SEQ ID NO: 89270 - DNA, 875 bp, Heterodera glycines
  SCN-specific regions: Sequence locations=1-121,143-875
gagaaacaccccttaaattattctaaaattacaattatttcttggtctaaactccaacaaaaatggaccggtccatcctcgtcccctacacttctcggttgatgtccgaaatttcgcccggtcaaacactgaacattcatggcaatgtgaacgcggatgcgcaccgtttcgaggtcaatttgttgagcaattgcgtcgaaattgatgcccacatgggctccgcgccgctgcacttcagcgtccgatttgacgaaggcaaagtcgtgctcaactcatttgctgccggagaatgggggaaggaagagcgccactcgaaccctttcaccaagggacagcccttcgacctgcgattccgcgtccacgaagatcgaatcgaaatattcgccaatcaaaaacaaatcaccgaattcaaacatcgaatcctttacaccaacgttgaccacattcaggtccgtggcgacgtcacattgagtggcgttcactggggcggtcgctacttcgaacttccattccaagcgaatttccacggcacttctctcaaaagcggccaacgtctttttgtctatggcattccgaagggcaatttcagcatcaatttgatcggtgccaacggggacacacttttccatttgaatccgcgttttagcgagaaaaagattgtccgcggctcccaaaaagacggcgtgtggggcgaggaagagcgcgagggcgccttcccactgaagaaggaacaggcggcggacatcgccgtgttcaacgagccgtactccctgcagattttcatccacggccaccattactgcgcatttgcacaccgggtggaggcgccgaacaccgactacaatttggtgcccgtcgaaggagaccatggactg

SEQ ID NO: 89271 - DNA, 886 bp, Heterodera glycines
  SCN-specific regions: Sequence locations=1-55,77-412,434-886
gtcaattgttgacgaaattcttttaattttgggaaagccaaatgcacatgaccaattgaagggtgctctttacgtgctgaccaatggcaaagagcagtcgcttctgctaagacaagattgggccgttctgttgcagctttggcccgcattgtgtttggttgacaattccgagaacaaacaaagcatcattcaactcactgatttggcccgtgatctcattgtttccaacttttcatcttttcaaattgaatattatcttcccgactccgttatgcctttggctgaacaactgttgtccgattaccccggcatttgtcataaaccggcgtggccattgcccgacaaacaaaaattgggagaatttcgggaaagggaagcggagatatgcggacgaaatcgcgaaaattttcttgccttggccgagaagctgctgacaatcgcaaaagacgagaatttgcactggcggcaggtcgactttgccgaaacgcttctctcattgctgcttcggaaggactgcgacctgccggacggtgttgtactgcacttcttcaagcgactcactgctgacaccataaacactcgcaaaattgcaattgacttttgtagttcatggttgaaaatacacaggcaaaaggcggttaaggaggacgtcgttattccggattgccctccgggaagggggccgggagcgcaatggccaattactttcggcatccgtagcgacaacaaattccttctcttcgacgcagcaaatgcaccctccaatgccgacaaatgggacagtgccaatttccactcgaaggtctatccgggcttttacacttggccaagcaaattccgtgtgtatgcgccaccgagtgaacaaaaatgggcaaatcgtgaattc

SEQ ID NO: 89272 - DNA, 1221 bp, Heterodera glycines
  SCN-specific regions: Sequence locations=1-139,161-551,574-644,666 -1221
gtgcaaaatgagtttggaagacggcctttgctcggctatttggccagcctaagcgacgaattggtgcagcaattgttcgagtcgcgtccgtgcgtcgtcgccattttccgtcttttgcccgcctttgcccaacaatctgtgcttcagctgatgttccacaaatccagcgattggcgttcgtggactcggagtcgcttccatttggccatgtccagcgccgttcagctccttttccgactgcgcattttggaaggcaattcgaacggcgactttcaaattaatcttgatttccgcatgaattacgtctccagccttttggccaaccctttggaattgtccaacctcaaaatgcaccatttggacgaggaaaaagcgcgcaaagcgaccaaagacttaatgggcaaaagtgtggagcgatgggagagcattctgtgctatttggcactgccgagcgaagcggcggagaaaagcgtttcggagacgacgaaggaccttttccaattcatcggattggtgcgcggaagagccaaagagcccgaaatctcttcgattggcttccaatttttgcttttgagccgctccgaacaaatttgggcctatctgatccattacatgcgcttcatcgcttcaaagggcgaagaagtgtttcccgttttggactttctgctacggctcacgctttgcatcaatggcgacgatgcgcttgcccaaccgctgaggctcgacccgaattggcccgaaattgtgcaggcattcgttgtgactctgcgcgaattgggactgattttcatacgcaaacggaaggacggttggtttctgctcactcctctgatgactcagctttccgttgccgcctcagctgaacccttagaggaaaatgccggccaaaatggcgtcgctttgcgcaattctccacttacaaattcacacgcaacaaatgggacaaaaggcggacgaaatggcgacggttttttaattgtggagacaaattacagagtgtacgcgtacacaaattcgaccctccaattggccattctgtccacattcaccgaacttctttaccgtttccaagacattgccattggcgttctctcccgcgacgcggtcagacgcgcttttcagaccggaatcaccgcccgacaaattacccaatatttgtcgacaaatattcgacagccgccgtcagctcggaacaattcgcaattgtccgattcttctgtg

SEQ ID NO: 89273 - DNA, 635 bp, Heterodera glycines
  SCN-specific regions: Sequence locations=1-635
gaatgacaacggtcggcattttgggcggctcccatcaatggttccccgcggaccaaccggcggaattgatctgtgccgcctctgtttcttcgctggttgaacgcgtcgagtggaagagggccggcggggacgcgttgccttcggatgccagcgacgaggaacaccgcggggtgctccgattcgacccgttcaaacctgctgatcacgcgggtgagtacgagtgcaacgcgtaccgtaacgaggaagtgatcgccaccagcaaagtggaagtgcaccccgagggcgacacgcggcccgaccttttgcacgtggacatttcaccgccgcaagtgcgcatggtgaacgcgggcgactcaattgtgttggactgtgtggtgcacggccgttctgcggatgagttcacttattcctggtcactcgcgcgtggcggagcactgatccgtgagttgggcaggcaaagtcagctgctggtcaagtcggcggatccgagcaacgattacggcatttaccggtgcgaagtggagagcgaggaccgcgagacggtcggacaggcacaggcggcagtttctgtcggatttgactcggaaaacaatgcagttgaagcaaagttcgacggtgattcgcaagcggtgctg

SEQ ID NO: 89274 - DNA, 678 bp, Heterodera glycines
  SCN-specific regions: Sequence locations=1-498,541-558,596-678
tggccatacaccgggattatgaaagcccgttttccggctacatagaaatgcacgaacacacgtctgcgttttgttttaccatggttgagcgagatatgcgaattttttatgactcaggggcgggtactcctatgggtagatacacgttggtactacacggcatcgtacaggggaactatttgggaaatgattcgggattgggactccctatttttttcttctggttttactgggagggaaggagccagacaaaccgcaacggtttttttaggagtcgtctttttctggcaaaggtccaaatgctaaaggtcatggcattagcttggggaaaagaactgttgacttccccaattgaagtactactaaatgttttctttaatcgtatggacaggtctttaacgattaaaaatctatatgtcattattattacagagaattgcttggctcttggtcgttgctctatcgggtccctccaagtctctttgatatttctcgccgaattgttgcagaaaaaatgatggaagaatttttaaaactgccatcacactttcgaattgctttttataataaatattaattgtgtaattttttttttgccttagttatagtcgaaatttatttttaattgtagaattttctaaaatttattttagtctcgaaaaatgcccagaaagacgc

SEQ ID NO: 89275 - DNA, 873 bp, Heterodera glycines
  SCN-specific regions: Sequence locations=1-362,386-402,424-671,704-873
gaattgattcgtgagccaatgttcggaaattactatcagtttgatggcacttttctggaaagtgatgttcttgagccaacttctgtcacggctttggctaatgacagcaaagcgttgttggacgcccgggccaaactttgggatgaaaaattcggaaatgacaaatgcacattgcagaaaatcaaggaaatgggcatcgattcgttagtgaaaaaaatttttgattcgtctgtgagcgaagaagcgatggaagagaatgaaacggagcaaaaggcaaatggaaatgttaagttgcacgtcgaagtaaagcgaagcggcataaaaaacaaaaacggggcggagatttattgctcggacaattttccattggttatcgacagcagtggcctcttgaacagattcttggaggatgagccaatcataagacacgcgccggaccgaaaattcggtgtttggtgcgcgccgcgaaaatattcgatcgacggaattcaatggaaaattgtgcggattgatccggagagcaaaccaaagaaatcggtcccgaacggagttagcaaaatgaatgggcgcagcaaagaatgtgtcagcaatggagggcagactgacgaatgcatttcgagttctccatcgaccgttccttcgcttccatcgacgactgttcgaaactccccgaaattggaggaggaggaggagaaagtggatgagaatgaactctttgagggactcatctgctcgcaaaatgaaacccatttcctcgtcttttcccctgggcgtcgttggttgggccgtttggacaaggcaaagtgtggcaaggacagtgcgtctattctcgggatgtggatccaattcaaaatcaagaataaagccggtatg

SEQ ID NO: 89276 - DNA, 641 bp, Heterodera glycines
  SCN-specific regions: Sequence locations=1-169,191-641
aaattacacaattcctaaattgcttatttgaaaatgcattccaaaacagcacttaattgcttgctcatttgggcattggcatttatcgttgttggctttgtccaagtgactgtgcagcagccgccgaacgaacagcagcgggaggaggacaaaggcatcttcgagaaaagcaaggacactctgtcgaacgcggcggaaggcacgaaggattggctggtgggggcgaaggactcggttgccgatacgttttcttctgcgaaggaaacggcgactgacaaagccacggaaactaaggacaaagcgtccgattacgccgaatcagcgcgcgaaaaagcgtcggaagggtacgaaggcgcgaagcagggggcacaagagcgatatgagagcgcaaaggaatacggaaaagagaagacggaacagttgaaggagggcgggagaaaagtggcgggagaggccgaccgaaagactgagatctaaataaaaagaaggcgcaaaaactgttgatggaatggaatgggggagtgatgcccgaagatggtgttaattggatgaaccaatgagaaattggactctatgagccctttctttgctcgtttctctcattcctgccatagtattttttatacggataaaatttcaat

SEQ ID NO: 89277 - DNA, 683 bp, Heterodera glycines
  SCN-specific regions: Sequence locations=1-424,463-683
tgtttgcggtacgggcctggttatccatgccaaactgaacaggtagatggatgccaaaaaaaaaaaacaatttgtgtaaaaaaaaaatattaagctaccaaatggtggaagtagtgctcgaaagtgcgctgattgccagttcgtcttcccaaacgatggctgctacaacttccatttggccaacaatcctccagctccaatggatgggcgtggacagcgccaacgtcagccaatctggcaatggcgccgggtgtgtcgtgcgtgtggacgtatcgcctacgtggccacacatcagtgcccacgtgaccaaccagccgacgatggaatctgtcggcgctgcaatgggccccacaccgtcgatgagccttgctacatccagcccattgacgacggctcagttcgacaacgtgcatcgattgctgttgacaacgacgattctgacgacgacgacgacgacgatgaagaattgccgcttcgtctctgcttcttcgatgccgagacgtcccaggacacgccattacagctgaacaaccgcaccgtccagaagcacgtgccgctgctcatcgtcgccgaagtcatctgcgaacgttgtctgcaggctggcatcagcgtgagcgatggccttggaagacgggctcctggctgcgtctgcatgacaggaatggtgaggggtcaactgtttc

SEQ ID NO: 89278 - DNA, 654 bp, Heterodera glycines
  SCN-specific regions: Sequence locations=1-26,201-220,476-488,510 -534,571-654
attgatcagaccactccttcatagtttctccttctcttgctctctctcttcctttctccttctctttctctctctcttcctttctccctctctctctttctctccctctctttctctccctctgactttgcctttcactctctctcttttcctttatctactatcagtaagtctctctccctctccctttcttcctctctattacgctttaccattgcattctctctctctctcttactctctctccgacttctctttcgctctctgatttcctttcgcactcactttcttctcactctctgttaatctcccttttctctccatctctcttccttttttccttttactctctctctctctctttgtctctaattttactatttctgttttactttctctctttacctctctcctctctgtcagtctctatctatcactttgacttctcttttctccttctcttgtttttttttctagtatatgtagattaaaaagttgctttttaaaatgtatgaaatatgtacaaaaatccccaaatatatattaaaatatgtaaattaaatttttaatggttatttattggaaaaattcttcgtaaaaagtaaagtaggaacaaaattccataaaaatgacaaaataagcttaaaatcaaat

SEQ ID NO: 89279 - DNA, 1116 bp, Heterodera glycines
  SCN-specific regions: Sequence locations=1-196,222-624,650-1116
aaaaaggaaatatttggccggcaaaagaggatttgagcgaccaccatttgaattgccggagtttattaagaggacggggataatggagatgcgtgagacaatgtgggaaaaggaggagcaccaatcgctgaaaaacaaaatgcgcgaacgaacccggccaaaactgggcagaatcgacattgactatcagaaacttcacgacgccttcttcaaatggcagacaaaaccacagatgacgaagatgggcgaactttactacgaggggaaggaattggaagcgcaaatgcgagaaaagaagccgggcactttgtcggatgaacttcgaattgcactgggaatgccagttggaccgaactccaacaaatttccgcctccgtggctcattgcgatgcagcgttatgggccgcctccttcgtacccgaatttgaagattcaaggcctcaactgtccgatcccagaagggtgtgccttcggatatcacgctgggggctggggaaaaccaccggttgacgaatacggaaagcctttgtatggagacgtttttggactgactgttcctcaagtggctgacgacgttgacgagtcgaggattgaacgtcgccattggggggaaattggaagtgacgaggaagagagtgaggaggaaagcgaagccgaagaggacgacgaggagggcaccggcgcagtgccaccgcctcccccggagggcggatacgtaacacctgcgccgacagaaggtttcgtgactccgagtggcatcacgacggtgccaggcgtggaaactccgagttcaacaattgaactgcgaaagaagcgaacgatggacgaaagcagtctctctggccccgaaactcccgcaccgccgctttacacgatattagcagagaaaaaggtggacagagtgggcactcagttgatggccaccagtcatgtgtacgacatcgccgcccagcgcaaaattccggtgcctaacgaaggcgtggaagtgtcacttaaccccgaggaactcgaagaccaaggaggactcgagcgaaaatacgaggaacaacttcgaaagcaggcgaagatacgaatggaaaatgaggaggacttctcggacatggtggcggaacattc

SEQ ID NO: 89280 - DNA, 661 bp, Heterodera glycines
  SCN-specific regions: Sequence locations=1-199,224-456,494-661
ttgagagttaccacattggtaggatggaagaagaagtgattttggatgatgagcggggcaccaaagcggcggcattttctccacactcaaacggcacaatttccttcggcttccaaatgttggcaatcggcgcgggtttctgcatgttcataatgcttctggcgttgttcgccgccgttcagcaccgcaagcgtcgccgcagcagcggctcggtgggctccttccgctcgccgcttattcacaagcgctcctacggcgggcacagcaccggcgggcggctgagtcaggcgattccaccgccgcccgccccgcagtacttgcgctgctccaaccaatcgctgcgcaagtgctcgtcgcccggcggctccgactactcgctgtcctcctcctactcgtcgtcggccgcatcggcacattccttgtcgcccatgtcgccttatgggcacggaaccgtcgccgcggggtatcaacagcagcagcagcaacaacagagtccgttcgccgcgctcaatttcatcccttacggtgccgcaccgcccgagggcatcgaagaacggcataatgccaaccacaacaacaaaatgatgatgatgatgaacagcaacgagcgtaaacgacacagcatcaacacgactgcagcagcagaggccgcactgatggg

SEQ ID NO: 89281 - DNA, 700 bp, Heterodera glycines
  SCN-specific regions: Sequence locations=1-700
agtagccaggcaggttatcagcacgatccaggccttatgtgccgcggtggttggaccggtcacgattctcgtcattgtagggcccaagtagtcaatgccgacatgctcaaagggtgcagatcgcacaacacggtcggtgggcagggatggcatggctggcagagcaaatgccgggccttggattcgtcggcaacgaaggcattttttgacctctctggtgactgtgcccctggctttagggcaccagaatttctccaggaatgaggtgagcgtggcttctactcctgagtgtcgcatcttttcgtgacggtctcgaattatcagcctagtgattggtgactggtccggaagcagaattgggttcttccagtcatcacttgctgcacagttgccgagtctggtttcaagacggatcagtccctgttcgtcagtgcgaaggcgtacttcgggcctttgcttggccaaattggtacagtcacgttgggcaagttcgatcagaaaacgctcggcgaattgaaaatcgcttgcttgaattggtccacaggcggaaacacgggagcacaatccgagaatgggcttgctagacattgtgagccatcgacgaagggcacggaggacaagcaccaccacgttccgaaggcaagtccagtcgctgaatctgtcggcgcaaatccatgcttcgtctttttggacaatgggt

SEQ ID NO: 89282 - DNA, 1139 bp, Heterodera glycines
  SCN-specific regions: Sequence locations=1-101,151-375,398-1139
ccgcctctccccccacctccgtgtctccccattcgctgccaatggccaaacgcgccaaatcgtcgtcccccgccctctctctgtcccattgtcagttgtactgctcgctgcttctgttcctcctctccatcctcctctccgtcctcatcacctttcttctcacccggaatgccattcgatctcaaatagaaagggtcaaccaaaatgaagcggtgacggcaaaactcgtagccccccacggggccattgcttcgctgaacgcgggtcacgacataacacggctacgcatgccgggaaagtcactgttggccaacgcacggccgcgcggaaacgaaacggcggacgaagcgaaggaagagcggccggaaaagcggaaggagccgggcgcggaggagctgagattgtccggagagcttttccccatttggtacaatttgtctctgaaagttttcgtccccggctttggtcccgaaatttcgccccaactcaatttgacctttaacggagatttgcttctgaattttgccgttaatcggacaacccgaacaattgaattgaacgcgttaaaactgcgttttgatccgaataatttgatggcgtacgaattgaaaaggacggacaatttggcaactggggacgaggtggacagaacgccgaaagtgatcggaattcgggtggatgaagcgcgagaaaaggtgttcttcgacttggacggcgatttaaccctgggaaatcattacgccctgcggattccttattcgggcccaatcgcctccaaattgtccggcctttacctgaccacgtacacaacgctttccggagagcacaaatgtgcggcagtcactcaaatggagccgacggatgcacgcagaatggtgccctccttcgatgagcccgaattcaaagcgatctttcggctgagtgtcactcatccgaaagggtcgcgggcggtgagcaacgcgaaggaattgcgggagcagcagcaaacggaagagacggaatggattcggacggacttcgaggagactttgccgatgtcctcttatcttttggcgttggtcgtttccgacttcgaattcgtcgagggaaacacttcccgtgggcaccgctttcgcatttgggctcgtaaagatgactta

SEQ ID NO: 89283 - DNA, 913 bp, Heterodera glycines
  SCN-specific regions: Sequence locations=1-165,201-232,255-691,713-913
ataaaataaatttggatgcatgagcgggtaaacacaaacattctttgtcaacagtaactcgtgaaaaatgggtaccactgcgtcctcccaacttgagaaagaactcagtgcggaccacgtattttcgaacgagcatttctatggtctcataaatttcggcaacacttgttatgcaaattcagtgatccaagctctgtatttttgcaaacagttcagagaaaaaattttggcgtacaaacaaacacacaaaaaatcagggatgcaacgcgataatttgctcacttgccttgccgatttgttctcaaacatttcgagtcagaagagaagggttggaacaattgctcccaaaagattcgtcacaaaattaaagcgagaaaatgaattgttcgacaactttatgcagcaagacgcacatgaattttttaattatttgttgaacgcaatttctgaagttttaatggaggagaaaaagaaggagcaattgggcggaagcctaaggaaagccaacagcgcaatggcaccaaacaaacggtcgttttccgcgaatgcaaaaggccaacccaacgatttgtccgcaaagcaattgaccagcacttctgacatcactggtcaacaggagttgacgtggattcaagaagttttccaaggaacgcttacgaacgaaacgaaatgtctgaactgtgagacaatcagcagcaaagacgaggactttttggatttgagtgtggacattgagcagaatgtttccattagccattgtctgcgcaatttttccaacatggaaacactgtcgggtgaccagaaatatttgtgcgaaacatgcggcagtaagcatgaagcccagaaaaggatgcgcattcgcaaattgccccaactgctcgccccccatctgaaaaggttcaaatacgttgag

SEQ ID NO: 89284 - DNA, 943 bp, Heterodera glycines
  SCN-specific regions: Sequence locations=1-943
gttcaaatggaggtcgacaagttccattcatcgcaaactttgatcgggaaagggacgcacaaattcacactttgggccgacaaatacgcgccgaacacctttctggatttgttgaccgaagatgagacaaatcgaatcgttgtggctccgtctttgggatgaatatgtttttgagaaaagaggaggcaaaaaatgggaggggagccaccgacgcatttcccagcggaacaatgccaatgcgacgtctctgtgggacactttggaggagagagatcgaacactcttcgaaatggaacggccaaaaggcactgacagccgaatgccaaaacaaaaaattttggcactttttgggccctccggagttggcaaaacgtcgttggcccgcgtggcggcggagcaggccggctaccggccggtgatcataccgatcagtgaactgcaaaacatggcggagctgaagtcgcgtcttgaaaatgccaccgattgcacgtccattgacgcgctcttccacaatttgtccgtctccgccgcttcgacaggcgaagcaccgccaccacacgtcggcactcggccgtgctgtttcattgtggacgcggtggaacaagcgtcgccggaaatggttcaattcctttgttcatgggtccgtcgttcccgcgcttcctccgtcgtctgtcggtgtcccgtcatttgcacttgcgcctccctttggcgtgcgcccgcgctgcgcgagttgcgcgccaactgcttgcccgtgcgcgtgcagcggtgcaatcgccagcggatgcagcgacggcttgaatttgccattacgaaggcgtgcgaattggccgtgatcagctggacgaactgttcctttcccacggcagtgacattcgcctctgtctgaacaccctccaattcagcacgctgaaaacgcacacttccgaccgaatccaagccaaca

SEQ ID NO: 89285 - DNA, 1481 bp, Heterodera glycines
  misc_feature (828)..(828): n is a, c, g, or t
  SCN-specific regions: Sequence locations=1-23,61-1481
ataaaaatgaaaaatttgaatacttttttcctgtgctaagcaacacacaatgagctatgatccttacctatctggaacaagttccaatgctcgtcgattgttgggcgcacccccatctctgtcacgtgatgttataacgaagtcattcgtaaaaatggactgcagtcatgaagcgtcacttggcacggaatgcagcggcgaagaaagcgaagcagcaaaaacagcggatgaaactgaaggagaattgaagccgtcacaacgcgacgaagaagaggaaaatgggacaacggggaaaaggcagcaaaagagacgaaagcgacgaattcgactcacagatattggaccgaaggcaaagaaaaaggccgaacgaagggaaaaaccaatggcggagaagaagaatgaagtgcaagatgagaccaatccaaccgaaactcattgtcagtcatctaaaatgtcgcctcctttacttgaaatcgaaaatgaactcggacaaaacccaccaaataaagtgaagccttctcctcactttttcacgccatttcaattactttgtgacaatttgatacggaaattcatggccaaagatcccgagaaatattttgcgcagccagtgacagagttggaagcgcctggatatcattcaatcgttgattatccgatgtcattttcaacaatcaatgacaaaatagataataatatgtacttgaatttggatcaattcaaatctgacatttgtctggtttctgacaacgcaatgctttacaataacacaggaagtgtttattttttggcagcgcaaaaattgaaagttttggcaaaatattattntttccgagaagtatcttttgttcctcgtctattcgttgccctttggaaaagccttaactgaggagcaacttggaatacgcttacggaggaaagaggagcaaacgccgagacaactcaaagagaaaagtggcagggaaaggccgttgccttttctgagtgacagtcaaaaaactgaggaaatactaaatacagctccagtcaaaataaaggatcgattgacgggacgacgaccatgtcaaattgcttacttggacaacagagagggagcgtttgccctcaacgttctaactgaaactgcaacgaccaaactgacacttggcgaccacgttaagccattgggcaaaggcaaccctggaatttgtgcgccatttgagcctcggatttgctcggattatttggtctcctacacaaaccccggtccttttgcatcgttcgctccccactttgatttgacttgggcgacaatgtcaaagcgtgacagcgacttgctcctttcttgctacggtgacagagataatgtaactgatgcgactgcactccgacaaatggactcaaatgtcggaacaccaacttcagatgtgggcgagtccatggtaaatgacctcactgaccatgaacacttaggaactattacgtcgctaggaaacacgagt

SEQ ID NO: 89286 - DNA, 1038 bp, Heterodera glycines
  SCN-specific regions: Sequence locations=1-254,276-503,525-1038
cgcacttttgacgaattccaaatggcctctcaaaagcaattacgtgagaaaaagtgttccgaagtcgaggacaaaacaaacgacggcacagaacgggaaatgacaaattccaccagcaatttttacaaattgaccaaaaccgattcgcaaagctctgtagaacagaatgttgcgaatttggagcgtaatttgtcatcgaatttggtggtcccttcgacgagtggccgatgtgccaatcggagagacgaggaggaaacttccaaccctaaaaatgcccaactttcggagcaaacaaagtgtacaccggaacagcacgaggaaaagacggacgaatgcccgccgaaagagtccaacgttcgactgaccaataaaatctgcaaaaggcgcatgaacaaagttgagaatgttgcccatttgaatggccgtgggggcattggggcgctcggttggcaggcgacgcttccgtcggcccgggaaaggctcactttcatgctgatgaacgacactttggccgacattttcttcattttccgtgggtcggatgggtccgtccagagaatccccgcccacaaatttgtgctttcgggtggctcggcggtgttcgaggcgatgttccgtttcggtgactcttccgactgtgccaattgcattctcgaattggaactcgtcgacgtcgagcgcgaggcgttcgaggcattgctcacttttttatacaccgacgacattcagagcatcaccaaggaatccgtgatgagcattttgtacaccgccaaaaaatacgccgtcccaactttggaaagtgcgtgtgtgaatttcctggagaattgtctgaacggcgacaatgcgttcatgttgttgtccaaggcgcgcttttatgacgaacagcgattagcgaaccaatgtttggaaataatcgacgaagagacccaagaggcgatgaaatcggatgactttctgagcattgaccacgagacgctttgcgttgttctcggcagggacactcttcgggtcaaagagttgactctgttcaaggcgtct

SEQ ID NO: 89287 - DNA, 669 bp, Heterodera glycines
  SCN-specific regions: Sequence locations=1-233,255-669
gtttgagaaattgccgatgaagaggaaggcatttgcactgacacagtgcagcaaaatcctctccattgtctgcgatgcttttcccctatcaaatgccccgtccgtttgccttgtcagcactatttttgtcgtttgtgcatcgccgatgagaagtgttgtgtgatttgtggtcatccgattggctgttccgagttagtagaggacaaagtgctgaattacgtgttggaaagttcgagtgaggtcactgagacatgtgcaaattgcgaccagatttcgcaaccgatgttcttctgcgacacgtgccatcagcccctttgcagcgggtgtcgcgagacgacccacaaagccaaaatattctcgactcatcacatttttgagttggaggagcgcgggaggttgagaagtcgccccatctgtccacagcacaatgagccgttcattttattctgtctcgactcgaaatcgctgatgtgcatcgaatgcttcaattcgtcttcgttggaacgacgcggacatttcgtcaacatcgaactggcgcacaaaatttgctgtgataaattggagaaaaatgcgttgaatttgcgcatttttcaggaggaacttcgtgagcaaattgagttgaggaaacgattgacggacgaactttcgaagaacagcgagaatttgaga

SEQ ID NO: 89288 - DNA, 1677 bp, Heterodera glycines
  SCN-specific regions: Sequence locations=1-414,437-1551,1573-1677
gtttgagcaggtcattccgaagaaggttaatccaccgtcggcagctgaagtgaaaaatggcggacgaagcgtcggaatacactgacgaagaatacacatacgaatacgaggatgaggaagaaccggaagccaacgagaacgctgctcccgcgccagttgaagagctcccaaaggacgaaccgaaaaaagcgggcgaagacgcagcagcgaagaaaaaggaaacatcaccaccaaagtcgctgaagaaggaggggtcgccgccaaagtcgcctaagaaagaggcgagtccgaagaaagaagcgagtccaaagaaagaggcgagtccggacaaatcgccggtgggcaagcgaaagggacgaacgccacgccaatcgatggaggagaaaccgaaggtggagaaggcaaaagcgaagacggaggaaaagccaattgaggagggcgaagcggcggacggattggcaccgccagcagtcgaccgaactgagacaaagagtccggagccggggtaccaaccgatgaccaagtcggtacagaagaaaatggcactttacgcaggtggaaagccgagcaaacacgacaaagccaagctaatgaagtccgagggcatcatccccatccaggccggcaccaacaaatacgcctcccaacgcggaatgaccggcttcggacggccacgtgacgtggtggacaaagtgaaaagtgagaatttggcagaaatcacagacgaagagaagttggcatcgctgaagggcagtacttggcttcagtccggcaccaacaagttcgcctcccaaaagggaatgaccggaattggaacaccgcgggacgttaattaccgcacgaaagggacgggaggggcgggcgaagtgccggaggacaaagcacgcttaacggacgggattgtgccgcttcagtcgggcaccaacaaattggcgtcgcaggccggcatgacggggatgggaatgccacggatcatcgacgtgcgaaagacggtggaccaggacagggaaagtcagggcttcattcacctccaaatgggcaccaatcgattcgccagtcagcagggaatgaccatgtttgggatgccgcgtcgcgaggtgacccaatacaaagacgaagtgaggggccaaatgccgcacgacgaggggaccatctcacgacagaccacgggatggaaggaaggcgcttctcagcagggaatgaccggcttcggcgcgttccgcaataatacgcaagtgcaactgcaagcgcaagaccagcgttcccagggaatgattccctaccaaatgggcgtcaatttcctcgactcccaagcgggcaaaacggcgttcggaatgcctcgtcgaacgtacacaccctacgtggacgattcgcacgaagaactgccagctgacatcacgcgaaggcccgaagtgccattttggaccggcatggaagtcgactttgccaatcagcaaggaatgttggcatttggcactccgcgcgatgtccgcggggaatacgtccgtcgaatgtggtaaacgcagtgcaaatggaggccaaagagaagcggcaaagaacaaagagaaattccttcgatcagtgcgatcattcggttaaataaatgtttagtctaattaatccttcgtccacaattagccccccccccccaattgttagcaatttacccacgaaaag

SEQ ID NO: 89289 - DNA, 731 bp, Heterodera glycines
  SCN-specific regions: Sequence locations=1-469,507-672,695-731
atttgtttgcggaaattcacttgtctgtgaaacgcctgaccacgctcgtcagcttgcttatggaaccgatggtcgttcagagcgatttcgagcagttgctttagacgggactcaatttcagccaaatggcgttataagcggcggaggtgccgacttaaaggcaaaagcgaaaaaatgggatgaaaatgcaatcagaaagttgaaagaccgtcgaacggcgttgcaggaagagttgcaaaaactgcaccgaaccgggaaaagggagttggatgttgagatgaaacgggaacagatcacttccctggaggcacgtctacgcttcacacagcaagaattgaagaagagcgaaaacgaaacgctgcggcggttggagcaggacgcggaggtcgaaagtgcggagccggagacaatcgaagtaattaaagccgaacttacaatttagacgaaaaagcaacaacaataaacattcatttattataaaaatttaaacatttatttaaaattttgcacgaattgaaagccgtcgaattgaaattgaggagcgcaaaatcgaaatagaacgcttggaacaaaataaaattgtcgcgttccgattccaataaacggatttgttcttcttcacgttcgcgaagtgcctctaaaacaaaaaaatcgttaattaattttttagtaaattaaacatttttggtttcattcaatagcccttaaggttttctacttactgcattttc

SEQ ID NO: 89290 - DNA, 182 bp, Heterodera glycines
  SCN-specific regions: Sequence locations=1-112,135-149,173-182
aaagtcgggaccgggacaaagtttttcgaccgggaccgcgaaaaaacccgggaccgggatttctgtttttccaaaaaccgggatcgggaccgggacctgaaaaacccgggatttcccgccccggtcccggtcccgctccactctactacttttttttttttttaaattaaatgtcaaaaata

SEQ ID NO: 89291 - DNA, 1122 bp, Heterodera glycines
  SCN-specific regions: Sequence locations=1-1122
attttaaaagcattatcgacagtttgtcacagaagggacttctcgaagcgaatcgtcaaccgcccatcagtcactcgacactcagttttttgatggaaaggaaaaaggacccaatgtcaatggtcaacatttactgctcggcttcggctcgaatgtgtcaatttgtccggttttttaagtgaggaaaatgccgccaaagccaattccgacaaaagcagcgaatgtcgaacaaagtcaacagcaggaaaacatgcacttgtcattctctgatgacatcgacttggatgccattcggaaggacttcgaacgccttaatccgctcccatcggccgctaatgaaagtgaagtttttgctcgactgcgctcaaccgccttcagactgcacactcagaacgctttttggtgccaatttgatcttagcgaggaaacaaaggcgaagatggagcagtgccggatgggcaacaacccaatggcatttgtcaagcgatgcattgtgctgcaggaattaaaaaagtccaccgaagcaatggagcagaacaatgaacagatgccatcgcaaatacaactcgatttccatgtcttcacacttccctatgtcctaccacattacgcctgtttatcgttattcgacggagaaattcatcacggcgcaattgcaacctcaaaacaaagggcgaagatcagttgtgcagcagtgttatgtgaagtgttggtgaagatgggctgggcggatgtgaaaagggccaaaaagagaaaaaactccgacggagagaaggcattgaaaaagaaaaaacggaagggagaaaacggacagacggaagacgttgaggagggaaatgtccgtttgtctcatcagttccttttgacattgcatccaaatgaatcgcttgacccaacaacgcattttttccttgcttcgtctgctaaaagcccaattcaattgctcaaagaagtggcggatcgtgaaagctttgaagtttcgtatacgaaaggaatggacgagtacttcaacaagcacattgtccacgtcaacacaattgagggcactgctgaaggacgctccgaagtgagcatcagcgaagcaaaatgttcagccgcgcggaagggaattgacgcattggt

SEQ ID NO: 89292 - DNA, 646 bp, Heterodera glycines
  SCN-specific regions: Sequence locations=1-646
agcgaccgacggacagagagaaatgccctcccccgccacctttttgaactgttccgtggaaccgtcaatggcaaatgtcaatttgtggagaatgtttccgttcgaagttgccgtgctgatccgtccatatcgccgactgttcgccatttcgcgaagccattccatcgccgttttggccctttgcattacaaccgccgctttggaaccctcggggatcagcaactcgcgcgacaaaagggtcgaactccggcggaatgggggcgccgagcgcgagacagttcagctcatcgatcactaggggggagagtgggagatgatgggacaggcaatggcatccctttttcgttagataatcccgttccattccatcgcttcttaccaatggtcgggactaaaacagtgaattggtcggattggacgagccgctgaatatggcccaaatggtcgatgaaagtgtttgtgtcgggaactgagaaaaggggtgggaagtccgagacaagctgaatttgaaaacgggttgaaaagctcatttaggtaattactagtattaaggacaatacccaaatatttgggtcgaatttcgataatccaatggtgcgtaaatgaactttgctcgtccatgagaagtttctgcaaaaagaaatgg

SEQ ID NO: 89293 - DNA, 648 bp, Heterodera glycines
  SCN-specific regions: Sequence locations=1-648
gtggcaaattggctgttgttggtgttttttctccgcttttccaattgcttttcatttttcacttcccccctttcttttcttagggtccgttcaaatgttcactgacctttcttcgccaaagaagacaatgcaaagacatttatttgaagtgatcgtcaaattcctttccgatggctttgaattgaatcaaatcgatgacgccgaaccgaacatttcggatttccacccaattcccgacaatttgcaactttcgaaccagccaaaaatgtgcctgcaggaaagtgaaatagagcaaacattcactggtgacatcatcaaactgttcggcacttctctcagctcaattagtctcgagcattggcctgaagccatacgcgcggaaaatgaattgatttgtacattcgcgaggcgggagagattttggacattagcaaaacacttttgcgcagtgagcgacagacggagggaaaaataacggacaaaaaagtgatggaatacgtaattctgcacattgtcgagtggaagaagtcaaccggcggaatgaatttgttttgatatttttggcaatgggcaaggacaagcaaggtggttatgacccggacatccacggaaattggcaaaatgaggagaagccatgtgcctgccctt

SEQ ID NO: 89294 - DNA, 1534 bp, Heterodera glycines
  SCN-specific regions: Sequence locations=1-57,79-1534
aatggatgaggcgaagaatatggcgctgttgttctttgttgaccacctaatgcaaaaggggggccagcggaccatccacgacttgagctgccaatttggtgcacgcggattcaccgatgaaatgcgtcaggcggtcggcaccacccaagagggcctctacgagttcctcagccagtacccgtccctgttcaccctccaagacggggacaaggtccagctgaagggctacggagatggcgacgagggccgcacgcatttgtcgcacattcctccgtccggccgccaacgcgactacgtcgcggaggcagtgcaattttttgtggccaaattggagaagttcggccccgaaatgcaggtaaaatcgctgctcggccatcgttctcaagctgcccccgaagtccggctcgttcacggacgccatctgaaggaatttgccgactttttggccaaccaaactaaccatttcacggtggagggcgaccgggtgaagttgaagcacatgccggaaccgaatgggacggatgccaaacaatttttggacgaggagggccgcccattagtcggccatcgggcgaaattggcggccgtggactttatgagaggggtgcttgaacagaacgaagaaatgcccatccctttggacattttctaccgccgtttctgcgaccgtttcccgcacagtattcgccaggaagtggccaccaaccccaaggagttgctgctgttcctcaagctgaaccggcacgtgttcttcatccgctccaacaaggtacaactcgtccgtaatcggcctggcgatgaacatggttccgagagtggtcgttcgaccggcgaagacggcgggtcgtccgatcgaagtgccacaagcccagcggagaacggaggcggctgtgcgccgccgagggcaccgacggacggaatgtctcccgagacgaacgctcttttcccgctgaaccgcgacaatttgcaccgcgtacaaattgtacaaacgctgcagcaggcacaggaagcggtgcgttgcctgcgcgtcgacctcgactccgtcccgtcttccgccttcctcgccctcgacttcaaattgctctctttcggctccgttccgtccgctgaccttccgctcgtcgttctcgccgttgtcgcgtcgccgctgcgtctcgtcgtttttgacctcgcccaatcggataaggttctgtcggagagcggactgcgcacccttttggaggacgacagcgtgctgaaagttacgcacgacgttcagcgaattgcgccccttttggccaaccgatgggacattcgaattggccgactgtttgacactcagatcgcccattcggtcattcagcacgacaaattcagtaaacccctcggcgacttgcgtgccatttcctttgtcaacttgcagcgcgtctatttcccccagtcgcttgtgctaagcgatgttccgcctcggaaactctcccaaacgcccaattggtcggaccgccctctgtccaccgatttgcttttggccgcgtgtgaagagtgccattgcctc

SEQ ID NO: 89295 - DNA, 677 bp, Heterodera glycines
  SCN-specific regions: Sequence locations=1-290,313-337,359-381,422 -484,506-677
gaggaagtgaaaagcagttctttttgccatttcaagaacacatggtcaaagtcgaaaaacaaatttcctccgggacttcggatgacccattgagtttggttgattcgatcataaaggaccattttctcaacgatttgaagcacaaacagctcacccccgttcaggcatgtactctccgccacatgttggccaacttcgattgcgtcgtgcagtcgcccaccggcacaggcaaaactttagcttttatgcttccaacgctgcaaattttggtgcaaaagaaactgaccggcgcaggagagggaaaagaacagccgacgtctgtctccgattcgtgtcgcattttggcacttgtggtggcgccgggccgtgatttgattgtccaacttttccatcttttttcaccattgtgcaaaaagcttggccttagcactttgaaattgcacggggctggcggaaaacaaaagaaaaagagcccaaagaagcacatgaagggcaaatgcattttgatctgcactccgggaagctttgagcactttttggagaaggaggccgagttgaagcagtacctgaagcacttggaagtgctcatcattgacgaggccgaccgctactcggacagagagtcaatgagcagtttgaccactttgcttgccgctttgccaaaacagcgtcggact

SEQ ID NO: 89296 - DNA, 699 bp, Heterodera glycines
  SCN-specific regions: Sequence locations=1-118,140-373,406-644,666-699
aaacaacgttccgattcattgctgttgcccaacgatccgaattcttatttagccgtccttaaccaagtcacttggagcgattttattgaacgcattgtgcctactggaactgtgtcaaatgttcatttgaaagtttctcgtgggcctgaaagaagaatttccaaaaaagcactggtcacagttatgccgggtgcgcggtggccggatggaaaaatgttgccaaggatgttttttgtaaatgtgcccgacattggtcgagtggaacaagaaatcaggaaagcggaagtggatgctgggcttgcccctgaacattggagcaacatccaatggatgcaaccggggccaatgtcattgattataccttctctggtcatttttgctttatttgtccttccattggttttccttggtcgaatgatgactggctcaaaaatgggcaacttctccgaatcgatctcttccatgatggggcatcgtcttcgaatttatgacccggcattaaaggatggtaaattgaagatcaaatttcgtgacgtggcaggccttcacgaagcgaaagtggaaattagcgaatttgtggattatcttcgtcgacccaacaaatacacgcgattgggcgcgagactgccaaaaggtgcccttctgactgggccgccaggctgcggaaagactcttttggccaaagcactcggcgcggaa

SEQ ID NO: 89297 - DNA, 636 bp, Heterodera glycines
  SCN-specific regions: Sequence locations=1-210,257-381,404-636
gtttgagagaaaatgccaaacattcgacagcagaagaagcatgaaatggtggacagtgatgacgaaaggaacgaatacggcagcactaaggctgaaccatcgccattgactgatcaatcggcgacgtcgatgatgactcataatagcagcaatgcggcggagggaggacacatcattagcagcaacggcggggcccaaatttgtggtggcaatggcacagtgccaatgccattgatttcctgctggtccccgtgctctgcgagttcagcgggggacccgctgctgtggtacgagacggacaaatgccagtactgcaaccaaaagtgcagaaagccccgtcgcctgttggactgtctgcactatgtgtgcgaagagtgtgtgcctgaacaatgcctgctgctggacaatttggagcccgacgaaatccgatgcccaaattgcagccaagttgaaatgtcttcaatttcgggtcaatccactgaaagttcgcgtgtggaaatctgtatcaaacacaaggagaaatttacccgtgtctgtctgtcatgtgcgcgtctcctttgtgtgaattgcgagcagcagctgtccttgcccaccgcgcaagtcaacaatatcactaacgttgttgctgttccgcaa

SEQ ID NO: 89298 - DNA, 688 bp, Heterodera glycines
  SCN-specific regions: Sequence locations=1-688
atacataattctttaaaaaaatacgacagttggttccatcgtattacaatttttttagaatggctgaggccagaaatattgctgccttaagcttcaccgtaacacacgatggcatttccgtctcttatgaccaggaagttctgcgggacatttggcacgcgttttcacgcagttataaaaaacgcatcgcaaaattcgagaatgatttcttcgctgggattttcccagccaatatccgttcgttggccattgtcattttccttgtggccgcattgaatgtttcattcggaaatgacaaaactccgttcaatcttgccgataagctcaattactacgtcttttccaatatcaccacgctcgacgttttgtcccgcactctctcaattgcctttgcgggttgcattttatggtttttgctcgtccaattctttcgtcttttgctcaaatggtttctcatgtacaaaggttggatgtacgaagcgcctcattctggccaaatttcacaaacgaccaaactttggttttacgttcttcacaaaattgccgcttatgagccgatgacgcactctttccaaggcgctttgcctcatctcccactgccgtcgttggcctccacgatggaaaggcacctccgttcgatgcggccaatcctttcggacagagactacgacgaactcgtagaactgag

SEQ ID NO: 89299 - DNA, 1160 bp, Heterodera glycines
  SCN-specific regions: Sequence locations=1-440,462-1160
gtttgagaaaatagttaaactatttgaatttatttctcttgcatatggcgacacccgcaacaatcaaaaaacttgaagaaaaaaagctgttggcacagcaacgtaagcaaatgcagcaaaaggacggcagcaacggaaacgcgggggcccaacttttgtcgctgagtgagcagtcggacgcgccttcctcccaccttttggtgcgcaccgaaccggtggagggagcaccgccacggcacatcgatttgcgaccattaagcggcaattattcgaatttccgtgagcgcagaggggaggatttctctaccgatgtgagtgctgaacgcccgtacggtttgtcgaattacaccaacttcgacgccaacagcggtcccacggcgtacgcatggccgccacagaattatcagccggcgtttgggcctccgccgccgctgcttacacagcaacaaaatatccttcagccactctctcgtccgtcaacattcaacacttatcgccgtccacgcaccgctgctaatttttcgggaaaactcaaaaaacaggagtacacgccgcttccggaggatgggaatgggtgggggatgggaggtcactatccgtgccgataaactcgtctgctttcatggaaaaggcaattttctgtcccaattattccctctttctcttgtcgtagatgggaatgaatacggttcattggagcattactatcaagcgtgcaaactattctccttagtcagcgctcaggctgcccaagagttgcgttccatcaaagacccattgaagacgaagacacgcactcgcgacttgctgttttctatgggcgttagcaaagcgaggatcgatgcttggaaaaattcccacggtgtgcaggtcattttgcatgcgatgcgtcacaaattcagcgaccaacatcaggagttatgtgaccaattgctggcgactgaagacgctttgttggtgcaggcatatgacaaagactcgttctttgctgccggaatggtcgagaaacgagtgcgcgaatgggccaaggaaaacgaaggcaaagtgctcaagtttccatccgagctgagcgacgaaacattcaaacacattccattggttggcatttctatggaaggcatctccctacattctcttcgtcactttcgctttgatttgct

SEQ ID NO: 89300 - DNA, 460 bp, Heterodera glycines
  SCN-specific regions: Sequence locations=1-460
gtttcaaatatcgtaagattgtttgatagggccagacaagagaaggcaactgttggtaccaagtttgcggtaaaaaaatgagaaaaaagagataaccatttttggtcaagaaattttttgtttgcgtttcaaatatcgtaagattgtttgatagggccagacaagagaaggcaactgttggtaccaagtttgcggtaaaaaaatgagaaaaaagagataaccatttttggtcaagaattttttttgtttgcgtttcaaatatcgtaagattgtttgatagggccagacaagagaaggcaactgttggtaccaattttgcggtaaaaaatgagaaaaaagagataaccatttttggtcaagaattttttttgtttgcgtttcaaatatcgtaagattgtttgatagggccagacaagagaaggcaactgttggtaccaattttgcggtaaaaaaaaaaaaa

SEQ ID NO: 89301 - DNA, 816 bp, Heterodera glycines
  SCN-specific regions: Sequence locations=1-633,655-816
gtttattgaacaacaaatcgcaaaatgcgatctgaacattcgctttataagctcaacttggggcggtgtgccaacaatttcttcctccacaaaatttcctccctcggcgactgttctttgcttcacacttcgcctgtcagggaaaatggccacacaaaactgacggtcaatgggttccattgcccgccaaaggaaacgaaaaattgggaggaaaaaaaagataaaacatcgcaggaaaaggaagacggagagaaggggaaagcgaacggacaacggaagaaagagcaaattgagccgaaagcgtgggaagaggaggaagaattcgaaaagtgccattccctcgtcgctttctccgtctatttcacttggttcgtcctcactgtccatgcgtattttcgcgagtttctgcgccgttacggaatcgagtcgaacaaagcggccgttgagcgcactgagctgagaggatttgcgccactcgtcgattctttcgaagcgatttacgcccgaaattgttacatgcgtgtccgcgatgtttttgagcggccaattggcggtgtgccaggggcgaaagtcaaattggtcgaccgacaaacagatgacttctgctggacgttcaaatttcccggctctcaaacggaagtgataaatgtgagcagttacaattatttgggcttcgctcaaagcgacggcccatgcgcggaaatggcggcaaaagcagtggaaaaagggggactatcgacgtgtggcagtgcgcttgaagggggtcagtgctcaattcagtccgacttggagaaattggtggccaaatttcttggg

SEQ ID NO: 89302 - DNA, 625 bp, Heterodera glycines
  SCN-specific regions: Sequence locations=1-85,109-123,145-199,221 -261,283-625
gcagcccatttgccttccgaacattcgtctctttttggtgcagcttttacgcggactcgcctattgccatgccaaacgcattctgcaccgcgacctgaagccacagaatttgctcatttcgaagaatggggagctgaagttggccgacttcggcttggcacgggcgcagtcagttccgaccaaaagttacacggccgaagtggtcactctgtggtacagaccaccggatgttctgcttggttccacagactacagtacccacattgacatgtggggcgtgggttgcattctctttgaaatgttggcccggaagccaatgttcccgggaaacaaagtcgaggatcagctcgacctgatttacagaaaactcggcacccccacgccacaattgcacccgcggctttgcgctttgcccgccttcaattgccacccgcgccatttgcggcggcactcgcccagggcattggtttgcctggcgagccgtataacgcacgaacgggcggatctgctgcagagactgctcgcctacgaggacaaaaatcggttgtccgccgtcgaagcgatgcgtcacccttttcttaagtgtttccctgaggcgatttttggacttccggatacggagtcc

SEQ ID NO: 89303 - DNA, 1043 bp, Heterodera glycines
  SCN-specific regions: Sequence locations=1-397,419-671,753-1043
aaagggcttaactgctaaaactaggcaattctagggaatttaaaatcgaacaaaaaaagttttggtgcattaatttgtcaacttttatggtcgtcttttttatggtcgtgtaaactgaaatagatcaaccctggaaagttactttatcaaaattaaaaccccccattatttagggttggcacatactttcaatttaggaatacaaatttttaagcgaggattcggtagttttttaacttaaggttgctgaggcaagatctctggattccgtttgcgtttctctaaaaaatcttgcacaaaatgcggaagatgaaagcgaggttggtatcaataattttgtactatttgtgctacagttttgatttcctattttatcccattcaaaaaaaaatcctccaaaaaggaattaaaaaattttacgtattcattcatttaaattttcttatttttttgcaccatttcccttgaatttttaattcacattgattcttttaacaaagcacatattattttgtcagacagcggccgaacttttttacaaaggggctatggaaatagatgatttcataaagaaattcacggaaaaacgcgttattggccatacgaggtaaacatttttccgaaaggagtttgcttttcccgtgaggtctgctcatctatgttttatttttataaaattaagttaataaatatatgattaaaaataaaataagctatagaaaaataaaaaaaacaaattataaagaggtaaatattttcagaaggctaaaggccgaaaagcttgccgaattgcttcgccaacaatgccaataccaaccgcagcacccgtctccttctgcacttggaatgaccactcaaactcagtattcgtctcaaggggtggcagcctcaatgtatcctgtccttggccaggcttatacgagcccagccaattttcggcattcttatatgagttaggagaacggttcaaccggagattacttggacacgcacttattattttctatcaactttttgccccgacaaataaacgttttataatg

SEQ ID NO: 89304 - DNA, 815 bp, Heterodera glycines
  SCN-specific regions: Sequence locations=1-13,40-815
atcttgagagcgttgtttgaaaccaaatattaaatatgtcatctctttccgaggaggtcaagaaagttaagcaggccgctaacattcctcctccggcagtttgtaacagatttgtcgaagggttttcaagcgaagatgtgttcgaaactcgaccatcttcacatggcggtgcttttgcattccgttacgatgttgaaatggtccagctcactagaaacaaaagtttgacttcgggcggtggcgacgatgggaaaaatggattgctccgcggcgtttgttttgaattgatcaagttcgtgcacgactcgacgcagggatttggacaagcggcacaatttgtttacgacaaccgtaaaatcttattcacgaacaagcgaatcgaacaatttgtattggaaattgacacggaaaaagtccaaggaatcgttcgcgatttcctgcgtgggtcttcggtcaaaattgagatcaaaccctgtcagactgataaacatgagctggatctcaacgacgtcttttcttccatctcgcgccgtcctgatgagcagtctgacagatctttgcgcactttccttgaaatgctgacttcccagccatttctcaatgctgggacccatgacatcattggtgctggtcgtctttttaagcgtcagatctgcaaagagctcgaagatggaattgtcacacgcgagggcattgctaagggagttcgcgtcattgacaacaatggtgaaccaaaggcggctttggttgctgacgtgaagacttgtgcattcttcgcaagtcgtaaccttgaggaaatcgtcatggagatggtg

SEQ ID NO: 89305 - DNA, 656 bp, Heterodera glycines
  SCN-specific regions: Sequence locations=1-139,161-656
ctttctttcccttccgatgcctttctccgcctttttctccgccttttccctttggtgcccttccgttctctgttccgcccaattcggcttcgctttgcttctccctctttcctatttgctctaccgtttaactcgcacttctttggcccttttccaagcaattttcgtctatcgtttggcgccgttcgtttacgcgccaaaactcagtacatttcggcaccgatggactgtggtcaccggcggaacggacggaattggcaaagcgtacactttcgaattggcaagaaggggcttgcgcaagttcatgctaattggacgcaacgagcagaaactggagagagtgaaggaggaaatcgagtccgaatttcccggctcctccgtgcttcttttccaattcgactttttcgacgcggtgaatgccgaagacgcggacagattgaggcgcgagttggccaaattggacattggcattgcagtaaacagtgttggagtcggccgtgaactgatggaacggtttggggagcggccggaagcggacagacaactcttccgagtcaatgccatcggcgcggcggagttcatttcggctgttttgcctctgatggagcggtgcgggggtggtcatttggtggttttgtcctcaagccagggcttcc

SEQ ID NO: 89306 - DNA, 656 bp, Heterodera glycines
  SCN-specific regions: Sequence locations=1-656
gtttgacatttcatcgttaaattaacagtaattttactttggaatttgagcgtaacaatttctcgtcaaaatgtttggtggcggaggagaccccttcagaaacccatttgatcaaatgcaccaacaaatgagacagatggacaacatgatgaattcgatgttgggcgatgcgtgggacatgctgaacggcttcggaatgatgggccccccgttccccaaccatcctatgctcaccgatggtctgaatcgtcaaaaccaagctcttcgtcgtcagcagcctccacagcatcactttggtcctgatacgatgatgagtccgtttggaggatttggccttttcggcggaatgatgcagcaaatgcaaaatatgcataaccatgcaattagtgatccgaattctgttgttttctccgaatcaacaatggtttcttacgatggaaatggacaaccgaaggtcgtccaacattcgacccgtaaagccggcgatgttaaggagaccaggaatgctctccgtgacggcgtacgtgaggagatgacagttggccattcgatcggcgaccgttcgcatgtgatagaaaagaagcgggacaaagacgggaaggttcgccaacaacagaagtttttcaacctcgccgaagatgaagccgaagatttca

SEQ ID NO: 89307 - DNA, 664 bp, Heterodera glycines
  SCN-specific regions: Sequence locations=1-50,76-664
tgagggtttagatttattgttaatattgttgtaaatattccctttttgggaattaataaaaataaataaataattcaaaatgtccgctagcaacagtcgaaaagcattcgtgcccttttcaaatgcactccgacgacgaaagctgctctttggctttggggttggcactgtcatcggcgccggcttttactacatggacaaaaacaacgaaaggcgcttcaaacgggacaaagacgtttatttcgtgtccaatgcgcatgcggccaccgttgacaccaaagcggcgctgaacaaacgcccgtccggctcacttccgacccgcgcggagctgttgaaaggaatgcgtgacgaggaattcgacatccttgtgattggtggcggagcgacgggcgcgggggtggcattggacgcgcaaacgcgaggtctgaaaaccgcgctggtcgagttggacgacttctcttcgggcacaagttcgcgctccaccaaactcatccacggcggagtgcgctatttacaggcggccattatgaagtttgaccgtgagcagtacaaaatggtcaaagaggcgctgttcgaaagggccaatttgttggaaattgcgccccatctgagctatccgctgccgaatatgctccctatttacaaactttggcaagggccttac

SEQ ID NO: 89308 - DNA, 663 bp, Heterodera glycines
  SCN-specific regions: Sequence locations=1-36,58-507,529-663
ccccatttcaaaagcctaacaaagtcctcccctttcacttcacttccctttattttgcctttcgctgcgatggcaaattccttctaaatatgaaaagaatctgttcgagtttaatccgctaattgtcagaagtgattcgttgggcttaaaaatttcttatgcctccgcttgggcgttgcgaatggaatgtgaatcagcgggcgcgactgatccaattggtgaggcaattcgaaatcatttggttgccggtaggcgcaacggacaaaagcaaaatttcggcctgtcgtcgggctgcattcgaacaaattcgacagcactttttggaggacggatttacggtcgacgatttggcttcacaatggcgaaatttgaaggatatattctacaagaggctcaaggaaatgaaccgacgcattcaaatgggcgaagtcaacgtaaaaccgccgtggcgtttttttgacgcgctgagttttttggccggtagcaaagcgatggatgagaatcggagggaagcgttcggtgaaagcgcaaatgaagtgtttgctgatgaggacggagtcattgaggacaatttgagcaattttggactgatggacgagctgaaccaaccgagcgctgaagaaggcctactcaatttggtgaaggcggtgaaagaggagcaag

SEQ ID NO: 89309 - DNA, 650 bp, Heterodera glycines
  SCN-specific regions: Sequence locations=1-125,147-524,548-650
gttttaggtgtttggagtgccaattttacattttaccgatcagtctatgcccaatttgtcacttttggacaaacttatttttacttcatcctgtttttccaacctcatttgtgcaccaaattgacaacatttgagcaatgaatgttcagcaacagcagccggtcacctcggcataccctcagcagggcaattttgcggaggagaagcagctgcatcccaatcacaatgtgtataggaaaatggaacgactgatcagtctgatgctgaatgttgatgatggcgtgccgatcaagacggtcaaatcgtttctttcaaaattgccaaggattccgtcggtgttcacgggccaagacttggtcggttggctgctccaaaatgtggacattgccgaccttggcgacgcgttgcatttggcccatttgctcgcctcccatggctatgtgtttcagattgacgaccacgtgttgacggtgaaaaatgacaacacttactaccgtttccagaccccctatttttggccttccaattgttgggagccggaaaacacggactacgcggtttatttgtgcaaacggacaatgcagaacaatgcacacttggagctggaggattttgaagcggagaatctggccaagctgcaaaaaatgttc

SEQ ID NO: 89310 - DNA, 1286 bp, Heterodera glycines
  SCN-specific regions: Sequence locations=1-364,386-656,678-1286
ctcacgtattatttggggacgttcgctatttatctaatgaattcggatttacaaattcacattcagtccaacaataatgtcaatgcttttgttttgttgattgaattgtataaaaataatagaggattttcagtaaataaacggcagttcgatttggatccaaaagtcatgaatcaattccataaattttttttattaactacagaaaataccgttgaataggatttaaacatattgttgtcaaatatactcttaggtattataagtaaataatcaattttttagcttattaatactaaaaaagcctggatcattctggacctgggttttcctagatttttatttagaaagtacagtttctctaactataaattgaaaattttttggcgttttatcttaattaaggatgactaatcgtaccagaccggcccttatgttttcaccaacctgtgtctacactaattaacattactaattgatccgcacagcataaatacccgttttttgttcactattattaaattgtcgtttttaaccaattatttaatttgtaacatcaattcgaatgactttcctggatcacgtcgacaaagatttcttcaaggcttggccttttggagtgttgaaaacgattcattggttcgctcccctcgccattctcattacacttggaaatagtcgttacatttatgactccctcggttttgtccttttcacagcatggaatgcattcatcgtttcgctgatcacttggctttgttatatcttccgattaaaccgaaaggccttccaatttggtgccggttatctcttcgtccctttcgcactgattgatttcattgtgtctctgttggctgtgctttgtttcggcatcagttcgttgatttgcgccattgcgctgcttgactcattggaatacagcttaggccacatcatctcataccttctcgccacggttttctgtcttatttctggctcggccttcggctattttgccattcttgtctaccgtctgattccgaatggccaattccgccatctgatgacgatggtaatcgaaggtcatcagaccactacgttggatggccaaggcggtgtgggcccagtaaatgccggccccccaccggggagaccgcccgtgtgaaaattcgcaatattttaatttatcattttttgcttatttgctcacttcccaaaatgcttatcagcccttcctcactttattcttcatatatgcaaccgatcctctccaaattatcatttttgcgagctccggtctccccctt

SEQ ID NO: 89311 - DNA, 756 bp, Heterodera glycines
  SCN-specific regions: Sequence locations=1-382,405-417,439-756
gtccaacggctcacccattcacaataaaaatgccgttttgtccgttggtccccatggtccgatgctaatgcaagacgtcgtttatttggacgaaattgcgcacttcgatcgcgagcgcattccggaacgcgttgttcatgccaaaggcgccggagcacacggctacttcgaggtgacaagcaaagacatggccgagcactgcaaggccgccatgttcagcgagatcggaaaacggacgccgcttttcatccgtttttcgcgtgtccgtcggtggagataaaggtggagaatcggggagcgcggacaccgcgcgcgacccacgcggttttgccatcaaattttacacggaggagggcaattgggaatttggttgcaaacaacacaccggcaagtcaaaattttcttcatccgcgacccttttctctttccaaatttcattcattcgcaaaagcggaaccccgccacccatctcaaagacccggaaatgatgtgggacttttggactcttcgacccgaatcactacaccaagtgatgtttctgttttcggatcgtggaattccggacggatttcgctttatgaatgggtacggtagtcacacatttaaacttgtaaacaaaaccggcgaagcagtctattgcaaatttcacattaaaacgcggcagggcattaagaatttgtcccctcaaaaggctctccaattgtcggccgaagaccccgattacgccattcgcgacctttaccatgcgatcgccgg

SEQ ID NO: 89312 - DNA, 1114 bp, Heterodera glycines
  SCN-specific regions: Sequence locations=1-5,44-92,115-126,148-1114
aaaagataaaaaatattaattaaattaattttattttattaaagtggccaataaaatggcattggcaaaacttaaaacatcagtttttgccatttttgttgtgctttttgtttcaattgacaagtgccgatgtacaaacattctgttcacctttttccatgacacgggaagccatttccaatcggtgtttccattgatgcaaaagctggcgagtcggggcaataatgtgtccgttttggacacagtttatgagcaggaccatagccttgaaatccatcactttcgggcgcttttgcccaaacaccataacgatgaaacatctaaacgtcactttgccaatgacatttggtcacgccgtctttccgccactgatttggccctttattttgggacatgtgacaaggaactcggaattttgatgcaaaatcacagccaaaaaattgttcagctgttcgacaccaattgggatgtcattgtgctggacgaccttttctggtccttcggtttcgccttcgccactttaagccaccgccggtggcatttggcgccgaatgagcgcaaagagccgcacattgtggcatatgcaacggcacagagcgggctcaattcgcacaattccatcagagcaacgagccaattttgggtcggtcggcccacactctgtccgctgtatccgaccgattccaacgacgttttttcgcccgaccgttttgtccaccgaatttacgcccttctggacataatccaagaagctgttgcggtcaatatttttgcccttcactttttgatgccaaacattgccaaattcggagtgccgaatttcagcttcaccgaattttattcgcgtagccaattgttcttgcacgacagcatcgacaggctcgggttgccggtgacaactgctgctgacattttcggagtcggcgcccattgcaaaacgccaaaagattcttccgccctttccgccaaaattaaacagtttttggaggacccgagctcaaaaggcacaatttatatcgccttcggttctcacatcgattggaaatttgcgccacggaaatttttggacgattttgtcaccgtttttcgaaaactgccccaatatcgtttcatt

SEQ ID NO: 89313 - DNA, 881 bp, Heterodera glycines
  SCN-specific regions: Sequence locations=1-881
tctccgactccccgccaaacatcgatcctgaaaagggctttcaattatccgcaggcgtgggccactcaaaacattcctcaacccccaatggaagagttcgggacgtcgatgaattggccgaggaggtgcccggtgaatccgatgtgagtgacgaggaggacgcagaatcgcctcttccttctgtccatgctcaaatgggcttattctgtcacacaaatccggaagtggcgcccgcttcgatgtggacctcgaagaatgtgcaggaatttaaagacaacatcaagaaagagggcaccgagggagttctgaaaattggtcatggcgaaactgtcacagttcgtgtcccgacgcacccagagggcaattctttagtctgggattttgcaaccgattattatgacctcggttttggcgtttatttcgaatggacaattgcggagacgaaccaagtgacagtgcaagtggaagagagtgaggacgaattggaggacgaccaagcggcggggggcgagggacgcaccggcggacagacggcgggcgacgatgtggaagcggacgcagcgaagcgacagaaagacgcgaacaaaccgcgcgtagacgaaatcattccgaccttccgaagggactgtcacgaggaggtgttttccggatctcatgtttatcccggacagggcatttaccttctcaaatttgacaattcgtattctctgtggcggtcaaaaacgttatattacagagttttctacagcaagtgatatcatccagattgattgttgaaatgtgaaccatgaatggaaatgattgaataaatattacccagaagaaaatgtctataatcaataggattgtcaatttcacgtaaatacatatttttcctggaa

SEQ ID NO: 89314 - DNA, 633 bp, Heterodera glycines
  SCN-specific regions: Sequence locations=1-369,391-514,536-633
aggcatgcaagaactttccaacattcgattggccactcctccgccacaaccgccgccggtgcttcgcaatgttccgttgcctcccgtgacgtcgaatgtcagcgaaatgatggtggaccgcaattacattgcaaagggagtctcgccgccgaagttcaaaccgattggcgaactgtcggattaccagcaacaaatcaacggatcacaagaagtttcaaacattcgattcgccactcctccgccacaaccgccgccggtgcttcgcaatgttccgttgcctcccgtgacgtcgaataacaacgaaatgatggtggaccgcacttgtcgaaacaacacagcaaagccgtccgcttcggattttgggctcgctgcttcatcatcatcgacatcgacaggagaggaggacgatgcgcaactgttcggacggcgagtggtcaaatttctgcgcagtttaaacaacggacgccgcaggcgccgcgcatgcattggcattgagcaagtgatgatcgaatttgaaacggaggaggaagaggagcaaaagcgatgatcacctaattatttgttttgatcggaatcacctctgctggatatttttgtggattctttgatccgttaataaaccaaagtttaaaa

SEQ ID NO: 89315 - DNA, 572 bp, Heterodera glycines
  SCN-specific regions: Sequence locations=1-47,69-572
gccacatataatccgaccccttattactgtatttacctaaatctgtattaatgtttaactttttattacctatcctactttaataagtttgttaacggacaatgcaatgtgcctacaggttcaatgtggcaacgttaaattgctggcttttaccacacccttggccaatcggaagcaaacacaaacaattccgtttgcaaaaattaatcgacgaactgaaaaattcgcgttttgacgtcattgctttgcaagaagtatggagcgaaaagatttttcttcaaatcgcccatgaactcaatggattttttccccattcacattatttccacagcggatttacgggtagcggcacatgtgttatcagcaagcatcccatagtttcaactttactccataggtattccctgaatggctttcctcatcacgtccaccggggtgactggtttggcggaaaaattgttggaatggttgaaataatggtggagcagtatcgcgttgcattttatacgacacaccttcatgccgaatacaatcgaaagaaccatctcttccttccgcaccgcatctcacag

SEQ ID NO: 89316 - DNA, 651 bp, Heterodera glycines
  SCN-specific regions: Sequence locations=1-78,100-149,171-265,287 -477,499-651
gccaacggaacttcaatttttggacgaatcggttgccgatgaagaggcggttcttggcagtgaaattacgctacaccaacacaaaatggagaaggaagaggaaaccacttttgaagagcacgacgacatgacagctccgaaatcggtttttggttcttcttcatttggctgcaacaaaagggagcactgcaaaagtgatgacgaggattattgtcacagcgcttgtgaagaggggccgacagaggagacaaagaatcattccccgccagaagaaagcagcaaagagaaggagggtgaacaggcggaagacacgggaactgggatgaccgacattgttgaagcagaagcgcttactgaacctggcactccccttcggcagatggacgagacgactaattcccagagaaatgaggaagaaacgtgcccaattcgagaggaggaacagcagacaaagacagaagagaattcgacggaagcgacagaagaaggaagaaggagctaaacgaagtgttaattgtgaaggtcggattttattaatgatattttagttttatcacattaataatggtgtctaaatgtttgaaaacccaccagaattactcgcctgattgacaaatactcccagcccccaacattcaagtatttctacat

SEQ ID NO: 89317 - DNA, 595 bp, Heterodera glycines
  SCN-specific regions: Sequence locations=1-304,326-595
gttccatccccaagtccgcgtttcgtttcggcactttcgaatttctgaagggtcacgcggtggatgaacgcggcaatctctccccgttcatgcgattggcttgtggccttggtgcgggaatttccgaggcgatttttgctgttactcctatggaaactgtcaaagtcaaattcatccatgaccaaacgctggaaaagccgcgtttccgtggttttatgcacggaatgggcgtcattatgaaggcggacggtccgcggggtttctatcaagggcttaccgcgacaatggcaaaacaagggagcaaccaggcaatccgtttcttcgtcatggaaacactgaaggattggtaccgggacggtgacccgaatgttccggtcagcaaacccgtggtcggattgttcggagcaattgctggggcggcgagtgtgtacgttgcatttgctattgtcacaattctttttttttacttccgtcccttccattttcgtttttatttctctttaccctaatttagctatggaaacactcccattgatgtggtgaagacgcgaatgcagggcctggaggcgagcaaatacaaaacactttcgactgc

SEQ ID NO: 89318 - DNA, 724 bp, Heterodera glycines
  SCN-specific regions: Sequence locations=1-1,27-411,433-449,471-724
gagatttcattttaaaaaatgtgttgtgatagcagctctaacaaatggatgtgctggttcggctttcacgtgacaaatggctctctcgtcgcggcgtggatttttttattggccggcatttttgccttttcaagtgtcctccaaatgcttgtttttcgtcacttttatattgaacacattttcaatttgatttcgcccattttgcttttgtgtggaagtgtgccgataattgttggagaaatgcgcgggcaaagaaccagcaaaatgtatcgaccatttctgatcactaccgtatgtttttggcaataaattctgatcactaccgtatgtttttggcaataatcactaccgccatttcttttgcaataacggcgtttcccgaacttgttggtaaagtgctacgttttatacgagccggctttgatactcattactttcttgatttgtggccttacactctggcccttatctcaatttggctttacccaattgtgtatcgggcgtacaaatttgttcaacaaaatgaggaacacaaaaacggtggaccgtatggacagaatgccaaagtgatcaatcaacagtatgccaaagtggtgccaatgccattgccaaatgccgaaatgattggataattgcattcttttatatggaatatggataaattagggcgatcacaagctgttttttatgcaactatggaacaaatcatggctcacaagttgtt

SEQ ID NO: 89319 - DNA, 825 bp, Heterodera glycines
  misc_feature (809)..(809): n is a, c, g, or t
  SCN-specific regions: Sequence locations=1-43,85-786
gtccaattaagagttttgatacctccttaaaagcaaggagcataaatatatttttgtgtatttttccttcatttattttgctttgctttcaaagttagtgctgaaatgacaacggaagaacccatcagcggcggacagccgaacacgccgccaatccccgccatcgaattgtcttaccccgtctccgtcatttactgtggcgaatgttcgatgcccgtcgaatactgcgagtacagtggcaaatttgagaggtgtcagcagtggttggaacgcaatttgcccgatttggcggagaaacaaatgaaaattggggcaggagatggaaaagcggcggaggaagggaatggggaagagacggaggcaaaaaagcaccaaaagcgaggcggaaagggattgccgaaggcgagtgggggcgggaagggctcgaaagagcagtccgctgcggtgccgcggattacgctgaagacggaagtgcggagcaaaaacaaagcggtgaccgtcgttaaaggcctcaccacttgcggtgtcgacttgaaaaccgcctccaaattcttcgcaaatcgtttcgcctgcggctgttccgtcaccgttggctcagccgacgaattggtcattcagggcgactttaaggacaaactcttcgtagaaatcccgaagaaatggggcgtcaatgaggaagtcattgaggatttggacgaccaaaagaagtgaccactcccctttcacactgcttgtttttactttaatttatatactaattcattgctttgttgtcgtgccgaaaagataaattttaattcatttaaaanaaaaaaaaaaaaaaaa

SEQ ID NO: 89320 - DNA, 851 bp, Heterodera glycines
  SCN-specific regions: Sequence locations=1-851
actctccggtgaactcagctgaaagactgcacatttcgctgttagaatatatcaacgaaaccttcaaaaatgaggatttctaccattttctttctgtccaatatcggtcaaatgaactaattcaaaaatggtccaacaaaatattctacgacaacaaattggtcacttatcagttgacgaaaaacattcacttgcgccaaataataaaccaacaaaatgatctctcctctggtcctttgtcctcaaaacaaaaatttctgatcgatggtccgcttgtgctcatcgatacggacaaaggcatttctgacagtaaatggcagaaagtctacagcttgttcaagttgtggtatcccctctctttccgcgagggtcagaatgagcacacgcactccttccacaacattggcgaggctttctgtgccgtccttcacctccacgcgttgaatttattcggcggtttggatttgtcgaaaatcggttgtattacgccgtactcggcacaggcggaaaagattcaaaagttaatggccatgggaagggacgagggaccacgcttcgaagtcagctctgtcgacgccttccaagggcagcagcgagaagccattgtgatgtcattggtgcgcaacaacaaaatgcgcgacatcggtttcctgagagaacaccgtcggacaaatgtggcaattactcgcgccaaacgccaattccttttgatcgcctcttcacgaatgttgaatgtggaccggcttcttagagaactgtacggtgtaatcagaacggatggcctggtgggggggcccgacgctttgctgccaattgctcatgaaatttggcagtgtcatttggaaaggaag

SEQ ID NO: 89321 - DNA, 658 bp, Heterodera glycines
  SCN-specific regions: Sequence locations=1-143,167-292,318-556,580-658
aagagactcacattgtcttgggcattggcacggtatgctctctgctggcgattatcgccaccgtagtcacactgccatcactgtactcggagatgaaccaactaagcaacaaagtgcgcgatggcgttgaagccttccgcgtgaacaccgactcggcctggactgatctgatggacgtgcaagtcgtcgtggcaccgccgtcaaaggcccgtgacaaccccttcagctccatcttccgtgccaagcgtcaattgcccggccattgccattgcggtcccccacaacggccaaactgccctcctggcccacctggtcctgccggaccgcctggccaacccgggcagccgggaagcgcaggactgcaaggacagccgggagcacctggccaacctgctcctccgtgcccgccccagaacatcccgtgcccactctgtccggctggcccacccggcagccccggaacacagggaccgcccggacagcaaggagcccctggccaacctggtgcgcccgctccgggcggaggacaaggaccgcctggcgcgtccggaccccaaggacagcctgggcagccaggacgcagcggaacacccggccaacccggacagcctggaaataacgctgttatttataacaccattcctgggcccgaggggag

SEQ ID NO: 89322 - DNA, 951 bp, Heterodera glycines
  SCN-specific regions: Sequence locations=1-951
gtccaattaagctaaaatgaaacgtaaacgtacttctaatacttcgagtcgcccaattaagcaacagtccgttgcccgttcttcgggttccttttttacgccttgggggcagaggaaaagtgcgcgctttttgaagatgggcaggcgaatttacctctgcaatgatgttttgtacgacattttcgccgacattgacattgttcggcttggccttggcattgcccccgtctccgctcacttcgatgctttggtggacagttgtttcaagaccaaaaagcgcaaattgcgacgcctttggatccgtcaggccattctcaccatgcgaaggtcgatccagcgcaaaactgacaaggccgaattggtcaattatgagggcaaacaattgccatttgccaaggcgccgcctccgaatggaattgtcggcttcaaatccatcagcataagttacctcgatgctgatgccatggcatttttggagcacagtcggcccctcttcgaccgcgtgggcatcgttttcaaatgcgacggagccatcaaagggcgtgggaaggaatttgtccaaatttggccccttttccgtgccaacatcgtcaaaatggctctcagccaacgtttgttggttcgcctgcgccgtctctgtggcccgaccgttctctgcgcctgtgccaaccttcgcttcgtcaacgtcgatgatgaaaactttgccatgaaatctccggcggacgacgccgccggcgcttcgccgggccaagcgctgctcaaatggctgtacacaccacgggaggacgggcagccgaaagtgttgacgatgaaggagaagccgaaaaagatgatggatgacattgcaaaggaattctccactgccaccactcccgtcagtttcattgtccgctttcgcaaatcgtcctgggatgcctacgatgacgcggccctcaagccgtttgagctgtc

SEQ ID NO: 89323 - DNA, 896 bp, Heterodera glycines
  SCN-specific regions: Sequence locations=1-831,854-896
gtgcaattaagttttgttatattttattcgagaagactttaattaccattctccgatttgttttgactttttgcaattggacaatgtcttcggaacaagcattaaaagcaaaacaacttggcaacgaggcgtacaaacggaaggaatttgccactgctcacaaatattatgacgaagccatcaaatatgaaccaacgaacatcgtattttacagcaacaaagccgcagtttttttcgaggaaggaaaatacgacgaatgcatcgaaatgtgtggaaaagcggtggaagttggacgagagaatcgggcggactatgcgctggtggcaaaggcttacgctcgaatggcaaacagttacaaaatgaaggacgaccccaagaaggcactgcacttctacgaaaaggcattgtcggaacatcgcgacccggacattgtgaagaagcacaaggaattagcgaaggaagtcaaagagatggagcagaaggcatacattgacccggaattgtcggataaagaaaagaacttgggcaaccaattgttcaagaaaggcgattaccccggggctatgagacattacaacgaggcgattaaacggaatccggacaacgctgtgctctactcgaaccgtgccgcgtgcttcaccaaacttatggaattccaaagggccgtcgacgactgcgacctttgcctgaagaaggacccttctttcgttaaggcgtacatcagaaagggcgctgctttgtccgcaatgcgcgagttcggccgagcccaaaaggcttatgaggacgcattgcaaatggacccgagcaatcatgaagcgatggagggactgcgcacgtgcatgcagtcgaacgaggagaacccggagagggcgcgggagaggggccttgcaggaccc

SEQ ID NO: 89324 - DNA, 1850 bp, Heterodera glycines
  SCN-specific regions: Sequence locations=1-7,29-445,468-485,507 -586,610-679,701-972,1001-1005,1052-1054,1077-1093,1134-1156,1182 -1191,1214-1236,1266-1285,1307-1702,1724-1850
ccggcacttccgatgaagaaatggttcgacaccaactatcatttcattgttcccgaactgagcactgatcagtccttttctgttggcctcaacaaaccgttgaatgactttttgttggccaaaaatgcgctgaatttggtgacaaagcccgtcctggtgggcccggtcactttcttacatttgagccgagtcggagaacggaaggaattggcgacggaggagcagcaaaaagtgcacaatttgaagctgctcccgtcgctgttgcctcattatgtgaaggtcgtccaatcgctggtcgacgccggcgccaaatggattcaaattgacgagccaatctttgcactgacttttgcggagaatgaggcgcccgcgtattacgacgcattccgacagaccgcgcgggcactgcagcaagtgacggcgaagaaggcgcacttgctgttcgccacgtacttcagctccatcgcgaagaatgtgcaaattgtcaaagaccttcccgagggcactggcattcacattgacttagtccgtgcccccgagcagttggacccagtgttgtccgcgttgccagccaattgctttgtctctctgggtcttgtcgatgggcgaaatgtttggctgagtccgctgcgtcagtcatgccaatgcgttgcgcgttgtgcaaaaattggcaccgggacgcgtgttggtcagcagctcatgcagtctgttgcacgtgccatattcgaccaaaacggaaaagcgcagcgcagaaatgccaaaaacggtggccactggaatggcctcgtcgaagataatccattggctatcatttggcattgaaaagtgcgaacaattggtgaccgtcgccaaaatgataaacggcggagactgcgccaaagaattggcagagaacgacgcccttctcaaagaccattccgtatccccgttgatacacaacggaacagtgaaggaaagggtcaccgccattgaggcttctggcgttgagtcatacttccgtaagtcgccctatgagcagcgcattgtgcagcagaaggcgtgcctgcagctgccgcccctgcccaccaccaccatcggctcgttcccgcaaagtgcgacggtgcgcgcgatgcgtgccaaattcaaagcgcacaaaatggcggacgcggattattgggcatttatcaacgcggagacggagcggtgcattcgcatgcaggaggacattggtttggatgtgcttgtccacggcgaattcgagcgcaatgacatggtcgaatatttcgctgaacatttgcacggcttttgcgtcacttccaacggatgggttcagtcctatgggtcgcgctgtgttaagccccccgtcctttacggcgacgtgcaaagggcgggcccaatgaccgtggcaatgaccaaatttgcgcaatcgttgaccaaaaagccggtgaagggaatgctgacggggccaatgaccattttgaagtggagctttgtgcgcaacgaccaaccgcagaaggacacccttttccaggttgcgttggcattgcgcgacgatgtggccgaattggagaaggagggcatcaattgcatccaaatggacgagccggcattccgcgagggattgccgttggacccggcacagcacaacgaataccttaagatcaccgtacaggcattcaaaatttccactggttgtgttgcggactccactcagatttattcccacatgtgctactccgactttggcgacattttcacgcacatcgccgagttggacgcggacgtcctttgcattgagtgctctcgctcggatttgagtctgctctcctgctttgaccgctttggctatccgttgatggtcggccccggca

SEQ ID NO: 89325 - DNA, 653 bp, Heterodera glycines
  SCN-specific regions: Sequence locations=1-266,293-428,452-501,532-653
cggtgtttcaaacggtgctcgaggcattggaataccctcagataaaagcgattgccatcatcgccgaaggagttcctgaaaatcagacgcgaaaactgataaaagtggctcgacaaaagggggttactgtcattgggccagcaactgtcggggggataaaacccggatgtttcaaaattggcaacactggcggaatgatggataatattctcgcgtcgaaactctacagatcaggaagcgtcgcttatgtctcgcgttccggaggaatgtccaacgagctgaacaacatcatttcccacaacaccgacggagtgtttgagggtgttgccatcggtggggatcgctaccccggctccacttacactgaccacattcttcgttatcaagatgagccgaaaagcaaaatgatgggtcttcttggcgaacacggaggcgaagaagagtacaaaatcgtccaggcgttaaaagaaaaacgcataaataagcccctaatctcctggtgcattggcacttgtgccgatcacatcacttccgaggtccaatttggccatgccggggcctcggccaacgccgtcaaagaaactgcggcacataaaaacgctgctttgaagtctgctggtgctcacgtgcccgactctttcgatgactttggt

SEQ ID NO: 89326 - DNA, 660 bp, Heterodera glycines
  SCN-specific regions: Sequence locations=35-326,349-660
cctcgtgccgattcggcacgaggcaagtttgagccgtaagcaatgagttcttttccgaaagcggtaaacatcaagattgagcacaacaattctttttcggaccacgattactgttacaaagaatctgcagttgaagaaatggacgaagaaaatcgttccttttttgtcgacgtggagaacgatgacgaatatgacgatgagtataatgcccgtggtcggaaacggaggagcgtcaaacagccggatttttttatgatcaacaacaaagccaacaattcgaataagaaaacgtcaaaggcgaggccgaggaaaagcgaaagcaaaagaggaaagagtggggagaaaaaagtcaaatacgaagtggaatacatatggggcaaacgcacggacaaattgcgtcctgataaggtggaatatcgcgtttattggaaggggtatccgattgagaagagcacttgggagcccgaagataatttgcgtttatgccaagaatccatcgaccgttacgaacaacgcgaaatgtatttcaacgacaaaggcgaaaaggaaatgcactcaaagggtctaaaaaaggacaacacagcgggaaatggggtgaaggtggtggtggtgaacggggcaaagccgttgaagcagattttgcccacaatgcaagctcct

SEQ ID NO: 89327 - DNA, 841 bp, Heterodera glycines
  SCN-specific regions: Sequence locations=1-679,701-841
ccaagtttgagcacttaattaattatgccttgccaattgcctaatgaaattgcgacggtcactgacgacgtgttttcgtatatgtgcaatttggcaatggaaaagtgttcgaaaaaggccgataaaaagaaggcctcgtgtggtggggcagcaatgcggaagagacttttgatcaaaaacttcgtggcacaaatgctcgcgcaggatcgccactcgcgagagctgtcttcaccaacttctgactgttcctcccacttgaatcagaccttcgacgagtcgttcgactttccgtcgtgtcaaagcggtgcgaatgcagtggaccaatttggagacgacatggaaatggacgccatcggagaggaagttccatccaatgcgacaaacgatgcctttctgtgcctggaccagccgtcgtcattgttgaccgacttggacgacgtttcgtgcgaccctcagcagcagtgccattcatcgcgcaatcggaagcggccctggtcgttggtgttctccgccgatgccaccgccactgctgactctatgccgatgccgtcgctgtgttcgatgggtgtcgtcgtcgaccagtacaaccaccaccacctgagcaacaccaacaacagtgttgtcgacatgttcacggctgcaacttctgctcagcaccaccacttcatcaactccaccgcaaacaacatcaacaacaacggcgttctccactcgtcggctcctccgctgttgtcgccgctgtgctgcggcatgctgcagatgagtccgttcgggtcggccactgctgctggcgaggccatgctgttcaatggtgctggtggcggtgccggtggtgttggca

SEQ ID NO: 89328 - DNA, 678 bp, Heterodera glycines
  SCN-specific regions: Sequence locations=1-678
agtttgagatgttacgcaaactatctgacgcgtaccaaaaggcacttttgacgcctatttggaacttagttcaacaaatacttgatgaaaattgtcgtgtgttttttggaacacttaacggagtttttcgtcaattggaagacagagaaattgctgccaattgtttgatcagtggtcgcggcggcatcaaagggcaaattcggctcgcacagggcgcggagaaagtactttctgtcagtgggcaaattcacagcccttccatcgagcctgacagaatggaagtacatgacctggggaacgtcaccgctggtagttcttctaccggtcggtctttacacacgttgtgtacttttgcctcggttggtgctgccaatgattacgttcccgctggtgttgtcacggctccgttggctctcagcggttcaaaaatcaattgcatcggtcgttctcttgtcgtttttcaagaagggcgttccgcattgggaagtggcgtaatcggttacgcgaaggacacgcgcattttctcggacgagtttgacgaaatctttcgtaatttgattacacagtacagaaatgtgaacgtctcagattgttggcttgttctcagagacggcacaagttcaaatccagattgtcgcgcgttcttcgacatgttggatgagattttggcgacggaag

SEQ ID NO: 89329 - DNA, 564 bp, Heterodera glycines
  SCN-specific regions: Sequence locations=1-144,166-322,344-523,560-564
aaaaaaagcatggccaaattcctttctggcattatgttttgcgcattgttggcactgctggacaccaccagtgcatggaagcgcgagtttttgcgcatgccgaaaagcaatgaaatcggcacggcggacgacagcagcgaaagtggcaaaaatttgaaaagccaatcggaactgatcgcttcaatgctgccaaaaagaaaaactttgcaatgctactacggcgttgacatgttccgcaccaacaacggcactgaaggtggtgcctttgaggaggtcaaatgcgatgacgaagactatgaccgctgtttaattggcaaatgcaagggacaaaattttgtcgaggtccgcaaattctgtgccaccaaagatggatgtgccgcgtttggatgtgccgttgaggaggaacttgaatgcaaaacgtgctttggcgaactgtgcaacttgtaaaaatggatcgagaaattattttcggattttcaaagatttcatgacatttttcggaccaatttgttcatggacatacaattaattttgtatatttaataaattaatttattttcaaaa

SEQ ID NO: 89330 - DNA, 844 bp, Heterodera glycines
  misc_feature (828)..(828): n is a, c, g, or t
  SCN-specific regions: Sequence locations=1-41,63-844
gtccaattaagattaaatggactcaaaatcaaatgatttcgaggcacgacgaacagtttgggacagcaaagttcctgtagagtttacgttggacaactcagagtccgtcttggcttctcatcagtcctgttttatgatgctttcccgtgtttcatatttcccggtttatctcgacaaagcattgaaagttttaaccagcggtgacgcaagcgaagaacaattactaaatgtatggcttcaatttgacggacaaattctcagatggcattatccgattggcgtcctttacgacatttaccatgggaatgctggcgatggccaaacaactccatggccaattactgttcatttaaaaaattttcccgatgaactcattcgatgtcggacgaaagaaacgctaaaattttgctttttgcaatctctgaaagaggcgtgccaactcaaacttggttctaacattgctgcgtcgatgactaaggatgagcatggtcgactatttgacggcttatgcaacgacagatttaacgacttttggatggtcaacgacaaactgatgggactccgttcatcatcaggcgaagaacagtttagcactattcccgcccgattttatgagtcatcatattcatttcgtcaattgcttttacattccaaaaaacaacttgacgatggcaatatgggtgaagtgttgttgattgacgcgctgcacaaagtgtttcccgattatgccattgaaacagactttgaagcggtgacccatggcattctgttgcccctcaacactccgctcatttggctggctagaaaccttgtgtaccctgacaattntgctcacattgtaata

SEQ ID NO: 89331 - DNA, 656 bp, Heterodera glycines
  SCN-specific regions: Sequence locations=1-656
cattaattaattatgagtgatcagcaacagtccaaaattgtgggtacggcaggcgctgtgtgcgcgctgggtacggtagcggtccttttgctgctgcttgtacagcggaagaagaagcaaagacaatgcaacacagaagaatatgtacgagctggacatgttgaacagctttacatctacccaatgaagtcatgtcgagggaacaaagttgactggcttgattgtggcgagcgaggttgtgcccatggagaacagcgcgatcggcactttttggtggtcgattcggcacggcaaaatcaaatgctgaccggccgcatttacccaaaaatgttgctgatcagtgtccatgtcgagcagggcgtactccgtgttgatttcccgaaccgaagcagccctgtggaggtaaatctgaaggaagtggaagagcgaaacgttgtcctacgagcaaaactgttttctgacctccaaacggatgggttggactgtggggatgaagtggccacggctttggacgagtttttgttggagggcaaagcggcggcgacgacgacagaggacggtagtggtggtggtacggtagggagaaagctgcgcctgatttactacggtggcgactggctgtacacggaacgcgacccgaagccggacaagagctg

SEQ ID NO: 89332 - DNA, 934 bp, Heterodera glycines
  SCN-specific regions: Sequence locations=1-665,687-847,869-904,926-934
aagtttgagcgtgaatttgtctactcaaaatgtcgccaaacacactttgtagcattgtttgcctgcttttggtctgcaacttcatctgggctgatgatgaacacagaagcttcgcagaggaattagtgagacgcctgcgacgttcccatggttactcagttggttatggaggcaattgtgcatgttcttcctccgcctacccggcgaccgcttcacacacttcatacacggcacctaaacaaaccagttactcatcttactcttgctccggttccggctgtggtcatcaagcctaccagccaccccaaaaaaccagctaccattggtgcactgggactgcctgcaacaaagcgcaggctgttgctcatccagttccggtgagcagcaacagttacaagtcttcctgcacaacttgtggctcaagtagtcaccagcagcattactcaaccgtcacagaaacgaaaacagtgtaccctgtgaagacgtactcatggtgcacgggtactgcttgcggtgctcaggctcaacccgttgccccggcagcaagcggtggtggcaccagtattagcaccggcagttcgtgcagcagcggaacatgcggacaacaaaaacaacaggttcaacctgttgcccctgtccaaccggctgccccggctagcaccagctcgtgcagtggtggcagttcatgcggtgccgcggcacaagaggttcagcccgctgctgaaagcagcagcggtagctcaagcagtggtggctacgacacacaggagactcaaccgagcggcagcgatagcagcagcggtgcgtgcagtggagcttcttgcggagaagcggctcagcctggcgccagcagcagctcctcatgcagtggtgcatcatgcggacaagcggctcagcctgccgccagcagcagctcctcatgcagcggcggcgc

SEQ ID NO: 89333 - DNA, 602 bp, Heterodera glycines
  SCN-specific regions: Sequence locations=1-285,307-602
attaattaatgtccgtttggtgccgttttcccttccgaaaagcgtttctttcctccgccttttttcctaagtgtgtctctgcttctgactttgcctttgttcccacttcttccgcgcttcgttctttccgcctttttgtcgacggtccgatgtcttcggatgctctctctgctgaccgagtcgccgctgttttgcgttcaaaatttcctgcgaccgatgggtcggcggtgcacgtggaggacacttcgggcggttgcggcgcaatgtttcacgtgcgggtggagtcgcctcaattcagcggagtgtcccgcgtcaaccaacacaaaatgatcaacgaagtgttgcgaagtgaaatcagagatatgcacgggataaccatcgaaacgaaagccgtggacagagggagagacagcggacagtgattagcgaagggaaagggagagactgatcggagtgaagggagagactgatcggagcgaagggagggactgattggcgcttgttttgtttttttgaactgttaaagttatgggagttttaaattctttcgcatcgtcagtacttgtcccattgtttgtatgtaacaaaagtctaaaaaccaa

SEQ ID NO: 89334 - DNA, 627 bp, Heterodera glycines
  SCN-specific regions: Sequence locations=1-308,330-627
caacggtggtgctgtctgaaccactgctatcttcctctacggttggacgacggtccacaacggtgatgacgacagttgtggatccatcgcttggcagcacgagccaccagcaacacagtccgagcacggctgaaacaaagcagcacgcaccgactgctggggacaacaaaaagggcggaggaggtgcaaaggcgaacccattccggaaccatccgagcctgctgaacagcattacgactgattccgacgctcaccacttaatggaaaattgcaatacagtgaccaatgagtcatgtgctgatgttgctgaaacggaaccaaacgacgaagtctttgccatacttaatgaaacgacctcaaccacagcagagaatgaattgggcgagggattaagcgccaacaatggggcaagttcggttgtgactttgggagaagaagcagcgtcggcatccacaacaaatgcttcgacttttgccacggcgccgttgatgagcaaaagcggaatttggttgggtgcgagagacacggacggggcactgtatttttaccacagagacacacgggaggctcgttgggacttgcctgagggtgaggagttgctgataattgacaagtcgaatgttggcg

SEQ ID NO: 89335 - DNA, 868 bp, Heterodera glycines
  SCN-specific regions: Sequence locations=1-742,766-868
attctccggcacaatttggccgccattcgcgacattgtttacaccgtcgaattcgcattgggcgaattggtcgagtcgttgggacgcatctctctggacgtgagagaggttcgccaacagaaccaactccgtcagctcgcccgtcccgtcaaaacgacgttggccatgctgaaaagagttcgccactctttggactccacgggttggtccctgtccactttgtcccggtcggctggcacttacgcgggccaagacgcgttggaccaattcgttgccatgttgccccagctgcccaaagactgctacaagttggtccaatgggtgtattcgctgtccgtgtggcgtgacttgccccgcggcggtgccacttccgtgtttctgcccccgtcgtccggcaccgtccctttccatgccaaaatgcatcctccgccgccccctccggcgccgttcccccaacaacgaccctcctccccaagctcttctctgctcaactattattcatccgagtccatcgaagatgaacaaaataacaacaacgaagacagcttcagaaattgggcaactgtgccaatgaatggctcattgacggatcggcacggagggcaggcaaagggtggcagaatgtttgtcgaacaacaacaatggcatccacaaaatggtggagcattggcaaacgatgtgatggacggcggggagtcgaccagctcgaccagttcaattttgacggcagaagaacggacgggtggaggggggaggaggaagaagcagtggtgacgaaattcgacgccattcgccggacaaaaggcaatcgccgccgatggtcgagaagcaaaaggtggtcgacttggacggggacatggtgatggag

SEQ ID NO: 89336 - DNA, 487 bp, Heterodera glycines
  SCN-specific regions: Sequence locations=1-111,133-288,310-328,350-487
cgggaaaagggggcgaagtgtttctgagcagagagagacacgtccactgcttggaaagagcagtgactcatttggaggagtcggaatctgcgcttgccctgtggaatgacccggcgatggccgccctctccttgcgtctctgtttgagtgcggtcggagagattgcgggccgagtggtgcatgagcaagtgctggacagtatcttcagtcagttttgcattgggaagtgagccaactcaaaacggactcaccgatcgctgcctttttttatttgttacgacgcgccgcaatcattcgcttttcctttcctcgcattgttttctcattgtcagctcatttttccccaaattgtccccggttaaacttttgcttcgacaatcgacggacgctttcttctcacaatcagataagacgttgccattttcttccgactcatccattttaaaggcctacggtcatttccagcggaggaataaatgtgcaaaac

SEQ ID NO: 89337 - DNA, 654 bp, Heterodera glycines
  SCN-specific regions: Sequence locations=1-654
caaaagaaagaattattttaacacaacaaaaccactaacaattttgtgctgcttcttctcgcccttttctcagtgcccaacttaaacttcttccatccgcaaatggcaccgctttgtttccaagtgaacgaatattacgcgcagatttcggagttggtgcccggcctgtacatttgcggggtgaccggactgacgccggccaacatgaaggccttccgcatcgagttgatcgtgaatgccaccagggaggtgccgaacctgaagagtcttggccatatccagcggatgaagctgtgggtggaggacacgacggatgaggaccttttcccgcactttgacatcgtggcagatcagatccatgccgtcatccaagaccgtggtgccgttctggtgcactgcgtcgccggagtttcccgatccgccgccatctgcttggcctatctgctcaagtatcggactcggtctctgagagccgcctaccatttgatgtgctcaaagcgtccgatggtccgtcccaatcttagcttttggcgccagctcatccactacaagcagcagggcaagggcaatgtcggctcggttcgcatcgtgcgggacgaagcacagcccgacaaattgctccccgacgtctatctgaagatcgtgatccccgac

SEQ ID NO: 89338 - DNA, 659 bp, Heterodera glycines
  SCN-specific regions: Sequence locations=1-78,100-624
gtatccccccccccattcattcattgctcatttcctttgaaccgtttgcccattttccattggccaaccatcaaaaaatgaaactgtctttgttcctgttggcactgttcggaattgtgctcgtttttgttgcggcaggagactacggttacggtggatacggcaagaaaaagtacggttctggaagccacgaatacggctacggtaaaaagaagcattacaagaagaagcactacgacagcggatcctacgaatacggaaagggcagctatgggaaaaagaaatacggcgactacggtggcaagaaatatgacgactatggtggatacggaaaggactatggatacggcggctatggcaaaaagtacagctacggcagcggctcgcatgagtacggaaagagctacggtggctacggaaagagttacggtggttacggaaagagttacagtgcctacggaaaggcatacgatgactattacaaaaaatactgaggggagacggacaaatgaacggacgacgagcagacggcggacgaaaagggaccaaagattgttttatttgattcataattttcaattttattatgcaatggaaaaactgtgaacgatgaaaaactttgtcaaaaaaattttctaataaaaattaattttttaaaa

SEQ ID NO: 89339 - DNA, 482 bp, Heterodera glycines
  SCN-specific regions: Sequence locations=1-253,275-482
gtttgagagaaagcgaagagttaattgccaattaaattcaaatggcataattggcattgacggcgcgtgaacagtaaaatgaattggtatcagacggaagaaatggtggcacggcccatccctggtggccacctccttgaaaatattgacccaaccaaagtccgcttgttcgttaaaatctttgcaacgcaattgcgtcggcagcccatcttttctcggaatgtgcaaccatttggacagaacttggccagccgttgcatttggcccatcaaaatcaccaaacgcatcgggcaacagaccaaatgaatcgattgaactcaactgattgacatcagtagaattgtcggtgaaatgagacgaagtccactcttatagtagttttgttcacggtgttcagaatttgcttcgttttcactgttgttgttgcacataaacccgcgtttctcaaatagagggagggcaattacaacaaacacaaaaat

SEQ ID NO: 89340 - DNA, 713 bp, Heterodera glycines
  SCN-specific regions: Sequence locations=1-114,136-368,394-459,481 -587,610-675,697-713
tgcttttgctctgcctgtcactcattcgacttcttttttgtctgatgtcgaccgttctttcatccccccttcgccatccaccacacattttgacgctgttccaatggttgttccggacaatgtttttccaaatgatccaacaaatgagcaacaattcaacacaatcaaaatgtgggggagtgaccggacaattgtgactttgcttcatcactacgcagaatggtccatcaaatacccgagaagaaccggcggtttaaagttattggtcgaagcagttcagagaagggctcaagaaatcggagcctctgttccgacagaccacacaataaaaaaatcgaacttgcgcgatccgtaagaaaatgcgcaacaaacagaagaaagatgaggaggaggcgcaacagaaattacaaagtgaacaaattgtgcccatcccgcaacacgaacaaatccaacaacagccgtcaactttccaaacaccaacggactggagaaattcgccaacggatgacgaagatgaaatcgaaattttgggttgttatgagatcgaaagaacgaatatcagcacagaagttgaaggaaataacgagcaaaacagcgacaacaacaacattattactaccaattgtgaattggtgcattcgacgaataacgagaacaatcaggaagatgccgagaaggaaagccacgaagaaaacactgttgtggatgttgca

SEQ ID NO: 89341 - DNA, 650 bp, Heterodera glycines
  SCN-specific regions: Sequence locations=1-650
ttaagtccaattctttctctttgtctcgtccaatcatctttgccaatgtttgtccgttgtttcattttgcctttcatttctttgacattttttgtgtccttttgcacggcaatgagaagaaatccatcggattatgatcagtcacgggtgccgtccaatctgaggataatttcatggcttctcggcgtttggcgttcagagcatgacggcaaagcgatgtttcccaccatcccaaaattcacttacggcgaagaaatttcaattgcactttcggacacgcgaatgaacggactgccggcatttaattactctgcatttgcctggtcagcacatgaccaagacgagttgcacagtgaaaacggttacattaccgtatcaggcggaaaagtgatgctcactaccgtaatgaacaacggatttgtcaccgtcgaagagggccccgccggtggctcacgaatccgcttcaaactcgtggacattggccgtatcagtttcagccgggatttgcccgtccatgacttggtccgcgaatggactcagttggaccacaaccatttcgaggcccgtctcgacatggaaacgctaacccatggaatgcaagaacacacagtgattgtctacacaaaagtgatgtgagaagtgatcaaagc

SEQ ID NO: 89342 - DNA, 655 bp, Heterodera glycines
  SCN-specific regions: Sequence locations=1-472,495-655
aagcgatgaaacaaacggcgccgatcacaaagacgggcctggcaaaacgcagtctccgctcgggctacgccttctcccactgcagtggctttggagaactgatcgccaagggcacgatgttcaagaacatcgaacacttgcgcatcccatcatttcagtttgcccttcatcatgattcccactccaaccatcgctctcgtcgccactctctttcccgggtccatcctgcactttcctcggcaaattcttcaacgggtcacagttccgatcagcaaattcttaacccgatcgtcctcaactctgataacgacgatggcgaaggtgccgcagtttcttcaatgactcatttttcgccgacttcgtccaatatgaccaccaccacgacattgggaggtggcaacgccaaaagccaacaaaagattcggccaattttgccccctcctccggcggtgccaaactcttctcgactccatcagtcccaacaccattctcatcagtatcggcaccataagcatcatcaaccgacttcaactcggcggagtaccattgaatcattagtcattgagcaaccgccgtcagcggacgatgagaaggacgacggaatgacaccaatgatcacacaaatcgtagtagtcaaagaagaggatgaggaggg

SEQ ID NO: 89343 - DNA, 819 bp, Heterodera glycines
  SCN-specific regions: Sequence locations=1-324,346-403,426-557,579-819
tttcctttctatccttaattttgaaaatttgaattgattgaaaataatcgtgtccattcattcccgcttttcccattaaaatgtcccaatttggcccggcattcgctgtcaatgccaacaatccgtacgctcacttcaaatgctgctgtgcaacatttaatatcaaagaccatgcccagttttgcggtgtgctcagtttcgcgctgttcctctgcctcgtgctcatttccatgatgcttttcgggtcgctttctctgttttacattttcgttggtgtcgtcgtttacattcttttgatgaaaactctctttggcgtcgtcaacaaattgtcccttctcttttacatctttttcgaggccattcaaattggcttttacttggctttgatgctttacataattgtaccgttgctttttcttgaaattccccgtcgcaactgtcggaatgttgagatcaacagtgaaatttgcgacgaacccagaaatcgctccgaagattacgtggaattgcttttgtttgtctctctcttggcctcaatcaaactgcactttgccagagtgtttgcccatttctacagatatttgacttggaatgagcagtgttcggtgcatcgagctcaatacataaacggacgaggcattcacatcaccatggatcagccccaattcgctgcttcgttttccccttattacggatgggacactcacaccgtaaagggatgcgacagaaggggacgacagaatgagacaaacaatcctaatcaattgcccataacggaactgccgccgacatacgcacaagtgatcggacaaaacgcag

SEQ ID NO: 89344 - DNA, 636 bp, Heterodera glycines
  SCN-specific regions: Sequence locations=1-92,114-120,147-636
gtttgaggtgaatatcgcacaatacataatatgtttcgagttgccaaaacacccgcccattatcaacaatctgttcgctcattcgccaccctaaaggacatttccatccgtctcaagtcgatcaaaaacatccaaaaaatcaccaaatccatgaaaatggtgtcggcggcaaagtatgcgaaggccgaacgcgagttgaagggcgcgcggacatacggcgaaggggcgcaattcttcgtcagcaatatcaccgcgggggaccaaacggagccggtgaaagttgccgaaagtgttgtcgaatcggcgggccgaaaacggcttctcattctgatgagcagcgaccgtggactgtgcggatcggtgcacacttcggttgccaagaccgcaaaaaacattatggccaacaaaccggccgacgtcgactacaaaattgtgtgcattggggacaaggcgaagatgctgatgcagcgactctacgccaaagaatttctgttcaccgtcaacgacattggccgctctccgccgaccttccaagacgcatcaattgcagcaaatgccattctctcctccggctacgaattcgatggcggtgaaattctgttcaaccgattcaaaacggtcgtttcgtttgagaca

SEQ ID NO: 89345 - DNA, 720 bp, Heterodera glycines
  SCN-specific regions: Sequence locations=1-568,593-720
cttaaaatgcttcacggatggcgagtttttgcctcatgtagcaaatcggttttgaaatcgccttccttacaatcgggtggctatggtttgtcgcgaagactcaagagcgatgaagttcgtggtccagttatcggaattgacctgggtacaacgaattcgtgtgttgctgttatggaggggaaacaggctaaggttatcgaaaatgcagagggctctcgtaccactccatcaattgttgcgtttaccaaagataatgaacgactcgttggtgcaccagcgcgaagacaggcagttacaaacagtgagaacactttgtacgcgacgaaacgactcattggccgccgctttgatgaccctgaagtgcagaaggacataaaagttgtgccgtacaaaattgtgaaggcgtctaatggcgatgcttggcttgaagctcaaggaaagttgtattcgccttctcagatcggcgcttttgttttgatgaagatgaaggagacggctgaaagttttttgggcacttccgttgcgaattctgtcgtcacagtcccggcgtatttcaatgactcacaaagacaggcaacgaaagatgctggaaaaattgctggactgcatgttcttcgcgtgataaatgaacccaatgcagctgccttggcttatggtcttgataagggggaagacaaagtcattgtcgtttatgacctccgaggcgggacgttcgatatt

SEQ ID NO: 89346 - DNA, 715 bp, Heterodera glycines
  SCN-specific regions: Sequence locations=1-282,304-715
gggagacggactcctccgcatcgtctatgtccagtcacaccgaaacgatgaaaagcagcagcaacggctccgattggcctttctgctccgatcggatgaaaatgatgcagaagccggccaaactgaacctgaacgaggcgggccccgcccctccgagcccgtgctcagtgaagacaccgcttgagggcgtatcgacggaggacactttgcaaagactgaggccgaaggaggaccaagcggaacaaagccccacggggacactcgcgacacggacaccgaaggactttttcttcataaaagtgctcggcgaggggtcattttcgacggtgtattttgcgaaagaagtgaccacgggggacgaatatgcgataaaagtgctgctgaaaagcgaaatccgacgggaggcaaaagtgcgctatgttctccgcgagaaggacattatggccgcgctcacttacgtccacgggggtcacccttttgtcattcgcctttattgcacctttcaagacaacgaccgactttactttgccttggcatatgccaaacatggcgagctgttggattggctgcgccggctcggctcattcgacgaagctggcacccttttctacgcttccgaaaccctttgtgctttggaatttctgcaccggtgcaaagggatccatcgcgatttgaagccggaagacattttggtgggcgccgattggcacattat

SEQ ID NO: 89347 - DNA, 934 bp, Heterodera glycines
  SCN-specific regions: Sequence locations=1-11,34-934
cttacacattttttgccttctctctctgttgcgctatcacaacacaattccgattcgtctacagcttcttcttccctcatcgacgagatgacttcttcaagatcgcgaactcgtcgtacgaccaccaatgctgcttcaaccgctgctgctggccgtagtcggagccgttcaacacatacgggtcgtcgttccgcgagcagaagagcaatcggcaacagggcaacgggtcgttcatcgtccgtcaggaacgcgtctcgccgagtgtcgcgccgtgtgtcgtccgccaggaaatcatctcgccgacgtcgccggattgtggcgcgcagagcaacgccaaagaagcggtccaagtcggccaagaagcgtggacgtggacgtccgagaaagccacagcgtggacggagtgcgcgtgcgcagcggagaattaccatcacgcaaggagtgttggatgtgcccggtcatggccaaatgacggaagccgagctgagagaaatcttcatggcgggcacgacggcgaatgaaccgacgaacagaccgttgggcggcgcggaagtgattacgacgacgaatgccaacaacagaacgaccggtgggaatgcgaccagcagcagctcctcaagcccctcactcagcgacagtgtctgaacgacgtgacgcgtggtacaacaacaataacaacggcatggagaaaagaggcgatcggaatggatgagaatttttgcagaggatactaattaaatcacggataattgtgcccatcatagagagtgtggctcccctttatgtgttgtataatgaaattgatcccccgtcaaatccatccgatttgtatgtatataatttcacccaaaatgccatcatcatgatgttgttaccaatgcctaaatatatgccatctgtgtattgtgaatgtactaataacatatattctgtt

SEQ ID NO: 89348 - DNA, 646 bp, Heterodera glycines
  SCN-specific regions: Sequence locations=1-646
cttcccactagtcttttaattacgggttctccaaaatggtaaaaacattgtggattgtcagacacgccgaaagagaagacaacataaactcgaattggcaaaaaaatgcgaaccctcaaaaattgaaatcggataacagtccattatcgtcgagaggcataaaacaggccacagaattggcagaaaggttttcgaatgtccaaatcgatcatatttttgcgtctccttttgagcggactgtgcaaacagcgacttttcttatctcacagaggaaaattccgatcaaagttgagcccggacttgcagaggctctttacctttgcgaaagtccgcctggctttgaggaatcggctgaactccgtaggcggtttcctctcgtcgactccgaatatcgctcaatttacgaaaaaccaatgcccagggaaggctttggagatgagtcatgcattcaacgaatacgccaaactcttgaagagattctgaggagatacaacgaagcaacctccatcgtttttgtctcgcatggctcgcccattggtgctcttcacgaagtgttggtcggtgattggaattatgtcggccaagcgacagtcagcaaattcgtcgagacgggggatggcaccggaaaatttagacaggaatttac

SEQ ID NO: 89349 - DNA, 633 bp, Heterodera glycines
  SCN-specific regions: Sequence locations=1-452,476-633
ctttgatctcgggagaacagagtccaagatggacacgagaagatttgttacggtattcggaaccaaaacttgggtgagaactgaccacagtcacacgattccaataataacccattcttcaacagttacactcgcgactcagtcggttttctgaacttcgtcgaagtgctcatgggtttcaattcggcggagcgtaaggccttccttcagtttacgaccgggtctttttctctttccttttttcttatttttgggtgtttttaggtgctcttctttgcctcccggtggcctcgccaacctccaccctcggtcggtcttttcacttccctttgtaaatgcggaaatctgtttttcagtctaactgtcgtacgcaaagtcggttctggagatgggtcttatccggtacgatttttcgctctcatagtcagtgtaaatttcacattcagtccgtcaacacgtgtgtgcattacttgaaactgcccgagtacagcagtgccggaatactcagagatcgtcttttggcggcaacagcagaaaagggattccatttgaattgaacgaattggcggggaaaagcggggacgagtcagaagccattcattttcatcaatattttccattattatgtgacca

SEQ ID NO: 89350 - DNA, 960 bp, Heterodera glycines
  SCN-specific regions: Sequence locations=1-148,170-775,798-960
tgcgtaaatgaaataatcgcccaattaattgttgcacaaaaagagggaagagatgtcaatctgaacaagctaaaatgcgaaattgcatccaaatacggaataaaaacgcagccgaaattagtcgacataattggggcggtgcctcctcagttcaaggagttgctgctgcccaaactcaaagcaaagccggtccgaacagcttcaggaattgtgattgttgcggttatgtgcaaacctcacagatgtcctcacataaatttcaccgggaacatttgcgtttattgtcctggtggtccagattcagatttcgagtattcgacccagtcttacacggggtatgaaccgacttcgatgcgtgcaatccgtgcccgttacaacccgtatttgcaagcggtcggaaggatcagtcagctgcaatcactcggacacagcatcgacaaggttgaatttatcgtcatgggtggcacttttatgtctttgccggaggattaccgcgactatttcatacgaaatttgcacgacgcactgagcggacatcgaagttgcaatgtgaaggaagcagttgcttatggagagcacagcagaacaaaatgcatcggaatcaccatcgaaactcggcccgattattgcctgcctcggcatctcgacgacatgttgtcctacggatgcactcgccttgagattggcgttcagtcgacctatgaagacgtggcacgggacacaaacagaggacacacggtaaaagccgtttgcgaatgttttcacatgtccaaggacacgggctacaaagttgttattcatatgatgccgaatttaccaaacgttgacattgaacgagacattgaacagtttattgaactgtttgaaaaccccgagttccgaccggacggcctcaaaatttacccgacactcgtcattcgggggaccggcctctatgaactttggtcagcaaacaaatac

SEQ ID NO: 89351 - DNA, 642 bp, Heterodera glycines
  SCN-specific regions: Sequence locations=1-238,260-642
acgacgaccgttgcaaattgttggtgaacacgttgcaggacacactgaaaggcattgaggcgcagtcttacaatggtggcggtgccggtctgtcccgtaaacaccgcgttcgcgaccgttctcgctcgccaattcgctcaagcaagcgtcaccgccggtcgcgttcgcgcagtcgttcgcgcgactattcgccgatgcgttactcgtcggccgtgtcgtcgcgacgcttttgagtggcaaaaggggaatgagtagaatatgttgacggattatgggatggttgaacagataaaagctgggccgataatttatgtaagcgcattaccttggcttgtcctctgacttcgcgtgaattgtcacaccatttgtaactttctttgactcataaatcagctgttatctaaagtgtttcctggcacaataaaattcgtttgtggtgggtccttcccatttttcattcgttgtcgtttgttttattttcagcatccctttgttcttctcccctaacttggttactgttatgtaattcttattattgactcactttttgcgttttctctcaacattttcatttttaagcccccccccccccctccctcttaaccaatttttgagttccaaccaaaataataacattacaaa

SEQ ID NO: 89352 - DNA, 633 bp, Heterodera glycines
  SCN-specific regions: Sequence locations=1-270,307-392,414-633
aaactgcttccagggaaacctggtatgccgctcacggtggacgtttcgtttcttcaaagcggcggctacccgagaacatttacactgagcttggcgatgaaggtcactgacgacgagcgaaaggcgaagcgccgttttctcaacctcatgcgcggattcgacaccgaagacttggatgtgctgcgaaaggcaattgagtcgggcggcatcaacatcaaacagtgcgcgccgggaccaccgatggaccttgttgaggaacgcgaggaaagcatcagcagcggagaagaggcggagcaggagccggagatgatgccgggctgttcggcgactattgtcagcacgcgaccacggcattcgatcaagcaaatggagcgtgaccgtattctcttccaacgccaacgctttcccaccgtcgcctcaattcaccatcagccggcgacttcgtccgcctccggcgttttggtgccaattccgacgacggacggcgccgccgctgtgcccggcagcgccggaggctatcagaggcgatattcgacacatcgagaacagcagctgcagcagaggaacagaagggacagcaaattcagcaggcgtttggccgtttacacttcaccaccagaagacagtgccgcc

SEQ ID NO: 89353 - DNA, 1140 bp, Heterodera glycines
  SCN-specific regions: Sequence locations=1-122,145-1087,1117-1140
gttttaatttggtctaaatgccggacggaaaggcgcctcatttcccccaacagcccgtggccaggcaaaatgacgacggctcgcttgagcttgaatgttttctggaggccaacccggtcccggaaatcaaatggttttatgaaaacaatgaactgaaaccaactaaacgattttcattccgactggacaacagagggtccgaggccttttcggccattctgcaaataaaagatttggcggacagtgacaccggtgcctatcgctgtgccattgtgaatccgttcggcaagggcaatgccaacttcaatttgaaacttactgggttcagttcgccaacattcattgaaaaaccgcagatttcttcacgtgacgacggccgggtgatgatcatggagttcaaggctaaatccattctgaaaccgacttttgtgtggcaaaaaggggacgaaattgtggccgagtcggaccgctacaaaatcattctgaaggagacgggaaaccacgaatattacgcggcattggaaattgtggagccaaaaaaggaaaaggacgcgggacaatttgtgtgtacggctaaaaatgagtcgggaaaactgacagcaacattctcagtgaaatttgaagtcccacaaggtgctcccactttcacacgcaagccgcagattttgcaaaaaacatcagactctggcgacccggccattgtgttcgacatcggatttcaggctgaccaaaacccggaagtgatttggctgaacccgaagggcaagaaaatgaaggagtccagcagaatcaagttcgggctgacgccggacggcggcgccaacacttacaccgctcaattggagttgaagaattataaggcaaaggacagcgggacgtacacgtgcaacatcaaaaatgacgcaggagaggcgaatgtggagctgacactgaacatcgaggacgacgaggtcaagcaataagccagaacagaggagcgcaaactctaagcagtgtttaaaatgggccattggacgatgctggcgacgacgaaagtcaagcctaaggagtaaatgggaaaatggagaattttgttgaacgatgccgagaaaaaatttcttgaaaaaatctgtttttatcatgaatccaacctaaggcatt

SEQ ID NO: 89354 - DNA, 639 bp, Heterodera glycines
  SCN-specific regions: Sequence locations=1-639
cgcgaatatcttcctaaagtgttgggctcgtccttcgccgccacaattggcccttaccgcggctatgacccgaacatcgatccgacggtggccaatgaattcacttcgcaggcgtatcgttttggacatggaatgattcaggagttttacccgcgcttggacagtgccgggcgcaccattccctcgggcggatttgccttcgtcgacggcactctccactcggaccacttcattttccagggcggtccggacccgatcattcgtggaatgatgtctcaacagttgaaaaggccacaacgattgacgcggacgatcaccgaacaaatgtttggcaccaccgacttgggcacaattaacatccaacgagggcgcgaccacggggtgccgtcgtacatgcgctttcggcaattgtgcgggctttccaccgcgacgacatttgaccaactgagtcgtgagataatgagtgtcgaggcacgacagaatttgcagaggatatacggcacgccagaccgaattgatctgttcgtcggcggaatgctcgaagacccggtggtgcgcggtttggtcggtccgacagttgcctgcattattggtcctcaatttgcacggactcgcgacggggacaggttttattttgaa

SEQ ID NO: 89355 - DNA, 509 bp, Heterodera glycines
  SCN-specific regions: Sequence locations=1-509
gcatttggttcccaagacggcgtcgtgtcctttgttgacattcgtcaggtcaatcggcagttacccgtcgccttcaaagtctctcaacatccgatcagtcggatcaaattccatcccatcttcgccaataatttcttctcttcctccgattctggcctaatccattgggatgccagtgctttggcccaaggagcgaatttaaatccgccaacaaacggaagagaaatgactggccacgaatctgctgcggacatgcggacgaccggagaaaatgaacacaccaacatttggttgtctccccatgcttcgacgagcgttaatttgcgagtgcttattgacgaggaccctcttctgctgagctctttcgacgttgtgaacggtgcgatcgtcgccgcttctcatacggctgaattggtgtttatgagcaatgataaatttacaaattgaaaaataatcagctgactggaaatctcattattattttgttacaataataaaaacacttgagc

SEQ ID NO: 89356 - DNA, 791 bp, Heterodera glycines
  misc_feature (773)..(773): n is a, c, g, or t
  SCN-specific regions: Sequence locations=1-158,182-564,596-791
gacaaaagtggttcgtcgttttgtttcacttagcacattcattgatgagtgtttttctgaactccgtcagaaggctgtccgtcatcagttcagccatgaaatttcttagacaacaagaagcgattgacatcgaccgggagctgttcacctcgtgcggtttcagcgtggaccaactgatggaattggctgggttggcctgtgcccaggcaatcggtgaaacgttcgaaaaggggaacgttctcattttgtcagggcctgggaataatggcggcgatggactcgtttgtgcgagacacttgaagcattttggattttcgccttcgattctctgtccaaaaccatcacaaaatgatctgatgcaacgattgatgcttcaattggaatgcctcggcattcccttcgtcgaatcattccctgaccccaattctattgagaagttcaacttcctcgttgacgcaatcttcggttttagctttcgtcccccaattcgggagccattcaacaaaattttgaagcaaatggaaagtgtccaaaatcgtgtcccaattgtgtcaattgatattccttcgggttgggacgtggagaaagggcccccggatgaaaagagcggtttgcccattctgagccctttggcactcatttcactgactgccccgaaacaatgcgcacaattttttaaaggagaatatcattttttgggaggccggtttgtgccacctgccttggtacagaaattcggacttgaaaatatgccaccatatgaaggatcttcncaatttatgcgtcttaat

SEQ ID NO: 89357 - DNA, 644 bp, Heterodera glycines
  SCN-specific regions: Sequence locations=1-324,346-644
gcttcgccttgtttcctcccatttgccaactttttgccgtccgattccgagtttggcgaagacacctctttcggaatgcgtccggttttgcccggctctggccaagaatttgcattggctttgggcggcaacagaccccgggagcaattcaccagttttaattggggactcctttcatttgcagttttattatctttgcctttttacagtaatcattctcgcctacaatcgagaacaagtgttgttggtcagtgatacgatcgatacacttattaacaatttattgactgtttagtcatggttgttcaaagcatgacatttccttgggtaaaatttgtttttcactcatctaactttgaaacaagctgttccccaatttctgattcgcgattgactatcccattttcactgaagtcgtgccttttcaattgttttattatgtcaattaggggttcttccaacaaatgtggcaaaatgccattctgtcaaatgactattcaccaaattaaatttttaacctgatcccatttgattaattcaataatcagaccatccatcgctcagaacactttggaacggctgaacaacttgccctacctgaaccgagtgctcgtcatttggaacgacgtccaccggttgccctc

SEQ ID NO: 89358 - DNA, 1008 bp, Heterodera glycines
  SCN-specific regions: Sequence locations=1-98,120-203,227-521,543-1008
attaagtatgaatttgctacacaaagaatggtatacggaattctcgcctgacgatgcccaacgaattgctggcactggggacgggtgttccaaaatgatgaagttggatggtgccgaactgtcaggggcctggactgggcaagcattttctttgaatgtggacaaaattcttttctccgaacgttcgaaatttcaggacgttcttgttttcaagagtaaaacatttggtaatgttttggtgttggacggagcgattcaaacgacagacagagacgaatttgcataccaagaaatgttagcacatttaccaatgtgttctcatcccgacccgaagcaggttctgatcattgggggcggcgatggcggaattttgcgtgaagtgcttaaacatccctcggtggagagagtggtcatgtgcgaaattgatgaaatggttgtccaagtggccaagaaatttttgcacggattggccacttcttttgactcgccgaaactccaacttcacattggagatggtttcgagtttctaaaaggacatgaagcggaattcgatgtaattatcactgattcttcggacccaattggcccagccgagtcgcttttcggcaagtcttattatcaattggtcagaaacgcgttgaaagaagacggagtgttggcgagtcaggcggagagcatttggctccatttgccactgatttccaaattgatgaattgcgcgcgcgatttgttcccttcggtggcttatgcttctgcgactgttcccacttatccttcgggcactatcggatatttgctcgcctcaaaacggcagatgcatgttctgagtgttccgcttcgtcccctcaatgattccgaatgccaatcgatgggtctgaaattttacaatcgccttttacactcggcttcttttgtgctccctaactttgccgaagaggcgctcaatcagcagcaaaacagtggaagagaccagtgaaatgaaaagggacgacggaagcgcattaattt

SEQ ID NO: 89359 - DNA, 980 bp, Heterodera glycines
  SCN-specific regions: Sequence locations=1-108,140-980
gtttgagaatccttcgggccatgtgactttaataaattttgccggtgtgaaatttgccattgcaccctcgatttatcttcttccttttctcactttcgttttgccatgcttttcctccctctctcccttttgcttttcctcctccatcgtccctttgccaatgccctcggctgtatgtccgccgtttgtgccgccggcggtccctccccctcttcccatgccgtcaatcgcatcattcgttgcgcttccgactctttttgtggccattttcgcgctttgcggcgaaatgaccaatttgtcgaggcggtcgacctcagttgtcccgaattcgccgtggtgcgcgctcctttcgatggcgaaatttcggcttatcgtccgatgggagggagccgagcgcaggaggggacaaagggcgaatgtgtgccggatcagggagttcggatcgacggccgaggccaatggcagggctatcacgcgctgatcagttccgtccagctgtttcgttttggtggcgaagtgaatgcgggccaaagaattggcgtggcacgagatttggaatgtgccgggacgcggcccaagccgaggggcgacgaaaatttcgtgcgcatggaactcttccgagaggacaaacccatcgacccaacccatcatctgatcgactgcatgtgcaccggccaaatttgcgagacaaatcgcgcaaatgccctcgagggactcccatttaaatttgacagccgtttcaacggagtgcgcgggtgggaaatcgtttgtccgaatgttcggcccgaagagccgaattcgtcgggcgaatcgcctgaacaaagtgacaacagacaaacaatgagtcccaaaatttacagtcccatcgaaggcgaagtgatcggtcgcgtgcggctgagtgcgtcgagcaactcgcaaagctattcgggctgtgccaacgaaggaatatttgtagttggcacgggaaaatggacggacta

SEQ ID NO: 89360 - DNA, 750 bp, Heterodera glycines
  misc_feature (733)..(733): n is a, c, g, or t
  SCN-specific regions: Sequence locations=1-750
aacagatccctataaaattcaattcttgatcaattcccctcattcatcgcggcggtcatcaaaaaagaggaagcaaaaaaaacaaaaatgattggcatgatgaacaacgccggcatggacggacccgcggagtttttcgcgggccgtcgcgatttgtgcgaattgcttgtgccggcctcgtcgttagcagcggtggacggccaagcgcagccccacgcgccaccgccgaaggtttttgagccgacgcagcagaaaaaactgagctacacgggcagtggccgacggttggtggacggaaagccagaagtgaacgaaacgccagaggaaatgtggcgaaaagcgatgctcagggcaacctgcacaagagcagtgaaagaaatgcttggtgagaaacgccgcaaaagctccaaactgagacaattgatcagcagccaaagcggatcaattcgaaacttttttggcacagccaaaaaccttcgccatcggaccaccggcgccaatcaaccgcagcaacaggttgaggccggtggcaaagtgatcagcagcagaacggaggggccgggaaagcccgatcggatgatcatctgatcagagtaaggagaggaggagaaagacagcgcaactgaaagccaatcagtgatcagtggagaaccaatcgccttcaccgaacaaccaaataacctcacatttctttcgcctttccctcaataataaactgaatacattctcaaanaaaaaaaaaaaaaaaaa

SEQ ID NO: 89361 - DNA, 638 bp, Heterodera glycines
  SCN-specific regions: Sequence locations=1-450,472-476,498-638
gtttgagtatcaaaagaatatccttaaaatttctactgaagattttaatggaagctgaggcggatttcgattccggattgctcagtacggaagtgagtcatcgacggcgatccgcttcagtgtctgaggattattcggtgcaaaaaacgaacgacgacgccacggaatgcaaattcgttgctgcgcagttgggttactactccgatagatttatcccggctttcatccacgcgtgcaattcggagaagccccaccacagagacccggagatcactcgtggctattgggcccggacaaacgcaatcacttcgatggtcgttcaatttgttcagcttgccggtccgtcaactcaaattttgaatttgggcgcgggatttgacacactttattggcgactcaaagatgctgggcttagtttttataagtttgtggaactcgacttcagcagcgtaacagccaaaaagatttgtcagatcaaacgcaacaaaaatgtgaatttaacggaatttttcagcaaaacagtggaagagaaacagcacagcgatttgcatgccggcgattaccacctcatcggcactgacctaaggcaaatccgcgaatttgacgggaaattggcaactgccgatttggacttttct

SEQ ID NO: 89362 - DNA, 577 bp, Heterodera glycines
  SCN-specific regions: Sequence locations=1-63,86-311,333-458,490-577
gttcggtgtctcctccccctcctccgtcttcaaatgaatgccctcctccgcttgtgccatgtcagtatgaatatttggaccacacagccgacgttcagctccacgcgtggggccaatcgctgggcgaagcgttggagcaactgacaattgcgctttacggggatatgaccatcgaaattgaccgagttgagcccatttacacgatggacttctccgcttccggccacgacctttccgcattggtttataatttgttggacaattgcctctacagtttttgtgctgagccttttttcattggacggttcgccaaatttctgaatttgaaaaaaccatcgggaaacactggcgaagaattgtcggtgcaaattcgaatttggggcgaatcgttcgacccgcaaaagcatccgcagggcactgaaataaaagctattacttattcgaatatgcaaataatacggaaagaggaggaggaggacgaaggggggaaagtgcccatcggacggacagacatttttgtgatagtggacatttaatcaacgctttgttgggggctttatcattgttacccggcgga

SEQ ID NO: 89363 - DNA, 756 bp, Heterodera glycines
  SCN-specific regions: Sequence locations=1-298,331-525,547-756
gtttgagtgactctgatggaccatacgccgtggcgagtcgtcctttacgtcatcgacgactttcggattcatttaaatcgtcgttttgatcatttggaacagtggcaaattgtcctttacactctgtcgttcgtcctttttgttcaatgggttcgcaaagtgttgaaattcgaagagttcgtctcatttcgccaattgtggaatgattcgttgctcagtttttccacgtacaaacacaaatgggaagagaacaaagaaaacgcgtacaaagaattggaggatcggatgcatcgcgccgatcggctgaaggaattttacaaatatttgcccgaccgtggactgccccccgacgacatcattcgcgaggcgaccgcctacaaaacgatgagcgacattctcttcgagaggggccgactgtgcgggtcgctgtacgcggtggaggacgaagacagcaattaccagcggatgatcaaacaggttttcgagctgtactctcatacaaatgccgctttccccgaagcgtgcccttccattaggaaaatggaggccgaatgtatccggattttgtgcagtctttttcacggaggtgccaaaagttgtggagtggttaccaccagcgggtccgagtcgatcattttggcatgcctcgcttatcggaactccgcccacaaaaatggcattcgaagaccggaaattatcgtgcccctcaacgcccatgtcgggattttttaagcagcgaaactattgggaatgcgt

SEQ ID NO: 89364 - DNA, 1169 bp, Heterodera glycines
  SCN-specific regions: Sequence locations=1-25,47-57,79-168,195 -476,498-717,740-1145
ccaagtttgaggtagaaaacttagcaaaaaatggccgacttcgaagggcgtgtcaaagcttaccgcttcgtggcttacacgaccgtttctttctccatcatctcacttttgtcggtgtgcttgacactgccaatgctgaagagttacgtgtcgaacgtgggcatgaaaatggactctgagctcagctcatgccagcacaatgccaaagacatttggtccgaagtcagtcagctgaaggggctgcctctgctggtctccggaaaccgtacggcgcgtagcgcatacggtagctgccaagagtgttgctccggcggtgcccaaggccagcccggccaacccggacagcctggacgacccggaaacccgggagcacccggctcacccggacagcccggacaaaccccgcagacgccttgtgagcaagtgcacccgcctccatgcaccccgtgccctggcggtcagcccggaaacaatggcccaccgggacccccgggagcgcctggatcaccaggccaacccggtaccggaggaggacagccgcaaccgggagagcccggtccacctgggcccaatggccagcctggccaacccggacagcctggagcgcctggacagcccggacaacctgccagcccaccgcagacggagccccctcctccaggcccacctggagaggctggtgcacccggacagcccggtcagcctggagcccctggacagcccggcgcgtccggacagcccggcccgaagggaccgcctggaggcccaggacagccaggcaacggcggagcaccgggccagcccggccaacccggacagcctggcaaccccggagagcgcggaatctgtcccaaatactgtgccgtggacggcggagtgttcttcgaggacggcacccgaagacgttgaaaaaagctattctgatcaggggaagaaaaagcagaaaatcagtaacgattgccctcccctcccccgtgcccttctcctccccattttccactggctttcttttccttcctttttttattttgtttagcttttccaattcgcccaaattcccccccccccttaattgcttctctttgtaatcgccgctatgccaagttgccaaacatcagcaacaaataaagaataaatttcacatgaaaaaaaaaaaaaaaaaaaaaaaa

SEQ ID NO: 89365 - DNA, 624 bp, Heterodera glycines
  misc_feature (526)..(526): n is a, c, g, or t
  SCN-specific regions: Sequence locations=1-1,24-359,383-476,505 -549,573-624
cttgtctctttccaattcctcatttgacaaagtcaaagatcagatgggcaagatgaattcgaaattgataaaaatggaatcggaagttcgcaaatggaagaaccaagcggaggataacgcgagacgcgtgtcggcactgagcgatgaaaaagtcgaaatcgaacggaatctttcgttgaaggaccgtcagctcgtccaactgcaggaattatgccgagtgctgaaaagagagggagacaaaccgaaccgacagaacgaaaacggagaagtgacggaaagggacggggaattggaagcaggggcaattgactgatgaaggacagaaacggacgaatctttggaaatgttcggatggtgtcgttgattttggacggacaaatgggctaattcaaagtggcactaatcgacgctagctttaacttttttaaatttttctactctattgcttaattttgtgtatataaatgctttttagtaaaaaaaaaaaaagaagaaaaaaaaaaaggaggatttatgataaataaanaaagggaacgcttcatggaacgctacgccccggtggcgaaggacctcgcctctcgggacgtcgtctcccggtcgatgacctttcggggggggggggcg

SEQ ID NO: 89366 - DNA, 843 bp, Heterodera glycines
  SCN-specific regions: Sequence locations=1-38,60-81,158-159,218 -473,497-600,622-843
cctcgtgccgaatcaagtttgagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctggagcgaacggagttgtctcacgcccaattcctggcccgaagggaccgcccggagcgcctggccagaacggaaaccccggaagccaaggtcagccaggacagccaggaggccaaggaccgcccggacctcctggcgcgcccggtcagcccggccagcctggaaactctggccagcctggacagcccggagcaccggga

SEQ ID NO: 89367 - DNA, 636 bp, Heterodera glycines
  SCN-specific regions: Sequence locations=1-28,51-113,137-142,164 -285,307-397,419-636
ttaccgtataaactacactattacccttatttttcttttaatttatcaatttctacaaacactcagccaaactgtcggccatcttcaatttacaatcgctgataaccgtcgtactattgctcatctgtacctgtgcttttcttcgtgctcttctgccgcgactgatcgaccggaacaagcaaggaatttccggcgtgttttggaagtgcgcgcggattggcgagcgtctctctttgtgggtttctgccggctgtttttgcatggcaatttatctgctcttctgaacccaaatggaaaagggacttgattttggtgctcgtagtggacgattggacccggtcgaatggaaaatttgtcggcaaattcccccgcgttttcttccggaaaagaacgatgtttatattacaaagaagacaaaagtggccgctcagttctttcgctgcaaaaaattattggacacgaaatttgatgaggtacgaatccatgcgcttggccatgccatcggtcgtgcgctgagtttggcactttcgctgcgcgacgccatggccggctcagtcaaattggacgttcaaaccagcactgtacaggtctctgatgaagttcagtctctgtctgattgcgatttggccgatgttc

SEQ ID NO: 89368 - DNA, 427 bp, Heterodera glycines
  SCN-specific regions: Sequence locations=1-103,125-197,221-299,324-427
caagtttgagacaaaaatatttctgatttgctgttacaatggtgaatgttccgaaggcacgtcgaaccttttgtccaggaaagaaatgccgtaaacacacgaaccacaaggtcacccaatacaaaaagggcaaggagtccacgtttgcgcaaggaagacgtcgttatgaccgaaaacagaaaggttatggtggacagacgaagccaattttccgcaaaaaagctaagacgacgaagaaaattgtcctccgcatggaatgtgttgagtgcaaacatcgtgttcaaaaagcgatcaagcgttgcaagcacttcgagttgggaggtcagaagaagtcaagaggtcaggtgatccaattctgagtttgtgatctcacctcttttgttgtttggtcgctgttgataaaccgataaatttttttgttgaaaaa

SEQ ID NO: 89369 - DNA, 654 bp, Heterodera glycines
  SCN-specific regions: Sequence locations=1-51,77-654
tgaggtcaattcgctttcttttcctggatgattcctctttttcccctccggggtcctttctcttcttttccccgcactttccactcaaaatctccgcttcatcagacaaaaacttcgcttttggttggaccggctgttcgccttctgctcggtcattacgacatcaaaacgagcgtgctcagagcatcggggccaaagaaaaacattctcaaaagcgatgtgctgagtcacataaatgacaaaaaactgtctccgattaaagcattttcggctaagccaccatcaaaaatgtctcttgaaaacgaagtgatctccgcgtcatcacatccgatcattccgctaaaatcatcgggtcggtccgagccgactcatcgccatgtccatgtggacattcaattgtcggaaatgcgtcagaatcaaacaaaacaatttgtgcagtcaaggaattcaattccccatgcttatgcgtcggcccaaatttctgccaacaaaatattggaattgctcaataggctttctgaaagggtcgattttaagctgtcgttaaatgattttatcataaaagcgtgctccttgtccctgcggtctgtccccgagttaaacgtccattggcatggtaattccatccatcacctttcttccgtgggaatttcc

SEQ ID NO: 89370 - DNA, 645 bp, Heterodera glycines
  SCN-specific regions: Sequence locations=1-18,46-242,264-645
aaatgtcaaatcaatcaacttcttctgctgctgctgctgccggatcgacggcgccgccatcgccttcgaacgaagcttcttctccttcggccgctcaagcgtcaagtcagtcatcgtctgctgctggtgattcgtcagcctctcccaatggaccgcgtcttaagccgcgtaaagtgcccgtcaaccgcttcagggatgttcgtccggcactgcagctgcgactcagtcagttgaagcatccgttaatcaggaaactggagcaggacaccggcattgaccgtgagaggctcttttacatggctatggcatatttcgtgttcctgctcctgttcactcagtgtaagcttctgctctccactctcatcggctcagtctatcccgcctatcagagcattgtgactgtccatactcaggccaaaagcgaagagattcagtggctcacttattggtgtttgttctctctgttttctctgtgtgacatttccttttccgtcgcccttccgttctatgcccttgtgaagacaatcattttgttgtatttggctcttccccaaacttatggtgcgcacaatttctacgtcatttacgttgacccgctggtggaacaatggatgctgatggtcaacgaaattgctggctgatgca

SEQ ID NO: 89371 - DNA, 649 bp, Heterodera glycines
  SCN-specific regions: Sequence locations=1-649
aatattgtaaaatatggcttctccgttgcgtctccctcaacggatcggtgcccaccatttttggcacaatttcgacaattttctttttgacgccgacggcgtgttgtggcgggaacaacagcccctccagggggcggtggaactcatcggaacgctgctcaaagcgggcaaaaaggtggtggtggtgacgaacaactccactcaaagttgtgccgaatacgtcaaaaagtgccaacgaattggcttcacagaccttgacgagcagaacattgtcagctcgggcatggtgttggcacatcagttgaacaaaatgaagcgcagtgccgagtttgggtcgacggcgcatttgccggtttatttgttcggctcggtcggactgcaaagactgctgaaggagagcggcatcgacagctttggcacggcgcccgacccaattccggcggacactgccactttcgtctccgacttgccaaaccttgacttgggcgtcccgcggccgttcgccgtcgtcgccggttacgacattcacttgagctatgccaaagtgatgcgggcggccaattggctgaaggagaaagcggtgcccttcttggtgaccaacgaagacgcgacattccccagaacgaaccctgagatagtcattccgggc

SEQ ID NO: 89372 - DNA, 669 bp, Heterodera glycines
  SCN-specific regions: Sequence locations=1-69,96-306,329-497,519 -583,612-669
agtttgagaggaaaaccgtctcaaaaaatggacttcgaagccaggatcaaagcttaccgcttcgtggcctactccacggtgtccttctccatcatttcgctgctgtccgtttgcttcactttgcctatgcttcaaaattacgtgtccaatgtcgctcagaatatggacagggaattgagtgcttgtcagggttctgcaaaggacatttgcctcggaagtgaaccaactgaagagcatccccgtggtgggaggaaatcgtacggcgcgtcaagcggacggatacggacgaggaggcggcgcagtgtccggcggaggaggaggaggtggctcgtgcagtgaatgctgctcaggcggaggcccgggcccagcaggtcccccgggaccgcccggcaatcccggaaaccccggagcacccggatcaccaggacaacccgggaaatctgtttccgctccatgcgaacaagctaccccgcctccgtgcaaaccgtgccctggcggccaacccggccagcccggccctcccggaccgcccggccagcccggctcaccagggcagcccggaagtggtggcggaaaccccgagccaggacctcctggacctcccggaccacctggaaaccccggagggcccggccaacctggaggccccggtcaacccggacagcctgc

SEQ ID NO: 89373 - DNA, 656 bp, Heterodera glycines
  SCN-specific regions: Sequence locations=1-118,140-579,617-656
catttaaccaatggctgagaagcttaaacgagctaaagttcgactcgagttttctgagaaaatgttctatgaaagagcactcaccgaatggagagacaaaatattaaaggacagtggtaataaaaatcacgcttttgttcttcggaaagcattatgcaatctcaaattgttttcgctcgacgtcaatggcttttcagacctaagaaaaatccgaggaattggcgttgacattgcgacccgattgtcttcggcttggaaattcacatgcgctactcacttttgcacagaatcccctacaattggccaaataaagtctctgaaaagtggcgaggcttttgtgttaatcgagcaatcgtcaactgaaaacggtggacgagttcccttagtggcgggcgccaaacagcgaaaggcaattccaagtcaaattggccaacagcaaaagagtcaaacgaacggaaaacaaaaaggacaccattttgaaacggctcccttagtacggtcaaattcgcaagaatgcgtagtcatgcataagtcggagtcattggaagtgatggactttgatcatttgctgaatgtttctgtttcaaaccagccatttcttcttttgcttttgagaattgtcggccaattgtcgcaatgtctcctccgcccacttc

SEQ ID NO: 89374 - DNA, 635 bp, Heterodera glycines
  SCN-specific regions: Sequence locations=1-635
ggaaggacgacgtgttggcatttggggacagtgccggccgagttggagtttgggacttggccaggagtcaatgtcgtcagacgggccttggtcagtccacacggggcccagtccaacgggtggtgttctcacggcttacgggtgactacacacttgcggcccagcatccaacctctgttgtagtgtgggacactgaacggttgcagtcgctgttttcactgcaaaaaccgggccacagcatcatcgacattgacatgtgcggactgaatccggtgtacatagcctctgatgggatgtttcgttttgcattttcggacacggatgagaaaagtcgcaccaacaacaccaacctgaacacatcgccgccactcatcaaatccgacattcccctgttgttgcgcccgtcgtactgtcaagcattgctgtcgttgttgtcaactgacacaccaccggcggcggtggcggaacagaacaacaacgacgacgacacaaccaccaagtccaaccaagaaaatttcgtcccatttggtggtgaccatgatggccaccaattgcacacatttgacgaccccgacattgaccatttgatcaatcgtttgtccgcaaaatgctgccgaacaccgttagaccgtgcc

SEQ ID NO: 89375 - DNA, 638 bp, Heterodera glycines
  SCN-specific regions: Sequence locations=1-365,387-638
cgctcctccacaacagcgtccaccggtcgacctcattccgaaggctccgtattatgagctgcccgctggcatgatggtccccctgatcggaatcgaagacatcacatatgaatcgttgcgcgagaaagacctccgtctcccgcctcccgaagcacccagtgatcagttgatgcgcgaaattgaccgcttttacatcgctttgcaaccgccaccaccagtggattgtgtccgcgacgcggacggatgggaagttaacggactgttggagcattacataaagaagagagagcagaaagtgaagttggaagcggaactgaaggagaaggggaagacatttgaagacgcgatcaccaacaaatatgtgccaccacagacaacgaaaaagagtgagtcaaaaaagtcgaaatcgagaagtccgccctcatcttcgtcctcagcatcatcctccggttccacatctggtgagagcagcagcgaaagttcaagtcggtcacggagtcgatcgaggtcaagatcatcgtccaggtcgaggtccacgtcaccgttgaatcaaaaatcacagagcccaacattcaaacgcctacgccgttctcggacacgaagtccaacgccgggaggaccgaccaagttttggcgga

SEQ ID NO: 89376 - DNA, 634 bp, Heterodera glycines
  SCN-specific regions: Sequence locations=1-81,103-163,185-448,470-634
gccgagagtaccggctacatcatcggtgattcagaattggaactcgcccgagcctttcgcactccgtgccctttgtgcctcatcacaatctcagttcctgcgagtttgtatgcagtgttcagagatgaggcaaaatcgaattcacgcaactttgtttcgcacacaactcccccagcccagctccgttcatgctcaattttcgacgacgcccaaatgtttgtgccgattcatttgaccgatggccgagtcatttcactgccaatcgactcgcaatcgaccccctttgaattgtgcgaaatgttgtgccaacaaatttgtctcaaagatgcgtttggcttcggcctttttcttgccgttggtcgccgttttatccgttctttgggcgttggctccgaatgcgtgattgacgcaattgcatcgcttgagacgaaaagcgaaaaaaattggcgaattttctttaagaaagaattgtttagagcccaccaaagtgaatccgacgaccctttggccattgaattggcttttcggcaaattttgggcggcattcactcaaaggaataccaatgcgaaaaggaagatgacctcgtcactttggcggcgcaacaacatttcattgacattaacggccaagacg

SEQ ID NO: 89377 - DNA, 648 bp, Heterodera glycines
  SCN-specific regions: Sequence locations=1-29,51-374,397-580,604-622
attttaaaaaaacttccaaccaattctcttttcgtcaaaatgctttctcccttctcctacgacccgttctatcgccgttcgttgtggcctatgaccaccgttggcaacgtcctttcgcccttccgccagttggagcgcgaactcgaccacttctttgacgggatgcagcccatgcttcgtgaccacgccgctcaactgaacgtcacggacaagggcgaactcacttacaaagtcgatgtcagcggcttccgccccgaggagatcaacgtggaggtgattggtaatgaaatcatcgtcaatggggaacatcgcgagcagaacgacagcgaatcggtccaccgtcagttctcgcgccgtgtgctcatcccggagggcatccaaaaggagagcatcaagtgcgagctggacggcggtcgcttgtgcatctgcggaatgaaaacggctggcgaaggcggacgaaccatcccaattgagatgaaaaagaaagcggccgtggaacagcagccgcaagcggagaagaaatagagggggacaaatggagacgacggaccgatcgatccattaatatgggtctcctcctttggacattttaaattattttcaacaataaagcgttttttctaaaaaaaaaaaaaaaaaaaaaaaaaa

SEQ ID NO: 89378 - DNA, 621 bp, Heterodera glycines
  SCN-specific regions: Sequence locations=1-621
tggactccgaaaatgcgttgcaatcattcaaagaattcaccggctgcactgacgatgacagcgcacgtcggctgttgtccaaatgcgcatggaatttggagagagccattgactttttcttctcgggacgaagggaagagggggatggggaagtgatgtgggacgagcagcagccgatgacgagccaaggaacacgacgacgaatttcgcactttgctaacagtttatggacaacgccagcgattggagggaacgcggcgaatggaaaccgacggacggacgaaacttctcacaaccaattccgaaccgcccgaatggacgatgattcggtgcaaaccctcgacgacagtgacgtacaaatggtcgaagaatctgacagaaaagcggcgccaccaccaaaagcagtgaatgggtccgcttcttctgacggcgttcgcgcgccaattgcgcctgtccaaggcgttctaattgagcagtcattccgcgagacatatcaaaatcgagaacgcctttggaacccggtgttcgagcagtatcgccaagaccatcaacagccctcctcgtcatctgcggcggcttcattcttatcacgcagagcaaacggtgcaaataatcgcattg

SEQ ID NO: 89379 - DNA, 869 bp, Heterodera glycines
  SCN-specific regions: Sequence locations=1-289,313-481,504-712,736-869
caagtttgagaatttattccgatacaatgaataagaccacgctgaaggctcgtttcgggtcggatattaggaagaattggatccatcacagtaacgacattagcctgaatgacttggtaacgaagatgcagcgttatttcgatattaaggatgcgaatgccatcaaactcaaataccgcgaccaagagagcgactgggttaccctcgccgacgacgacgatttggcttatgcactcgcctctatggaacttctttacgtggacgtgatcgtcgagaaatatcaattcaagcaagatgaggaaacagttgagaagacagcgccgcctgctgaagttgtgaaggcagtggcgccgccgagggacgcaactcccgtggacaatggtgacgtggcacagctgcaaaagcagcagcgttcttctacgactccagtttcatcgatcggagagctcacagaaattcctctgaatgggccggtcactccgccggtcaacatgggtggaatgtatggacagccgcagcaattgccacaacaggcaccggtgccgcaacagacgccgattccgccgccgccggttagcgggggagggatgttctatggacaaccgcaacaacagcaacctccgcaacatcagcaacaaacgccgtttccattgccgccggttagcgttggagggatgttctatggacagcagcaacagcctcaggcaccgatgccgcaacagcagcaaccgccacacgcaccgatgcagcaacaacagacgactgtgccaccggtcactggaggaggggcattctacggacagccgcaacagcaaccgccactgcaccaacagacgccgatgccgcctccgccggtcagcgcgggagca

SEQ ID NO: 89380 - DNA, 858 bp, Heterodera glycines
  SCN-specific regions: Sequence locations=1-75,98-110,138-245,268 -506,536-858
cgggtgtccacctcccatcagttgcccgtgggccaatctcgtccatgtcgacagtcgatttcttcgtcaaactcaaataaacgggcggaaaacaatactttcaggtgcattctttttaaataagggttttttcaccagtcgaattagactaatttcactaacaaattaaaaaatgatattggacagacccaaaccaattggcggagttgcgagtcgctgtcggagtgagccgtaagctcaaaaataattcggtttttgttttgttccgtcagtgttgtccatgtttacaattagctgttgcttattattcgactttgcatttaaattcgcaatttcagccgaagcgacggaggacgcttttccatgagagggactcacaatcagccgaccaaaggacaaccgaaggcgagcgcagcgaaagccgtcgttcagcagcaaagccctgaaatggtggcatggctcagacggaaagagtacgacccgcggaaggcggcggcagaccaaagccaaagggaagcgcagcagagacagcagcagaactctttcatggcttgtcggtttttctccacctcggccaatgccaaaacgcccttcgcccgatggcgtcaaaatcgcaagagtcagcagacgatggccgaccaacgaagcaaccgttcccacgacgacttgagccgtctaggggaaagtatggacgacgagtcgcttcatggcgtggctgtcgatccctgctcgaattcgctccaacggacggtggacgaattgacgcaaaagtgccacaagtcgattgaacttttgaaattgtgcaaccaatccggcctttcttcgtccgtagagcaactgctcgaaaaggtcgtcgaa

SEQ ID NO: 89381 - DNA, 996 bp, Heterodera glycines
  SCN-specific regions: Sequence locations=1-316,338-760,782-866,892-996
cccccattttccattttcttcctattgagtggtgggaacacccaaacacacattcctcaccttttcttcatcatttgctcgtcgtttttgcattcacttttcacaaaaccttattcgcccaattcattatatgaatattggaaaatgacaatttctgtcgagatttttgacgccaagtcgccctcacgaccgggtttcaccatcgctgaggttgagcctgaggacactgtgcgtcaattaaaacgcaaaatttcgcaaaaaacgcacctttccgtggaccgaattgcgcttcgtcttgagccgaaagggaagagtttggtggatgaacaacttgtgtcccaactgaatttgccggcaacaaatgctcagctttactatcgcgacttgggcccacaaatcccatggaaaacggtgtttctgatggaatatgccggacccttcttcatttatccgctgttctacttgcgcccagcgcttatctacggcacgggcgcttccatggcaccggttgcaactgccgtgacaattgcctgcatttgccacaccattcactatgccaagcgattgtacgagacacaatttgtgcatcggttcagcaacggcacaatgccattccaaaacttgttcaagaactgcacgtactactggggcttctccgcgttcatcgcctattttgtcaaccatccgttgtacacgtcgcccagcttcacccaagtgatgattggccttgtcggcttcacaatcagtgaacttggcaatttgtccatccatcttctgctgcgtgaccttcgccccccgggctcccgtgagcgcaaagttccctaccccaactccaacccgttgacgctgatgtacaactttgtcagctgtcccaactacacttatgaggtgtattcctgggttttcttctgcgtcatgactcaatcgcttcccgccgttttcttcactttggccggctttgcgcagatgaaaatttgggcggacggcaaacaccgg

SEQ ID NO: 89382 - DNA, 867 bp, Heterodera glycines
  misc_feature (594)..(594): n is a, c, g, or t
  SCN-specific regions: Sequence locations=1-286,308-484,514-779,803-842
actttctcttccgttggcactgctgggcagcgctgtacgagcacacggcgactgattatccatgaaaaagtgtacgacgtggtgttggaacgggtggtcaacgcgtacaaacagctgatggacacgcgcatcggagacccgttggatgagcgcactttgatcggtcctttgcacagtcgcgagtcggtgctcaaatacaaaacggcgattgccgaggccattgccactggcggtcgaattctgtgcggtggcaaagtgttggaggagtcgaagggcaattacgtgctgcccaaggtgatcactgggcttgcgcacgacgcaccggtggtgctcagagagacatttgcgcccattgtttacgcagtgaaagtggccgattttgaggaggccgttgcggtgaacaacgaggccagccagggcttgtccagcagtttgttcacccaaaatgtgtcgcttctgtccgaatggattgggcctaagggaagtgactgtggcattgtgaatgtgaacattggcacttccggggcggaaattggcggcgcattcggcggtgaaaaggaaaccggcgggggacgcgaaagcgggtcggactcngtggaagaattacatgcgtcgctcgacatgcacaattaatttcggcaaggaattgccattggcgcaaggagtcaaatttgagtgattaatttcgaaggaatttatatggtttttgtaatttaaaagtttctttgtgataattcttttgaagtcaaaaaagtgtcttgccattcattcgttcttttgcatttttcttttgattttgttgtgctgtttcattattatactttgataaaaaatgccattttaaaaaaaaaaaaaaaaaaaaaaaaa

SEQ ID NO: 89383 - DNA, 673 bp, Heterodera glycines
  SCN-specific regions: Sequence locations=1-58,86-430,453-673
agacattttactcaaactaaattcaaataagacagttgtccttcggcggcccattgtcagcaaaaaagaagaaggaaaggaaaaatgaggacgaaaatgcacgtggttgtccttggaccgaagaaagtggggaagacttcacttttgaaaagtctgatcaatcagcacgacccaaagccaagcacttcctcgtccgatggccaactttacgttcccaccgtcgaagacactttccatgtccaattcggcgactttcgttccgttgaccaaatgccgcagcgctcacttctcattcttttccatgacactgctggcataacggactttggcagcattgagttgagaaaaccgtaccttcaggttgccgatgcctttctgctcgtttattccgttttggaccctttggctttaagtcaaatggaagcgttgaaaaaatatttggagagggaaaagaacggcacgagcaaagaacggaaggaagttgccctttctgtgccaatgccttcaaaaaaatatcccttcccttttcaggtaccaattgccgtggtcggaacaaattgcgaaatgtcgggcaaaaaagtgaacacggaaagtgcacttctctgggcgagtcgtgaaaaagtcaaactgttcgaagtgtccgcgaatgaccgaaaatcagtcgccgaaattg

SEQ ID NO: 89384 - DNA, 517 bp, Heterodera glycines
  SCN-specific regions: Sequence locations=1-14,36-478,500-517
cttttaataggtaaatacaatgaaatattctttgctccgaccgtttgtgaatcgaatttttacgcccggcaaagagcagcagcaattggtgcaacgaaaccaaaatgaatttggaatggtcaaaacaaacgccgggcaatcggccattttattgcgatttgtcagttggataagcggcagggaacaaattgagcagcacttcagccgattcgggaagataaaggagacgctaatgttttatgacagagtgacgggaatgcaccgcggcttcgctgtcgtccatttcatctcaccacaaagtgcagctcaggccattcaacacaaaccgcatataattgacaacaaattgttggcggtcacttaccacacgccgcccgaaatccgacggaagacgaattagtgggaccgaataaacgaaacatttaaattgaaaattaataacggattaccaagcgagaagcacatgtgctacagacgttgttttatttaaacgaataaagaacaaacggcggaaaaa

SEQ ID NO: 89385 - DNA, 679 bp, Heterodera glycines
  SCN-specific regions: Sequence locations=1-143,165-679
gtccaattaagatttttattctcgccttttcattttcataatgtctggccaaataaagactccgactaatcagaaattgctcacaaatgttgcaattgtgcggatgaaaaagtgtggcaaacgctttgaaattgcatgttacaaaaacaaagttttgaattggcgcaacaaaactgagaaggacattgacgaagtgctgcagacgcaaacagtttttgtcaatgtttcaaagggacaattggcaaaaagggacgacctccaagcatcatttggcactgaagaccaattggaaatttgtaaattgatactcgaaaagggcgatttgcaaatttcagacaaagagagacaagtgacctcggagagctcttttaaggaggttgccaatctgatcacggatatgtgcgtcaattccgagacacagagacccttttcacttgctacaattgagaaggcattgcatgatgcgcacttctcattgaaaagcaatcggtccacgaaacaacaggccctagaaatgataccgaaattgcgcgagtcgttgaaaattgaccgtgcgaaaatgcgaattcgagtgtctgtgcctgccaaaaatgcgaaaatgttgcacccaaagctaaaggcattttttgacaccacccaagtcgaaaattgggacaaaggcgaactcgaaatggtgggg

SEQ ID NO: 89386 - DNA, 714 bp, Heterodera glycines
  SCN-specific regions: Sequence locations=1-515,552-601,623-714
ggcagcagagaaccccacaaaatggagagggacggacgggaaaatggagatgaaaaatgcaaatcaaatggccaattttgacagttaatgaagagacccccggcggtgttcgacagacgccgcgtgagaaattggcaactgatcagacgacttaagctataatggaaggatttgacataataataatggagggaacgacgtcgccgccttattttttgcgtagtcggacgaggaaggaaggaccggccgtgctggaactcattgagaagcttcaacaagccaacgacaaagttgaccaacaaatcgcagaggaacaccaattgcgaaatgaagtccttcagatggcaccgcgcgcgatgaagaaatacctcggcacacgctttgaacgactgatgaatgccaaattggaattcccccaaatggcggacagtgaacgcaaatccgaggccgagttggccaaggcgaaagaagaacttcgccagttgaaactccaagcagtcaaagaggcggaggaacagaaaagggagttggaggaggcgcagcgaatggagagggaattgaaagagcgagtgaatcggaaattggccaagctgagggcattggaagaaatgtgatggcaaatgtcagtcgttcttcagtttgtgcgggttttctctgttgtgttagtcatgtaattatttgaccgtatgtttaacaataaataggatttatttt

SEQ ID NO: 89387 - DNA, 638 bp, Heterodera glycines
  SCN-specific regions: Sequence locations=1-434,458-638
attggaagctgagaagaccgactgctgtctgtcaattgaggggacatgacgaacatgtgatcacgtgtctgaagctgcgaggcgacctcattgtcactgggtctgacgactgcactttgcgcgtttggtctgctgcgacgggaacgtgtgtccacgtccttaacggacacattggcggtgtttgggcacttcagctctcacaggatggcaaaattgctgtcagtggttccatcaaagcttgggacattgttgcgggtcaatgcattcgaactcttttcgggcacgtggctgcggttcattgtgttaaatttgacggatcactgattgtgtcgggtgcgtatgacaacaatatccacgtgtggaatgctgcggacggatcgttaatgcacgttttggaagggcacaccaacagagtctattcgatacattttgtgagtgagacgaaattgctcatttccggaagtctcaacacaacaattcgggtgtggaacgtggacaccggcgaatgcttacaaacgcttgtcgggcaccaatcactcacttctggcatgaaattacgagacaacattttagtgtctgcgaacgacgattcgactatcaaagtgtggaacatcaccgacggaacttgcgtccatact

SEQ ID NO: 89388 - DNA, 459 bp, Heterodera glycines
  misc_feature (415)..(416): n is a, c, g, or t
  misc_feature (419)..(419): n is a, c, g, or t
  SCN-specific regions: Sequence locations=1-66,107-118,140-241,263 -330,358-382,410-416
attaccattgcctaattagttaataattgtccatcaattaaccctccgatgccttcccccatccgccttttctttcttttcctgtttctgcttcttctcctcccatttttgtccttcgccgctttgtccccccgagagaagcgccaattcagcttcaccgatggcttctcaagcggcacaattttgcagccgggcggcggcggacttttgagttggtggcggagatgagccaacggcggaagtgaagcaaaacaatgggaaagattttgggttgtgatttgatttatgacgaatgaatgacccaccgatcaaccgacttaccagaccataattcattcattcattcattcattcattatgccgtgccaatatccccccaacccatccttttattgtaaataaaaaatttaattcnnaanaaaaaaaaaaaaaaaaaaaaaaaaaaaaaaaaaaaaaaaa

SEQ ID NO: 89389 - DNA, 647 bp, Heterodera glycines
  SCN-specific regions: Sequence locations=1-647
gtcttgtcctgctcgactgttgcttcattgcactcgcctccacctccccaccgctccaccaccatggccccgaccgctacctcgtcgcaagagtaccgtcaacagacgtacaacctgccgcgcgccatccgcatggtgatcatgggcccgcccggtgcgggcaagggaacgcaagcccccgccatccggtcgcttttcggagcgtgccatttggccacgggcgacatgctgcgtgcggccgtgtctgctggtacccccttgggcaaggaagccaagaaggtcatggacgccggcggcctcgtctccgacgaaatcgttgtcggcctgatccgcgaaaacctcgacaccaacccggattgccgcaacggcttcattctggacgggttcccgcgcaccgtgacgcaagccgagaagctcgacgacatgcttgccgccaagcaccaggcgctgtcgcacgccgtcgaactcaagattgacgacgccctgctcgttgcacgcatcacgggccgcctcatccacccggcgtcgggccggtcgtaccacgttgagttcagcccgcccaaggtccccggcaaggacgatctcacgggcgagcccctcattcagcggtccgacgacaacgttgacgcgctcaagaagcggttggt

SEQ ID NO: 89390 - DNA, 656 bp, Heterodera glycines
  SCN-specific regions: Sequence locations=1-34,56-273,295-656
gtttgagttttagcaactataaatatacgccctgctgatgacaacgcccaatttgccttacggtgcaagagaggggagcggccagttcagtacgggcaccaatttcagtcccccaccaccgccgtatgacgccggcgccagtagtccatttgaacaaccacaccaacagcatcagtcaccatcgccctacggaatgatgtacagcggtggcaatgtgccgtcgccaccaccgccgtcctctccttaccaccaataccaacagcaggcgccgccgcaaatgtccccgccgttccaaccaccaattggggacccacaacagcagttcatgtacgacccgttgttgaacactgcgcgtcatttgggtggtcaatttgcggagcaacaaaagcaaaagttcacccaatacctttcgtccacgtcgttcaacctgaagtattattttgcggtggacaccaattatgtgcggcgaaagttgggcatcattctgttccccttctttcatcgggattgggccaacaaatgtgagggcgatgcgcccgtgttgccctgtcaggatgtgaatgcgcccgacctgtacattccgttgatggcgttcatcacctatgtgctggtgtctggttttgtcttcggagttcagaaaaggttcagccccgaaa

SEQ ID NO: 89391 - DNA, 491 bp, Heterodera glycines
  SCN-specific regions: Sequence locations=1-429,451-491
gtcaaagggcccgagctgactgagttcgaactctctctgtgcccccatcagcgtctgctcgacgccgagggcgtctcaattttgcagcgttcggtcctcgaacacaacattttggccgcctcgcgactgtacgccaacatttcattcgacggattgggacaacttttgggcattcctgcggcaaaagcggagaaagtggccactcaaatgatttccggggagaaagtccaaggggcgattgaccaattggagcggacggtttcattcgaagtgcccgattcgtccaacggtggcgccgattcgcaaattgcttctatctgtgagttggttgcttcgatcaacgagaaattggctactcgcttctcggagtggcacaccgaacgattcaacgagtacaaaagagcacaccaacagcccaatgatcccatgcaatagtgattattatttattacggtgccatttgttttgttcggcttatttatccaataaaa

SEQ ID NO: 89392 - DNA, 702 bp, Heterodera glycines
  SCN-specific regions: Sequence locations=1-459,481-702
gccaaacacccattcagttgcatcaatgaacaactttatatggacatggccgatcggctggcagaggacggattccgcgaggtcggctaccaatttgtgcacatcgacgactgttgggcggaaaaggcgcgggactcacagggccgaattgtggcagatccgactcggttcccatccggaattcgcaatttgtccgactatatgcacaaccgtggactgaaattgggcatttacggggacattggcacggagacgtgcgaaaattacccgggcagttaccagcactatgacatcgacgcgcaaacttttgcggattggaaggtggactatttgaagctggacgggtgctacatgaattcgtcgatgatgccggacgaatacccaaaaatgggcgtcgcactgaaccgcacgggacggcaaattgtctattcgtgctcatggcctgattatttcgatcacaattttgaagaaaagatcaattacaccgccgttgcctattggtgcaatttgtggcgcaactttgacgatattgcgcgatcgtgggcaagcgtgataaagatcatcaatttcttcaccaagcaccaggatcagtttcgcaaagttcaggcgccaggccgttggaatgacccggacatgttgatcgtcggcaacaccgaattgaccgttgaccaggccaaagtgcaaatgtccatctgggccatt

SEQ ID NO: 89393 - DNA, 747 bp, Heterodera glycines
  misc_feature (598)..(598): n is a, c, g, or t
  misc_feature (600)..(600): n is a, c, g, or t
  misc_feature (630)..(630): n is a, c, g, or t
  SCN-specific regions: Sequence locations=1-36,60-557,581-724
tgagtgtccaatgggacaaagttccctatttctatcccatccaaataatccaatttgggctgggacaatacaatttggacagaaaaggggcggaagtgattgtccgaccattggccaacagagcgacaaatgccatgggcacggaaaatgccaacggaacgatggcattgggcgacggcgcgacagtccgtgtcaaactattccgtcgactgccacttttgcttttttctttgaaaacgcatcgaatggacagcgaatttgtgttggaattggaaaaacgccggagggaaggcggaacgatggaaatggcactgttttttaagcattcggaagcaaagggatgcgtgtggagtgatgagagcattaaggccccacgtctctccgctgtgtttaatatcggcccaaaaccaacaatgcgttgggtggattttgttattgacaacgatatttatgtgacaaaggcgttgaaaatgttatgtgcccgaaaaaaacggactcaaaataaatgcgacgccaaaaagggcgcgttttgactatcatttgttgcacgtgtcacaacttcagtggatgttttcaataacaggggacccctttttcnangaaacagccaaaccatgggagaaatatgcnaagggatgacaggaccgacagacattttcaaccaattgacaaaatatttaatagttctgctcaattccacagaaaaagaagtggtcaaaattggaaaaaaaaaaaaaaaaaaaaaaa

SEQ ID NO: 89394 - DNA, 616 bp, Heterodera glycines
  SCN-specific regions: Sequence locations=1-616
ttgagagaataaaatctcgtttttggcatccgttggaaatgaaattttcgcttctgttggctttcgcattcgctgtgccattggccgatgccgcgctcactttcccctccattggttatgtccaatcggcggctgtcaatggcactttgacatgcaatggaaagccaacgcatgccaaagtgaaactgtacgacgaggatgacacggacatggacgacctaatggacgaaggagtgaccgacgaggagggatttttccatctgagcggaaaagagagcgaaatcactccgatagagccaaaagtgaacatttatcacaattgcaacgacgacgaaagtcttaacccgctgaagaaagtgtgctacaaaaaaatttccatcgaccttcccgccagttatatcactgatggacccgtggccgaaaaagtgtttccgctgggcacccttaatttggccgggtcgttcaaaggcgaaacgcgcgactgtctcaactgatctgccgaggcggttgatgtaaagagaatggcacaaagaaaggctgaaaggcatttttggccacacaattcttttttcaattttcactcagtcgaataattaatgattctgtcgttggtaaa

SEQ ID NO: 89395 - DNA, 652 bp, Heterodera glycines
  SCN-specific regions: Sequence locations=1-143,168-652
attaagaattaaaaaataaatgtttgctaaatgtttattgtttctcgcaattatcatttctgttgtaccaacagaaaataaaggatatgaaaatggatatcgccagtgcagttgtggtgagcagacggaatgctttgaagaaataaaaagcaaaacagcacaatgctttgaacaagaaacaggaaaattgggcaatgctctgacaaaaaatcttgtggatccaaccaagacaaagccttgcttcgacaaattcagtgcttatgtcaaagattggctgtcatgtgttgatgcaaaactggtcaaggaatcgagttgtttgaccacaaaatcggacataaaaattcaatctggcgattttctgacaatttactcaaaaattgtgcgcgaaaatgtcgacaaacggatgaactatctctatggtcttgcaaaacacccacttgtccaattggaagaaaattggcatgaatcggccaagcaatgtgcctttgagaaagtggctgagataaactgttttaagaaatataactgcgtgttaaaagcttccgaaaaagaggtgcagaaagtggcgaagcaatgctacaaggagtttgatgttgtcaaggtgcaacacaatatgtgtgaatgcatggcaaaaaatgtacccggctatggt

SEQ ID NO: 89396 - DNA, 643 bp, Heterodera glycines
  SCN-specific regions: Sequence locations=1-511,533-643
gtcaatcggtgctgtacctggacggtgtaaaattttctgatatacaggcaacaatacaaggcatttttctcgccgcttgtttcctgtttatctccagatcaaagcccctaaaaacactcgcgaaacaacgaccgatgaccaacattttcaatgtgtacactctgtccaccatcacaatacaatttgccgtccattttgcctgtttgattcacattgtcagacttgctcatgccttagaggagagaccaggaaaaactgagttggaaaaggagttcaaaccgaacttgttgaataccgccgtttatttgatgtccgcttctctgcaaattgcaacttttgccgtcaattaccgtggcagacctttcatggagagtttagttgaaaacaagcccctcttctactcaatcatttgctcttttggtgcaatggtcgcctttgcttcaaatacctttccggatctcaacaataaatttgagcttgtccacatccccgtcgaattgcgtgatacattgatttgttgtattttgggagatttggtctgctgtttgcttttggatcggatgttgaattatctttttggtgatcagcgagttcgaaaaatgttgatgtattaattctatttgtattcaaattttgatttatc

SEQ ID NO: 89397 - DNA, 646 bp, Heterodera glycines
  SCN-specific regions: Sequence locations=1-646
tggctaatgattctcgcagttcttcgagcgcttcctcccgttctcgctcgcctagtcacaggcgttcgccacgccgtcgcgagcagcgtcggcgccgctcgcgttccaccttttcacgttctccatcacctggccaaaaacgactgcacatcggcaatttggacgagtcggtccgtcgtcgggacattgaagacgtttttggaaagtatggacggatcagcgactgttggatggccagttaccctcccttctacgctttcgtcgtgttcgaaaacaacaaagatgcgtccgcctgcatgaaagacttgggcaacacggcgtacatcaaagggtgtcgtgcgcgtgttacggtggctcttccaaggaatggtgcgacttatcgtcgcggaccgccgcctccgccgcgacgttattacgacgaggaggacagtcaccgacgccgtcgtcgttcgcgtactcgctcgccccgtcgtaggcgctcgcccagtcgctcgcgcagtcgcacaccgccgcgccgcagtcgttcgcctcgtcgttcggcgcgtcgccagcgctcgccgtcgccgaagagagaacgcagagacagggaggagaaggacacaaagccccgagaagcagcagatgagcatgagcagcaacctatcgc

SEQ ID NO: 89398 - DNA, 632 bp, Heterodera glycines
  SCN-specific regions: Sequence locations=1-80,105-451,473-632
gtttgagcttctgatcagtcgctacataaatcaacaaacgacaacataaaacagtcgactccaattccgctgatccattcaaaatcttttgctgaacaccaaaagcacaccacttggccacacttctgcgccacttcaattctttggccatttgttaaggccgagcacaatacgcaatcctgacacgatgaagcaccaatatcagaatgagctgaatacacagtccagcagagctgtgacatcaccactcgcagatgatgacgaaacgctggacgagtcgcgcgagcgtgcctacaaattggtggcgtacacggcggtcggcttctcgctggtcgccatcctggcggtggccatctgcttgccggtggtgttcaactttgtggaccacatccaacgccagaccaaacgggagctcgacttttgcaagagttcggccagggacatcatgttcgaggtgggggacaagcagcgtcgcattgccaccgcgtttgaagcggtgcgcaaccggacgggcggcgccgacgcatcctttgcctccatgccattcccgtcgctgatcgcccacctgcagaaccgacgtgccaagcgccagaccgaggcttgcgagtcgtgctgcattccgggccatcccg

SEQ ID NO: 89399 - DNA, 788 bp, Heterodera glycines
  SCN-specific regions: Sequence locations=1-84,109-513,535-761
ccccgagcgggacaccaagatggacaccaccaatgccgaggtgatggacaccaagaaggaagccaacgcggcagctgcagcgccggtggcggcgtcggacaacacggcaccagccccaatgacatggatgatggacggcattgtgccacgcgatgtcaatgtgatggtggaccgtaccacgaaggagttgcgcaaaaccacggagacggacggcttctacgacatgagccagcgggcacaggaacgtgtgatgttggagacagccggcaaacagggcgaaattgtcaagacaaagctgaaggaagcaattgaggaggcccgaaaaatgatcgaacgtgctcttggcacagtgatttcctactcggaagcgccaatggagtccaaaatgcaattggaacaggtgttcatgacgctgacggacgagaccaagacgcccaaagagaagatggagcggatcaaggacatccagcagaaatggacaccggaaatccgcgcggcgttgaagccatccactgacgacaaggaaattgccgaggcaatccgcttcttcaccgacttgccggctcagattgagcttggcaaaaagtgatcggagctgtggcacaattgtgccgatctgatcaatggccggacatcgcacaatgtcccaaaaaattcatagaaaaacaaaaacagtaacgatcattcggattttcttttaaatgatcaatgtcaaacaaggattgtttttttttgtggttaaataaattttcattttttttaaaaaaaaaaaaaaaaaaaaaaaaaaa

SEQ ID NO: 89400 - DNA, 659 bp, Heterodera glycines
  SCN-specific regions: Sequence locations=1-55,77-659
aagcttccttcctccccggcggcaacggaacacaaacaatcggaagacccttccgtccctcactcactcacttcccccgtccttccaatccctttgccctctcatcttctcgacctaattatacgagcaaaaaaaacagtaatttgtttgttttatcactcaccaattttctaaaataagaaatgaacacacaacaacaaacttaagcagacaaattattgtttattcacttattaatttgttttgtctgctattttccacaattcccttgacaaatggccgaattgccgtcgctcgataccaaatttatgtggcagcacacgtggccaagtgcggatgtcctctgttcgtttcgtacaatctcatctttgggaatgtgatttttcaattgtattttcggtgaatttattgcgagcaattcggagctttggcgcggtgctttcattttggaactcggtgccggaatcgcggcacttccgtcaatgacggcacttcgatacgacgcagcaaaagtggtgataactgagcaaaaccaagaggttgttgaacaaattcagtgcaatttggagcgcaattttgacaaaaaatttactcgagagaaagtgcgattaatgagtttggattggcttcagcccgacgattccctggcacgggttgtt

SEQ ID NO: 89401 - DNA, 1012 bp, Heterodera glycines
  SCN-specific regions: Sequence locations=1-1,23-403,426-652,675-1012
gtttgagataaatgattttcaaccatttctacacccaattttacattctgcttaacgtgttagcttcaactggctttgttttctgtacaacagaatggttcggagacctcagagcccatatgaatcctccgaaatttcctccgttttatgacatcgtatacgacgaaccagattgtccatttgggcttgaaagtgtggccatccccgagtttgtgtactttggggaaatgattgcaactaaatttgttcaagagcattcacaatgtctgcagttttgcttggaaacctcaaagtgcaaagctgtgaatttctttgaatcgatcgaaggaaaaaatcccgaagtcggtttctgtgaactgttggtcgaaggccagtatgacaacccacgactgatgcgacctttcaaaaaagcaacttaccatgaaaaaattcactgccgagctgaaaacgaagaggaaaaacagccattcatttttgatgagaaggagggcaagcaattgctaattggaaacgaaagtaacgaacgcaaaaacacgtcgtcgacagcgaaacaaaccgaaaaagggacaaatgaaaacggacaaaagacaaccgcggaaaatcggcaaagtgaaggaagaatgaacgagcaacggagccaaaaaacaacggaaaaacagccgagaagagaagaacaaagtgaaggtcgaggaaacggaggtcgaaaaacggagacaaaggaagaaacggcacaaaaatcggaaacgcaggaaaaggcaacggaaccaccgacagcacaattaaattcactgattctcaaaagacttgcggaaagaattcaagaactcaaaaagcggttcagaaattgacaaatgaggaaccaaattgatttgatgaggaaatactagtatttattaatgatactaatcatgctgccaattcatttgtattattttttggccagtagttttgacccattttagagataatttcgcaaaaaccttatttgtgtcatttgaattagttttactta

SEQ ID NO: 89402 - DNA, 641 bp, Heterodera glycines
  SCN-specific regions: Sequence locations=1-120,142-535,560-641
gtccaataaagcttattatgtttcgaaattgtctcctggatttaactcctctccgttgtgcatttattgcaaataaactggctcattattcttccaaaacaccaacattttcgaattgcattccttcaccaattttatcgggaaatcaattgtttcgaattattcgtgacaaaattcgcacctcaggcccaattacggttgctgaatacatgcaaatttgtgccacttctcaacttggttattatgctggtcaaaatgaaatttttggagagcgtggtgactttgtaacttcgccggagctgactcagatattcggagaattaattgggagttgggttgttcatgagttggaaatgacctcttggaaggaccggtggcaattggtcgaactcgggccgggctcgggcgaattgatggccgatgtgcttaatgtgctgcgccaatttgatgtattacaaaatgttgaagtttatttggttgaaagttccgagcgtttagtggagcgccaacgagaaactttgaaaaagaaatttggcgaagatttacttagaaacattcgatgggacgattcattggatgatgtgccacaaaggttctcccgggttctggccaatgaattcctcgacgctttgcccgttcat

SEQ ID NO: 89403 - DNA, 724 bp, Heterodera glycines
  SCN-specific regions: Sequence locations=1-244,266-609,639-656,678 -682,704-724
cactccgatttattacgtttacatgtgcttccgctacctcaattatcgcaatttgatttgcatttgctgtgcccccaaatttcggcgtcttctctttcccgattgtttatgcttttgtgccagaaataaacggtgccaaaaccaaaatgaagaaaaggcggacaatgacgaaaaattgagcgtcgtgagggaacagccgctgccaaacaattcctttgaacaacggcgcagtctcggcaccactgggcaggtgtcgaggagtgtcaaggagggatttgcacttttcgacttttcactgaagttgtttctgtccactgaacaagtgcagaagctgcatgactttgagggggagtgtatggtcgatttggcccgagaaaaggaggacaaacgaaatcggacatccgaagaacgactcaacagaacatgtgaaagaacggaactgattctgttgcgcgttaatgacatcgtctcgcgggaagccacgttcaaagggaacatccacgacttggaaacgaggctgggaatcgtggaaaatagacaggccgaagtcctggactatcttcgccaatttggtgctgttttaccgtcattggttcagtcagtccaaactcttcaacaacagcagcagcaactgttgcagagactttcatccattcccgaataacaaattttattaacttacttttattttttgttgttttggctgcatattttattatcattt

SEQ ID NO: 89404 - DNA, 830 bp, Heterodera glycines
  SCN-specific regions: Sequence locations=1-830
taaaaaaaatgatgcccaaaaatttttgcggcaaaacatcaaaattttcttcgtgccttctccctgctcttctgctgatcataatattgtcaatactaaattctgtgagctcttctcgtcgccaccattctcctgcttctggtcataatcggcggctgtcatcaatttcatcgcccgccgttgcaaatggtggcagcctctttgaacatcgaacaaagcatcaaagtgttgccgcggctgatgagtcggccgggggttgtgccgttgttccaccatcgctttggtgcggctgtgacaagctgcagacacagtgtggcaccggacgattgtgcggccgatacaccggcgccatgcgaaatgagccgcttcacatcacactgctctatgaaagcctgtgccccgactgtcaaagtttcatcaccgaaactctgttcgatgtgtaccaaaaattcaagacgcacttgcgaattgaatttgtcccatttggcaatgcgaaagtgttggagaatggcacaatcaaatgccaacatgggcctgaagagtgtcggatcaacaaatttcattcgtgtgccattcacttcatgcacgacccaatgccattcatttactgccttgaaaagctgatcagttcaggcattccgctggagaaagcatccaaaaaatgctatgtcaaattgcatccaatcccgcacatttacgaccagattactcactgtttcaatgggccgaccggcgatcgacttcaaagggaagccggtcgtctgacggcacagatttggcctgatcagcatgaatatgtgccatggattttggagaacaatgccagtctg

SEQ ID NO: 89405 - DNA, 638 bp, Heterodera glycines
  SCN-specific regions: Sequence locations=1-228,255-638
ataacgcctcagggaatttccgacggcataatgcaccaaggcataccaaatgtgccaacagtgtcgaacaacggaacatcgtttgggcgagtggcacctccgggaatttcggatacgatttctacaactacccaatttactataacagcgacaaatttaccaataacttcttttgtcacgacacaagatcctaacgttagaagcgaattcgaaaaagcggatgctcccgaaattttgaaaatttttattccacctaaacctccagcggtgccacaagaagcaaaaaagatttttgaggatttatgtgccggagggaaatgtttggtgcaaaaacctgaatttatacagcaaaaagcggcggtagagaaagaatcagagcaaatcgaactgaaattaaaccctgggaaaagtgcggagcaagtgaaaagggaagtgaaagtgcgcatggccaaaacgcagcagctgaagaaggcactcgtgcaaaatgccggccttgagggacaggtggaaccggcggacaacggagtgtttggacatgaccaattgttaacggagacgcaagcgaacgatttgctcaacgaattgacgcgtcacaaagcgaacagagccaaaagggcgggaaacgcaatgtttttgga

SEQ ID NO: 89406 - DNA, 841 bp, Heterodera glycines
  SCN-specific regions: Sequence locations=1-841
ctgtcaccgcggtgacgaggctgaagaaggactaccagaagctggtcagggacccagtcccttacgcaattgcagcaccgcttccgtccaacattttggagtggcattatgtcgtcaccggtgctcccgacacgccttacgaaggtggttactaccatggcaagcttattttcccgcaggactttccctttcgcccgccggcaatttacatgatcaccccgagcggtcgcttccaaactaacaccagactgtgcctttccatctcagactttcacccggacacgtggaatccgtcctggtccgtttccaccattattatgggtctgatctcattcatgaacgagaactcaccaacacttggcgcattggtcagcactgacgaggagaagcgcgtttttgccttgcgttcccgtgagctcaaccttaaaaatgcccagttttgcgagctgttcgtcggcctggccgaccaaattcgggccgaattggaggcggaaagggccgccgcatcggacaacgccgaggggcaaactgcttccggagagtcgacgaccaaaaagaactctcgacacgactcttcctcactgactgccaatttgttaatggtcgcgggtgttgtcatccttttcttcgccgttcgctacgttattctcaacgcgacgactgtctgatcgaaaaatgtaaaactgatccgactttcccactgcttttttgccctattttttgctgctgctattttccctttctctgtgtttcaccgacgcattttaggcctattcaactgacagaacatttgcctattttaagggtcgtttatgtcgccaattgaaatgcgatttttatg

SEQ ID NO: 89407 - DNA, 520 bp, Heterodera glycines
  SCN-specific regions: Sequence locations=1-520
gaacccactcgtccattatgagggaactgccgaagaaatcatttgggcatgcgatggcaaattggatgccatggtggtcggcgccggcaccggcggaacaatgactggaatagcgaacaagatgcgacaaaagcttccgaattgcaaaatcattgccattgatcccgagggttccattttggccaatccgacaaatcgccaaaagcacgcctacgaaattgagggcatcggataccactttgtgccgtacaccactgatcgcaatttggtggacgaatggatcaaaacgaatgatgcgaatgcctttcgcaccgcgcggcgactgatcagcgaggagggattgctgtgcgggggttcttccggcgccaatgtttgggcggcgatggaagtggcaaaaacgatgggcagagggaaacgcgtggtcacaattctgccggacggaattccaaattacatgagcaaattcatcgacgacgaatggatgagagttaagggatttgaaggaatttgaaaaagggga

SEQ ID NO: 89408 - DNA, 730 bp, Heterodera glycines
  SCN-specific regions: Sequence locations=1-81,103-141,169-293,315 -681,703-730
caagaaactcacattgtcctcggcattgcctcgctgtgctctctgctggcaattatcgccaccgtagtcactttgccatcgctgtactcggagatgagccaactgaacaacaaagtgcgcgacggcgttcaagccttccgtgtcaacaccgactcggcctggactgacctgatggatgtgcaagtcgtcgtggcaccgccgtcaaaggcccgtgacaaccccttcagctccatcttccgtgccaagcgtcaattgcctggccactgcaattgcggtcccccacaacggccaaactgccctcctggcccacctggtccggccggaccgcctggccaacccggacagccgggaggcgcaggactgcaaggacagccgggagcacctggccaacctgctcctccgtgcccgccccagaacatcccttgtccacgctgcccggctggcccacccggcagccccggagggcagggaccgcccggacagcaaggagcccccggccagcctggtgcgcccgctccgggcggaggacagggaccgcctggcccatccggaccccaaggacagcctggacagcccggacgcagcggaacacccggccaacccggacagcctggaaataatgctgttattttcaacaccattcctggcccgagaggagctcccggagcgcctggccaacccggaagccccggcagcccaggccaacctggccagtccggaggccaaggac

SEQ ID NO: 89409 - DNA, 687 bp, Heterodera glycines
  misc_feature (683)..(683): n is a, c, g, or t
  SCN-specific regions: Sequence locations=1-227,249-476,503-553,590-687
gtccaattaagcgattcgtattgcctttaaaattcttgtcaccactcaacatcaagtttatgggtgcaatgagttcttcgtcttctgccgccccatcggacccgcagcaaaaaagcatttatgaattttcggccaaagacattgacggcaatgagaccagctttggcaaataccgtggcaaagtgctgttggtggtcaacgtagcgtcgaactgcggcttcaccgactccaactacagtcagctgaagcagttgctggacaaatacaagtcgaagggactcgaaatcgcggccttcccgtgcaaccaattcaacaaccaggaatcgggctgcgccattgacatcaaagactttgtgaccaaaaagtacaacttcgagccggatctctacgacaaaattgacgtcaacgggcccaatgagcatccgatctacgcctatctgaagagcgtccaaggcggcatcctcggctttgatgcgatcaaatggaactttaccaagtttttgatcgataaaaacggcaaagtggtggagcgttatgcgccgaccaaagaaccgaagaacattgagaaggaaattgagaaattgctggaggcctgatttgatgaaaaaaacttgagcttttcagacttatatgcccatagaataatttgtaatctaaataaaattcttatgcttaaaaaaaanaaaa

SEQ ID NO: 89410 - DNA, 957 bp, Heterodera glycines
  SCN-specific regions: Sequence locations=1-565,587-708,730-957
caagtttgaggtaatgtattaaccaaagcttaaaaatgaaaagcaattctaaaactgctgacattggtgatttttacgagatattgggcgttcctcgtaatgcaagtgagcaggaaatcaaaaacgcttaccgaaaattggcactaacttatcatccagacagaaaccctgggaatgagcaagcgcaagaacagttcaaaaaagttagcatagactattctgttctctccgacccaaataaaaggcggcaatacgatgtgtccggaccatcgatggcaatgaatgattttgaaggactcgacatatccgaacttggcggagttggtcgcttttttggcgcaatgtttaccaaattgggaataccaattcctacccaaattggaccgaaagtgcttgctcaagctcgtgatctctctcgtggcaatgtcacaaacggcctctcgagccaggtctggtgctgtccgaaacagtgaacaatcaagaggcaaatttctacgcgtttcagatgactcccgaattccaacaacacggagtgatcattcgatgcaaatcattggcaatgagcaaattcaaattggtccttttcgatcaggaaggcgcagtccgtcacattcgcgagagtcagaagaaaaagaaatacacttccgctgaacttttctttgtgccgttccaacgaataaacatttccgaattcattccaattcgtttttacatggaggacaaagacactccgctgccatttcactttctggacactttagaaacccatggtgctaatgtgatggagcttcagccaggaaagcacatcctttgtgtatacggcgacaatttcttgagaatggtcagttacgaaatcactttcctcccgctgaatcattacgccagcgcagcaattaacaaaatcaacgcattggagcccgtgttggcatcgaagaaatcggaaatgcaagaattcca

SEQ ID NO: 89411 - DNA, 548 bp, Heterodera glycines
  misc_feature (470)..(470): n is a, c, g, or t
  SCN-specific regions: Sequence locations=1-283,305-464
tgagtattacgctaccaggtagagaagataatgatatgctaatccataacttagcgattcatggcatagccgctgccgaggggagtgcttgtagtagtggtagtgcgattgcttcacccgttatagccgcattacagggggaacacaatcaggcaatacgcttttccttcagcaagtatacgacccatgaagagattgcaaagaccgttgaagtattgcggcaccttgccttgtaaaaaggtgctaaaaaaagaaaagacaaaacgacgagacccgagaaagcaaaagaaccaaaggaagaaagcagaactgaggggaaccacgaaaaaacactagaagttcaaggaggatagggaagcgacataaacaaaatggttagagtagaacacacaatcaataggagagagaaaatcaaagagaagaaacaggactagctaagatcacaagcaaaataatagatagccaaaatnaaaaaaaaaaaaaaaaaaaaaaggacctaagaacaaaaaaaaaaaaaaaaaattttaaaaaaaaaaaaaaaaaaaaaa

SEQ ID NO: 89412 - DNA, 540 bp, Heterodera glycines
  SCN-specific regions: Sequence locations=1-513,535-540
atttgctaaaaaaatttagttacctaaaatgcctgtgcgacaaattctctcgggtacccgcagaattgcgaccaaaagtttgtcgtttggaattggttcggcgaggttggccgattacggtgtctttaaggccctcctcgagcccttagtggtttccaagtttgaagagctatcgcgcattagagtcgaaaaaattacgatcttttttgggatcctcgttttcgtctcattggctgacgttgctatgaccctgcggaccaacgaacatgttggcgacgttgagcgccgtcttgaaagccgtcttgaagaccgttttgctgaccttcgagcgcttcttgagcgccgccttgacagcattgaccgccatctcggaacttctgacaaagcgacggatgccaagttgcccggccagtgatcccagtggaactctgacgaaggatctcgggtgttacctttaccgggtattgaattgaccaattgctttgttgttctcatcttttcactaaagtcgtaaaaataaagttttaatgtaaatgaaag

SEQ ID NO: 89413 - DNA, 630 bp, Heterodera glycines
  SCN-specific regions: Sequence locations=1-630
tgacaaattgcctcccctccgaattctttgcaaattactccttttctccccaaaatatggactttaacctgaaaacattggccagggaggcgtccgggatgctcagccgagccaaacaactaaccgaagaaaagctattgaacgcggagaagacggaacttgaccctcattgcgagcaattgctcgccaaggcggataaaacggaggaacagtcgaagaaactgttgtccgccatggaggcgtatctgcagccgaacccagccctccgaatgggcgacctgttctatgaaaagatggaaatcacttcgccagcccccaatcgctcaaacactttggaataccttagcgaggcgatgcaggaggctgcccaatcctttggcaccgaaacgccattcggaggtgctttgcaaaaaattgcgcagacggaagccaaattgggcgctgccgaaagggaaatggtccaaacgacggccgggcaaacgctggtgccaatcaaacgcttttttggagggcgaaatgcgaaacattcagaaaaaacgccccgttttgcaaaagaaacgcttggatttggacgcgcccaaaagtcggctgaaaagggcgcggactttggagggacaagcgaccgtaaac

SEQ ID NO: 89414 - DNA, 1005 bp, Heterodera glycines
  SCN-specific regions: Sequence locations=1-10,81-387,411-881,905-1005
caagtttgagttcgttccttttccatgcgtttttcttcattttcctccccttttctccccctctttttcctttctttgccaattgcgtttgttttgtccggccgaactttgccgttcaccggttcgcaattggccaatgaagtggccagggcattttttaattccgtcaacacttgggacatgtcaattttcggagccgggactaagcagggcgaggaccgttacaagatcagcttggacggcctggacagaatgaagaacagattcagagtgccgttgccggcggggcaggggttggaaaagctgctcagatcgtacagagtggagcctctcagagaggattaccttggggtgaacaaagccagagaaagagtgttggcaccgagtaaactgatggaactgatggaaaagctgggcaatgtgctggttacggacccaaaaatgcgccaaaagatcgacaaatacgacaaaaaaagagcggatgaggcggcgcgaagggcggcgatgatgccaccaaggcaagacccacaagcgattgcaaaacgcaggacgtggccgaaggaggacggattggcattggaaaggggccatttgcctcagggcaacaaccagagtccgacgcgactccagtcgacgcccaggatttggattcaagaagatgaccggtggcgccaaccgatgactttctcccgaaaagacgtgcgggaaagaagttggctcgagtcggacaccgactcggacttggtatcttaacttcggtgttgcgctcgcggcgaaggagtcgagtgaacattttggacgacgaccaaccgacaagaagaacggcctggggaaggtcgccgacgccgtcgccaaatggacgtgctgttgtacaacgaacaacgaccacaacgacgacgacaactgaggaggaggaaggggggcgaagaacggtcagatttggcgaagtggtggtcgttgagccggaggagagaacagtgaacagacgcacggaagtgcggacac

SEQ ID NO: 89415 - DNA, 827 bp, Heterodera glycines
  misc_feature (807)..(807): n is a, c, g, or t
  SCN-specific regions: Sequence locations=1-63,85-256,278-539,562-827
ccaagtttgagcctaatttgatataacgaatatcaatggaacatggaagcttgccgcttcaactcattattttattcgttttaacgttgcaaatttcaactcagtcgccagaaatttcagtgccttctgatgttcaaattttgtcagcagtccggaacgtagatttgaccactcaaattgtcaaggttaaaactgactttgagttgaaaaatggaagaaacgaggaattgagcagttttgtacatgccatgtcggctgaggaggctgcaagactttcttggatgtccgcttatgagagcggcaaagaatcgggcaaattacggatttctcgtgttagagtcaaaggggtctcatcggacatggttttccacaaaattgagtttctcgatttgttaatgtccggttccaatatcaaactttcggtggattatgctcttacggaatatttggtgccctctcctaaggacattttgcagtcagaaaaccagctggtcatcttttccggtactgctaatgttctcagcgcctacccagtgatgaaagaaaattgtgtctataaaatcggttcctcaaagcccatttcattcacggagatagcaccgagcaaacattcacaggaaaaaatttcctacggaccatatgagaacaccaaagcgtattccaagaaaccaattaccattcattacgaaaacaatgcaccatttttggtcgcttcatccgtggagcgcatcattgaagtgtctcattggggcggaaacatcgctgtggaagaaaacgtcgaaattttgcacaaaggagccaaactanagggttcattttctcgactt

SEQ ID NO: 89416 - DNA, 729 bp, Heterodera glycines
  misc_feature (726)..(726): n is a, c, g, or t
  SCN-specific regions: Sequence locations=1-270,292-312,334-702,726-729
agacagcaggacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgcttttgcacaaacaaatagtttaactaataaatgtccgctccgccgccgtacaacccgaacatgcaacagtacccgcagcagccacagccaaactacggtcagccgggctacggtggtggcggcggtggatacggttacccatcgcaaccgtacccacaacagccgaactcatatggtggtggtggctatcctcagcaacaacaaccgcagccacaagtcgtctatgtcgagcgcgaccgtccgcaacagcaagggagcaacaactgttgtctgtgggcattgttggcatgctgctgcggttgctgtttggcggagtgttgtgactgatcaaaaaaaagataaagcgcgaagaatcgaagtcggcggcgatggccaaccaaagcaaaaaggcacttgaaatcgaaaaatatcatttattttcttttctttgtgatcattctcaacaaccatttgtcatctgcgtgagaacatttttttttttttgaaattttgtaaattctgacaattaaaaaataataaaaagtnaaa

SEQ ID NO: 89417 - DNA, 632 bp, Heterodera glycines
  SCN-specific regions: Sequence locations=1-31,53-187,228-632
acggtttatcactcaaaatgagcgaatctgccagtgatgatgaaaatgcccatctaatcgaaatcaaattcaaaacgatacaggaaacttacaatgtgaaggtcaatgaaaactcaaccataaagcagcttaaaaagacaatggcgaagaaactcaatcagcctgaagagaaaatttgcctcattttttctgggaaaatactgaaagaccatgagaatctctcacaacatcatattggtgatgggatggtccttcacatggtcatccgaaatcagccctcaacttcgacggcttccgccgcaacaacttcctcagtttcgactgcgccgacgggtggcgctgcgccgaacttagctggaactccgccgtcgttaggcggaattggcgatcttttcaacaaccctgaacttgttcaaggcattctgaattcacctttcatggagagtatgctggccaacccggacataattcgaacgatgctgagccaaaacccccagtttcagcaaattatccaaaacaatcccgagctgggccacattatgaatgaccccggcactatgcgacaagccatggaaatgattcgcaatccaacggctcttaatgagttgatgcgtaaccacgaccaagcaatc

SEQ ID NO: 89418 - DNA, 958 bp, Heterodera glycines
  SCN-specific regions: Sequence locations=1-240,272-359,381-958
ttgaggcgcactttcaaaagtttaaatgcttttccaacgacaaaaattgccaaaaatttgtgccactcttttcccaaaatgccaaattcggcgatcgtccaactttgtcgagttggcaggcttcaccgcctccactgactccaagcagtacgcggctaaaaaactgttgttgctcaaaaacggcagctcccgaagttacaacgacgtgaacgtggcagccggacgttttgcggcattgctcaacaaaaagtacggcattcagaagggtgacactgtgttatgtcgaacttcaaaaaatgttgacgcgttggcactttatttggctgtccttcggcttggtgccatttacgtgccgcttaatcccacttacacaaaacgggaaacagagcattttgtgaacgacgctaaacccaaagtgatggtttcgcttaacgcatcggaggacgcctcatttactcagtccggctttgatgttaagcatgtgctgtgtgagaagcgattggcagaggaggcactgaagcaagagcccagctgtgaggttgaacccgcagaaaaggacgacgtggcatgcattttgtacacaagcggaaccacgggaagaccaaaaggtgccatggtcactcacggcggtttggtggccaatgccgagacgtgcactgacatttggcacttcagcgaaaatgatattaatttgcacgttttgcccttctaccacatccacggcctgttcatcagcttcaactgcacgctaatgtccaagtcgagtcgcattttcttgcccaaattcgacgtggacgaaacaattgcgtatttgcccaaatcgaccgcgatgatgggcgtgccgacattttacgctcggatggtcgaacacgcgggactgaatcgggccgcggggaaaaacatgcgcgtgttcatcagcggctccgcgcaactaacgccccaagtggttgagaaattc

SEQ ID NO: 89419 - DNA, 832 bp, Heterodera glycines
  SCN-specific regions: Sequence locations=1-32,54-86,123-349,371-832
gtttgagggagagaatttccgttccatttaataatttaataaacccaaaatgtcttcatcaactgctgaactgaatccggaagatggtggtcatccgccacagaacaccgccgtggccatcgagcagtcgcaacaggccatccatccgccggcacaaagcggaagcggcaaaattgccgcgtgggcatcgccgaacgcggacgacacggagccgtacggaatttgcgcaaagattctgatcgttctgtcctacatcatcacaatcatcacttttccgatctccgtgttcatgtgtattaaaattgtccaacaatatgaacgagcggtgattttccgtcttggccaactgaagaagggtggagccaaggggcctggccttttcttcatcatcccttgcattgatgagtatcgtaaaatcgacctgcgcgtggtgtccttccaagtgccgccccaggaaattttgtccaaagactcagtcactgtcgaagtggacgcggtggtctatttccgcgtgttcaatgccaccatttccattgtgaacattgagaattcgaccggctccaccaaattgttggcacagacaacgctgcgcaatgttttgggcaccaaaacgctgagcgaaatgctcagcgaacgcgaaaacattagccaccaaatgcaggaagtgcttgacgaggccaccgagcattggggcgtcaaagtcgaacgtgtggaggtgaaggacgtgcgcttgccgcgcgaaatgcaacgcgcaatggccgcggaagcggaggcgacacgcgaagccaaagccaaggtgatcgctgcccagggtgagcagcaggcgtcgcgc

SEQ ID NO: 89420 - DNA, 865 bp, Heterodera glycines
  SCN-specific regions: Sequence locations=1-256,278-865
gtgctttttcgttctgccaatgtgcccttctgagtttgtgcctttggcatgacttcgacgcttcgcggtttctgcctttcccccgctgatcagcagacgaatcttttctcattttgcagtgaaatggcgacgaacgcatcacagaaaaggaaggagatctatcggtacaaagcgtcgttcaatgtttatgcgatgggatggtcaaccaaattggacaatcacctcaaatttcgcttggccatcggcagtttcatcgaggaatacaacaacaaagtgtccattgtgcagctgcacgaggaccaaggcgaatttggccatctcggcactttcgaccatccttacccctcgacaaaggtgctgtggatccccgatccaaagtcggcttttcctgatttattagcgaccaccggcgattatttgcgcatttggcgaatcggcggtcacaacggcgcttcgttggaagttcggctggacaataaccgttcgtctgagtattgcgcgcctctcacttcggccgattggaacgaagtggacgtgtcactgattggaacgtcgagcattgacacgacgtgcaccatttggcagatagagacagggcaagcagtggcgaacacggaaccgtaatcggagggaatgtgaagacccaactcatcgcacatgacaaggaagtgtacgacatcgaattctctaaactgtcctcgggacgcgacattttcgcatcagccggcgctgacggaagcattcgaatgttcgatctccgccacatggaatactcaacaattgttttcgaagaaccctccaaaaagcctttgctcagattagcatggaacaagcaggaccacaattacttggcaacattcgccca

SEQ ID NO: 89421 - DNA, 661 bp, Heterodera glycines
  misc_feature (467)..(467): n is a, c, g, or t
  SCN-specific regions: Sequence locations=1-535,564-661
aggcgcgaaggaagcgaatcggacactttggagtgcgagatagtcgacgacagtcgagaaagcgaaagaaattcgaatcaccgcaagccgtaccgcctgccgcgaacaccgacttcattcagacagcccggggcgcaattcggcgtcagtcattacgcgatcggagtgggatgacacttgcacggcttgattcacaacgtgaagggtccgacctgattaggagttggagcaaggaggatgtgtccaatgaggaaatgtctgcgcatcatttcggcaacgggggaccgtccacctctcaccagccgacagcaaatcagcaaagacgcgactcgccgcctaaaagaatgcagaaacaatcgcagcaaaagcagaagcaaatgtcgccagacgagtggttgaagaagttggaggccgaatcaggcggccttcgagacgaagaggaggagcaggcggagaaaaacgtgctngaaagggagcgccggggagagcatgcggaagggagcgaaagcacagaaaggcaacggggtgattaggagagatcagcaacagcagcagcaacacgatatgaacggaatgaatctgaagggatcactcggtgggacagaatcggaggcggaagaagagctgttgctgcattatttgatcacgccttcgccttctc

SEQ ID NO: 89422 - DNA, 640 bp, Heterodera glycines
  SCN-specific regions: Sequence locations=1-640
cttgacagtgcggatgcggagaacctggccttgatcaatcgtcccgatttgggggtgaccttcaccaaattgcattgctggcgactcactcaatactcaaagtgtgtgttccttgacgccgacacttttgtggtcaaaaattgcgacgaactctttgaacgacccgaattctctgcggcaccagacgttggatggcccgacattttcaacacaggcgtctttgtctttgttccctcggagcaaacatatcgcaatttgcttgattttgcactcgtttatgggtccttcgacggcggtgaccagggacttctgaacgcatatttcagcacatggcgtgaatcagatgctacccaccgtctcccgttcacttacaatgtcacgaccgttgccatttatggctatgccgccgctttgaagcgtttcgcgccgaacatcaaaataatccattttcttggcaagcaaaagccttgggctctgctctacggggacggcgctgcggggatggcattcgtttcggactatcacaagcaatggtaccaactctacgcaaacattgtccagcaacttctgcctccgtcctcttcggtaatttcttcttccaccccttcttctcttccgtcctcttccttctctattattc

SEQ ID NO: 89423 - DNA, 820 bp, Heterodera glycines
  misc_feature (784)..(784): n is a, c, g, or t
  SCN-specific regions: Sequence locations=1-95,117-222,244-281,303-784
tggagggcaacccggcaccgacaattgtgtggaaaaagggcggccgaaaaatgccattgaccgacgaccgagtgcggtgccaaacggacggtgacacgggacatgtttctctgatcatttccaaatgtcggccacaagatggggacgagtacacattgatggtgaagaacgcgcatggcaagcacaaagttggcgccaagctgcttgtcacgccagcggccgaatcaaatttggacatccgggccaagcagaaaaaacgtggcacgggctttagcaattcggaacaggaaaaacagcgccaacggagtgatgccgagcccaaaagcaaggctgaacgacgcaaacgccaagtgtatgtggtggaggagccccgtgacacatttgttgtgccgttgaactcgcagcatgccaacgaaaaggaaaatgccacttttgaatgcgaagtgaacgacaaggagatcgatgtgaaatggttccatgacggtgccgagatcgggatggacgggcggcactttaaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgcaagccggtgaccttctagttcgacgatgagttgtattaaatttttttgtttttcactgttcctgttttatttgtgcccatctcttttttaaactctgtgaattgaagataaaattttattttccnaaaaaaaaaaaaaaaaaaaaaaaaaaaaaaaaaaaa

SEQ ID NO: 89424 - DNA, 547 bp, Heterodera glycines
  SCN-specific regions: Sequence locations=1-61,83-430,452-547
cgtttctccaaggttttatcttttatcagtgccatttgataacataattcgcgcacattatgcttcggccgccacatttcccattgcttttgactgcgattgttgtcgtcatttgtttactctccggcactgcaaatggcgacaaaaacctgttggacgagctgcgcgatttggacattttccagctaaagagcggcgtttcggcgtgtccattgctcgtcggcgagcgatgccccgagtcgagtccgctttactacttcaaatgttgcggtgatctctactcgagctgttgcgttcggttgcaggattgggctgtcggcgtcatcgctcttctgatcgtgctgattttggtcgctgccttcataaatctgatccgctgcatcttttgtgcctgatccgtttgagtacgtcggatgaaacaattgaggacaaagcagtgaaattgttgtaaattaaatttccaattgcaacaaattctgggatctttttttccatggcacttaattttgtttttctttgagtgattccatcaatacattttttcatt

SEQ ID NO: 89425 - DNA, 655 bp, Heterodera glycines
  SCN-specific regions: Sequence locations=1-567,589-601,623-655
caattgccaattgtcccttccttttcgaccgttttttctatttccgtcgcttttcctcccctcccaaaatgggcgaagttcgctttcactccgattacgtttcctccaaccgcggaatcaccaaaatcatccaaattgtgctcggttttgtcgtctgttcggtgctttgttcgaattggtatggcgggtacagctgtttcggggagggccgcctcggttatgtgagcggattgaactttgtctgtttgatgattaacatcatccttttcctgctcaatctgttcaacattcgtccactgaaacttgaacaattgtacaatgtcgccgccgcccttcttctgctcgtcggcatcgtccttctgttatggtacataatacagtactcttactggaacatttggatgataatcgcagcggtctgtgtgctgatcatctttttgctctttcaatgggacttcaaagggaaccgcacaatgtccgaagggcacttgccaatctgacgagggacggaaaacaaacggaagacataacgccgaactcaccgcattttcaaataatgccaaatgcttttctttttgaaatgctttttgaacatgaaaatgcctttccatttctttatttttcccgttcgaatgctttttctttgccgtccttt

SEQ ID NO: 89426 - DNA, 1113 bp, Heterodera glycines
  SCN-specific regions: Sequence locations=1-76,98-225,249-1113
gtttgagctcattgttcggccacttgtgctgtttcggctccaatggcgcttctcccgttgttcctcctccttttgcctttcttttgcccttccctttgctcctccgatttgccggaatgtccgtgggttaacccggagaaagagttgcagaaatgggcaaatttgccggtgtttccctccaaatgcaatgtgaccaaagacacgccagcggaggaaagcggagacgaaaaggaatattgggagaggggacagcacaggtattacttcaaccaatgggtgagcgacaaaatcggaccgacgagaaagttggacaaaatggcacatccgaagtgcgctgagattgacttctccaaagtgcactcaaaggtcactgtggtggtcatttaccacaatgaaatgctgtcagtgctcgtcagaatgatcaactcaatcttcaacgaatcgccggcacatcttttgactgaagtgattctctacgacgacttcacagagtccaatttggacattggcgactcactgaaggaatatgcgaaaattgcgaagggcaattgggaaagcaaaatccgcttcataaaggcctcggaacgacagggactgatcagggcaaaggttttggcatcgcgagaagcaaagggtgacgtgctcatcttcttggacagtcattgtgaagtgacgccgggctggctggagccattgttggcacccattgaagagaacccaaaaagggttattctgccggtgatcgatctgatcaatgccaacactttcaattatgaaaaggcgatggtggcaaagggaacgttcgactggggattgtactacaaatgggactatttcgactggtcgtacttcgacgtggaggaaaacaatgtgaagccgtacaaaacgccagcaatgagtggaggccttttggcggtgtctcgcgattatttccgtgagattggcgagtacgacatgggcatggaaatatggggcgcggagaatatcgagttctcaatccgcgtttggctgtgcggtggcgaggtgctggtcgcgccgtgttcccgcgtcggccacgtgtttcgcatgcgccgcccgtaccgcggcaagccgggcgtcgactcgagcctgtac

SEQ ID NO: 89427 - DNA, 821 bp, Heterodera glycines
  SCN-specific regions: Sequence locations=1-821
ttgagaacgatttatggagaattgtttgtcgaatggaaatgatttatgccgttctggttcctttctactcgagatgaagccgtccactgatttggcttcgcttttcgttagccttcctgggcccgtgtcaaacgagggaaaagcggtggatgaaccactgggcattatgagggtggacaaccaatcgttggaaattgcttttgatgttcaggacattgctgaacaaacaggatgtcaatccgccgatttctcctcgtcaatgttttttcaaaaattcggtgctaaatttgtggacattatgctcgaaccgaccaccctttgttctccctcttgggccgatgctcaacaacggctgattatgtgcaaagtgcgggcggaggcggactgtgtgacgtttgcaccgaaaacaatcggacgattggaggaggaattggcccagcgctgtctcttgcgagaatacgtcgaacgcatcgaacacaaccgaactttccacgtgaactgtcgccgatgcggtcatttgattcactcgcacagcaaaggtgactttgtgtttggtgtgtttcccaacgacgattggctggagacggcaccccaaatggattatttctgtgccctttcttccgattgttgcggtgctcatttggaaatgtcgtcggtgcagcctcggaattctggcgagggtattttgggcttttcgcccgttttgtcggccgattcttcgcgccattggctgccgggcgagcggaaaattgtgttcagcaattcgttcattctcttccaaacactgataaattggcaaaggaagtgaccgaagtggcgac

SEQ ID NO: 89428 - DNA, 619 bp, Heterodera glycines
  SCN-specific regions: Sequence locations=1-245,267-595,617-619
ctctcctcgaaagtcgcccggccgaaattggccggccttggcgcgagggatgtgttgcgaactgaagcacgactttgtttattcggcaatgaaatcgatgagcggacgacaccagtggaagcggggattgcctttgtgatcgcaaagagacgacgacaaacactcggattccctggggcggaaagaataattcggcagttggaaaagaaagacttcgtcaagaaaagggttggattggcatcaaccaaagcggggagggcagcgagaaataaaatgccaattgccaacccaacagatggttcttccgttggctttgtcaccagcggatgtccttcgccaactttagggaaaaacattggaatgggttatgtggacaaggcgtatgctaaagttgggaacattttgacggtcgaagctgggcgagacagaatgattgaggtcgaagtggtcaaaatgccatttgtgaaaagcgcctattatctgaagccgacttctgtgaacgaagacaaaaagaaatgattaacattaattattgtatttgcattttacattaaattatatatttccatttttaacattcacttattatatttgcatttctaattaatgtacaaataaa

SEQ ID NO: 89429 - DNA, 556 bp, Heterodera glycines
  SCN-specific regions: Sequence locations=1-556
ggcaataattccgtgtttaatcgttctttgaaagtcacaaaatgtccttccaacaaattttctccacctccgccggtcttttcggcttagtttttattacgtcgacgctttcggccccagcaccaaaaccgcgaaaaccaacaacaacacccagcagaaaagcagccattcaatgcttatctaaatcccggctttgacaagcgatctttcgattccttcactggccccggcttcactgggctggacaagcgggccgctttcgacaccggcttcaccaattacgacaaacgcgcgttcgactcgttcactgggcctggcttcaccggacttgacaagcgatttgaaccgtttgatggctatggcttcaacggatttgagaagcgatcgttcgattcgttcacggggcccggcttcaccggaatggacagaaaatgaacataaaatggacggatggccaaattcaatcaaatcgttaaaatttgaaatttctatgtgaccccagctgttttctttgctgaattgcaccagttcgatattctcaatttatgcgccatta

SEQ ID NO: 89430 - DNA, 670 bp, Heterodera glycines
  SCN-specific regions: Sequence locations=1-13,37-670
aaataacttcctgtttcccactttttgttaatttttcctttctgcactaatcactaataatcaaatgcattcccgagtccaccaatattcaacccgagaccaagttcgagtgcccaatgtgattgccttagtcggtttgcctgcgcgtggaaagacttatatttcacacaaactttgccgttatctgaattggattggcatcaaaacgagggcattcaatgtgggggagtaccgtcgccaggcatgcgatttcttccagcaaggagcatctgaattctttagcccaaataatcaaattgggacacagatcagagaccattgcgcaaaattggccatggaggacatgggcctttacctggagaaaaaggagggcgaagtggccgtttttgacgcgacgaacaccacacgccagcgacgcaaatggctggtcgactactgccagagggagcgcatcaacccaaagtttcgcatattttttgtggaaagtgtgtgcgatgacccggacataatcgcagcgaacatttcggaggtaaaagtcaattcgcccgattatcgcggaaaaatgacggaggaagaggcgaaggccgactttttgcgccgcatcgaaaattacaaattgcaatacgaaccgttggacaacgaaaaggacgaccacctttcgtacatcaaa

SEQ ID NO: 89431 - DNA, 659 bp, Heterodera glycines
  SCN-specific regions: Sequence locations=1-9,55-128,154-371,394 -546,587-597,619-659
cggcacgaggctcaatttatttgtttgtttgtgtttttattttctaaaaattacttagcaaattctcaccaacttccttcgtttcctggacaacaagaaccgttacagggacatcatcagcaacacgcacaacaacagcagcaacaacaacaagtaaatgctggagcggaacatcagcagcagcacgctcagtttggtggcgaacaagtcaaagacgaaggacacataaaggaacatctcgaggggaaagtcgaccctacggcacacatgacgccagaacaattgcaattccactatttcaatgcatgacttggacaaaaatggaaaattggatgggatcgaactaattaaggcgatcacccactttcaccaagaaaatgcaagtcctgggcatcaaggtgccagcattccgccgcctttacccaatgaaaatgaactggagaatatgatcgactcgattttgcgcgaagatgactttaacggggacggatacattgattacggagagtttttaaaggctcaaaagctgcgagaagaccaagccaagagccaacaacagcagcagcaaacgccgccgccgccgcagtaaaacgacggaaccattttaaagccggcaaaggggatgttgttgttcctcataatctcagtgctttctcacc

SEQ ID NO: 89432 - DNA, 679 bp, Heterodera glycines
  misc_feature (671)..(671): n is a, c, g, or t
  SCN-specific regions: Sequence locations=1-94,116-645,669-679
tggaccccgacattttctctgtgcctcctaaattccctttgtccattgagcaaacaattgcccatcctttgcgtgtttctgctgctcatttgcaacccacaaaggacaaaatgatgacacgaagggcattccgtatgttccgagtgtgccacgatgctttacagggaccaattgtcgcccaatgatgtgaagccactacttcaaagctttgcgcttgaccatttccccgaaattcacatttcgaggcccgtaaaactcggccctggacaaaactctgccatttttctaactcttacaaataattcgtctggccctattgacatttcactgacggggaaaaggctcgaagaggaagaaaactgcgtaaataattctgatttctccctgcaaattgtcctctctaatcgcgactcgaccgacgaacagccaaaaatggcccatcagcaaagcgacagccgcatcattaacatcagtcagcacagagtgggcatttgcgcagaatgcgtcccttccgcggactcaattgaccactacgctctgttcagcctctcattcagccacacttcgtctgaccttccagagaagaagttgaaatccgacgtcaaagtttcgttgaaacagtcataattctaccgtttattgtgctattaataatttatataaaatatcgnttgaaaaa

SEQ ID NO: 89433 - DNA, 659 bp, Heterodera glycines
  SCN-specific regions: Sequence locations=1-659
cacgggtacactgccggactgctcactttgccacttcctgcgcttgtctttctttgggggacgttggccagcccgcgcccctccaaattgttttggattgtcatgataatttacaccgaattcgaaatcgtggccaaattcgcttttcaattcggattttggccttggaatggggacacagtcggcaataacaaagtgtacaagacggagtatgtgttcggagttcagcgcattcagggctttgccggcaaggacgtcgccctgctcatcgcactctttttccaccgttatatgttgaggaaatttggactttggagagacgcaagttccgacagattgattaacgaaatgcccaaaaaacggatggacaatgggtcatcttcatcatcatctgctgaaaaaagtccacagaaatcgactcaatcgacggttgttccatcgtcgagtggagaaaactttgaatcggtggccaaggcacaacgggaacagaactccgacgacatcgaaaagggcataaagcgacaaaggccgtcttatccgcgggttcgtctcctcacagccattggacgtgatcatcaacgaaattccgaaccccgactatttgctcaaaatttgtttggacatttatttggtgcgcgaggcgggcgactttttgctgg

SEQ ID NO: 89434 - DNA, 631 bp, Heterodera glycines
  SCN-specific regions: Sequence locations=1-631
cccactttgggtacaagccaagtgaaaagcgtgcgaaaagaactgaaaatgcacctcctaagaatgctcaaacatcccggcactttcactttgcacaacctccacccgaggatgaagcaattgctcatcgaattgggcgcttctcagtccgaaattcaacgagcgatgcccgccatcaacgaaattgatgaggcactgaaaaagcgtttggccgctgcgacggcggtggccgctggcacggcacggcaaacgacgacggaaccgaaacggcacaggaaagagccgcaacagcacgaacaggaggatttggacttgagggacatcaagcggattaagttggatgaggacgaatacgacgatggcatcatcgacctttacaaacagttggacaaccccgactccgccaacgctgccactcagaaggcaattgacatcaccaccaattttgtattggaacggctctctattcacgtggtcactaagttggtgatgatcagtctctacactttgcccgataaaatgcctgcggcttttgcctcgagttacactccaatcgacgaagcgggcagtgaggctcaaaaacgtcatttatcacgcatgatggcaatacaaatgactcgagaaggcgaag

SEQ ID NO: 89435 - DNA, 883 bp, Heterodera glycines
  misc_feature (851)..(851): n is a, c, g, or t
  SCN-specific regions: Sequence locations=1-883
gggcttggctgttttcatcaatgatgaaaagttcatgactaaacttggccttacgactggcttcaagggaaagacattcatcgtccaaggattcggtaacgtcggcttgcactcccaccgttatttgcacagagatggtgcaatttgcatcggagtacaggaatatgactgcgcaatttacaatccgaatggaatccatcccaaagagcttgaggattggaaaatcgcaaatggttcaattcgcggctttcctggagccaaggctttcgagccattcaccgacttgattttcgagaagtgcgacatccttgtcccggccgcttgcgagaaagctattcacttggggaatgcacatcgtattcaagcaaaggtcattgctgaggcggccaacggaccgacaactccggctgctgatgcagttttgatgaacagaggcgactgtcttattgtgcccgacatgtttatcaacagcggaggtgttactgtgtcgtacttcgagtggcttaagaatctcaaccatgtctcttttgggcgtctgacttttaaatatgagcgtgactccaactaccatcttttggcgtcggtgcagaagtcactcgagcgcaccttcgaccgtgccgttccggtggatcccagcgaggagttccaattgcgcattgccggtgccagcgagaaggacattgtccattctggccttgagtacacgatgaaccgttcggccaagcaaatcattgccaccacgaacaaatacaacttgggcttagacttgcgtactgctgcctatgccaacgccatcgaaaagatttaccaaacctatgagacgtctggctttaccttcgcttaatcgattnttcgacgcattcgtaatgtagttaattctcgg

SEQ ID NO: 89436 - DNA, 663 bp, Heterodera glycines
  SCN-specific regions: Sequence locations=1-25,53-104,127-364,386 -477,508-663
ggagtgtttcttcgctttcgtgtcttcaaatattttttgttaaaaatgatgaacattcggtccaacggcaaaattcggtttgctgtcagttgctcgtcaaacatgaaccgcagcatggaggcacactttttcttgcaaaaacgtggcttcaacgtgcaaagctttggctccggcaattacgtgaaattgcccggcccaagtgtggacaagccgaacatttacgagttcgactccaccacatatgagcacattttgcaggacctgaagcagaaagacagcaaactctatacccaaaacggtctgctgaacatgttggacaggaatcgacggataaaaaaatgtccacaaaaattccaaaattacaaggagaaattttgtgtcatcatttgtctggaggaacgggtgtatgaccagattgtcgactttttgcagacgcgcgagtcgaccaccggcgaaagtgtgcacgtgatcaacttcgacatccaggacaaccacgaggaggccaccatcggcgcgctgcacgtggtggaactgtgcaaaaagttggaagactgcgaagatttggacaacgaaattgacgaggcgctgtccgagttcgaggcgaataatccggagcgcaatttgctgcacacaatttgcttctattgaccccccaccccccaa

SEQ ID NO: 89437 - DNA, 1011 bp, Heterodera glycines
  SCN-specific regions: Sequence locations=1-358,380-682,705-1011
tagagcacatttgcacaaaaacgggtgccacacaaattatttggtcaataaattgggaccagtctcacatgcgacgctgtttgatcaatgttcagtcgatgatggtcgaccaggaggccaaggagggcgttattcacgcattgaatgggcggaaactgattttcggaaggggttcccacatttgttgcgacgggtccctccagtttggcgccgatgacgccgcgggcgcttggcaaaaagtttgcattgagtcgggcgttcgtcgtttcgatgtgcgtaatttggaaacattgacggagagagtgcgcgaattgcttgggggagttcaattggttcgaagaccccacgaaaatgtgctcaataccattcagcaaattcaaattttcatcggaaaaatttgttcgcagcccaaaaacgaaagagaaatgctaagggcacttttgtcgccggaaatcttcgtggaaattgtgaattgttaccaggaactgatggtggtcgaaggctgtcttcagattccctgctgcgtggagtttccaccgctcagaaaatttgtggctgccaatgcgattcgttctcggcaacttcggcaggaaaatttggaacggaagtggcatttggagttggcccgtgatgcatgtgtctcaaaattggcactgtccgaattgtcttgggacgcgagcctttccttcaaaactgtgagggtttgcatggaaaaactacgacggattggcccggaaaagtctgcccaatttgctcgtcttagcattcacctttcgaacagtccgaaattatttgtgatgttcaacggtcgcctctcagtgcctatcgattgggtcaaagaactttaaatgcaactgataattagttaattagccaataatacacttctaaattttccactcttttccattcgcctttatttgactcaatttgcaaaaatattacgcaaactgtgaaattaaaacaaattaccaaaattaatgcatttcaatggccatgccggtgattctc

SEQ ID NO: 89438 - DNA, 632 bp, Heterodera glycines
  SCN-specific regions: Sequence locations=1-632
aaataaggcatataattcccctcccttttaattagtcttattattcatccgtttgtgatttatttcttggttatgtcggtccatagtgaattggctcggtccaaaattttgacctgcagaaatcgtttggcggtgcgtcggttggctctgctcgaacaatacttcgagctgaacaaatccgttcaatgtcttcttgacgattatcggctcaacataatgaaagcaaaaagcacttcccccggcttcgtcgttgggtcagtgaccgcccttttgtcctctcagagggaactgagcccgacaatttgggttgaaactgcgaaaagcgattgcggttctttcctcgcattgaattggccttcaaaatatgcgggggaaaaaggaaatgatttgcgaaggaggggaggagaaacattcgatggaaaaggggcggaagaagcggaagggaacggagggcactcaacggatttccacccctttggcgttttggagagtcaaagcgtaaaagcggcgaggaaaaacattcaaaaactgcttctgattctttgcgacttggcgaacattcaaagacaaatcctttcgctggggaaagaggcggacgaaacgaaattggccgagttttagcgagcttttat

SEQ ID NO: 89439 - DNA, 624 bp, Heterodera glycines
  SCN-specific regions: Sequence locations=1-624
ggaaaatgccaaatttgctccaagttctgttcggaccggttgtttaccgcccatatcaacccaacctattggaatcgggcggtaacaagctgttcagcatcggtgctggtgcctacaacacttgtgttgtgctgtcgcccattctcgtgccgtacattgccttttcttggacccactcccatcacttttcttttttgcgcttcgttttggtgttttatgccattgccttttccttccgtacgattggtcggctgacaaatgttgactacgtccgttttatcaaattgctcggaaccgtgcgcaaatctccgcagaatgtcactttgctcgacacactcaaagactacgattttcaagtgtacgctgcgcccgctgattttaaagcatcgccaggccgaacggccaaatggcaccctccgcgtgaacgccttccggacttgaatcctccgcttaattttctgcgtcaggctatcgcgtggacggccgctaacacttttggacgtcgaatgcttttccctggttcgatggcacttttcaattcaatgttgaacagccaactggtcgatggacggcgcaaattgttgacagaaatgggtgggaaacggaaagtcattgagacggagg

SEQ ID NO: 89440 - DNA, 635 bp, Heterodera glycines
  SCN-specific regions: Sequence locations=1-25,67-67,89-543,565-635
caattaagcaaaacattcactttccatcctcccaaatttcccaaaaatttctcaaattctaaatttgaccctttctttctttttctttgaatcggccgaatgtcgtcgcttgagcaattggcttcacctcacaacgatttttacgagagtctcttcagacagctgaatccctccggaagtgccgaagtcgatgccgcgtctatcgctgcttttttgaaaacggcacacggcgttagcgtcgcacaactctctcagatttgggaaattgcgagcgaattgagcggatacaaaaatcgaagcgcactgaacaaaattggcgtgtatatatgtttaaagttggtcgcgggcattcagcatggtaattaggcctaattaggataggggcgtggggcgaagagaggttccaaatttgtctttcattccccgtgtgtccaattgcttttccccactctgatcggtactgtctttctttcaccgtgaaggcttccctctcgcgccctccgatctcgacgtgccgttgtccgccgtgccccaatttgagtgtctgtccttccccacgccgcctcctctgccccccgtgccgcctccgccctccgcggactcaaaaagtccgtcagtctctgccgaattgggca

SEQ ID NO: 89441 - DNA, 701 bp, Heterodera glycines
  SCN-specific regions: Sequence locations=1-653,675-701
ccaagtttgagcattaagattttttgattcaatgttggtcttacgcccacccgatggcgaacagtcagtgcgtcaacttatgttgctcaacatctcctgtcttccaatcaattatgggaccaatccgcgctcgactcattacaaaagggtgacacgaaatcgactagcggaaaaaggccctgacaatggggacgaatgcgacacgagcttttggaccatgatggcctatcgtcaccatttcaatgatcaaaatggcactgattgtgaggaagacgcccccatgcttgtgggtgccatcaccgtgtccaaccgaaacagcaactgttcctgttgcagttccaataaaaccgatggggtcgtccagccacaaaaacaaatgttttctgtccaaattcagacattggctgttttgcccacttttcgtcgtcatggcgttgccactcgtctgttgaattcgctgataaaccaatgtgaaaaatgggctaacgtcgaaaatatctttttgcactgtcagacgacaaatgaagcggcactttgtctatatcgggcccatggttttgaggtcgttcagcaaattcatggccattatcagtgcagggcaattgacggcgaatcggcggatgcttttctactcgagcgacggtttaccaatgaaaatgatgaggagagaaaagttcgacaaaatgcggcatttcactaga

SEQ ID NO: 89442 - DNA, 622 bp, Heterodera glycines
  SCN-specific regions: Sequence locations=1-11,33-622
aataaagcgcgtttaaatggctgaaactttttctcttttatctccgactcatctgctgaatgaaacaagcctgaaccttagatgcccatattgcccaaagaaattcctaaagaatactgaagccatttctcacatggatccgtgtctgaagagtcggccttacccttgtacgaactgttctaggcggtttaaatctgcgcaaaatttgagccaacatgagaggattcacacaaatgttcgaccttataattgccagtattgtgagaagaattttactcagaagtcacatttacaacagcacgaacgcatacacacagcaattgtaaaacgtctcataaattattgtcctgcttcgactacgttttgggtgaaccggccttctcatgccgttactgtggcgagacgttcaatatttattcatccaaaatacagcacgaaaaaagtatttgtggccttcacgaggccttggacaaacagaaagaaaattcgagtgaaaagaacggtttcgcaaagattgcaccacttcctcaaccgagcaaaacgacgccgaccgaacaatcatcgtcacggggaccagcagtaagaccgactgtgagaacagcacacaacggcactattcacg

SEQ ID NO: 89443 - DNA, 577 bp, Heterodera glycines
  SCN-specific regions: Sequence locations=1-2,24-474,529-577
atttttaaaagacgcacaaaatgaacgccaatctgttgagttcgaccgcccttttgctgctcttttccgtcccgttcatttgcgcctccataattccacaacagcacaccggcattcagtcatatcgggtgaaggggcgtttgctgtgcggcgatttggcggcggaaaatgtccgagtgaaattgattgacgacgacttcggcccggacccggacgacgacttggacacggggtacaccgacacgcagggcaatttcgacctgtccggcgacaccaccgaactgacaacgattgacccgcacctgaaaatctaccacgactgcaacgacgcgctcattccgtgccagcgtcgttggaaatttgagctgcccaaccattacatcacgagcggaaagcagccgaacaaagcgttggacatcggcacgtggaatttggaggcaaaaatgccgggcgaaagccacgattgtattcactgagagagtggggagaaagagagggaggagagaaagaaagagagggaagagagagtgccggaaaagcatcgaataacggacaaagaagcatatgcaaataaaat

SEQ ID NO: 89444 - DNA, 663 bp, Heterodera glycines
  SCN-specific regions: Sequence locations=1-11,33-63,87-663
gtttgagacaggcaaacacaaagtaaataaatgacggccacaaccattgcccaggatccgactccctcccctcggcgtgtttttctccgtgacctttgttccctcttttgttgcccgccgctcccttcggctattgttgccaaattggcttttatgccaccggaaccgagttaccgaattttgaccaacgactcgggacggacgacgttggagctgatcgacggcaggacagagtggccacatgggcatgatgagctgaacaatgtcgaggtgttcttcacccgtactcaacgtcgcaataaaatcgcctgtatgttcgtccgacccttcgaactttcgcatttcacccttttgttttctcacggaaatgcggtggatattggccaaatgtgtaacttttaccttgggctcggctgtcgactgcggtgcaatgtgttcagctacgattactcgggttatggtcagtctacaggtcgtccttcggaaaaaaatctctacgcggatatcgctgcggcacttaaatctctcgaaagccgttatcaaattccaccggagcaggtcattttgtacggtcagagcattggaactgtgccttccatcgacttggccagttgtaatccgcgcatcgctggcctcgtcctccattctccacttctttccggc

SEQ ID NO: 89445 - DNA, 1203 bp, Heterodera glycines
  SCN-specific regions: Sequence locations=1-38,60-846,869-1203
gtttgagctctcatccgacacaatcatccttcttttgccaataattccaccactttcctaatggtttccacgtccccatccccaccaattgccatggcccaacatgcgccactttctcatcgccaacatcgcgccccgttggccaaagtgttggcctcggaaaaaagtctctatctatcgatgaacgcgataaaaacaccaaaaaaggcgaaaatgcagaaagttgccccaattcgagcccaaatcggcgaccattccgaatggattccgttgcgcgcctcgaaacattcgcgccaaacggtgaatccgatccgtcgcttcaccgattcgctgtccgttgaaccaaatccgaacaaaactccaatccaactgaaccttggcgaccccactctgaccggttgcttgccgccctcggagtccgtcgtggccgctcttcgggaggcgatcgattcgcatcgcttcgacggctatggcccggcgattggaacgcaaagtgccagagaagcaatcgcagagcatttttcttgctccgaggcgccgatttcggccaatgacgttgtgttggccagcggatgctcgcatgcgcttgaaatggccattgtggcgatcgccgacccgggccacaatattttggtgccccgtcccggcttcccactttactccacgctatgccagcccaatggcatcaagacaagacagtaccggctcaagatggaggaggacgggctgatcgacctgcaacaccttgaaagtctgatcgatgaccgcacccgtgccatcgtcgtcaacaatccgtccaatccgaccggcatcgttttccctcgcgaacatttggaacagattctgaagctggcccaaaaatacaaactgccgatcattgccgacgaaatttacggcgatttgacctacgcggaaggggccaaattccacccattggccacgctgtccccgcgagtacctatcattacctgcgacggcattggcaagcgctatttggtgcccggctggcgactcggctggctcatcatgcacaatcgcttcggcgtgctttccgacgtcaaagccggcattgtgtcactgagtcagaagattgtcgggccatgtgcactgatccaaggggcgttgccacgaatactgcgcgacacgccgcagtcgttcttcgacaacaccaaagcattgctagcaaaaaattctgaaattgtc

SEQ ID NO: 89446 - DNA, 641 bp, Heterodera glycines
  SCN-specific regions: Sequence locations=1-641
tagacgggaaagttgaaagagacgcggatgggaaggaagttcgataccccgttattctaagtgctaaagagaagacaattgcgcgaagagttgtgttggcatttgggcaaagtgtctgcggattcgatttgctaagagccaacggctgttcgtatgtgtgcgatgttaatggattttcgtttgtaaaaacgtcgaccaaatattacgaagataccgctaaaatactcggcaataccattttgaggcgtttagcctcttcgctgagcattccttggcacattcctttccaagatgacgacccgccattagtgtcgacgcccagtggcaaaataatggaacttcgctgtgtgttggctgttattcggcatggagacagaacccccaaacagaaaatgaaagttgcggtgaaggatgagcggttttggaacatgttcaaaaagtatgatggaccgagaaagcgcgaattgaagctaaaaaagccgacgcaactgatggaaattctcgaaattgtgagacatttgcttcaagaaagtctggagaaacggcaaacactgctcacaattagcagcaaaaatatggcgcgttttcttaaagacaaacgcgacgatttggccccagcagaggaaacttcggtgatgaac

SEQ ID NO: 89447 - DNA, 450 bp, Heterodera glycines
  misc_feature (412)..(412): n is a, c, g, or t
  SCN-specific regions: Sequence locations=25-270,349-410
ctttttcttcttttcccttcctttaaccaggccaacaatgccgatgagtccaccgccgcctgttgccacaaatgctacgtcgcgttcagagattgtttccgcgagtgtttggacaatcggtcggagaatttggtgtgcgtgccgaactgcaaaattgccttgggaaattgctcgaccgacaaatgcggattgatctgtccccgacccaaaaatccccaattcagcccaccggaaaagtacgacagattctattgaaatcgccaaaagagcagaaagagagagaaaaaggaaggagagagcgagagagagaggacgaaagaatgagagagaaaagaagagacagacagacaaagggaaaagacattatgccacaaaaaatataatttgaatgataaatgggatatgtggttanaaaaaaaaaaaaaaaaaaaaaaaaaaaaaaaaaaaaaa

SEQ ID NO: 89448 - DNA, 764 bp, Heterodera glycines
  SCN-specific regions: Sequence locations=1-764
gtttgagaaaaatttgtcaaaaaatggcacgaatgcacaaaattccgctggaccctgactcggcaaatgtgccaatgtttgttgctaaatgcgagcaatggttggccaatttgccaacacactttgaacaggtcgaaatgcagcaaaacttcgatcaaaattttaatggctcttctttgtctgagcagttaactgagctaattaaagcattggaaacttctgaatcaccgttggtggtgtttgcgcacaacgatttgctgctctttaacatcctttttgacgaggaaggcactggcgatgtccatttcattgactacgaatatgcgggccaaaactaccaactgttcgacattgcaaatcacttttgcgagtacgcaggtgttgatgagtgtcccgattatggaatgaattcggccagtgaagacgaacgtcggcactttctgcgccgttatttcgtctattttggccaaccaattgaggaagagtgtgaaatggacaaaatgttgtgcaaaattcggcactttgaagcggcagcccatttttctggactctgtgggccatccatcaggcagcaaaatccgcgattcaatttgattacatgcgttacgcgatcacccgccatcgttactgcacccggcttatgacctcatcaggcattgctaaaaataattagccacaaaagcacaacattattgatttttggttttcgttatctgtactttatcaactctcttaataaaaggtgacgatcaacgcgaaaaaaa

SEQ ID NO: 89449 - DNA, 628 bp, Heterodera glycines
  SCN-specific regions: Sequence locations=1-318,340-628
ccgcgcctcaggcttctcctcatgtggcgttcgattatggggcgacaaagcttgctgcagccgcaccgtccagctacggctcggcctccgaggcccagcctgccccagcaggcgacgaaaatggcactaaagaggtgtcgcaacgaaaaaatgcaacacccgcgcaaacggcacagcacaataatgcaccaccacaacaaccggcacggcaaaccactgcagcacaaaatgtgctggagcaacggcgtgcaaaacggcgttgtcccagggaagccgggtttgtgcaagctgatgcagctagcggaggaggcatgcatagcccagcagcagcagcacgcatttcgcacagggttattggtcatactgcaccaagcactgaatatgcgtccggtccacggccagcgggaactgatgcaccacgagtgtatgcagcgcaaccctacgctgcaccgacgcgatcaatttcatctgtcagcaaatcgaggggctcaattggtcccgaatatgagcaaacggcggccgaacaatcgccgccatcagtgaaaccgccgagtacacgcacaaaagcgcagcctgccggatcggcaccgtgcaacacgcagcggtgcaacggaagaggcggaccagg

SEQ ID NO: 89450 - DNA, 675 bp, Heterodera glycines
  SCN-specific regions: Sequence locations=1-498,523-675
ggataaaatgccaatttaaaaaaaaaatagattatggatgattctcatcaggataatggacgaaagcagcaaaacacttttttgactccaaaattctccattttgctgccgacgtacaacgaagctgaaaaccttcccatttgtctctggctgataatcaaatatttaaaggggctgagttatgaagtgattatcatcgatgacaacagtccagacggaacacaggaagtcgcaaaaagtttgcagaaagaatttggagcgggaagaattaaattgttgacgagggaaggcaaactcggattgggaagtgcctatgtttttgggcttaaacaagcacagggcgaatttgtcattttgatggacgccgatttgtcccaccatccgaggcatattccggagatggtcactcttcaggagaagcatggctatgacattgtcacgggaacgcgttatgcgatgggcggcggagtgtccgggtgggactttagacggaaaatgatcagccgaggagccaactttttggcacaattccttcttcagccgggcgtctccgacttgactggttcgttccgtctctatcgaaagtccgttttgtcaaaactcgtcgtcgaatcagtgtcaaagggatacgtttttcagatggaaatgatgtttcgggcaaaaaagggcggcttt

SEQ ID NO: 89451 - DNA, 866 bp, Heterodera glycines
  SCN-specific regions: Sequence locations=1-404,427-617,639-866
atttcaattttgccttcgctttaaaaataaaaacaaaaaaaaaccttttctcttttggctttacattaaatttctccgcgtttttggcccctgatcatttctggggcatttctcaaccgcttcatcgagcgtttcttccacccctctgctcattatcacacaaagggcagcggaccaagttgaaaatccattgcttaaataatcgtgacttttttttgacgaattgggatgagattttcttgctttctttgtgtgtcctggttgatactttgctcggaaatttaacggcctttaaattttgaacaaatttactcaggccatcagatttgaaaattctttttgaaagagacagtgccttaccaaacattaaaaaaagaaaccaaaaagtttctatttcataacccatttcatttttattttcattttagctccgtcgcatcgccgccccgggtgagcatttgcgcatttgtgtcgactcgggcggctgttccggtttcgagtacaaattgacgctcgacaagcgattggacgaggcggaggacgaagtgattaaagcgtcggagggagccatcgttgttgtggacaagttatcgcttcaatttttgcggggctcaaagcttgattttgctgaggatttgatgcggtccgcgttcagaataacggacaatcccctggccactttgggctgctcatgtggtgcaagttttgcaccgaaaaatcaaatcgaataagcaaaggacggaaacggggcttcgtttttatggtcattgcttttttacttttattattattttatttgtttcaatgtttttgtgtgcatttcactgccggtgtatttgtagggaataaaattcggatttaaaaaa

SEQ ID NO: 89452 - DNA, 653 bp, Heterodera glycines
  SCN-specific regions: Sequence locations=1-80,119-179,203-313,347 -454,476-653
gcacggcggtggcaaaaagtgccgcggaaatggtgttggcggatgacaatttctcaacaattgtggcggtggaggaaggccgtgccatttacaacaacatgaaacaattcattcgctatctcatctcgtcaaacattggtgaagtcgtctccattttccttgtcgctgcgcttggcattcccgaagctctgatccccgtccaattgctttgggtcaatttggtcaccgatggtcttcccgccactgcgctcggcttcaatccgcccgacttggacattatggaccgactgccgcgttccgcctccgaatcgctcatttccaaatggcttttcttcagatacatggcaatcggaacttacgtcggcgtcgccactgttgccgcttcgatgtggtggtttttgatttacgaggacggcccgcaagtgtcttattaccagctgacccattggatgcgctgtgaaattgagccggagaactttgaggatttggactgtgccgtttttgttgacaaccatccaaacgcaatggcattgtcagtgctcgtcacaatcgaaatgctgaatgcgatcaacagtttgtccgagaatcagtccattctgaagatgcccccgtggacaaacatttggctttgcgcgggcatcgctctgttcatg

SEQ ID NO: 89453 - DNA, 608 bp, Heterodera glycines
  SCN-specific regions: Sequence locations=1-470,493-608
caattagtcctctcaacgtgtttcgtcatttatccttgttcccccaaaatgcggcttcgtcttcggctttccccgtggtcctttcgcggtgccgtccccggagtcgtttgggtcggtgccgacgaggttttctccgtgtccgatgaccacagtctctgccgctggaccgtctccaaaacggaggccaattttctgtctaatgcgttgaaagactccattttccccacttctctcagtgccgcgtttcccttcgccgccgggcgttctccattttccggaggactgtcaattcgctcgggcaaaaagcaacagcgtacttccgccattcactcgtctcagtcagcagggaatgagctcattctgatgactgcctctgatggcaaaatccatctgatcactccggcggggaaaattgaacgaacaatcgaagcccaccaaggggcggccattttggcccggtggagcacttccgagcccggaggggcgggcggatttgtgagctgcggagaggacggactgttgaagatgtggtcgcgaaacggaatgttacggtcgatgttggcacaacttgggaagccaatttatgcgatggattggaatgggaacgg

SEQ ID NO: 89454 - DNA, 961 bp, Heterodera glycines
  SCN-specific regions: Sequence locations=1-355,377-790,812-889,912-961
ttgagttcctattttggtacatttactgatcaaaaggcaatgtctgaggaaaaatttgaagatgttgatggctctattattgcacagaagcgacaaaatactgaaaacggcggcccggcctcgaagaaggcgaatgtgattgagtccgacaacctccaaatcaaagttttgatcccttcggcggcggtcggcgcactgatcggaaaaggcggcgaaacgatgcgaaatttaaagaacgactcgggctgccgtgtgcaaatgtcaaagaacttggaagtgtaccatgggacatcggagcgcatttgtttggtcaaggggaaacttgctgcgacaatgattgtaatgggcgcaattttggaaaaaatccaggaaaaaattgacgccaaccacgcttctgaccatttcgacctgaagggattggaccggaccaaagagatgaaatttgttgtgccaaacacttccgccggaatggtcataggaaagaacggcacgagcatcaaagagattcgggacacaacaacggcaaacatccaaatctaccccaaggcgggctctgaggaggccaaaatttcggccgagagagtgattacggttggccacgaatcgaacgaagttttactgagcgcagtgcaacgcgttctggaaaaagtggtggctgatccgatgcatgcgcagccagtcccagcggagagtcagttggcttcgggctttgaattcggcggatcgcggctcagtgccgggagcaatcagtttgggggaatttcaaacatgggcaacaattcggaagcaatgcatgggaaatcatttggagggccttccttcaaattcaatcccctccaggggacgggaaacaacgagctgttggcttttctcgacaatttgcagtccactttgcgctcttccggattcaacgaccaatcggtgtcagaggtgatgcaggcgatgcaagtgctggccaaat

SEQ ID NO: 89455 - DNA, 601 bp, Heterodera glycines
  SCN-specific regions: Sequence locations=1-42,64-80,102-601
agagaacaatatatttttacacaaaaatgttttcattcggtaaccaaaatggcatatgtttaaaccgatttaaaactcggtttaactgaattcttccaaaagccgaaataagtcaactgagatttcggttaaggtattttttgataccattatcgttaagattgaccgtcatttgacaaagttacggaataaaatggggatgtcaatttctagattaaaaaggtaaaaaatcggtcggggtcgttttcgcgtggccattttcgcgcggttgcatataagcgaattttttactttttttatagtttggaaaattttttcactcccgttttacttcgggtgcttaattcaatatatatttaagtgaattttataaactaaattaagctgacaaattattatacagtctaataattttttcacggtctaatgctctgctggtattagtgtaaactcaccatcccaaattcccatcctccgttcttcaagtctatccgagtatatataaagccgaccaaatccctttccagtcatattcttcatcccattaattccatccacatttttttgataattttttttcagttcacttcttcaattttct

SEQ ID NO: 89456 - DNA, 683 bp, Heterodera glycines
  SCN-specific regions: Sequence locations=1-319,341-683
aggttttggtgtctgtgacccttcgccaactttgtacgatgtcacggtcacattatgacaagattatgttcccgccaatttctgcccatggaatgcttacattggacaggagtaagttcaccaagtctatccaaattcccttcgtctccgtccctgtcaaatgcatcgacagagtccgtttgctctccgccgttcgtgcggtttgtcttgagagaatgccccgcctaaaaccatggcatacaccgccaaattgcgacggatcagtcgaaaggcttttgctgtttgaccccgacaaattcggagaagaagcgacgaacgacttggctcagcaactttcccaaacgatggattcgtcgccagaattcggcaaaatggcatatacgatggaatacgaagattgggacttgagacggtgcattcagtcggttctgccggatggcttcgaattcagcggattcgaacagtgcggacacatcatccacttgaacctcagagaacacgtgctgccgtttcgctttacaattggccacattctcttggataagattccatctgccagaacggtgcttaacaaagtcgacacacttacgcacgaattccgagtgatggacgccgaattggtcgcccgggaagcggagtttatgaccgaagtggtggagcacggactgcgttaccgattggat

SEQ ID NO: 89457 - DNA, 629 bp, Heterodera glycines
  SCN-specific regions: Sequence locations=1-184,207-629
aaggcgtcaaatcctctgaactcgcggcatatttatttgaccaattgcgaaacttatcaaagttggaaacgccgatcactgatcagacagtggacgtaattgtcaaaacactcaagcttgttggccgttttctcgagaatgatcgtgggcctcaagcaatggctgagtttcttgctttgtttgaccggtccattcaggaaacgacgactgaccaattgagcgagccggcgagggaaaaagtgcgatgtttgttcaatttgcgcgagaacaaatggggcgttgtcgcggaaccaaatgtcggcgatggtccgctgaccactgcttcgacttcggtgggtatcattggcccggacgatgttccgttaacggaggacgaatgcgcctttatggaagaaaacttggacaattttgtcgacaattctcccggcgaatctcaatgcttgaatgcatttgacgaggacaacgttgaggacgacttcgagaagttcctacaggcaacggccattcgtgctgctgagaaggcgttggaaaaggtgtccattgacgaggatgacgacgcctcttccattgtgtcatcgcacaaattctcgacaagcaaatgacgaaaagtggagaaagacatcggaaca

SEQ ID NO: 89458 - DNA, 668 bp, Heterodera glycines
  SCN-specific regions: Sequence locations=1-1,23-86,108-164,186 -567,589-668
cttgggcaagcaaatgttgaattgttttctggacaatgactcaccatttaaattttgatcaatttctccaagttcatgagccccaattgttggcttctggtttgcctgaactgttctggaaatccttatacaaaaagatatccaatcagattttcgatgcaggaaaatattttgaggttatcatcgaagaaagcgaaccgaatgaaacaatttcatcgcaagtcaaagctatgagcgaattgaaaatggacgacccggaaaatgtttttctcattgaccatgcgtggactttccgtccgaatacagcacgttttgcacttcaacaagttgacggactgaggaagagattattggacatgttcaatatcaaagcttggtatgccaacaaagaatgtttaaaggacccttttgctgatgatagcgcagaccaacagcaaaagtgtgctgatgccgtagccactcattccgctgattgtgaggactcggaagtcgcatcgccatgcggccaaaatgtcgaagaaatatgggaaaagcattgcgaaatggacgacctaataattgacgaaatgtggaaatatgcaatgacatattcaattcgaatgctcaatttggaaatggacgaacaccaaattcctgtttggtatgtcatggacgaattcggtgttcga

SEQ ID NO: 89459 - DNA, 643 bp, Heterodera glycines
  SCN-specific regions: Sequence locations=1-510,533-583,605-614,636-643
caactgaatgcacttgtttccaaattgtcactaacgccgaataagatgaacgaaagggcagaatttactcagcaacttaaaacattcgttcaaccttatttcgtttctcctctccaaattcgagtgttcggctcgtcttccactggccttggctttgtcaattcggacttggatcttaatttggtatttgatgaggatttaattaattgcggcgattttgccagaattccctccgtttcatcacccgaaaatggcccgacattggatgacatcgaccaacaactgactcctgaaaagctcaaacgaagcccgattgacagagatactttcaaccgacttcccaaaatagatcgtgttcgtctgcttaatcgtcttattaacgagtttcgcaaggagaaagggtcggtcactgcgcatgttcccattcccgacgcgcgtactcccgtcgttcgttttttgactcgcctctcatcggcacgcgtttcttgtgaactctctgtgcagaatttgttaggagaatgcaaagccaatctgattcgtgatttggtccgagctgaaaccactggtaccctttggcgtctcattttctttttcaaactttgggccctctgcaacggacttttctcgcctgaccctcaattgg

SEQ ID NO: 89460 - DNA, 804 bp, Heterodera glycines
  SCN-specific regions: Sequence locations=1-97,121-804
atttactatcaccatgaatcctgctgatggataaagaaaataaaaagccaaaaggtacaaaaagatccaaaaatcccgaagaaacttcgaaacaaagagaggaaaaccaaaacaaggaaaatgacgatgaatttattcatcccccaaggagacgttcagcgaggttaattgcaatttcaaaacctgctttatcgagtgatttatcggcttcggctgaagattttgttcatggaaaagggacgaaaaccgcaaaatcggaggtgtttggaacggatgctcttttcggtgtctcttcggcttctttcacttcgcctttcaattcttatttgacttcatcagttgaacccatcaaattgtcttcagatgaagcgactgtttcttctaatcggtcccttacaaagagacttaacgcaacaaatattcaaaatgcccaatcgctcggtgaaggaacttcgaaggcgactttacctctttcttcggatgacgatggcgaggaggacgaatggggggcaatggaattattacacacggacaaaacggagaaaaaagtaattgaggtcgaacttgatgaaaaacactcagatttgttcaaactgcagataaatccgttgaaagagagagacgcaaaagaagcggaggaaagggcaaaatgggagcacgaaattgagctggaaatcatgcggaagcgccgtgaatttcaggaaggtcttcatcgctttcatttcctcactttcgttgcccatcttcgctttatggcccattcccttctccgcaattcttccactcttttgacgccattcactg

SEQ ID NO: 89461 - DNA, 665 bp, Heterodera glycines
  SCN-specific regions: Sequence locations=1-30,78-482,507-665
gagcaattcattttcgattgatgacaaatcttaataaaaaaattttagaatttaagtttaaaataattgtataaaaaccgtttttcatttctgtttctccgcttcctttgtctccaaattccaataatttgatattataaatttgaaagaataaaaataaatgacttacaaggagaagcccgtgatcaatgccgagacgaccgaaaaccttgaacaggaacgggggcacatcacccgtatcctgtcaaggtatggaggtcgagctggacgcgtgggctgccatcatgaacggactgcaaggcccagcgagagaggcggaggaagcgcttttcactgcctttattcgagatgaccggcacttgacggaatggttggaagatgcgcgagaaatgctggctcacatagcagcagaactcgcagatgagcccaaccagccaatcgcggcgggaggacagcaaccagctgttgctgtgaatccacccgtgccagccgtgccattcgtcaacaatgccgcatttctcggcggtgccaatgttcaacagccagctgctgttgccaaccatgccaatcagccaccattggtgccaaataatgcccaaatcgtgccaaacccgcgttttggcagagtttcgagagtgccgtcgaccgtgccgcccttgagcccg

SEQ ID NO: 89462 - DNA, 648 bp, Heterodera glycines
  SCN-specific regions: Sequence locations=1-228,250-648
ctctgatcaactcatctgcctctctagccctttgatcagcccatttatccctcttccatgccaatttcggctctgatcagctcatttttaggcctttgatcagcccatttagccccattcggagtcaatttggccctgatcggttattggcattaccctatttcctttgcaatttcacccttggatcaatacgattcgtcactttcgtgctaattccaggtctgattacttcatttgctttcttcatttccgttccaatttcaccctttgatcagtccaatcaaccttccatgccgatttcggctctgattaaatcattttgttagccctttgatcagcccattccgatttcggttcagaacagctctttttcatcccctttcccaacccatttcgcccttttcgcgccaatttttcgggaccgatttcattaacttccgcttcccgcatcttaggaaatggcaatcgtgtatactgaattcactcgggaaggtatagatacgtggttgttttatgctaaattttgaaattcaagaaattgacgaagctattgaggaagcagttttgaaagtgaaaggaggaactgagagagatggcatgcgcgccgccttggaaacgattgtgagcagcccccatctgctgttgaac

SEQ ID NO: 89463 - DNA, 650 bp, Heterodera glycines
  SCN-specific regions: Sequence locations=1-513,535-549,626-650
agaatgcccaccggcagcagagtgccgttaattgtggaaagacgaagtgatgagacggaggaggacacgtggacagtttatccgacggcgggcatttgcatcaaattcaaagaggcccatttctccgccgcttcgtccgtctccggcccctccacctccaaattcttcatcaatttggcccattgcactgagctgccgccgccccatcggcacgccgaattggacgaggacaaagtggcacaaatggtggaagaggacccggatgcttttcgcattccaatttgtgtgggcgaattggaccgatcggcggaggaccgcagcggcgaagcggtggcaaaagtcgatgtgctggtcaattcggagttcttccacaaacgcatcagtcaatccgagtttttccgtcagctgacacttcgaatcgtttgccaggcaattgagattaaacattcgcttcgtgtggacattggcaagcaggtcattttgcgcaacaaaaaatgcattggcgaactgtgcgcccaaagaattcggaagagaccgatgacgacgaaagaagcaaacggagaagggaaagtgaaagaaacaacagacacaaaagaggaggaggacgaagaggaaaggacagaagtcgatcaaatgttggacattgagga

SEQ ID NO: 89464 - DNA, 644 bp, Heterodera glycines
  SCN-specific regions: Sequence locations=1-644
catcgagtcttcgtctaggaagtcaacgaagtcatgccgtaaatgcagtccatccaaaacgagaaaagccgaactatgagagaccaaaaagccaacaaagcacaaagacggagcaacaaaaatgctggaggtgcggtcaaacgaaccatcaccacgcagcttgcccgcagaaaggctacaaatgccgaaagtgctcacaaaacggacacatcgagttgcgttgtgaagcagtgcaggaatggcgcaaaaagaacgccaaaagttggctcaagaaaaatgttggcaatgtccacatagtgacagtcaacattggcaccacagcaaaaccgacaacaaagtcaacattgctaagggtcaaggtctcctttcaaggcaaagtcatcgaatttgtcctcgacagcggtgcagaagttaatgtcataaacgaaatgacatacaaattgatcggtagccctaaaatcaaagcctgtaaagaacaagcagtgctttacgatggaagcacaagaagcttcatcggaaaagggaccggcacattcgaattcaacggagtgaatgttgaacaagaattttatgtggccggcaaagattccctaaatttgctgtctattcaaacaatggacgcatttgggctgctcgacgaattg

SEQ ID NO: 89465 - DNA, 629 bp, Heterodera glycines
  SCN-specific regions: Sequence locations=1-16,38-60,82-316,338 -475,497-629
tttttcaaaatcggccaaaaaaaaatttttaaaaattgggccttgtaaatttttttttttgtaaagaaaagaattgctggcgaaaatttagcggtcaaggcacctccaaaaagttcagaaaagacctttattttgttgatagagagattcattcgatatgtatattcctgatcttgacagttttgaaaaaaccctggcatcgagactcccgatacatcactgattggctcaaaaatcataatcacatctgactaagaaaatccccaatcttcgttttgtaccaaaattagtaagcaaaaaatgaccaaacccattcaaaaaaaaaaattttttttttggctctattccagttttatgctccaatcaatgccattctcagtttcttaggcatggccatcagtttttttatttgttcagtgcctacattcttggtatcaagccagcaaaacttggtattaagaaaaaaatattagaaacatgaaataagaataattttgtctattgccgttagcccaaaattaaattacaaaaaaacttctatagaattcaatctttcatttgatatcaaaatataggcattgattggccaaataagaaaaaagtatggcctaagaaactgaagatagtca

SEQ ID NO: 89466 - DNA, 990 bp, Heterodera glycines
  SCN-specific regions: Sequence locations=1-39,63-325,347-814,837 -919,941-990
tgagatttcgttaatttatttctgtcactttccgtttcttattctctcgaattgaaaatggttctgttgggtgccattgaccaggggacttccagcagtcgttttctcgtcttcgattccgaaaatggcaatttggtcgccggccaccaattggaagtgcagcagcaattcccgaatcccggctttgtggagatgtgtcccgagcaaatatttaagacgacagtccgatgcatcaaaagcacttgcgaggaactgaacagacgcggcattgacccgaagaaagaaatcaaagccatcggcataaccaatcaaagggaaacaacaatcgtttgggaccgagagacggggtgccatctgagtaatgccatcgtttggttggactgccgaacgcatgagctttgtgacgaatacattcagaggacgtcgacacgggacaaaaaccatttcaaagcgaagaccggcctgccaattcacccgtacttttgtgccctcaaacttcgttggcttctcaacaatgtgccagaagtaaagaaatcgctacaaaatgggactttgatgttcggtacggtcgactcgtggcttatgtggaaattaattgggatccatgccaccgacgtgaccaacgcgagtcgcactttgttgatggatttgcagaaccgcaaatggtctacagaaatgtgcaccttttttgacattccaatggaaattctgccggaaattcgaagttccgcagagatttacgggcaccttcagaaaggacctttggaaggcattcctttggccggctgtctcggagatcagcaaagtgctctgcttggtcacggctgtttgcaggcgggcgaagcgaaaaacacttacggcaccggcacttttatgctttgcaacacaggacaaagggcgtacatctccaagaacggacttttgaccacaatctcttaccaattcggccaagcgtcgcccgtttgctacgccctcgaagggtcggggtcc

SEQ ID NO: 89467 - DNA, 1114 bp, Heterodera glycines
  SCN-specific regions: Sequence locations=1-315,337-601,623-737,794 -966,1015-1114
ctaatttgtcatattgtacttttccgtaactgagcttctttaatgaccgccgcagcggattcccaagcttttctgagagacttaactaatttctgcttgacattgtcaacttcactggtgttttcgggttcagtgttgggattcagaatttgctcaatgcaaaatattgggtctcgcccaaagaccaaaaagaaaggtgtctcctttgtggaagagtgaattgatgtgttatagcagaagttggcacattcaagaaattcatcaaaatctggttcttcacttgaaatatatttcgcaagtatattgtgaaatgtcctaaaagatcgctcaactactgcattgccttggctccaatggggaatagcataacatttattaatatagagaagcgaacagaaggacttaaaaaaatcagaggtgaatgccgtggcattatcagttaaaagactcgtacagcctccaaactttaaataacagtgtttaaaggttttgctggttatccattgccttttaagcgccccctcgggatgggaggagccctatcggagagataaaatggggggggggaagggtaaaggccatttccggtcccggccttacacctccggccctccaaaagaccgtccctggtcgttaaaatttaaataatttccaaatttgaatgaagtcctcagactttttctttcttttgatttgttttacgatgagaaatttgttttgattttaagccaaaactgaaaataaaataatttaaatatttatttaattactcaaaataaaaatggaaaatgccgagcctctaatgggaatgaacccattcctccaaccaatccacagaagctctgtcattgagctactaaaagaaatccgccctttttaaattaattttcttgaaattctgattcaattggatttgaattaaattggcattgcttttcaaattatgagacaagagaaaatctgatgaaatttaaaacttttaaaattatataaatttaataattgttttaatttccaatcgactaaaatttggatttttgatataatttggtgtgactgtatgactatacctccccttcatatctgaggatcgtccctgatccaagaacttaaa

SEQ ID NO: 89468 - DNA, 658 bp, Heterodera glycines
  SCN-specific regions: Sequence locations=1-154,176-255,277-531,553 -632,654-658
gttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataacccattcagagactagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaa

SEQ ID NO: 89469 - DNA, 878 bp, Heterodera glycines
  SCN-specific regions: Sequence locations=1-170,193-878
ctagtctcgagtttttttttgctcaccttctctttcttaaaaaaacatcaagaaatcgacaaaaaaattcgttctctgtgtacaaaacgcatacgtctctttatttcaattaatttgcttataagcaaagtttcctaaaatctgataactgaattgtcgttgctccgcatttgacaaaaaagaaaatgactctccagtggaccgtggttgcgttcatcctttacgcagaaatagccacaattattgtgcttcttttgccatgggttcggccgacaatgtggaaaaaagtgtttaacagtcgcgttgtgcacaaactcaaacagttttccaatgtttacgcctacgctttcatttttgtgctcattcttttgttcgttgatgccacccgtgaggtgcgtaagtacagccacgtggacacgactagagagatggtgggacgagtggccgaggcggacgccgtcgttcacatgcgtctcttcagagctcagcgaaacctttatttgagtggtttttctctgcttatggcactgattatcagtcgcatcgtcactttgctcgcccgttgtgcccacctcgaattggctgctgaggcggcgatgaaacaggcggaaggggcgggcaaagcggcgcaaactctgctcggaaaagagggcgatgtgaatagtctgtccggcgaagaagcgaaaaaattgcgaaaccgaagtggaaagaaatgggagcgaagttgaagaaagcggagacggacagagacgcaatgaaagcgcaggcggagaatttgcaggaggaatacgaacgcgtgtcgcaacagttacggaccgcagaggcttcgcacaatggtaacaaaaagagtgattgaagacgaacgatcgcacaaagaa

SEQ ID NO: 89470 - DNA, 551 bp, Heterodera glycines
  SCN-specific regions: Sequence locations=1-551
tgccaatattgtccggcaaaaaagtctcctgggacatggccaccgcctcgtgcaccgacactgatgaccaaccgcagcgcaaaaactccaaaggctcgtatgactacatcgatgcggacgaatgccatgatgtcgtgactcatcattcttcgactccattttactccattcgtaactcgaactcgacccgcccttcctcgtcccatcatgcacaaatgtcgtcatcatcgtcgccccagtcgcgctacgactacctggactttgctggcaaaccggaccaaccgcagcagcatcagttgcgacgacaacagcagcgagcagcgccgcaacaacgcgtcgctgtgccgccaccggcgctgcgacgtgctgctgcgtcagcagatgaaccgctctatgcgactgcgtcttcacaaatttactcgttgggcggcagcgaagacccgtacagttccattgtgagtattggtggtggttacggcagtggttcggccacctatgaccagcacggctattcacggatcatcaactccaacaaaaacggcaccaccggc

SEQ ID NO: 89471 - DNA, 585 bp, Heterodera glycines
  SCN-specific regions: Sequence locations=1-77,100-585
attttctgatggattttgggccgcgcgacgacgagggaaagccgtgcaaggcgtgcttcagcttcgaggacatgctgcggatgatgggcaaaaagaagacagccgatcggcggaacggcgaagcgcaaaacaaaacggcgggggacgaaccgtcgacttcgagcagtccttcggcggataggaggaggacggactgtccgttggacaaagacgaattgggaaggtcgacttggaatttgatgcattcgatgtccgtttattacccaaaagagcccaccgaacagcaaaagacggcgatgggacaaaccatcgacggaatttcaaagacttatccgtgcgaccattgcgccgccgactttcgcgccgatctccgtgcccatccgccccttttgaattctcgcgacgcattcgcccgttggatgtgcgaggcgcacaaccgcgtcaatgtcaagctgggcaaagagcgcttcgactgctcgcgcgtgatggagcggtggcgcgacggatggcgggacggatcatgcgaaaagaattaggggggaggaaacagtagcaaatgttggcatcaaatcattacttttagcc

SEQ ID NO: 89472 - DNA, 609 bp, Heterodera glycines
  SCN-specific regions: Sequence locations=1-13,36-84,106-282,310-609
caagttctcccccaatttgtcccaccttttttgctgcttattttgctctcctccgcctgccccttttcgctcgctttttcctctgatatattgccatctgtcaccaattccaccggcatcggcaatggcactgatgccaccactgatcctactgataccactggtaacagcgatttgatgacgagtgcaacgctcccagaagaaacgactgccaaggaggaggagggcacgaagccgggcacggacggcaccgcgagggatggccaagggacaggcgaaccgcaaaaagatggggaggggatgaagcaggacacgggcgtttccgcggcggatggcaatgggacagccgaaccgccgaaagagggggatgagagccctcaagagtcattcgcctgttcagtgctctgttggactctgatcattgtcggcggtgtcttcatttgtgccgtcggattgactgccttcgttttattgactgtgcactaccaaaatgcccgtgccgacccgaacaatccgtccgctgctgttcaaatgagtgccattccgcgggggatgacagcccattgaacggcgaaaggacatacatcggaaaagattcgagagaatcga

SEQ ID NO: 89473 - DNA, 599 bp, Heterodera glycines
  SCN-specific regions: Sequence locations=1-145,178-222,244-559,581-599
gtaaaatatgcaagagactcacattgtcctgggcattggcacggtgtgctctctgttggcgatcatcgccaccgtcgtcactttgccatcgctgtactcggagatgaacgaaatgagcaccaaagtgcacgctggagttgaggctttccgcgtcaacaccgactcggcctggactgatctgatggacgtgcaagtggccgtgtcaccgccgtcgaagccccgtgccaaccccttcagctccatcttccgtgccaagcgtcaactgcccggccattgccaatgcggtccgctgcaacagccaagctgccccccgggcccacctggtccggccggagcgccaggtcaacccggtcagcccggaggcgcaggacagcccggacagccgggagcacctggacaacctgctgctccatgcgcgccccagcacatcccatgcccgcgctgcccggctggcccgcctggccgtcccggaggacagggaccgcccggacaacaaggagcccccggccaacctggttcacccgctccaggcggaggacagggaccgcctggcgcgcccggaccccaaggaccttctggacagcccggacgttctggag

SEQ ID NO: 89474 - DNA, 471 bp, Heterodera glycines
  SCN-specific regions: Sequence locations=1-1,23-46,68-172,194-238,260- 317,340-471
atttgtccgtccgtccgtttgagtgcaaatgaaaaaaaaacaattaaaaaggcggggagggggaaaagaattaatgaattgaccaaacactgatcattttttattttcacattcgttgctgttctgcttttgctgctgtccgatcacgctaacggtgcacagagataaataaaaagaaaggcatcgtcactcatatgaccaaagatgggacgagacatggagggtgagggtaattgaggggttaattggggtggggtaattagagggtgcaaagggcgatgggtaaagggcggagacgctaatcaacgtcaattaccccaaaaaggaaaactttgcaaagacaaaattagcaaattttttgagacgagaatctaaaaaaaattcaaaagcaggataagaattcgggaacccgatctgtgccggattcccagatgaaatcctaattttccaggttgatcccgatgcgctttt

SEQ ID NO: 89475 - DNA, 972 bp, Heterodera glycines
  SCN-specific regions: Sequence locations=1-548,570-882,910-972
aacctttacatcgcaaccggtggagaggatgacctgctcaccgtctattccctagctgaaaatagggtcgtatgtcgtgggcaggcgcataagtcatggatttctgaagtcgccttcgattgttatgcacccgaatttatgttggaacaaactcaaattttcgacgaaaaacgctgttgtccgcctttgaagggtgagggcacctgttcatcgtttgcaactaatgaaggaaacgcctttcaaaatgggcaccatttcccttctggccatgaagaaagtgtttcttctgccccgcaaattggccatttgccttttgctaattgcgacgacctccgcacgaccaacacaaattcgcttcaattgcttcccaacggaaaagtaacgcacagaaacggctcatcggatgatgcaaatgacgtttctcactgtcagcctcagcttctctatagggttggcactgttggccacgactgtcagttgtgcctttgggacctttccgaagacattttggcttctccgcccctttcccaacatcacttcgacgaaatcaccgtttctccttcaccctcaaactttgcaaatgtttcccctcgaaataccacggtcattcccattggcttcgcaaatgcattgtccacaaccgaaactgatgtgagaacagctgacaaaccttctgacgcaaatagcaaaagcagcggacgcttcagaaaatttcataagcgtggcttcagtttcgggtcccgtttgacgggaaatgaacgaaaacagcacgggaattcttcgaacggggcaaattccaatgaaagtacattgaaaagaggcgaaaattatgcacaatttctcggaactgtgcaatgtccacgactcgaagacgtgccaatgattgaacctttgatgtgcaaaaagattgcacacgaaagactcggcgctttgctccttcgcgaagattgcatcgtgacctgcttgtcagga

SEQ ID NO: 89476 - DNA, 586 bp, Heterodera glycines
  SCN-specific regions: Sequence locations=1-41,64-229,253-586
tgagtatcaaattggccaactgttttccgtggccgaggcatcgcgacaggagacgggcggcggagaaggtgttcaggtgttgcgcaacgaaccttttgaaggggagagtctgttcaatggccagttctcttccggacaatatacgcataaaatttaccatttcgattcaaaagtgccgtctcttctgagagcgattatgccaaagggttcgatgtcggtccatgaacacgcgtggaatgcgtatccgtactgcaaaaccgagctgaccaacccggacttcatgaaggacagctttttcattcggattgaaactattcatctgaacgaccgcggcaccactgaaaacgcgctctgtctgacgacggatatgctaagtaaacgccaagtcgtgcgcattgacatcgcgaacgacaaagagtttataaatgcagccgacattcgtgaagacacaaaaccctcgacgttccactcggagaggacaggccgaggtccgttgttgcagtcgtggcagaccaactgcgagccggtgatgtgcgcttacaaactggtcactatcaactttcagtggttcggcttccaaaactgg

SEQ ID NO: 89477 - DNA, 1141 bp, Heterodera glycines
  SCN-specific regions: Sequence locations=1-98,125-161,184-477,507 -530,552-936,958-1060,1082-1141
tattaaaataattttgctaaaaaatgggtaggaagaagaagaagccgcaaaagccatggtgttggtattgcaaccgcgaatttgaggacgaaaaaatactcatccaacatcaaaaggccaaacacttcaaatgtcacatttgcaacaaaaagctgttcaccggcccgggcttggccatccattgcatgcaggttcacaaggaaagcattgataagattcccggcgcgttgcccggccgtgacaatgtgaacatcgaagtgtacggaatggagggcttgccgccagaatccactcgtggccatgtcgaggacgactcggacatgcaaccctccaaaattccgcgccccgcctttccgcctggaatgtcgatgtccggcatggtgccaccaattgcggcgtacaatcaatacacaccgcgcacaccgtttggtatgccgtcctatgggatgccgcgtcccggcactgttccgcttcctcaccaccaacaacaacagcagcaacaaatggccgcaatgatggcagcagctgccgcagcaggggcgggcgggcggatgccggcgacgtccacagccgcctcaattggcgcgattccgacaccaccggcgggcattgtgccaccgcctccgctccccgccggaataccgtcgcctgcgtcgggaggtgccattccgatgccaccgcaagcggcattcgccgcttaccaggataaaagcatctccggtggaaagtatggcaccagggacgagccctctacttctgccgcgtcgtcgtcaacaatggtcaaaacattgggtgccaagacgcgcattgtgtgccaagatgaacagacatcgctggaagagatgatggcccaacgcattgtgccgacctacacacgtgggctgatgccatttgtgcgttagcggagccgaagggtcgcaacaacgaaggcggaaaatgtctgtctgtctgtcactgagtgtttccccacgggggcttttcgtgccattcatttatcggcatcgttgttgttgaatcaaaaattgtggtcggttgagtccaaaatgtgaaggttggctcacttacaacacaataattgctttttcactctattcattatgatgtttctttcttttttacaggaaaatgaaatttggtgaaa

SEQ ID NO: 89478 - DNA, 665 bp, Heterodera glycines
  SCN-specific regions: Sequence locations=1-445,468-665
cgtgaattcgttttgtcgttattcttcgggtccattcatcctcgaattacgcaattcatacaagttccaaaacgactattgtcctctgatttgtctttctatatccctcgacattcgccactcacatttcgcttaatggacgaagcgtattttttgcgcaaatttgatgagtacgaacgcaacgacagttgggatcaggtttttcataagattaatgtggagtcggaaaatcaggcgaaaaagctgagtttgtgctgtgatctgtccaacacttttcatgagaaaaaccgatatcggaatgtgttgccatatgaccagaacagaataatgctgaggtgcggtgtttcttccgagagtgactcgtacattaatgcttccccgttgcatttgccttttgcgcatcgcaattacattctgacccagggacctctgcccaacaccacctgtgacttttggcagatgatctttgagcaagaagtttcaatctgcattatgctcagcaaagtcatggaaaaaagctttgtcaagtgtcactcttatttcccttcaaaagatgagaaaaaaattgcatttaacaattggggaatgcgaacttgagcatgaggaatcaaagccgaattacatcattcgccgtgttcgactcactcggctggaaaatcaggggg

SEQ ID NO: 89479 - DNA, 551 bp, Heterodera glycines
  SCN-specific regions: Sequence locations=1-435,457-551
tgagaaatggcttcggttactgatcgttttctgatgaattggaaggggattccgctgggttttggcctcgtcacttcgacaacatgttcatatctttctaacaaatcgcggtggctctcgaaaattcgctcttcaatagctcaacgtcttcttgaatcaaaagaaacaaaaattgcagaacaaatgttacaacaacggcgccgtaatgaactgatgctgcactttaaaatggcttcttacggtgcgcccgtggcattgggcactttggctgccggcggaattttgtcttctttgccaaaaatccttcgtcttcccaattcgattggcttcactgtttgcgggtttggcctttccattggtgcatttattgtcggtgctcttcttttggacggaccgatgtacgcgtacaccgaatgggttcagcaacggacagacaaaggaacagaaaaacaaaaagtggaatgaacaaatgcaaagtccaaccaaccgactatgatttttttgttttgttttctttaaacggatttataaaatatgaaagaaaacaaaaa

SEQ ID NO: 89480 - DNA, 1118 bp, Heterodera glycines
  SCN-specific regions: Sequence locations=1-170,192-526,550-1118
caatgccattgcctattcgcttttttgttcttaaaatatgccagcagaatggacggaatggcaaattcgtttcgctgctcactgccgcccttcacaaggaattgtcgccgccgcatttccgacgcttttttgcctcgaccacttccgcttcttccgatgatggttttgttgttgaaaaggtggagaatggaaacgcaaaaaattacgaatccattgacggcgcatggaaatgcacaaactgtgctcatctgaattggccccagcagcgcatttgcaaacattgcactattggcatacccaccgaagcgcaaatggcgattctgaaacaattgctttgggtgtgtccaaattgcactgctcgcaacaccggcgaccattgcggaaactgtgccttggcccggtgctcagtgtacaaaggcttttgggtgtgctcacggtgcacgtggcgaaacattcccgtcaatttctcatgtcgaaaatgcaaaaaaggcaaacagacggaggagcaacgccaactcatccagcaacagcgatgggtgtgcggagagtgcaaacaccacaatttcaaggaggaatgcttcagttgcggtgcccctgagtccaaacggttgcccgatggcgtcggtggcgagtcattgcccgacgggtcgtggtattgtgtcggttgcggctttctcaacttccccaactattcgaagtgtcgccactgtcgcagagaagaaccgacggatgagcaacttggcgtcattcacagttcgcgttggcaatgcgctgagtgtcattttgacaattacgagtccaatttgacgtgccaccattgcgacgcgccacggcccacggaagggcaactccctgcaacttctgattgtcagtattgggtgtgctcaagctgtttgtggcgtaactttcccacccatttgtcgtgccaaaaatgtatcaaagggagggcaccggaagagaatcgccaacaaattcaacaattgcgatgggtttgcggaatatgccgacaccacaatttcaaagaggactgcttcaaatgcggcgccccaaagtccaaaggcttttcctgcggaatcggtggcgagtcgttggacgacgggtcgtggtattgtgtcagt

SEQ ID NO: 89481 - DNA, 778 bp, Heterodera glycines
  SCN-specific regions: Sequence locations=1-696,718-724,764-778
ggaacaccaggcggtgaacagaccattgacggagttgcggtgcattggtattctccgggggactacgataagctgacaaaagtgcacaatttgcggcccaacaaattcatttttgcctcggaagcgtgcacgggctatgaagtttttgagcacaaagttttgctgggcgattggtcccggggccgagcttatgcccgcgacattctcaacgatttgcgcaattgggtggtcggatggactgactggaatatgtgtttggatttggagggcgggcccaatttggcacggaattttgttgactctccgatcattgtgaatgccagtgctggcgagttctacaagcagccaatgttttatgcgatggcacattttagtcgctttgtcccgcgcgattcatcagtcattggctcctcactttttgtcgccaatggtggcgtgaacaaattgggcgagaaaaaagtggacaaatcagtggtgccaaatgcaagcactgccgcttccgttgacaatagcacacaatccaccgccgtggagcatatcgcttttcaaacaccaaatggcctccatgtgctggtgctgatcaacagtgatcgggatgcgcacaatgtgtccatttttgatcagacggaaggccgccggtggacagtgccattgggcggtgacgcaattgtgacggcaatttggaagccaaaaaatgatggaggaaaagcagccaaaaatgcgcaataattaattattgcaatttaatatttttatttattatgatgggccggccctc

SEQ ID NO: 89482 - DNA, 1016 bp, Heterodera glycines
  SCN-specific regions: Sequence locations=1-500,522-913,970-1016
aattttaaatctattcttaaaatggtgaatttttttgttatttttgtgccgtttttgttgttgattgtgtcaaatcagttgaaagccgaagaaacggaagaaaatcgacataaaacggaggaaacatggaattatgaggagcccgaagaatggggaggaaagtgccaaaagggcgacagacaatcgccaattgacattcacaaacaatggttcattgattataaaattccggcaatttcatttgcaaattacgaaaaaaatggaactgtgacaatgaaaaacaacggtcatacggtggtcgtaagcggatttgacacttgggaaaagcagccgaacatcgccgacggaggctttgggagcaaatacatgttgagccaattccattttcattggtctcaaaacgagaacggaagtgaacatacggtggacggagaacattatgacgcggagcttcacttggtccatgtcaaagaagggctttctttgtcagaagctctcgctctttctgatggtgtcgctgtgttgggcattttcttcaaaagggcgtacgttggaagcgcacttttggcacttcaaaacggactaagccaagtgacgaataaagatgactccgtcacaattgaacattatgagcccaacgatcttttgcccaccgcttcggaggtgtttttccgctacaacggctctctgaccacgcccgactgtaacgaagcggtcatttggacagtctttgccgtgccgaagtccatcagcagagagcagatacaattgttacgagcaattaacgggcacgacggaaaaccgatcagttcaaatattcggccggtgcaaaagctcagcagaaaagtgcagaaattccgctacaacaaagtgtcgattttgccataaacatccactggcccttctaatggacttttaattaattaataattaattactaaatagattttatttaacaaaataatatttgtcattgcaatgtttttgttcaataaaagttacgataattaaaaaaa

SEQ ID NO: 89483 - DNA, 882 bp, Heterodera glycines
  SCN-specific regions: Sequence locations=1-243,296-335,357-882
gtccatttaagggcactgaagaggccgaattgcatgtagaagaagcaaaccccgagttttaattggcaaaacattcagcggacggtggtgcaaatggtcagaatggcggacgtttcgcaggacgacattttggtggtggagggtgccattgacaacgaccaaaccctgaaaaatttggtcgaacggacgtacaataaatttggccaaatcgatgttttggtgaacaacgccggcagcattcttcagcaccaacgatcgcggcagaacagcaacagcaataacagcaccagcagcaataattacggctacgactacacaaatgggcaaaacggagccgaggaggaggacggaggacgcgggaggtaccacggcttccgcggctttcgaaggacttcttcctcagcaacggcaatgaccagtcgccgcacttgctcaatttttggagctttggacaacgattttgactttttgtttaacataaatttgaagagtatcgccaaattgacccgtttgtgcgcgccttatctcgaagaaacaaagggtgccgtagtgaacatcagcagtttcggcacacagcgttccctgtccgactacacttattacagcaccataaaaaatgctttagacaattattgccgctcaatcgctgttaaatttgcaaagcgcgacattcgagtgaacaacattaaccccggttttatcatcggcgaaactttggacgaagacgacaacagagcgaacaaattcgagttgaattggatcaaaaatcacgtgccgatgggtcgcggagggacggcggaggaaattggcaaagtcgtggcatttttggccagcgacgacgcctcttacatcaccggggcaacgataactgtggacggtgcc

SEQ ID NO: 89484 - DNA, 844 bp, Heterodera glycines
  misc_feature (748)..(748): n is a, c, g, or t
  SCN-specific regions: Sequence locations=1-18,40-165,189-350,394 -579,602-844
ctcaaaacgaaggatcactaaagagaattcttttttaatcattctcgaaaatgccaccgacttgggccttagtgccgcttttgcttctgttctttgtccatttcattgatgtcggattcgctcgtcgctacaaagcgtcaacaaaatacaatccgccggcggaagaaacgacgacagaaacgacagaattgacaaccccaacggaatgccctgcgccggtgtgcccatgcgaatgtcccaccgaagaaacgtctgaaacgcctccttcgacgggcgggggagggggcactgacgacatcgtgacctcgccggaaggagaggagacgaccacgcccgtctccggttgtgttccgggcccgccggggcctcccggcccaccgggcccagcggggcaaaaggggccccagggaaaatgcggcgacaatgcgagcaaacgcaaaagggaagcagcagcagtgccgaaagagtttatgacgaatttggaaccgaatgtgccagtcaaacgtgcaaaagaaggagaagccgttgcaaagacgcattttgcacgtggccatgtcaaggggggctgtccaccgggtcccccgggggagcctggcactcccgggcctccgggccctcccggagacccggcgccatgcccgaagcacatgaaaagcgaagcgcaaagcgtcgatggcaaacaactggctaacagaaacaaacgtggggagacggtgctgaatgctgcaaaggaggggaccgaagtganacgcccaattgtgcgccatggcattggaccgcccggccccgccggacccccgggaaaagcgggcgaaaaaggagagcccgggccttgcgaatggta

SEQ ID NO: 89485 - DNA, 628 bp, Heterodera glycines
  SCN-specific regions: Sequence locations=1-628
tttttttgtacatttccttcgctttttctctgtcatcagcttatatttcaacgttcttcttgtactgcttgttctgctcgtccatttattcagaaggtactccgggcgtcttgtggccgcggtgttgcagcgactgttacacgcgcgcgccgcgcacatttacgggctcggctggttcgcgttgcgccatggcgagctgttgctggccaacggactgcacttggaggtgcgcgagttgcgcgtccattcgctgttcaattggtggtggacaacgacggcaccgacggtggacagcgcggccaacgacggcggtggtcaacgcatggcactgaacgtgcgtgtgtccgtcggcacaattcgtgttggcaaacagttggcggacgaagaaggcagcagaaatgctacgagtagcatttgtgatggtcaaaatccgctgattgaaaactgcggtgtgctcgactcggtgtccatccatttgtccaggcccgggccgggccaactccatctccaggttcagctgcagcaaccggtcgagttggtctggtcaccggtcctgcatttgatggtcaacgacgtggtcagagcgagtcgtctcccaaatgtcccaattggtcaactttttcgactc

SEQ ID NO: 89486 - DNA, 678 bp, Heterodera glycines
  SCN-specific regions: Sequence locations=1-678
atttttttttaaattttgcctataattaattctctttttgacgaattgagtttgcaatgtctatggatgaactgaagaaacgcgccaaagccattggtacatttgaggaactaagaaaaatcatagatatccgtggtgtgaatcggtacaacccaaacaatgcgccggttttggaacgggcggtggatttgatgatcaaagagacgaaatacgacaaggacattctgatgacactgttgaagctgtaccagttgaacccatttctttacaacgaaaagtacgtgtgccttgtgctattgaaaacgatgaccaattttccacgcaacgattttgctttggcaaaatatttggtggacgctgccaaagtgaacgctccggagttgcgacgcgtctgtcagattggctctcttcttgagtcttgcaatttcgcgctcttttggcgtctcgtcgacggacggtacaaaccccgcgacagtctcgacgaaccattcaaaaaacctgacgaaattcgccaattggtcgagtccgtcacaagtttcaaagaggcgacacggaattatgcatgtcaagtgatcaatgtgacattccaacgcattcacaagcaacagttggtcaatctgttgggtggcattgatgatgcccaattgactgcctatacaaatttgccatcaaacaaat

SEQ ID NO: 89487 - DNA, 443 bp, Heterodera glycines
  SCN-specific regions: Sequence locations=1-359,381-396,419-443
caggaatggatgatatcaaggctcaattgcatgtagctctttcaaaaaacggttatggccagcccgagtacagatacttttgcgagactgatggccgacaatattttcgttgcgagtgctcagtcaaacgatatgaagatatttatgtggccaatgaaattgctcagaaaaaacgcgatgctcaaacaaaggctgcaacgtcgatgggcaaatggatggtgaagaacggctttttgacggacgaagaattgccgcaacttatgcagaaaagcgaccatgcgagcgaaaaggatgaatcagcttgatgatggacacacactttcaaacattctcatttttgcaacatagtttttgacttaattcccatttttgagaaatttattttcacatattggctaaaatttaagtaatttataaaaagtagtaataaaaaaagtgagagc

SEQ ID NO: 89488 - DNA, 461 bp, Heterodera glycines
  SCN-specific regions: Sequence locations=1-195,217-461
gagacaacgcatcaaaaaagtccacctctgactacccatacaccgctcttagtgaccaacttgcggcaatttcccaacaaatggacaacaacagtgtcgaccccatcactaaacaacttttgaaaatttgtgtcgaacttttacagcaggtccagcaacaacagaccgtcatctccgaacaagaccttcaactccaacatttcaaacaacagaaaatgatggaagaagccattcaagaccatgagcgtcggcgaagcgtcgtcgtaatgggtctccctgaatcgcagaaacaaaagccgtccgagcgagtcgctgaggaccgaactgccatctcaggcgttctcgatgagcttggcatcgagagcccaatcactgtgtacagaatgggttccccagaccaagcaaacacaggtcaaaaccgcccgaggttgatgaaagtaattttcgggtgctccaaatat

SEQ ID NO: 89489 - DNA, 849 bp, Heterodera glycines
  misc_feature (825)..(826): n is a, c, g, or t
  misc_feature (829)..(830): n is a, c, g, or t
  SCN-specific regions: Sequence locations=1-418,440-820
cgcggatgttcgtgccgaaaagtctgtggccatccatccaaaaaggacttgccgaactcgcctctcaaaccaaaatgggcgatgtccgcgacccttccattttcatgtcggctgtcatcgatgcgaaggcgttcaaacgaatcaacgactacatcgcttacgcaaagggagccggagtcaaaaaggacggcactcggctggtatttggcggaaaatgcgacgactctcgtggatggttcatcgagccgacttgtgtggaggtggacaacatttcatcccttcttctcaagcaggaaatatttggaccttttatcgctgtttacgtgtacaatgatgtggatgctggtcagctcgttcgttccctgaaggaccaaactccgttcggactgactggcgcagttttcagccaggacaaggactttctttatgaagcaaaagacattctccgtgatgcagtcggcaatttgtatttgaatgacaaatgtaccggttccgttgttggtcagcagccttttggtggagcgcgtcaatccggcactaatgacaaggccggaggcccccattacgtcctccgatggacttctgcccaagtgatcaaagagagttttgggccgcttaccgaatggcgctacccgcacatggattagatgggagacctttattgtcttttgaaaccaacgtggttttcatgtagcgagatttccctccattcaatccaataatttcctttgaatttctcccataattctctccctatcgccccatctttttttgatgttttgtttttccctattctattgaattgtcgcataataaatggaatanntannaaaaaaaaaaaaaaaaaaa

SEQ ID NO: 89490 - DNA, 700 bp, Heterodera glycines
  SCN-specific regions: Sequence locations=1-700
tgacattgcaattaaaaactacgtgaataaaattttgttttatcttcttgggggagccttcaattagtaaaggtggatgattccgaatcatgatttaaaaatataccagctagtgccagtctctgggcattggggtcaaaaggcgtcagctgacacatttctcctgtgtctatctcattttcatgcgtcagctgtctagcatttgtccttaatttattagagaaaaagaggcattgagtatcgtaaaaagagaggtattgagtatcgaaacgattcattcataattttatggaaattactgctagtacggggtataaattcaaacatcctcaaaagtggaagcaacaacaacaacaacaatggcaaaagacgcaattttcggcactatgtacgcgcgctggacaccgacgtagcgttcaacaaaaaattcagactaatgaatgctaaaagtacattcatgatccagactctaccatcaaatcctgagtcgcttttgcgagtcatttttggacattgcatacaatcgtcattagatgaagctcagagacgtggaattgaaccgagtcgacttactgcaacaattacttcacagttattggaccctgacatttggattccgatccgtcagataactccaaacacagtggacacaattttgaatcgcttcttagatgtggcacaatcaaagtcgcgggaaggt

SEQ ID NO: 89491 - DNA, 640 bp, Heterodera glycines
  SCN-specific regions: Sequence locations=1-52,86-473,586-640
aaaggttcaaatattttgtaattggtcgccattttaataagctgagtcattaatattcaaaatgttttttaaatgccattttaatgaaaaatggaatggttttcttgcgaaaaaaagtccaaacaaatgcattcatataattaaatcagtctttacaaaagcaaaaagctttaaattcaacaaaaactgaataaaatttgaaaaaattctacattttcttatgaaatgataggagcattttttcgataaaataattctcgcgagatcggacggccggctgaatcaataaattgcgcacaaatttattgcatgaatggggtgcgagttgaggagcattttggggatgggtgaatttggtgctgatgttaagtgaataaatacggaaaattgaacgatgaattattttattggtgaagtgtagggagaagaagtgcagcagctgtcggcggacggacttttttggaagttgtaacaattataaaaaaataaatatattataataaaaatttttttaaaaatatttaaattaaaaaatgcttcctttattagtcaaatatttttattttaaaattttaatgttaaattgtcactattattctttttacgacaatatttcaaacatttatccataaaaaatgat

SEQ ID NO: 89492 - DNA, 1019 bp, Heterodera glycines
  SCN-specific regions: Sequence locations=1-239,269-404,427-656,678 -885,908-1019
aagatttcttttagtacctaatttttttaaattttacggggaaatcgatgcagcgtggtgcacccggtaagattaagttagtttatcgcagaattaaatttttcactgcatgaactttcacctttcttagctgaattcattccaaagtcaatggcgccaattggttgcccaatcgtcttcacctctgcagttccaattggaaatgtccaacctgaactactcgcccattaagttcaacgctcgttttctcgttataaattcgtctgctaacaataagcgacaaacaaatgaaaaatttgcttttgacgaagaaatagccgacgggtttcaaattgcaactgccgatgactctcttctgatagaagttgtgctgtataatatttccaatgttccattgcgctttgaatattgttcattgactctggatgaaattttaaattcatccggtgccaaaaagtcgaaaacactgtccgaatggtctacggcgggaaattcgtcaaaaaattctacgttggtattggttcccaaaagaccaagccgcgttttctttatctacaaaactacatttgcaacatctcttaaacaattgatgcaattgccagcctcaaaggcaccgactagcagatgccaaagtccgttgatggatgaacagaatgccaaggaaattttaataacggtccgacacttttcattgcgtacattgtccggatcactcagctgggacatcgatcaccgatcgacgagtaatagacatcaccaaaattcaattgaggagatggacaagaacaactatgcagtgaagtgcgaccacaacggtgcaatgtgttactgacctgtccaattttggctgatagcaccgaattggaattatttgttgacgaatgcgttcaattgactttaaccctttgtaatgcggagcgcaacggaacactgctgaagaacatttggtgagcctgggtaatctgccacaaagtctgccgtgaggatgaagagttcgccaaccagcagcagaattcgca

SEQ ID NO: 89493 - DNA, 866 bp, Heterodera glycines
  SCN-specific regions: Sequence locations=1-497,519-866
caccgagcgaaacgacgcccgaaatgcacgagacatttttcaaacaattggccaagacgcaccacccccacttggcagacgaccgtccccagtacaccatccaatatcagaccgattctccgatcaacatccgtgcactggtttatgtgcccacaaagcgcgtctcccacttggaatttgcagcagattcacagcgggacatcgccatttcgctgtacaatcaacgcgttttgattaagccaaatgccaaagagttggtgccgcactatttacgcttcctaattggggtcgtcgattctgaagatgtgccgttgaatttaagccgagaaatgctacagactgacctaattctcgaaaaaatcagaaaaacccttaccgaacgatgcgtgcgcttctttctctcacaattgtccaaagaccgagtcaaatacaacgacttttacatgggctattcaatgttcttcaaggaaggcgttgtcacggaacagtccaacaccaccaaggaagaaattgctcagcttctgttgttcgaatcgtccagttttcggtctggcactttgaccactctgtcggaatatgtcgaacgaatgcaatcggaccaaaagaacatttattacatttacgcaccaagccgtcaactcgccgaaacgtcgccttactttgaactgttcaaagacaaatacgaagtgttgtttttgtcggacccagcggatgaactcgtctttttgtcaatgccccaatttcgcatgaaatctttgcagtcgctggagaaatggacgaaggaggagggactgagcattgactctgacaaagaatcatcagctgaattgatgagggacagctccaaaaaggaatttctttggctg

SEQ ID NO: 89494 - DNA, 593 bp, Heterodera glycines
  SCN-specific regions: Sequence locations=1-593
aaggggtaaacatcccccgtggcccttcttttgtttgatgggcacaaatttttgtccaaatcggagttgttgatgaatggaaaggccgtcttttgttgttggccggtcgtttttggaccaacaatttttgaataaattagtgaagtgaaaaaatgtgaaaattttggcgaaaatgttggccgaagtgaggaaatggtggggtgaattgacgaaatgtccgaatttgtgatgagacgggaattaaaacccgttccgactgcttctccttttccgatcagtgccacaaatgcgagagctgccagtgatcggtagagccgaaagtgggggttgaatttgatgaagacgaaaagcgcggccaaggcgatgatttccgaggccacggcgataagcagccattgtcccgtcgagagcaatcgaagaagtggaaaggggtcaaatccccaatttggcattgtcagggtgaacgtgctgcccggctcgatgtgaccgctcgctgagtctcgctggctaaagccgaattgctgctgtttggggatgaaagcaagcccccctttaagtttaaattttgttgtccccgccgggcatttcacttg

SEQ ID NO: 89495 - DNA, 1122 bp, Heterodera glycines
  SCN-specific regions: Sequence locations=1-58,80-557,580-844,867-1122
gtcattttccgggagggcgacccgggccaaagttggtttgtggtcttacgcggcactttggaagtgaagtcgtcaggcaaaaggcattcgtttctccacgagggcgacgactttggcaaattggcgttgctgaacagctgcgaaatgaacggaaacagccaaaagcagcagcaaaacaacggcaacagaacacaacggcagtcgacggttatcacagcggaggacggctgccaacttttgagagtctacgcaacgaaattcagcagattgctgagtgagatggagacgaacaccgtccggctgaaggagtatatggaatgcgacaatggcaccactgaaaggccattggatgtgttggtgttgcagagggatgccggtggaggacgccattcgctcatcgccggattgcctagccaaattttggagtacactttggagacacggatggaccatttggtcacaatggtggatgagtcgttcgtcgttctgtcccggctcggcacccgttcttcctccaccaatgccctccaacccgcggccgattcgcttctcctcgacgttctcttctctcttcccttttggatgccctccaacgaattgtgcaacatgctcaagctgtactacagctttggcttttcaaactccatcgaacaaaacgtgcaaacaattggtggtgatccaagtgaatggagccgaacggcgaacacagcgacgaaacgacggactgtcgcttttgtcagtgcgtggcaaatggcaattggtcatcgctttttcctcgactccgtggccaatgcttttgtggaagaacttttcagcagtttgttggaagacgtgagaacagccgaagagacaacagaagcgatggaatttgaggaaatgatgcgccaaatggaaacactgatggaattccgagagggattcatgcgaaaattaagccgacacccacgcgttgtcctggacaaaggaaaatacggcgacggggcatcggcacccgacccaattttgccaagagatctctgcattcaacccattcatttgatgaatgcgtccgatcactccaaacggtcgatcattttacaattgcgaatggacaaaagtgcggcagaaattgcacaaatggcg

SEQ ID NO: 89496 - DNA, 793 bp, Heterodera glycines
  SCN-specific regions: Sequence locations=1-683,705-793
caataatccaggaaaaaaatatggatttccatataattacacgccctaaacatttcaatgatttttaaatatgtacatagatgctaatgcctcaacggcagctgcgtttggttagcaaaagtttgctgtttgtccatggggcgggtgccaaacaatttttgcaaggattgacaaccaaagacatggactccctcaacaatgttccgttggtttattcctttctgctcaatgttaggggacgcattttggcggattttttcatttatcgtggcaacaacggcggaaatgccgaggcttttgtccttgaaactgaaaagtcacaggccgaactgcttgaaaaaacactgaagctgtatcggctacgcaaacagatcggaattgagccactattggacaaaactgtgcttttccgtttcgatgctgaaggggaaacgacgcaaaaacaaaaggcaactatccctgaaaattcgtccaattggatggtcgacccgcgagtgcccggctttggcttcagagctattcgaaagattgaaaatgagacagcacatgatgacgaggcgtcttcctctgcgtatttgcgtcatcgattggcttggggattggccgaaggaacagaaatggtcgaccaaattccgctgaatatgaacggggacattaccgggggaatcagcttcgagaagggttgttacattggccaggagctcgttgcccgcacgcatttcactggcattgtcagaaggcggctgatgcccttccgaccaatcgatgacaaaaatggacgcgacggtttccg

SEQ ID NO: 89497 - DNA, 738 bp, Heterodera glycines
  SCN-specific regions: Sequence locations=1-16,40-738
ggtccttcaatttcttgtttgaaagtttaaattttttcaaattgatgcaatttcggaattttaggtctctccaacttaagaacataaaatatttgcctttcagtaaaatctttcccggaatgtctgcggataaaacgggcgcactttttgtgggcgatatcattttagccgtaagatttcgcaacaaaagggaagaagcgcgacatcattttagacgtcaatggcgagtcattagtcaatgcgcggcatgacgaggctgtccgtgcacttaaacaagccgggaaaatggtcaatttgcaagtgcaatatcgacgcgatttgcacctccgtcgggagaatatgctgcaccggctgagttgggaggagagtcgggtcggtgcgtcgtcggctgggccgacggtgaacggacaaagtgcgggagaagcgttgcgaagtttcggactcaaattggcatttgtcacgcgaaacccactcgaggaggaggacccggagaatcggaccatcgaaatacgctcgcacagcgctcgacacattctgacgttgaggtgttcgtctgccactgaagcggacgcttggttcgaggccatccattcgtgtgccgacactctgctcactcaggcgttggcacaagtcaatttgatcctcggacaaagtccgcaagtgctccgcatgggttggatggcggagcaggacgccgccattggttggaaggccgtttttgtggcattgactgtcaac

SEQ ID NO: 89498 - DNA, 1111 bp, Heterodera glycines
  SCN-specific regions: Sequence locations=1-92,114-847,869-941,963 -1000,1029-1111
ataagctggccgcgcgaaagtcgaaattttcagagacccaaaatttatgtgccattttcatcaaatttgtgggccctcggttttttttttaatttcaaaaattttcaattttagttagggtttattcccgaccctggtcatctgtggcatatcaaaatcagatgagagtgccaattaaatgaatgagtttctatttctatgatttttttttaattctattgtctttttctctttcctgacgagcgtatttctcgccgacattttttaaatcggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatacacaaaaaaatcagagcaaaaaaaagttcgaattactgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccgtttttaaatttctccagccattcccgacaaaattttggtcggggaatttcctttccgattcccgactcttctccatccatggggccggcacggcgaccaaccctaattttaattccttttaattggacaacaacaccaaacaaggggagacctttctcaagtggaggagtcgagactctcgaatagactgtacttcttcccccgccccacccgactgacccgccacttccgatggacgaacagttgcagggcaacagtttcagcagcatttggcccaccgatttgtgctgctgctgttggtgttgtattgcggccgtgggttgctccgtttgttgcacttcggctgctgttgttgttgttgttgttgctgttactgcttgtgacggttgtgcggttgctgtcgccgctggttgttctacagctactgcttgcgcttgggctgccgctccgtttgc

SEQ ID NO: 89499 - DNA, 630 bp, Heterodera glycines
  SCN-specific regions: Sequence locations=1-9,32-482,505-606,628-630
atttactcctctcaaaaatccaaattgtttcttccatttttcaattacggtacggccaaccccaattttcttacaaattttggcataatttttcttccattcttttcccaaatattttcttcctttttacttaattcatttttcattacatataaattttagaacaatttcacttttttgttcatccgtttttgatttgtggcttttatttattttttttttcttcttccaaattttcttcccatttttctccaagtttcacttttttcttttttgctccaattccaatttgtccaattaaaagtaaaaaaccaaacaattaatatatactcaaacgaaaaaaataaatatgaggagcaattatcagagaaacttgctttcataatgatcaatcacttgtcacttcttaataattcatttacttctcattttcagacgaattttttgtgttcatttgacccgccttttgtggagacaatggcttaaataaagttataatttaaatatgacgaggttaattaaagccagggtgaccaagtgtcctgattttttagatttgtcctgtattgtggagggtacctatttgaaaaatcaaaaatgtcctgaattctcagactgtcctgaattttt

SEQ ID NO: 89500 - DNA, 391 bp, Heterodera glycines
  SCN-specific regions: Sequence locations=1-319,343-391
gtgaggctggagtctccatggccattccccttcgggctcgttatgacagcttcgacgtggtgcagcggggtaacacacggatgcccccgagctcactccgaagtgagtctgtccgtgccattcggcccgaccatttttaggtttcacgaaataccgccctgtaatctttcgccatatccgggaagaactgtcaagctcaacagaaatactggacccgcagctaagaaggcccagacgtttttggccgatgggaaggtaacccagcgccctcggattagcgcaacccgtgcagcacctagggactttcgcgacctgtaggccaactcctaccaggctccccggaggttccgagtatcgccacactcgtgcgcgtcggtagttagccgacgtt

SEQ ID NO: 89501 - DNA, 972 bp, Heterodera glycines
  SCN-specific regions: Sequence locations=1-972
aatatgcccaaaagcaaaatccaatcagcgagcattctggcagaacagcaaaaaagtgtcttttcctgtcagccgacaatccccgccgccgatgagtcggatgatctgtccaactcctcccatttgaattgttgtcagccgatcagcgaaattgaacaacatcagataaacgacttacgccaaattttggaaacacagcttctgaagcaagaggtggacgaagcttatcttctcagatggctgaggtcaaaggaaggcaaatttgacgaggcggccgatggcattcggaaggatttggtgttccgaaaagcatggggactggacaaaattgtaaattgggaagcgccggaaattttggaaaaatactgcggctacggcttcctctctgaccacgacggcaatcccattctgatgtctctgctcggaaatactgacgtagaagggatgttgcgatctgtccaatcgaaggattacatcaaattttcgctcgcggcaattgagaaaggcatcacattgtgcagggaacgcgccctgcagacgggccgacccttcgagcagatgatgctcgtgttcgacttggaccacatttcttcggcccactactcctccaagcaggtcgcctcctccttcaccaccctcgtcctcctcttccaggagcattttcccctcgttctgcgaaaaatcctcgtaattcgagcacccgaaatggggagaattgcgttcaattcgatgacgccctttctgtcaaatgccatcaaatcgatgatcgaaatgccttctgaggaggggtggcagtccgccttaagcaaatacgtgaatttggatgcttggcctgtccattggggcggtcggatgatggaccctaacggagacccaaagtgcccctccaaaatccgctacggcctcggccccgtccccgactcgtttttcgtcgacccttcccaagcaatgcccgactatgacccgttgacc

SEQ ID NO: 89502 - DNA, 633 bp, Heterodera glycines
  SCN-specific regions: Sequence locations=1-232,254-633
catcaccatcaccacaaatacgcgccgttggagcatctgctgaaccgcccggtgccaatgttcaagcagttgaacgaggcggaggtggcacgggcgatgatcagccgctactggcgcgacctgtacgagcgagcggaatgcgacgtggtcattgtcggggccggcagtgcggggctgagctgcgcgtactgcttggcaacgcggcatccgcacctgagcatcgcgatcattgaggccaacgtggcgcccggtggtggcgcatggcttggcggacagctgatgagtgccatggttgtggacaaggagatggagccgttcctggacgagctggcggtgccatatgaggagggtggccccaattttgtggttgttcctcatgccgcactgttcacagccacactgttggcaaaagtgcttgcgcagccaaatgtaaaactgttcaatgcaacggcggtggaagatttgattataaaacggcaacaacaatcagaaacaggcgaaggccctggcaaaagcgtacaacaacagcaacacgttgtcggcgtggtcaccaattggactctggtggcactgaatcatcacagtcaaagttgtatggacccaagcacagtgatggccaaagttgtgatcagt

SEQ ID NO: 89503 - DNA, 644 bp, Heterodera glycines
  SCN-specific regions: Sequence locations=1-15,37-219,247-317,345 -424,446-497,519-572,595-644
atttacaaaatgttcttctgtattgtctgttggtccacttatttgttaggaggttttttcggcaatcattaagaattggtgtcccgacgaaaaatttttttctaaatttgtcgagtttccttcacttactgtgttgtatgtctacatttattttgaaattttgcacttacaaatgtcaaatcctcaaacgtacgtccattctttgattcccccctcttcctgttgatgctgctgctgttgtgtttgctcctctccgtctttttcatagcgttttatcgacccttccccgtcctctcccccccccccggcgtccctttcctccccaaacaccacagccacaccaattcattctcttctaactttccaaaatgtcccaaacaccacagccaaccaattcattctcttctaactttccaaaatgtcccaaacaccacagccacaccaattcattctcttctaactttccaaaatgtgacggcgtgcaatgaatttccctctcttccttttccttcatctttccgcgtgcggaagcagagcacaaactgtcgctggcgaacaccgaaatttcacaatggaagaacaaatttgacgctgaaatggcactgcaccacgaggaggtggaggacttgcacaacaacatgatg

SEQ ID NO: 89504 - DNA, 716 bp, Heterodera glycines
  SCN-specific regions: Sequence locations=1-59,81-623,645-716
atgacacattcggacaatctttggctgatgatggcaaaagtccgacgatgaatagcgattttatttttgttggtgtgttaagtgcgcaggtaaattgatttaaaaaaacaattcctgttgagttaatccatcgattataccctttttttacgtttttttgataaagcatttgcttctccccgtccccacagcgttttctcgacacgcgtgcatttcaaatttggcgcagttgggcgcgccgagtgcctggccgcgtgctgttctttgtcgccgacggcactgtgctcagtgcgcgagtgcgtgcggcgcgcatgccagtggttgtgttgcgtggcgtcgatgacgcgtaccctccgcagaaaaaagcgtttgcaatgctccgctggatgttcgacaatcagctctccaacttccattggtttctgcgcgccgatgacgacctttacatacgcaccgatcagttaaagcaatttttgatcggcatggaccctgacagagcacatttcatcggccaggccgggctcggcaattccctggagtatggccaactgtcgttgggtgcccaggacaattactgcatgggcggcccgggtgttttgttgtcacgtgaaacattacggcaacttggcccccacttggaaaactgtttacgccacttggtcacgagccaccaggacctcgaattgggccgttgtgttaggtcggacgtcacgtgg

SEQ ID NO: 89505 - DNA, 936 bp, Heterodera glycines
  SCN-specific regions: Sequence locations=1-936
agttcttctaccttcgaatttggagtgccaagctttgtttagttgaacatgtcatccgtttctgctggtggcgatggaaaaacacctgctggccatacaattccaccaccaaaaacatcgggagcagcgacgggcggtcagcagctgagcgcaagtgcgaatcaattcgtcgataaaatcgacccattctcaaaacgaggaaattcacgccgcagacgacgcttgatcggcagcagtcgttaccacgcggacaatgagccggacttgacacaattaccgctgatcaaggatgccggtcaggctgaccagacttatctcgcaattcaaaaactccagcaatgtcagaaaatcttcgatttttatgatcccgtatcgcaactgaagagtaaagagataaagcgggcggcgcttaacgagctgattgactacatcacggcaaccaaaggagctgtgtgtgagccgctttacccagaaataatcaaaatggtgtcgaaaaacattttccgtgttcttcccccaagtgacaattcggaatttgacccagaggaggacgaacccacgcttgaagtgtcatggcctcacttacagctcgtttacgaattgtttttgcgttttctcgagtcaacagattttcaagcatctattggcaagaaatatattgaccagcgatttgttcttcaactgctcgaacttttcgattcggaagatccccgtgaaagggattttctaaagacaattttgcaccgtatttacggaaaatttttggggcttcgtgcgttcattcgaaagcagatcaactacatgtttttgtctttcgtatttgagactgagtcattcaacggagtgggagaacttctggaaatccttggaagcatcatcaatggatttgcgcttcctttgaagcaagagcacaaagtttttctcgtaaaagtattg

SEQ ID NO: 89506 - DNA, 801 bp, Heterodera glycines
  SCN-specific regions: Sequence locations=1-801
gtgatctccgcctcttccgacaccaccgtcaaagtgtggcacacgcgcagaaatggcgcgtgtttgtccaccctcaaaacacacaaagattgcgtccgctgcttggcttatgcccggtggcccaccgaattggtggcgagtgccgggctcgacaaatgcatttacctttgggacgtgaacacactgaccaaagtgacggccaccaacaacacggtgaccacttcgtctttacgcggcaccaaaaattccatttactctttggcaatgaatgagtgcggaactgtgatcattgccgggtccactgaaaatttgctgagagtgtgggacccgcgcacgtgtcaaaaggtggccaaactgcgcggacacaacgaaaacattagggcaatttcggtgaacagagacggcactttgtgtctgtccggcagcagcgatggcactgtcaaattgtggagcatcggccagcagcggtgcattggcaccattcgttgccattcggacagcgtttgggcactgcaaacggactctgtttttgccaccgttttttcgggcggacgcgaccatcgcgtgtttcgaactccgctgcgcaacctcaacgactcggaattgctgttcaccgaagggaaacccgtgcagaaattactgatggtcgacactgaccaacccaaacatttgtggacagcgacttgggactcgtccatcagacggtggccaatcgacggcaaagagacggaacggacggaggaggggccgcgggtcaacatgacactgcaaggtgctccaagcatccgaaaatacgccgta

SEQ ID NO: 89507 - DNA, 806 bp, Heterodera glycines
  SCN-specific regions: Sequence locations=1-127,149-806
tggatatttcttcgtcccaattaaaaatcttttcggtatttctgctctttatcgacttcgtatttcccaacaaccatgaaaattttgtcactttggcacaatttagagccggtggtgaaaaattcagttttgcggaacggcgttttttgctctacgatgtgaaccccggcgagggcttcaatttgcgaagggatgtctatttgagagtggccaacacagtacggcagctcagagagaaaggcttcgactttgttcttgtgctgccgccttggggaaactgttggcattggcgcacaaagccgcggcagacgaaaatccgttggtctgaactgttcgacttggacagtctgtcggactttgtgccggtcatagagttcgacgagttcctcgaagctcagggcacttccgtcagcactgttttgtatttgcagcattacgcggagggatgggccgaaggcggcgaatacactctcaaatacgacattcgcccgtgcattgaggcggacaaatattacgctaaaaggggcgacaaatggaacggccatttcttcgattacgctgaccatttccatgcgaaggatttgcaatgtctgtccatccagggacagtcgagcacactcgcagaagcaatcgcacaattattccccgagggtcgttctttgatggtcgaccgtgccgaaacgattctgcacgaccaattcggcgaccatttcttttggaaggcgcggaaatcaatgcgatacgccaaaagacttcgttcgattggcgacactttccgcgccgaccaattggccaatacgtccgac

SEQ ID NO: 89508 - DNA, 617 bp, Heterodera glycines
  SCN-specific regions: Sequence locations=1-108,130-301,323-617
gtttgaggtagtctataagtgataatttatcactgttaattattatcattaacaatggtagccgcgccagatgaagcgcaatttcatatttcgttttacactgacgaagaagagtgtaagaatttgttgcctgccgagtccatcaatgtgcccgcgtcttcgcactcggaccaactcaatgtgttgatcaaccaaatcgggtcgatgaacgatgacagttggaagcccgtccaattcgactttctgctccattccgtgctgttgcgctgctctctgctcgagttggtcgagcagcaacagttgtccctggagaatgtgctgcgcatcgaatgcattcgccagtcgcccgccccgcggccgaccgccgaactgaacgaagcgcaatgggtggccgatcttagaacattgagccacaattgtgttttgtccgtgaattttgccggtctgctgaatgtgtgggaattggccggtgaatggaccagagccgtcgtcaaacaattggacgacgaaccgttgaaatgcgtggacacattcactcaggacgacggaacaactttcgctttgagtggaggccaaaaccaaactttgactttggtgcgactgcgggcgcagaatag

SEQ ID NO: 89509 - DNA, 648 bp, Heterodera glycines
  SCN-specific regions: Sequence locations=1-136,158-296,321-420,442 -527,549-648
cattggaaagtgccatcttttgtccctccattaaaatgccgatgatttcaccggcagacaaatgcgtctccgattctgcctctgttcatttcactaatgacattgcccccgacgctctttgcctttgaccaaatgccaactttggacccggcaattccgactcaaagtccccacttggctccctcttccgattcgtgtgttggccaatgcgctttgattttcactgatcaaatgcgctcccaattgggctcggaacattcgacgggactgctgaatttgaattacaacgaattcttggctgccttttccaattcatctttcttcgattccttttgcaatatttatcatcaattcaatttttgctacacaaaatgcccacaaggatttatgcaagaattgttgagcagaagtgccgaaatagtggaccatttttgtgtgtggaattacaaagaaataaagacaaaattcggttgtttggtcgctttggaccgcgaaatgtccaaaaagtgtcttcattcctgcgctgggcatcacaaagctgtcacttctctgatgcaaaacttcaaacatttggcgatgaacagcgacccgacggaggccgaaaaatatttgggagaaagttgcgaatacgtcgggtgcactttgcac

SEQ ID NO: 89510 - DNA, 1328 bp, Heterodera glycines
  SCN-specific regions: Sequence locations=1-76,99-666,688-798,820-1328
cacggcacaaactgatgggcgacttggacgacgcccaagtggacgtggaacgcgccgctgcctacgcgggcgcgttggagaagaagcagaagggcttcgacaagatcatcgatgagtggcgcaaaaaatgcgacgacctcgcggctgagctggacgcatcgcaacgcgacgcgcgcaatttagccacggatctcttcaaggcaaaaacggtgcaggacgaactggcggaggcgctggagggcacgcgacgcgaaaacaaatcgctggcccaagagatcaaagacctgaccgatcagctcagcgagggaggccgatcagtgcacgagctgcagaagatcgtacgccgactagaggtggagaaagaagagattcagcacgcgctggacgaggcggaggcggcgttggaagcggaggagagcaaagtgttgcgagcccaagtcgaggtgtcccaaatccgatcggagatcgaaaagcgcatccaagagaaggaggaggagttcgagaacacgcgcaaaaaccaccaacgggcgttggaaagcatgcaggcgacgctggaggcggaaagcccgggcaagcaagaagcactgcgcatcaagaagaagttggagagcgacatcaacgaggtggagatcgcattggaccacgcgaacaaagcgtacgcggacgcacagaagacgatcaagaagcaccaggaacagatccgcgagttgcagctgcaagtggaggacgaatgacgccagcgggacgagctgagagagcagttcctgaacagcgaaaagcgcaaccagattctccagagcgagaaggaggagttgatgcaccaggccgaacaggcggagagggcacgccgtgcggcggaggccgatttgatcgaactgcgcgaagcagtcaacgacctgtcgaaccaagtgaacagtctgaacggatacaagcgcacattggagggcgaacttcgagcattgcacgcggaattggacgaaacgctgacggaactgaagaacgctgacgaactgagcaaaacgcatccgcggacgcggcacgacttgccggaggacttcgccaaagaactgcacactcgcaacacgtggacagactacggaaggaggctgggactcccaaatcatgagatgcattccgccttggaaccagccgaaggcgcggccatcaaggcgggtaaaaatcatcgcccagctaaaggaacggatccgaaccttggacagggattggatggcatgccaagccgtcccccagaaaccggccaaaacttccgctaggcttaaccgcctgttcaaaaacttgatttccgggggggaagaaaacaaaagaac

SEQ ID NO: 89511 - DNA, 742 bp, Heterodera glycines
  SCN-specific regions: Sequence locations=1-69,91-315,359-742
gaaacactttgtgtaaaatgctttcccattctgcgcttccattcacacggcggaagcgttttctcgtccaaccattttttcattttcttcggtgattggcaaaatgctttccacctatgccctcttttatccgaccatcatctgctacattttctgcttccgcatttgggttgctactgcttcgacagcttcctaccgtacggcgggaccgaaaacgaaagtgccagacaaaaacgaatggatgaagcgatgtgcggcggaatacgagcgaaagtactgcgttgagacggacaccaaactgaaacagcagacgacgaagaacaaggagaagaagaagcagcagcaacagcaagacgaatcgccggaggagtattacccgaccaattacgagcccgccttcaattatgacaaattgcatgtgtccgatataacccttccactgacaattcatcaaaaggataaatatcaagcccaaaatggaccgactaaatacgaaccgaaggcggaaggacagcacgtgacgagttcagtaacaaccgcagaagcaggaaagtactcgagttcaagcggacacgcgagttcgtctgaaagtgaggaagaagaccgctgggaggagccaagaaagcggtcgcgaaaccgggaaagagatgagcgaaacggacgccacggggaaggtgaagacaaagcagcgaaacggtggtacaaaagcgacgagtcgaaggaagagaaaagagatggaaaa

SEQ ID NO: 89512 - DNA, 2486 bp, Heterodera glycines
  misc_feature (1514)..(1514): n is a, c, g, or t
  misc_feature (2472)..(2472): n is a, c, g, or t
  SCN-specific regions: Sequence locations=1-1861,1884-2373,2395-2486
gttcaaccaaacacttcaaagcttcattcgcgagttgtctccctgtttatcgcattcttcgagtccgtaatcgcttccgggatagggcgtttatggacgtgtcatttgacgcgactaccctcaaaaccaatccaaaattacaccggaagagcctttagaacatctattgcccttcacacttccttcgtttgtcgtccttcgcttggcactgctgaaaagtcactgcaccgaaccgcggccccgaacccgagcctcacaacacttggacgtgaacgcggagcctccttgggaccctgatccgaacgcaattacctgacattcgttcccgtacattggtgaaattgtcctccattattgttagtgtcccatccattgtctcgtccctttgtttctgccgacttcgtctttgaagcggcgttcttattcaacacgccaaaattcgtctcttttccaaccccaaaggccttttcctactccgtctttcgtcctcttccttcgtcactgtgcgtcctcatcagttgaaggtcaaccaggagcgtctctcccactttcggttccggaagttggccgccttcgtccgtcgtctgaagcgaccgccctaatttgtttgtcctttcattcattggcattggcaactcggcattatttgaattccaccaactacaacgatcagcgctcttttcttcggcagaacatgacaaacttcggcttccccccttcgcccacttttcacaccgttcgattgcgcgagggtggcaccatcacagtgtttcgagacgtcgccaacgacgagtttcgccggcgtcgtccctcggaatttgctgcacaaattgcggaaagcaaaagtgcaaaggatgactgtcgtccttttttcgtcatgaacattgactgcgccgttgcactgcttgaactttgggcccagtttctcccacgcgtgcagcccttttatgcgctcaattgcaacgcggacccaatgctgcttcgcttgatggcctctcatcagtctgttgggttcagctgctcatccggcgcagaaatgctcaatgctctccattatgtgtcggctgaccgtgtgtttggcgcctttccctgttggactcggtcggcactgcgccaggcggaaacgtgtggcgtgtacacgctgtgtttcgacagtgagcgcgacttggaccgcatcttggccaaccactcaaacgccagattgcttttgcgtatctgcgtggacccctgcgcgactgatgcgaatgcgttgttcggagccccgcttgacgaggcagtcgaactgttgaagctgtgcgttcagttgggcctcaattgcattggaatttccctctcaactggcccttccactgatgataattgcaatttgtcatcatcgtctcttttccatttctcttccgtctatgcgtttgccattgaatgcagtgcgcgtctgtttcgcattgccattgacttgggcctacggatggacgtgctgaacattggcgatgcttttgcttgtccttggtcatcancatcgactgaaacggacgagtcactggcgcatttcgcggagttttgtaccgaatttaaccggtccttcgatgtccatttcccgtctgatggcattggccatgggcttcgcattatggcaacccctggccaattctttgcgcgttccccattttcatgggtcaccaatgtgattggaaagcgaagcactgacgcaagtgcagtgaccaacaacgattttgatgctggcaaaaccgcttttcattaccagactaatgagagttattacggcacatttggctgtcgaatgatggtcaacaccgaaccgcgttgtgcaccgctttttaatgacttcgacatggacacggaacagaaccaatgcttttattatggaacagtgtttggtcagtcgggctttgacgacggctcggacacggacattgtccaatcggtttgccactttcgccagttgaacattggcgattggcttatttggtccaacatgggagcgtattcatttggcaattgcgggtcactggatgacgaaatcaacgacgacgatgacagtgatggaaacgaatttgacacactcaaaacgccaccgattttttatttcgcttcgcaagggaattgggagtccgtctgtcacaagtttgatttcgcctttcttgatgagcatcaacagcagcgtcgtgctggtccgttgtttgcgtcttccgccgatgagtacctttcggattcggacagtgacggaagtgtgggggaagcgatggtacacagtgacacggaagagacggacggaggcggaacggagaagtacgaattttggccggtcggatggccgacaaaatttaacgactaaccattaaattcgcctatccccctattttaaacagttatttttctgtttgccccatttaacatttctcatcctttcctgatattttcactcaattatcataaattagctttgcaaaaaanaaaaaaaaaaaaac

SEQ ID NO: 89513 - DNA, 609 bp, Heterodera glycines
  SCN-specific regions: Sequence locations=1-501,570-588
caatatcgcaaaaacggctcaaccaccacactcacccacgccaaccaaccaacgcaaagcacatacgactaggaactttatacaaattttaaaaaagtaatattttgtatatgcatttaatcaaatttctactttctttataaatgttagtttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtacctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcg

SEQ ID NO: 89514 - DNA, 659 bp, Heterodera glycines
  SCN-specific regions: Sequence locations=27-635
gagtacccgccacagatgggcgaagacgtgacccaagtggtgtacagtacgccgctctacaaattcttcaaatatgccgaaaaccgcgatgtggccaagcgcgtgatgaaggaccgcgagctgaagaagatccggcttggcatcgaaggctacccgacgcacaaggagaaaatcaagcggcgcttcaaccgttccgaagttgtttacaactatgtgcagcgtccattcctccactgctcctgggagaaggaggaggcgcgttcccgccacgtggactttgcctgcccaattgtgaagagcaagtccaacccgagtttggcttccgccgcctccgaccctttgccgcagcctgcgccgttgcaaaacaacatcaacaatgggtgggcggcggagaatggtgccggcgaacattcggccaatttccagcaacggccgacgaatgacaacgacgggagcagcggaaatgagaatgagcgtcaaccattgcgctctccgcccgcaaacgtgcagaattcggcagcggatgattgaggcttaatggtttctgatgatatttttcaatttccactctcttctgtctcattgtgttcctttgacgcatttattttctatgcattcgtaaattgaaacttgtcaaaaaaaaaaaaaaaaaaaaaaaa

SEQ ID NO: 89515 - DNA, 222 bp, Heterodera glycines
  SCN-specific regions: Sequence locations=1-36,58-222
agacgcattttctccattgaacgctttatccgcaatttgagtgagtgatggatggaatgtgattttcgatggaataggatgggaggacggaattttaagtcaatttctaattttaagattttttttggtggggaggattacgttttcaaccccaaaagtttgccatatttttgaacagggctgcaaactcgaactttttttttaaaacaaaaactttttgta

SEQ ID NO: 89516 - DNA, 840 bp, Heterodera glycines
  SCN-specific regions: Sequence locations=22-840
atttctgtttttcaaataatccaacgaaaatccgcgtaaaatgtctaataagcaacaaaagaacgcaaactttggacagagatggcaacttgaatcgaatacgtccggaagtgattcgaagacctttctttgggggcagccacctgattttggatttactgccaagactcggaatgatttggtcgggcctcttccgccctcacaaggcgtcagtccgtcgaaaaaaaagccgagttcaaagagtcgtgtagacgcattccgtcccccgtgggaggacagttcggaggaagaaaaggagggcaccgcgacagagggaaagggcacggaggaaaagcgctgggacatggaagagagtgggtgggggcagcgcacgacggaacaggtcggaagttcgtccgttccgaatgctgaagtcacaaatgtcgcaagtacttccgtcgatgttgaccaaaacaaagacaaaaaccgagtggcccagcagcctttcttcggtcggcggcgacgtgtcgtcagcgcttttgagaagatcgttttccgctcggctaattccggcctcaccattctcatgcccagggaccaccccgatttggcggcggcctttcgaattgcttccgagacgtactcccacgggtacaacactgccaacgcgtcaaaggcgttggaccgattcgtcaagcgcaaattgctttgcgtcgagcaaatgcaatgtttggcgaaggaggcgcctacggcttggaattcgacggtgcaaatttgcagaaaattcatcacagtgccgtcaatcggcgtacaaaacaccaaattcgaagggcacggggcgacgctcaaagaagcggtgga

SEQ ID NO: 89517 - DNA, 667 bp, Heterodera glycines
  SCN-specific regions: Sequence locations=1-16,38-667
gctttcaaattttccgtcccaccaccacctccacttccgcttccgctgctgtctgtctatctgtgccggttgaccaccgtacccttccgcgatgagcaattcactgtaccgtagtccaagcactgccggaggtgctctctacaaatcgccctcaatgagtgccttcgccggcggcgctccgttcggcgccatgtccgtggctgacctgggcagtctgacccgtctggaggacaaaattcgcctgctgcaagaggacttggagtcggagcgcgagctgcgcaaccggattgagcgtgaacgtgccgacctcagcgtgcagctgatcgcgctcactgaccgtcttgatgatgccgagggcacaaccgaccaacaaatcgaagccaaccgcaagcgtgaagcggagctgcaaaagttgcgcaaactgttggaagagtcccagttggaggccgaagacgcgctgaacgtgctgcgcaagaagcacaacgatgcttgccttgactacaacgagcaaattgagggattgcaaaagaaaaatgcgaagattgatcgcgagcgtcagcgcctgcagcacgaagtgatcgaactgaccgccaccattgatcaggtgcagaaggaaaagcatgcagcggaaaaagctgcagaacgcttcgagggccaggccattgac

SEQ ID NO: 89518 - DNA, 910 bp, Heterodera glycines
  SCN-specific regions: Sequence locations=1-538,578-692,714-910
cattgcgtttccgcaaaatgtcaaatttgaattttgaagacaatttgcaacgcgtacaagtggaaattcaatggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgtgagttatggcagttctcatggcacttttcgtgccatcaattcatttgtctcgagaatcactcaattgagactcattgcttccatctcgtcccccacccaaaggttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagacttcccctccatggaacaattgggggacggactttcacaagtgatggagcagttcaatctgagcaaatgcattgccattggggagggcgcgggtgccgacatcgtttgtcgttttgcgatgagcttcccccaactcgtcgtcggtgccgttttggtccattgcatttcgacaacccacggaatcattgccagcatcaaagagcttttcaccaatttgctccttaatgatggtgaaatgactcacagcgcgtggaattggcttttggtccacaaatttggaaatcatgaaatggacaaagaaaagcgcaattacgtcgatgcgatcaaagcgggcggaatgaatgaatacaatcttagcagatatttgtacgcattcagtcaccgcgacgaactcacagatcggctgaaggatcaactgggcaaagtcgacgtc

SEQ ID NO: 89519 - DNA, 917 bp, Heterodera glycines
  SCN-specific regions: Sequence locations=1-788,810-917
ttttaatccacaatttatgaaatatttgtattattcgagctgtccgaattgaaatgcccttcaaactaatcgcataattcgaacgggacgatgacagaaaacgaagacaaaaaagcaggaacaagggtatttaaaaaaacttctcccaatggaaagattacaacttatcttggaaagcgcgattttttggatcgtggtgaaactgtcgatttaatagatggaatggttctaattgacgatgactatataaagtcaagcaaaaaagtgactgtccaactccttgcggcatttcgctatgggcgagaggatttggatgttttaggcttgactttccgcaaagatttaatctcgcaattatatcaggtttacccagcaacacaaaacgagtccctaaggccgatgacgcgactgcaggaaagactgaagaaaaaactcggtgaaaatgcctttcccttttggttcgaaatccctccgaattcggcgtcttctgtcactttgcagccagcccaaggcgacacgggcaaaccttgcggagttgactatgaaattaaaacaatggtcggaggcgattcgacgcaagagaagcccaagaaacacaactccgtccgtcttgccattcgaaaactcacttactgtcctcaattggagcgaatccaaccgatggttgacgtgaccaaaaattttatcatcagccccggtggccttcatctcgaagcgtcactcgacaaagaaatgtattaccacggcgaatcaattgcagtgaatgtgcacatccaaaataacagcaacaaaactgtgaagaagataaaagttactgttcaacaaatggcagacatttgcattttcacaaccgctcggtatacttgcgatgtggataaaattgattcttgcgaaggttttcccgtcgggccgggttc

SEQ ID NO: 89520 - DNA, 1035 bp, Heterodera glycines
  SCN-specific regions: Sequence locations=1-151,173-1035
gtttgaggttaattattttgtccgtcctttttgtcccactcaaaaatgctcagtcgaatgttgtcctcggctgttgccgtccctcggatgtgtgaatcaaacaaaaaattgttgaggaaaggcgcgactttcgttggtcttctctgtgggcgaatggccaactcaactttcactgccacagttacccctcctcatcggctcttacgtccgttgcatatcaacgaaaaaaaattgttcggacctggtcccagtaacatgccaccactcgtccaggagggactcgttcaaccgttgcttggacatatgcatcccgagttcttcgaaattatggatgatgtgaaagccggcatcaaatacattttccaaactgagaatgcgctgaccttcgctgtttcgggcactggccatgccgggatggaatgtgccattttgaatctgctggagcctggccagaccattttggtggtgcaaaacggagtgtggggcttgcgggcagcgaatttggcggagagacttggcattaaagtgcatcgattggtcgtaccggagggagaagtgattaatttggacgattttgccgaggctgtggataactaccgtccccaagtggcattcgtttgtcatggtgaaagttcgaccggagtcgtccatcccttggagcgttttggcgatatttgcaatgcatatgacgttcttttcctcgtggacaccgtcgcctccatttgtggtgcccctttccatgccgatgcgctgaaagttgattgtgtgtatgccgcaactcaaaaagtgttaaactgcccgcccgggttggctcccatttcattcagcgaaaaagcactggagaaaataacgaagcggaaaacgcgagtgccctcattttatttcgacgcgttagagttgggcaattataggggctgtttcgacgaggcgagaagataccatgccgcggcggccatttcgggggtttgtgcgcgacgcgaaggtcttactgtaggtgcccaataaggaattggacacattggggaggcgcaccga

SEQ ID NO: 89521 - DNA, 641 bp, Heterodera glycines
  SCN-specific regions: Sequence locations=1-641
gggtccgggcagaggccatcatcgcagatcgattaagaaaattgggaccccatcgttcatgggccatttgttgtcgatggactcgcacattcgatggcccgaatgcaagacgcctggcccacatttgcgaagtcaagaaatgaaattgcctagcaacattggacagaagaaattgtccaacattggactggttgtgacaactcgaaaaattgcctcaattggtcttgaatatccgcacgcttacgaagaaattgtgaagcagtacaacgactttcgttcccacattgttctcctgcaagatctgaagacggcactgcacaacactgagcttgaacttgaccaacttgccgcccaaatgccagccgataaagaatgtccaatcattgagccacgctttcgtgtgagcagcacattctacgaggaattggaacggagtccggtgagggtgctgaacacgccaatgactgagggaggcaaaggaaaagggaagggcaaacagcaactgaagccggcaccggtgaccggccgagcgatcaccaaaatgattgaagtgaacacagcgccaacaacagttactcgtaagagacggatgcactaccccgagggaacgccgccaacccggtctcaaacggccattcacc

SEQ ID NO: 89522 - DNA, 623 bp, Heterodera glycines
  SCN-specific regions: Sequence locations=1-186,208-485,509-517,539-623
gttgtgcaaaatttttttgtaataaaaactatgaaaattttttatccggggttttagaggttgctgatcacgaatttgacatctaactcgaggtcatggactccaagaaccccagggaattctttttaattgggaaatcgacaataaggaattcccggaaacttttccgttctcgaaaatcgcatttgtcttcaattaattccttgcagaaagtgccactaccagaaaacaggacactgcacaattggagagcgccgacttagcatttgccaatttaatgcaggcggaagagcgcgttcacgagcgggagcaggaacaacggttgaggaacagccaaagtgttcaaatggaggtcgacaagttccaatcgtcgcaaagtttgaccgggaaaaggacgcacaaattcacactttgggtcgacaaatacgcgccgagcacctttctggatttgttgaccaaagattgctgttatggctccgtctttgggatgaatgtgtttttgagaaaagaggaggcaaaaaatgggaggggaaccaccgacgcatttcccagcggaacaatgccaatgcgacgtctctgtgggacaatttggaggagagggaccgaacacttcgaaatgtaac

SEQ ID NO: 89523 - DNA, 758 bp, Heterodera glycines
  SCN-specific regions: Sequence locations=1-49,71-758
attcgatgccatccaacgcacagaaagcggacaaaacaatggcaaacggaaaacaacaaacgatcggtgaaaagcaacccgaacacaaacggcgtgtgatgcgacatcggcacattcgcctcaaaccgaatattcttaactcttcggctgcagcgaacgcttccatgaaaagacacccgcagccaaacttcgacacaatcgaagtgctcgaggaggagcacgagttcgaggttccaatcaacgaggaggaaatgatgcgctttcccgggatggaggaaggctcacaaaagtcggacaaaatcagcgtccacaggaggttttggcagctgaattggaagggcgtccacttctccggccttcccacttggctacaagacaatgaattcctccacttcggacatcgacccccacttccgagttttggttcttgctttaacagcattttttcacttcataccgaaactgggaacattttgacacatatgtacggtgcaatagcattcattggcattttcatttggtttttggtccaagccgaagatgtcgtcagttggcccgacaaattgatattctcttctttctttgttggagccattctctgcatgggaatgtcttttgcctttcacacagtccaatatcatttcgaagatatcaacaaattagttacaaattagactattccacatgtgcctactatcattaactcatttatcccttaactctattacgcatacttctaccaatgtctcccgagacca

SEQ ID NO: 89524 - DNA, 685 bp, Heterodera glycines
  SCN-specific regions: Sequence locations=1-408,443-501,523-685
aaaacaaaatgaaaaacgcgtagaaaatggacaacaaaaatgtgttgagaacaccaccgggaacagcagcaattgggtgttcaccaccaccaccgtcaacaatcggaaattgctgatgatgcggaggaggaggagaagccgacgatttggagcagggcggaggagggacaccaccaatgccaatgccaacaaaacaacactcacagaggcgcgactgctcctgggacatggcggcgaccacctcggtgacgagtcgcgggtgctccttgaccatctcggcccagccgtcggtctaaaaattttaaagaaatccatgggaaattggaaaggtgctaggtcgttatttaaaaaaccatcattatgatttttgggccccggggtcgtttgggccccaacccaaaaatagaaaaatgtacttttttaaaaattaagattctaaaaactaagcctgagggatccctcgccacttggcataagctaggtttaattaacattcgctcattttttacaattttacttattccaaatcctattattttttaatagttaaccaatttgatgtgcattctgatttggacatttttcagaaatggctaacccaattgcaaccaaaaaacaaaaagtaaaattgtcttacgaaggccttctaaagaccttcgctaaaatgagttctgatgggatgaca

SEQ ID NO: 89525 - DNA, 1924 bp, Heterodera glycines
  SCN-specific regions: Sequence locations=1-138,176-340,362-362,398 -515,538-637,663-846,872-1863,1895-1924
acaaccaagagcccgtgaccaagcgaggcttctgccaatttgtgttggacccgatcttcaaagtgttcgacgctgtgatgaacatcaaaaaggacgaagtggcgaagttggtggagaagctgaacatcaaactgaccttggaggagaaggaacaggagggcaagcccttgctgaaaacgatgatgcgcaaatggttgccagccggtgacactatgcttcagatgattgtcatgcatttgccatcgccagtcactgcgcagagataccgcatggaaatgctgtacgaagggccgcatgacgacgaggcggcggttgcaatgaaaaactgcgaccccaacggaccactgatgatgtacatctcgaagatggtgccaacctctgacaaagggcgcttctacgctttcggtcgcgtgtttgctggcagagtcgccactgggatgaaagcgcgtatccaagggccgaattatgtggtcggcaagaaggaggacctctacgagaagaccatccaacgcacaattttgatgatgggccgttacattgaaccgattgaggacattccggccggaaacattgcgggactggtcggcgttgatcagtacctggtcaagggtgggaccatcaccacctacaaagacgcacacaacatgcgcgtgatgaaattctccgtgtcgcccgttgtccgtgtggcggtcgagccaaagaatgcgggcgatttgcccaaactggtcgaaggattgaagcgtttggccaagtcggacccgatggtccaatgcattttcgaggagtccggtgagcacatcattgccggcgcaggcgaactgcacttggagatctgcttgaaggacttggaggaggaccacgcttgcattccgctcaagaagtctgacccagttgtgtcctaccgtgagacggtcaccgaagaatccgaaattgtgtgcctctccaaatcgcccaacaaacacaaccgtttgttctgcaaagctaggccgttgcctgatggactgccggaagccattgaacgcggcgacgtcaatccgaccgacgacccgaaaaatcgtgccaaaatactcaccgagaaattcgaaatggacgcgaccgactcgcgtaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgcgatgagaacatgcgcggcgtccgttttgacatccacgacgtcacgctgcacgccgatgccattcaccgtggcggtggccaaatcattccgacggcgcgtcgtgttttctacgcttcggtgttgacggcaaaacctcgtctgcttgagcctgtctatctcgtggagatccaatgtcccgaagcggctgttggtggcatttacggagttctgaaccgtcgccgtggtgtcgtctttgaggaaagtcaaattgccggcacaccgatgttcatcgtcaaggcacatttgcccgtcaacgaatcattcggattcactgctgatttgcgctccaacactggtggtcaagcgtttccgcagtgtgtgttcgaccattggcaagtccttcccggcgacccgtttgatggcacttctcgtcctggtcaagtggtcactgagacgtgaaaacgaaagggattgaaggagggcattccatcgcttgacaatttttatgacaaattgtaatacatggatttaaattatggcggtgtttttgtttgttggctgacacaatacacttgttgtccttttattatgaaatcattgtggtcgtatgtaattttatcttgttaaaaaatttaatgttaaaaaaaaaaaaaaaaaaaaaaaaaaaaaaatcgagactagttctctctctctctctctct

SEQ ID NO: 89526 - DNA, 647 bp, Heterodera glycines
  SCN-specific regions: Sequence locations=1-647
ggtggggacgcagtgccccttccgagtgcagttgctgactccccttttctcgaggtcgatttgaataggacattaactccgcaatctcaatggacaaatgagtcgactggcactatgcatcctatcgttgacactgagccgaatccgatccgagacgcacatgagccaaatcacattttccactattcaccctcatcacactctcccgacgacgacgaaagcagtcaaaacggacagagttcgtcctctcagtcagcgcccatcagctcagctttagacgcttccttgactaatttatacaaggaaaaggaaaacgacgaatgtgatgatgaacggagcatgccgagaagggcgtcggagagaacgctggacagatttgaggacgtgagaacgattgcctccagtgacattgaagttattcgccaaatggacgattggtcggtcacgagcagttatccgaacagctcccaccagcagagcaacacacagaaaattggacaaattcggtcaataggagaacttcagcaaagccaaacaccgccagagttaactaccaaattggacacttcagaacaatctcagcgagaaatggacgagaaaattgccgtattaatggccaaattggcgcatagggaccaaaagataga

SEQ ID NO: 89527 - DNA, 972 bp, Heterodera glycines
  SCN-specific regions: Sequence locations=1-1,96-213,288-370,395 -717,739-805,827-972
tctcctcctccccctcttcgtcggattcttccacttcctcctctttctccgcctcttcctcttcttcgtccgcttccgcttcgtcctcttcgtccggcttgaactcatcggcatctccttcttcggacctgttccccaccgtccgctggggtcgtgccaacgcactcaccgctctgtctgccagtctgccgatttgtgcccccgcggctgtgccctcttcctcctcatctctctgctcggtctcctctccctcgtcctcctcttcctcgtactgcaactcctccttcaatttcttgcgcatattcaccgccgcctttcgcaggggccgccccgtctccgtccgctcgacttccctctccactaatgtctcctcgtcttcgtcgtcttcctcttctaaagaactcgcttttggcccccattttctgtggtgcgtttggcttttgggtgcctttgacttttttctgctcgaaggcccagcttcgcagtcagtgtcactcagttgcaactcattttcatcatcgctactgctcgacatttgtctaattttcatttttggccggttattaggcgggaaaagtaacctcttccgtttttttgctcgtccgattcgctttccgacaatccctttcttttttgctgaaggcgtgtaatcgctgtccgaatcgtcgttgataaattcgtcgtcacttcttcggcgtccctggaagccaatgccccttaaaaatgttttggtacttttttgtggctctttgccaaatcacctcgcagatcgcctttccgagggaagatactcgtcctccgatggttctgggtcctcttcattttcatctgcactgctcgccttccattcgtcctaatttgctatgtctccggaatggcatttctcactaaccgtgtccgactcggacgcattgccaatgtccaagtcggtcagtcttttgccctttcgtccgcctttcttcgtcgttctgc

SEQ ID NO: 89528 - DNA, 682 bp, Heterodera glycines
  SCN-specific regions: Sequence locations=1-489,511-682
gaacgtttatttttgaaaatgggccgacggaggaaaacggcgcctgcccttttgcgcaacaaacggacgcgaattgacgaggacgaaatggacgaagaagaagaaggggcatggaatgggcatggccaccaaaatatgggacttcgaccgagaaagcagatccaacggacaatcagtgcccagtgggccccgcgtctgcgcgaaaggcaccaaaatggacagaacacaacggaggaccaattggcggacatggaattggaggacgtggacatggatgaggacgaaatcgtcaaaacattgaatatggtgttcaccaacctcgacctctcccaattgcccgctttgtctcccggcgccggactttatgcaatggccaattatgcaattgaagagaaatccatcccgaaaagaaaggcggcggagaagaaggttcccgaggatgtgttggagcccactttcctctccctggagcaagccatgcaaagagatcagaatttcaaggggaagctgttggacgcgttcttggaggacttccgggagtattttcagacgtatttctcccgtccgaattcgcaaacatttgacaaggatttgtgtgtccgtttccttcttcaacacttccctttctgccgtgttccgctcattgaacgactcgccgacgaattcgccggtcgttacgccg

SEQ ID NO: 89529 - DNA, 655 bp, Heterodera glycines
  SCN-specific regions: Sequence locations=1-605,627-655
attctttaaaaaacagcctgaagatgttccaaatgcttttcaaacgactcgctagccaccaatatatcgtcgatgtaaatgaagacaaaatcgttaagaattccatcaaacagccgagtcatgaatcgctggaacgtggctactgcattcgacataccaaatggcatgaccaaatattcgtaaagcccaaactctgtggtgaacgcggatttgctgactgagtcagggtgcatttttatttgccaatacccactcatgaaatccatcgtactgaatacttttttattgcccaacatcatcaaagtgttgtcaatatttggcaaaggaaatgcgtcttttactgtaattgcgtttaggcctcggtaatcaacgcagaaacggattgttccgtcttttttcgggactaaaacgatagggcttgcgtaaggtgaccaggaaggccgtatgaggcctctgtccaaatagtcttgtagcatcgttgccactttttctcggaatgcataagggacgggccttacacgcattttcacaggaggagctgtcccagtttcgacgtgatgcattacgaggtcagtttgtgtcaattcctggtcctcaaatgcaaatatttcctcaaaatcacaaatcagttgacaaattggccgttgttcatctt

SEQ ID NO: 89530 - DNA, 579 bp, Heterodera glycines
  SCN-specific regions: Sequence locations=1-152,174-579
aaatttacattttggacgcaaacggagacaaacagccgatccatgttttcgaatcactccaccaacacccggtcattctcatgcagtacacagcggcatttgatgtagcaatttcctttgacgaaattggaatggttgaatattggtcaggcagcagaaatgagttttcatttcccaagacggtcaatttcgaatttaaaacggacacggatttatacgaattttgcaaaataaaacaaatgcccaaagcattggccatcagtccggacggacggacattcgccgtttgggtgttccaattcgtacatttacatttttgacttgagaagcggcaaaataatcaaaaaactcgacgaaactcttcaacgatacatcgaaatgggaaaggagactaagggcaacggactgccggcgatcgaatggaatcgccgtgttgcgctcgaaaaggaaatgagccgtgacccgaacgcactgcgattcatcagcatcacttacgacgcctccagcaactttctcatcttcccaactccgctcggcataaccgtgtacaatttggtcagcgaccaagtggcaaggcgt

SEQ ID NO: 89531 - DNA, 648 bp, Heterodera glycines
  SCN-specific regions: Sequence locations=1-648
gtgaagcaacaggaacgcatatcttttcccttctcagttgactcaaagcgttttttacttttgcccaccgattttgtggatgaaaaaagcaaatttttcaaccgtcagtttctcaccatttatcgggcacggattaattgtcttaaagacttaattaaaaaaaatgcgcgaaatattcttgcttctacctccaataattctgttcaaatcgatgatttatcaaatttttctgccggcaatgatattttgctgatcggtgttgttttcaagaaaatgaaattccgtcaaagcattctttacgagttttcggatgattcgaatgttcccattaaaatggggagaaaagcgggcgacaacctttgcgatgacgaggacatactccaattggaggacgaccagcagactgttaaattgcttggaaacattgacaaacattgttttgtcactggcgatgtcattggagtgatcggctgtcaggaggatgtatcagacaattttgaagtgcgaaggattatttacccggaaatgagccctcaattggaatggcctttggttgagcatgattgttatattgtttttatgtccggcatttcattagttggcaattttgacaacgatgttcaaacgttttcggcactgatgcagttt

SEQ ID NO: 89532 - DNA, 640 bp, Heterodera glycines
  SCN-specific regions: Sequence locations=1-303,326-640
tttaaacgaaagcacttcgcccattggtggctccaccagcagcaaaatgagcagcagcttcaaccagagctcctcctataatcgcactttcgaacgcaaagtgatcgaagagagtacgccgacaatgaccacgcggatgttcacctcatcaccactgaacacaatcaagaccactcttggctccggcttcccctccgacttgggcggactcggcacgggcaccggcaccaccttcgtccagccccacaactaccaattcggcaccgccacctcgggctcgttccactcgtctgacgacagtctgtcggtcagcatggactgtgccatgtttgcacccgaagaactgaaggtgtctgttgtgggcaaccaaattgttgtggagggaaagcacggcgaaaagcaggactcacttgggtcgattgagcgccaatttgtgcgcaaatttgccatgccgcgcaacgccaccgccgactcagtgaacagcaatttgaccagcgacggaatgctgacggtgaccgccagcgcaccgaaagcaaaggataattcgccgattcgcacaattccggtgaaaattgtcacaacctccgcgggcggacaaacgccacaggaatgggggaggccaatttcaacaaaatggcag

SEQ ID NO: 89533 - DNA, 836 bp, Heterodera glycines
  SCN-specific regions: Sequence locations=1-29,54-54,83-402,441 -502,527-527,556-836
ataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaa

SEQ ID NO: 89534 - DNA, 699 bp, Heterodera glycines
  SCN-specific regions: Sequence locations=1-699
ccaagtttgaggtcgacacaataaacatactcttattaaaattgtgcccaacttggtctatttgcctggacgaaaaccggcacgactcatcgctctccgatcggtcccgaccccctacattcccccgaacggctactctgcgcgcctcgcccatttcatccccttcccgtccccttcaccccgcagagttcgacgcaaatttcttgtcgccacgacattttttgcctatcaaatattcgcaataaatgcccatctatttaaaaaatattctattctattaaaatgttctgtattttgctatatattaagaatagccgtacatctaaaggagtcagtaattgaacaaatttctcaaatttcaagaaaggttcaggcagtcgccgtaaaaattgtctatataaaaacaatggcgatacgcatttctgcactaggtcctttttcaaaattgatgtgcttttattgaaaaacatgtttaacgggccacaaattaatagacaaattcaggcacattcttaaaaaattctgcttttaattagttcatttaatagattatgcttttgctttgtttttttaaattctacgcccgcgattatctgataggacaatgatatcaataaattttcttctgaagaagcgaagagttagcccaaacgttttccttcctttctatttaatgatctatcatttcagatataacag

SEQ ID NO: 89535 - DNA, 869 bp, Heterodera glycines
  SCN-specific regions: Sequence locations=1-277,300-301,323-869
caagtttgagctcagatattatgccatttttattcccttccattgttactacgaataatacggcgtttaatcggattaacgacaaatcagcaaatgttcgccaaaaattggatatgatggaaacagcgcttgtgcacctaacgactaacaaatgtcagcttaatttcagtgccgaaaagacaagatccgatattcgtcgggccactgacaagcacatttctatgttgcgtgaacgcgaattaaaactgtttgaagaggttgaccacattcatcagcgagaacaacagcttatagaggaacaaatggaacaactcaaccaagccattggcacttctaaatttgtggtggagaaaatggccgcatttgctgatgaaaagaatttagaagaactcatttctgtggaattggaccaaaaaatcaatttgcttgataaattggcaaattcgtccaaaggtaccaacatcgtattcagtgccgcttttcaacagaacatcccgcttggtcaaatttatgttggatttgccggtggttcggcttctcctcaggcgaatgccaacgacggcgtttcgtccgttgcttcagatcagcgactacactttgagaatggcagcgagatcagtttcgatcaatttgtcaacagtgcgctcagaggagagacatcggtcaaaggtggcactgatcaggccaataatcacttggccaattgtgcagcaaatggagtaaaaagagaaatgttggtgccggacgcgacatttatggacaaacttcgggttgcgatacgaaacatcatacaagaatcgccgcccaatagcaaatggaatacattctcgagaatcaggcagaatttgtacttcgatataatttgtcag

SEQ ID NO: 89536 - DNA, 1105 bp, Heterodera glycines
  SCN-specific regions: Sequence locations=1-38,60-171,193-336,358 -523,545-1046,1068-1105
caagtttgaggctaaagttttcatttgacttccccacataaatactgacaaaaacaaaacgcccccgcattctttgtctaaccgactcaacgttgagacatggcctctgttgatgagaatgagcagcttgtgcaggaaattgtcgggaatgttctgtcggaatcagcaaaagaccaccagcaagaggagggaacggaacaccaattgatggacgaagtcgtcaagatggacagcaccgatgccgaggcggaggaccatggagggattggacatgaagtggcaatttcggtcagtgacgtcaagcaggaagggtacgcagtggaaagtccggtgggagaggaagaggagaaagaaacggagggacaaaacgacggcgcaatgcgacagattgccgacaaagttgggggaactttcactggacgaagacaaaacagcgaacaccgacgccgtcgtggaaccgccgatggccacggaagagaaggcggcggacgttggcaacgacaaaccgtcgggagagaatttgaatgaggaaaacaacgaaagcaaaggctatcaatcgccagtgtcggaggaggagcaccccattcagcacgtcgacgcaaaacaaccgactgttgacgaaggacagacccatgctgctgctgctgactctctgccgccgtctgaaccgaccaccgattcttcagcggaaaacgatggcaacaacgaaattgtctctcccactgcgctcgagccacaattggtgcccacttctgatgaggaggagcagaagccaaagaatgccgtcgaagctggggacgatggtgccgccaaagacaacactttgagcagcggcggcgccacggcttccgacgaaacggccgctgtcgcggcgttcagtgccggcactcctccgccggttccggcggttggccagcagcctcaacagcaaacggagcaccaacttagccaacatcagcagcaggcggaactgtgcggagcgaagacggcggtggcggcggagtccaccgcccgcgacagtgccgaggacgaaacggatgcttcttcgtctgctcgtcaatctgtcccggccaaaggcggcactgacggaaaggcgcacggcggt

SEQ ID NO: 89537 - DNA, 656 bp, Heterodera glycines
  SCN-specific regions: Sequence locations=1-553,575-656
gagtaaacctaagtaataaatagtcaaactaaatcttcttgctcgtcctcattgctcaatgcatacaacggcagcaccgccacctcatcagccttctgttgtcatgtcggcaattgatgacaacaattcggtgcgctttccgatcattcaagtggaagtgaaaattcgagtgcctgaccatcttgtcggtcgactgatcggcaaaagtggcatctgtgtgaagaaaataatggaggacacccagtcgcacatttccatcagcgaatcacgaagtcaacaggaggtgaatcagtaccaaactccggagctgctcgaccgaatcatcaccattcggggcactgcttttggctctgtgatggcggccgagaagcaggtgcagcagaagttgcgccacattcaggaacaggacatgaacatcagcgggggaggcggtggagtaagcgcagcaagcggacggcagttctgccccacgcctgtgcctgctccgcccggtggcattttgcagtctatggacggcggtggaggcgctgccattggttcgtacattgctccgtcggcggtcactgtgacgggtgcgccaatgctttcccgtggtccgccggacaatgccttccatcaccatcctcccacagccgccgccatgtacagtgcgcaat

SEQ ID NO: 89538 - DNA, 633 bp, Heterodera glycines
  SCN-specific regions: Sequence locations=1-97,121-131,153-633
cttctaaaaacgttcgatccattgcaaattagcgcaaaaatgttgcacagttttcgcggtgttcgcctttcttcccataccaacaacacatttgagttctcctcctccttctcgtcgtccacttcaacaacaacaaaacgtacaaaaagcagcaacagcaacgaggatggcagaacgccaacaaacggcaaaaatttgtcaccaaaaaaacgcaaccattcacaacagcgtcagcaacagaacgacagcaaaaaaagcgcattgtccacagatttgggcctcaaatcagtggtggtacagagaaagctgaacatccagacgaattattcactgcgtgcagtgcgcaagaaaatcacggcctccaacgaattggtggtggagcaggacgaaggggtcgcaaaggccaaaccgccgaacgaacaccgctacaaaagagccgccaaagacgaaaatgaaaatgacgcttttggcgaggacgacggggatgaaaatgattacgatggtggtgaagatgagcatggcatttggctaaattggcgcgccaagaaacgggacaaccaaagcaacaaattgggcggtggccaaaattcgcaaattggcacggaacgggggtcggcacaggcccgactgatg

SEQ ID NO: 89539 - DNA, 349 bp, Heterodera glycines
  SCN-specific regions: Sequence locations=1-257,279-327
caagattataataattataatgttcaagaacattttcttcttctttttaattgttgcgccatttattgctgcttataaaccaagttgcaaatgtcccgaaaatgaacagccaggccaattgagttgtaacggatgtgagccgagttgtgacaatcggaaaccggaggtgtgcaccaaaatggcatgtgaatgctcatgcgactgtgtgccgggattgctgcgagacaaaaagacgaaaaaatgcgtgccgaaagagaaatgcccttattaaagaggacaattgagtgataaaaaatgataattaatgcatttggagataattagtgaggaataaattaatgttgaaaaa

SEQ ID NO: 89540 - DNA, 749 bp, Heterodera glycines
  SCN-specific regions: Sequence locations=1-572,606-749
tgccatttgccgtttcgccctctttcaactttttgcgtcgtccgttccctttgttggtctttcgtcgttccctttttaaaccgccattggactcaccgttctgtggcatttacaggacaaaaatggctactaaaaatgggagaattccttatgaattgcttttcgaactcatttccgctcttccgtttcacattcgatgggccgtcacccgtgtttccaaggcttttgatggttttgtgtggcagaagcaattttcatgggttagagctgagctgatccgcaaggaagcacaaaggcaaaaagaaggcggcgcattcctccaaatggttgattctctttcgacggctgtcaattcgctttcggaggcttctcactcgctttcgcaagcttctcactcgctttcaaactcggcggcgcaggaaatgcacaaaaaaaacaaatcatggttcaacttttttacaaagcaggtgtattcaatgcgagacgaaattaatacaatgaccgctgaggcccaaaatgcggacaaagaggacggaggaaatgcgggcgaaggaggagacgccgccggaggaaacggggccgacaaaaagggggccagaaagaggcaccacggtgaacgttgaggaatcttttgcggaatggctttgtcctgtttcaaccacggacttggtttattacgatttccttgaatttttttgtgtaatttctcttctcctaatcagacaacgcattagagacggataaattat

SEQ ID NO: 89541 - DNA, 655 bp, Heterodera glycines
  SCN-specific regions: Sequence locations=1-554,577-655
acgccatgaattgatgctgttacggatgagcgatgtaatttcgaatggattgggaaatcaccgtcccgataatgcatttgtcttcccaacgattgcacaacatcccaacgaaatcaaacccacaaatgcgatgagaagttcaaacccattggttggtctcgcttcgtcacgttcatctactactgcatgttcatcattgtccgggaaagatgacgacgaacaacagctacagaagtgttcgattgatgcagcaacactttgtcgtaatctgatcagattcgcctaccaattgtcagctgctaaacgacgaacactcgaagacccggagctgtatcggatgcgcactcactcaaaaacggaggagagactgagacggaaggttgtcagagacatgattatggagtgagttactcgaaaagagggcctgacccacttctgaccgcgaacttatttattcctttcttaagaatgcccggaaagttggaccatgcctcagtggtcgcttacaaagttggaaaatggcctcgccacgcagagagtcattcactgagaaggagagtaacggaatgggaaggagggatggaattggacggagttttcatggaaaggcacggataccgtgaaccaaacgatgaagacgatggtggggcgagaa

SEQ ID NO: 89542 - DNA, 1374 bp, Heterodera glycines
  SCN-specific regions: Sequence locations=1-1011,1034-1374
tttatctttaaaatgattccggactcggcgtacatcgaaatcatgaaaaactgctcaaaatggaatagccgaacaatgggtggtagaactcggtcacaaacggctgttttcgatcaacaaaccggaattgtgcacagaccgaccgagcatttgtttcgccatccctccgaacgctgtcgggctcaaaatccgatgcaggtcttcacttatccgcctgtccgatgggttaaacccaaaaataatccctcggccggcatcgaaatgaattattttatgcgtgcgaatccttcactgaaaagcgcaatatcatcaagtgttgaacagccgcaaaatgcctcaagcggagagcaacaaatcgcagaggcacaacaacaaatcggcaccaatgttccgtcagttcgaagtgccaccggcggaagtggcacaaagtcttacattgagaatgaattggacttggctgaatacgacctcgatgagttggaaaccaacgatcagtcggacgaggaagattggggagccagtcgaaaaaaacgcaagaagacgggaccaggttttggtggaaatgtaccgggccgaactgcgcgaaaagtaccgtcaaacatttcgtctgcgaccgccaaaaaggagcagccgactgacaatgggtcaaatgggggaacgcctactgcagcaaatgtcatcggcggcggcgcgggggtcgcaacgacagccacggaaacgcgcccttacgtttgccagttgtgcggcgccaaatacaaatcgaggcccgggctcgcctaccacaaattgcacgttcatcaatcggactcgaacaatgagacgccgaaaagtccgataatctcgccgaaggtgcaagtgtctgaatattgtgacttttgcctgggtacgaatttgcaaaatgcggagggcgaggcggagccgctcatttcgtgccatgattgtggtcgttctggacatccgacctgtctcaaattcactaaaaatatgctcgtctccacaaaacgttacggttggcagtgcatcgaatgcaaaagttgtgcaatttgcggaacatccgaaaatgatgaccaacttttattctgtgacgactgcgaccgtggcttccatttgtactgcttgaagcccccgctgaaagaagcacccgagacggattggagttgccatctgtgcgtgaaggaattcggcgccgaagcgtccattgcgaaggcgacaaaaagcacggaagacggcacatcatcaccagccaaatgaccaaaacataatggaaacggggagaattgacaccgtaagacatttcgaattttcaattttgttgcccatccaacaaactaaccataatttgtttgtaatttcggatgaatgaagagatggagt

SEQ ID NO: 89543 - DNA, 575 bp, Heterodera glycines
  SCN-specific regions: Sequence locations=1-371,393-575
ctttcaacgaagtcggctcccgagacgcgctttttttactgtccgttcttcagcttcatctgaccatttcagtgaacattgctacgatcataacaccaaaatttatgatttcttccgactcgcaccgacgcgcgttgggagacatcgccggaatgggcgtcagcggaagagcgcacccatcgctggccaaaatgcgcgagaatttgatcaatggaaccatcgactttcaggaagtgccgatcatcgacatgaaccccgaggacattcgggctgagctgaagagagtctacacgcagttgaggatgtacaagctgaagaacgcataccaggacaacccgcacatcagcaaacggaaaggcggcggtgccgtaaagaaaagcgccgcgggcgatgcgactgtaagcggaagactgtcaagcggcgcgggccttagcggtgcgggactaccgaagggcgtccgcggaacggagggctattgtgccgtaaaacgcaattccatcccccgtgaggcgacaccgaatgctgttacatcgccaaagcaattgcatggcgctgatcgcccgcctccgctcgtt

SEQ ID NO: 89544 - DNA, 132 bp, Heterodera glycines
  SCN-specific regions: Sequence locations=1-97,119-132
tacacacatattcgcttgcccctgatgagtttgactaattgtaagatgggtctctctgcttgctgtttactgttgggcaatttgaatttttgcattcattcaaattcaaatgccacccgtaaatgggtcatt

SEQ ID NO: 89545 - DNA, 614 bp, Heterodera glycines
  SCN-specific regions: Sequence locations=1-614
gtgagttccgctgctcattttttgtttatgctcaagtcggctgttctgttccttttgaatttgttctacccttttgctaatttctgcttggatttgttgcccaattcgtcccccatgggctccaagtcgacccctgcaaccgccgacgtcgcttatgccaattatcggctgtttgacgaactgaacaggaaagtgcgggaaagtctgagaaaggccatcgaagctgacgagacgaggattgccaaatcgcgagtgatcggactgtacgagaatgtgttgaagcaaataaacaaagcattggagatacggcacacttcgtgcccttcacacaagcagacggaaatgcaggaacagcagaaaaaattaaaagcctttgttggacagacgaaggatcggctggaaaagttggcatccattgagccgatggcgcttagagcgacgcctcttccactggcaacggtcgaaaccggcaacaacagagcaaggagaatgccgtgcacttccacggaccaaaggctcgtctcaaatcgtcaaaatttgtccaaaatgtctctgctgaaaagcgtcgactccaaactcggcgatgaaattctcgccaccatcgtggaaacgac

SEQ ID NO: 89546 - DNA, 1138 bp, Heterodera glycines
  SCN-specific regions: Sequence locations=1-119,141-173,201-354,379 -1138
ctgaaggtgtccgttgtcggtttggaacgcgcgttggagcagtacacaagtgctgctcattttgatgctccatttgacctgaagcaagtgcctttgtccactgagccgttgaccgcttcaaccgatgaggtgaaaaagaaagcggcgatggtggacgatgcatcggctgccatgaaaaagcagaaggaggagaagaaaagcggtacttcccgacaggagcaatttgcacttcaattcgcgtccatgccggaatttgccgcctgcggtgccctgttcaagtcgtgtgccgcggttgagctcaccgaaaccatcactgaatacaatgtgtcatgtgtgaagcacattttcaacgacgactttgttcttctgcagtttgactgtcgcaacactttgaatgaccaactgttggaggaagtttttgtcgaaattgagccgcaggatgagggcgaagattgcccttggcatgtgcaaagtgttcacccgttggcccagttgcccttcggccagccttgcaccacttatgtgctgctcaaaatgccggaggacggacgcattgccggcacattcggcgccaaactgaagttcaaaatttgcgacgtcgacccggcaaccggcgagccggaaagcaacgatttgtacgacgaagtgtacacgttggagcccatcgaagttggcctcgccgactttctgttggccaccgcgccgaagggcgcctcatttaccaccgcgtgggacgcgctcaaggaggaggggcacgagacggaggagtcgtacgcgctgtccaatgtgcacacattggaagatgccgtctccaaactgctcaaatgcaccgcccttttcccttgtgagcattcgaatcgggtgccggagggcaagtcgtcccaccagctgttgctgtgcggcattttccgtggcggcatcgatgtgctgtgccgtgtccgcctggtcatggacccatccgaccagacggtgtccatgaacatggttgtcagatcaatggacgaaacagtcagtcaaatgatcgcaaacattgtcagctgaggaacggcaaaaaacattcattcatctgttgttacatcaatgataatatttctaaatttacactatttgattgatggctggattttatttatttact

SEQ ID NO: 89547 - DNA, 586 bp, Heterodera glycines
  SCN-specific regions: Sequence locations=1-53,92-188,293-555
tccggccaagagtgcaccaccggacagtgttgtcgtcgttgtcgctgctgttgaacatcaacaacaacaacagcagcagcagccgccgctgtcgtcgtcgtcgcactgtcctcctccgccttctgttccttgtacgagtgcctccccttccatcgctacgtcttccattgttcttacgtcaacatcttcagcagttccaccagcagcagttgaacaacagcaacaacaaccaccgccaccagcgcagcagaataataacagtaacaatcagccccagcagcagcagcagcaggaatcagccgctgagaagcttgtcacttcattcatgcgatacattggtcaacgtcccggtcaagatgggcatgccttggtgcaagagtttgtccaacagtctgctattcctgtccaattccgttcattggttgctgaacagcttaatcatattgtggcagctgcgcgcgcgaatgtgtaaatttggagagagagagagacccacagagaaagagtgcctcgctgatctttttttgcgttattttattcattgattatcatttgaattaaataaaaaaaaaaatttaaaaaaaaa

SEQ ID NO: 89548 - DNA, 570 bp, Heterodera glycines
  SCN-specific regions: Sequence locations=1-570
agatgaatcaatttctccttaacttgtcctcttcctactctcaatggatttctaaggcttttgcttctactggaaagggaagatggtatgcacagccattagatgaaatgagtcgacatcggagtcgtccgccctgttacggcatggcgaggaggtcgaaggtgctctgcgtggacaattcagagattgccaaggaagcaaatatgagtgggaagctggcctatgtcatttgggtgtacaaagacgggtaccgcaaaaggcacatgccgaaggcagaactcggcgacagggtgttgctctcaattagaggggagatgaaacgtgctgtcgtcgtcgggtgcaagcagcacctcgccatccgaaagcacgggttaccctccaccgacaccaacaacgtcgtcctgctgaacaacgacgggaaccctcttggcaatcgcattttggcacctgtccctgcctattttatgcggtatcgcaaatggctacacgcttcaaaagtgtcggcgttagtcaagaaatttgtttagaaaactttttttgaattgataaaaaggttggcgtgctcaaaaa

SEQ ID NO: 89549 - DNA, 748 bp, Heterodera glycines
  SCN-specific regions: Sequence locations=1-182,213-723
tacatatttgttgactaaaagcatgtttctttaaatataaaaagtcccatcatgtcgaattccggcgaattaactttttccgacaaggatgatgtcaaaggtaaaactgaagacgacaaatcccgtggcactaaaaggaagaagcgaaaggactcgcctagcagcagttcgtcgacatcttccagctcatcttcctcctcttcgttttcatcttcttcagagtctgacgacacttcgctttccgaaagtgaaggccctcccgcaccgagcaaagtcaagaaaagtaaacttacgcacgtcatcaacccacgtaaaatttttattcacgaatatttgatgagcaaattgcacgtttccgatgtgaagagacttccagcggaaataagtcaaaagtatcaaatggtgcaaaaagagctcattgggaaattcgcatcgggagactatgccaagaaaccaataagtttccgaatcgacgaaattacgcttgcgggggcggcagcacagaaggctttcaatcatggtccaacagtcgctgagtactttttgaagaaaaatggtattacacttaaacatccgcaattgccttgtttggtgcaaagcggcggtggaaagcataaaagcttttatcccatggaactgttgttctttgcccaataatttgaagatgtccatttctttttcattttttatttgtttatttttctataagtaaaaatttcgattaaaaaaaaaaaaaaaaaaaaaaaaa

SEQ ID NO: 89550 - DNA, 630 bp, Heterodera glycines
  SCN-specific regions: Sequence locations=1-151,177-563,585-630
gccttctttcacgcggaagttgagaagcggcggcaatgcgttcgcgaaaggccgacgccgcgcaagacggccagctcatgggttcagacgcagtcgctgctgaagcggtcgctgattgacaattggcgaaaccccggcctcacccgagccaaactcttccagaagctcatcatgggcgtgttcatcggactgttgtacatgaacacacagttgaacggtgtcggcgttggcaatttgaacggggccatgttttatatcatcgctgaactgacctactccacgctgttcggtgtgctcacctttttccccgccgactttccgctgctcgcccgggagtaccacgacggattgtactgctcgggcgcctattttgtcgctcggtccgcctcctatttgccgctgttcaccatcgacggcattctgatggtgaccattgcctattggctgatcggactggtgcccaccgtgggccgctttctgatcactttaggcatttccttcctcgtcgagcagtcggccgttgcgtttggcgttatgttgtccgccgtgtgcccttcttaccccgtcgccgtctccgtggccggcccaattctcaccattctgtcgctgaccggcggactgtacgccaac

SEQ ID NO: 89551 - DNA, 849 bp, Heterodera glycines
  SCN-specific regions: Sequence locations=1-188,211-291,316-354,376-849
gagttccatgtccattcattgcttaaccgcattctcaagaaccgcctcaagactgtccaagacggcgagggtctcgattggtccacggccgaagctctcgctttcgggtccttgttgacggagcgtcatcacgtccgtctttcgggccaggatgttgagcgcggtaccttctcgcagcgccatgccgttctgcatgatcagaagaacgagaccacctacactgccttgaacaacttgtcacccgatcaagccgctttcaccgtgaccaactctcacttgtcggaatacggtgtcctgggtttcgagctgggctactcccttgtgaacccgaactcgctcgtcatttgggaagcacaatttggtgattttgcgaacactgcggaagtgattattgatcagttcatcgcctctggcgagaagaagtggttgcaacggaccggccttgttctcaacctcccgcacggctacgacgggcaaggaccagaacactcgtcgtcgcgcattgagcgtttcttgcagctttctgacgaggacccgtatcgcatgccgactgctgatgaacttgctcgccaacatcaagattgcaaccttcagctcgtgtacccatcgacacccgccaactacttccatgttctccgccgccaaatccaccgtgacttccggaaacccttgttccttcctttctccgaggcactccttcgccaccctcttgcccggtcatcgctcgccgacatggctcccggcactcgcttccaacggttcttgcccgaggcgacgccagatgctctcgttgcacccgaccaaatcacgcgcgtgatctttggcttctgcccagtgtactattcattg

SEQ ID NO: 89552 - DNA, 540 bp, Heterodera glycines
  SCN-specific regions: Sequence locations=1-43,65-540
attaagacgaccatttcgaaatttctcttgtccattacttgcctattcttattattttcttattcactataaatacacagataacctttcatgggcgggaattcgagtgtgccggaatcgatggcgaagaaagttgacgaaaaccaaatcaggaaggaaatcagtgagtgtcccgtggttgtttatacaaagtcgggttgcggctactgcaaattggctaaggaactgttggaacaggagagaattcgcttctgtgagcacgatttagagacgaaggaacagcaagagccggacaaagcacagagttatgtgaacggcttggtctatgtgtccaggcacagattggtgccgcaagtattcatttgtggcaaattcatcggcggttatacggaattgacaatgcttaaggagtccaatttgctcagagaagagatttcacgatgttcggacgaatgatagcaattggaaggaaaaaaactcacgttcatcaaaattagatcaattttttttttgagaagaaaatgtatctgatcagaaaaa

SEQ ID NO: 89553 - DNA, 828 bp, Heterodera glycines
  SCN-specific regions: Sequence locations=1-595,617-828
gacaaacttctcgtctgctacttggaggatgttaagaacgcgctctacgtgcactcactcgatgacgggcgtgagctttacaaactgccgttgccgatcgggtcggtgggcggtgtttttgcggaaaagtcaaagtccaaaatattcgtcggcttcgagtcgttcctcgtcccgttcatccttttccatggcgatttctcaaaatgtccgtcccgcgagtcgcctctccaactgactgagacccgtcgcgtgaatgtgcccgggttggactgtgatgcattcgactcgaagcaggttttctacccacgcgatgacggcacaaaaattccgatgttcattgtccaccgaaaaggcgtgaaattggatggcagtaacccggcaattctcaacggctatggcggcttcaacattgctcagactccatatttctccgttactcgcctgatgctcgctaaacattttggcattgtatcagtaattgcaaatattcggggtggaagcgaatatggggaaaaatggcacgaggcggggatgctcggccgtaagcagaacgttttcgacgacttcattgccgcggccgaatttctcatcagcgaaaaatacacgaacaacaagaagttggccatccatggcgggtccaacgggggattactgaacgcaggctgctctcaacaacggccggacctcttcggggccgtcgtcacccgtgttggcgtccttgacatgttccgtttcaacaagttcaccgtcggcgctgcttggactaccgaatatggcgaccccgacaaaccggacgacttctccttcattcgcatgtactcgcccctt

SEQ ID NO: 89554 - DNA, 854 bp, Heterodera glycines
  SCN-specific regions: Sequence locations=1-744,766-828
ggcaaacacatgctgcttttgggtgaacagttcccggactttggtgccgacacttcccatggcaaaattgacagtttttacgaatggatgggcgaagaaagttgggccattctcttctcccaccccgccgattttacgcccgtttgcaccaccgaattggcacgtgccgcgcaactcaccgccgaattcgcgcggcgccatgtcaaagtgatcgcactcagttgcgattcgtccgaatcgcatcgcaattggactgaagacatagccgcgtatggcaattcgaaagggaacggaagtgagaagatttcgtcggcagccgattttccctttccaatcattgctgatcagcagcgtcttttggcaattaaattcggcatgattgacccactaaattccgatttgtccggtgtgcctttaacggtcagagcagtttttatcgtcgacaccaaaaagcgtcttcgtctgtcattgctttatccggcaagcaccggacgaaattttgacgaaattttgcgagtgcttgactctcttcagctttctgacaaatttatggtggcaacgccggagggatggaagccgggctccgcttgtatggtcgaaccacgggtgacggatgcgaaggccaaggaaatgttcgccggcgttgggggcggagtccgaccggtggaattgccctcgggcaaacggtacttacgcgaagtgaacgacccatcggccgggcaaagcgaagtgccacggagtgactgaatgaattactaaatgaatacggcacattcacttcccattcatttgttcattaaataatcggtcaaataagaattatttcccaaaaaaaaaaaaaaaaaaaaaaaaaa

SEQ ID NO: 89555 - DNA, 651 bp, Heterodera glycines
  SCN-specific regions: Sequence locations=1-651
cttaagctgaaagatgtttttcccatcgcatacaatgaattctaatgggacgatggcccaatctaacaatcagcagcagaagatgccactgagcagtgcgcctccgcctccaccgcctccgccggacttcaaaaacttattggctggcaaacaacaacaggcaacctttgccgacaaacttcgggatgtcaaactccgaaagtgttctgcaggaaacggtgtccagaaacgtaccgtctcgccatcaaatagtgttggctcttctaacgggagtgggtctgtctcgtctaaattccaaagccaagatttgatcagcgaactgtccgatcgactaagcaagcggaaaatgactgtggaagcttcgtcaaatgcaaatggcaccccaaatcaaccgaattcacagactcttcccgtgaacaatgcgaaaggctctcaatcagcgattcctcctttcggaaaaatcggcttcgttgttgcatcgtacggagggacaccgtcgacagcgggcgcagcctccgctgctcaagactcacaattaacttgcgaaccggtggtgaaaggcccaacacaattaacttgcgaaccgatggtgaaaggcccaacttcatcagctcataatgacattgccaattccgaggctcgaccaaaggc

SEQ ID NO: 89556 - DNA, 636 bp, Heterodera glycines
  SCN-specific regions: Sequence locations=1-636
aaaagaccaaaaatgttttatcgacgaatattcgctttattcttgtgcattttcgtcattctcttcacattacaatttctccccgtcatcgatggcatgcaatttgatgtggtccaatgtggccattcaaaacggtgcgaattcggcggttgtgcgccaggcaaagcgcaaaacgcggcatcatgtgcctatttgttctcaatggagccggaggggccggacagtgttcgaatggaaatgtacacgcgacgcaacgtgccggacgtcaaatatgtggcagttgcattctccgatgacacacaaatgggtgacgatgcggtaacatactgtgttttgactggcaacggacgggtggaggcgcgcctttcggtgaacccggccaacacaaaaaacaatgtgccggcgcctgcgggggcggagaatggctttctcgagctgttggaaggaaaagcggatgacaacggcatttactgtaaatttcggcaacactcaaacaatgggccgggcaaagatttggcacggccgaacctgcacaaggcgtactatctgttcttggccaagggaccggcagaagaaccacacacgatcggaattcactcgttggacagcgatgatcacgcggtgttcccacacatt

SEQ ID NO: 89557 - DNA, 1507 bp, Heterodera glycines
  SCN-specific regions: Sequence locations=1-1507
gtccttaagtacccatttcgtacctacatttgacgaaaatggatggtgctgaatcagtcattttgcagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgagtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatcccagccccgtgccttttctgtgctcgatgccttgtccgcttctggtctgcgcgccattcgcttcgcgttggaagtgccaaatgtgacgcgagtggtggccaatgacttctccgagaaagcattcgaagcaatccgtcggaatgtgcaactgaacggcgtccagcacaaagtcgaggcggtcttttccgacgcaatcgatttgatgatggcacatcgcaaattcggcaaaaggttccacgccgtcgacttggacccctacgggtcggcgtccgcctttttggacgcggcggtgcaagcggtgatggacggaggcttactgatggtcacttgcacggacacggccattctctgcggcaacactcccgaggcgtgcttcaacaagtacggctcggtcccgctgcggcacaaatcgtgccatgaattggcccttcgcattttgctccgtgccatcgacgcccatgcgaaccgtcacaagcgttacattgtgccgctcctttcggtcagcgtcgacttttacgtccgatgtttcgtccgaattcggtcgggcgctgcgatggccaaagacagcgtgacaaaactcgccaatgtgaactgctgcgccacctgccaaagtttggactttcagcctctgctcaaaaagagtgtcagtgggcccagcgtgcgcttctccaccgcccatttccagtccgaattggttcgtctctttttgggacagtccgacgcgtcgatggacggacgaatggtggccaaatgcgcgcattgtggggggacggccattcacacgggcggccccatttgggtggcgccgacgtgggacaccgaattcgtcgggaaactgctcgcaatattgaaaggcccgaatgcggggcagctgagacttggcactcgtgaacgcctggagggccttctgacggttctgtcggaggaactgcccgacgtgcccctcttctacgaacacgaccagctgatggtcgtcatgaagtgcccctcgcccaaaatgaacgtcttccggtccgccctgctcaacgcgggcttccgctgctccatctcccactgcaatccgcgggcagtcaaaacggacgcgccgacctcttttctgtgggacgtgtgccgtgaatgggcaaaacgaaacggaatc

SEQ ID NO: 89558 - DNA, 910 bp, Heterodera glycines
  SCN-specific regions: Sequence locations=1-651,674-910
gttctctgtgaatgtgtcgaacaaagaattggctggtctgaaggacaggctgaccaaatgtcgaattggacatgaacagctggaggatgtgcatgactttgagtatggttttcccatcggagaattgatggaatggagggaccggtggctgaatgagtacgactggagagaagcggagaaaaagctgaacgcaatgggagaccatttccgggcgcaaatcgaaggcttacaaatccatttcatccgaagccgtcctgcggacccatcggtctacaaaagaagggtgccaattttgctgtgccatggttggcccggcaatgtgttcgagttccataaactggtcccccttctgactaatccccgctccaactacatccgcaacatttcctcgtcagaaatcgcgttcgaagtgattgtcccttcaattcccgggtacggctggtccgaacagccccacaaaggaggctttaaccaaatggctaccgcacgcattttccataaattgatggtcgaacggctcggcttccgtcggtacatcgcccaggggggcgactggggttcggtggtcaccagcaacatggcccgaatgttccctgaaagtgttgccggtctccatctgaatgttgtcttccccgacttcaaaagtccaagccaacttctgatttcgttgttcggttctttggtcccccgttggatattctccgggccagaaggcccaactttcagcttggccggcattttctcgttcatttttcgcgagagtggatatatgcacattcaggccactaaacctgacaccgtcggcgtcgctttgaatgattctccgttgggtctgttggcttatattttagagaaattcgtatgttggacaaacccttcatttttgaaattggcagacggaggactcgaa

SEQ ID NO: 89559 - DNA, 964 bp, Heterodera glycines
  SCN-specific regions: Sequence locations=1-138,168-964
ccattcaattcaaacgctctccgcttggcttcttcaccatgcaaaaaaacacgcggattgcattttggactgttggcttaaggaagtgcgcaataattcggagaacgaacgactgatcagtctgattaatttggcaaacgatgtgatacaaaacagtcgaaagaaagtgccctcctttatggcagccttttttgaagtgttacagccggcatttgtccatgcctccgagtgtttggacgaatcgcaccggaaaatggtggcgcgaatcgttgcggtttggcgcgaacgtcaaatttactcagctaagaatttggatgatttgtcaaagtgtttaaccgcggacgaaccatcaactttttccgtctctccgaatttgaattccgaaacggaaagcccttcgaagagttcgccagtggacgggggacaatcgcccgttgcttcggaggaggacacaaagaaaatcaaggaggaattccacgcattctccacactcagttccaacatgatcgcccttctgcgcaagttggaggaccctgcttctacggacgttaaaatcaggcaactcatcgccgcttacccggaaagcattgccaatccgacgcttctcaaacaattcaaatcggcggacgaatttggcgaactgtcgaaaaaaatcgcagaagcgatgccagtggtcgacgtttactgtggccgactgcgcgaagagctaaaagatcgccagaattttcaatttttactcgaagattatatcaaagcattaaacgaagccaatgaacgaaacaaacaattggtggtgtccgtgaaaagacgcattggaagactggatgaggagaagcaagagttggccaggcatatcgaaagtttgcccgacctgacggaaatgttcgggtccgaacccgcaactacgaaccttccatcgctaggggaattgttcactccaacttcatgaatcgttgccaaagaa

SEQ ID NO: 89560 - DNA, 662 bp, Heterodera glycines
  SCN-specific regions: Sequence locations=1-404,426-662
gcgtcgtcttccccttgtgccgagaattgcaccattttcccccatccaacgttttgaaaaacaattcccgaagatttattatgctccggaatggcgacttgacgaatcggggaagagaatgacgaggggtgtggaggagaaatactcgccgatgaataattacggagttacgccggacaagtgggagtacatgaacaaggtcgtgtggccccctaattacgtggtgccggagacgggcaaaccgaagccgagggaagtgttccattgcattgagaatatccacacggcaccgaaaaaaatgcacactgttcaccaatttgcgttgaatatggtggtggacgaggccattcagcagcttcgaaaccaccagaaaaagcctacttttttactggccgatttaatcgaagaggcaaaagagcgtgcaaggaaggagtttttcattgaaaatcctggaaaaatgtttgttgccgagacatttcacatccaatcgaaaattgtgaaaggggcgagacgacacgcgcacgagaaatggcacccgatgagataccgttacatcaatttgttcgttaggctgcaagaaggcgaatccgcccaagtccaaaaaacgcgaacccgacgcccacggatgggataaaatggaaaattattatgcttttttgcaa

SEQ ID NO: 89561 - DNA, 477 bp, Heterodera glycines
  misc_feature (461)..(461): n is a, c, g, or t
  misc_feature (464)..(464): n is a, c, g, or t
  misc_feature (466)..(467): n is a, c, g, or t
  SCN-specific regions: Sequence locations=1-397,421-477
gtcttcctcattctgattgttacttgttctgaagcaacaattcttttagcttacttccatctttgcgccgaggattaccattggtggttccgttcctttatgacttccggatttactgctgtctatttgttcatctactgcattcactacttcaactcaaaactcaccatcactggtgtcgtatctaccatcctctacttcagctatacttcgatttttgtctttttgttcttcttaatgaccgggaccatgggatttttcgcaacttattggttcatctacaaaatctacagttcagtgaaagtcgattaaagatgtaaatttgatttgtgattagaatacatgttaatttttttttggtcattggtttttgagcaatgatgggcttctttcaatgtttaatatatttttgtttcccttgtcttaatgtttttttttataaatgtgattagaagtcgaanaanannaaaaaaaaaa

SEQ ID NO: 89562 - DNA, 576 bp, Heterodera glycines
  SCN-specific regions: Sequence locations=1-158,180-354,378-451,473 -510,532-576
atttgtttcagcaaaaagcaacaacaacacccttgttacgtaatgctcatcaagctcgtcaaggcgacggtgggcgtcccgtcgccggtggcactgcgcgcggtgtcggcacgcggcgtgggcagcggcacgcattggattggcaacgattttgaggactttgacaagcactacaagaccggactgcgtgacgccgtgccgattgccgccttctggaagaagttctccgctttcgtcatgatgccactgttggtattcgcgggctattgcggatggaaggaccatcagaatgtgcaccattctccacgccctgagtacgtcgcatacgaatatttggccacgcgtcgaaagcctttcccctggggcgacggcaaccattctttattgcacaacccggccactaattgggtgcctggcgttggctacgaagccccgtggcccggcgatgcgcacaaaaaggagggggacagcggcggcgaggggaagaagcactgagcggcgcccactgaccgatggatgatgaaatgaatggcgcttccccccccacgacgatgtagaaaattatggtggagcgac

SEQ ID NO: 89563 - DNA, 833 bp, Heterodera glycines
  SCN-specific regions: Sequence locations=1-78,106-124,166-833
gtcaagtggccagcccggcggtggtggccctgttgtggtccacggtggcaatgcggtcaactttgctgctgccgctgctcatcagcagcagcaacagcaggctgctggtgacccatcgcaacatgttgcggctgttcatcatcaccaccagcagcaacagcagttgcctccgcaacaaaacaaaacgcttttcacaccggcagcaaacccagcgatggtaagcgcaacgccggccatgcaacaacatttgcaacagcaagctcagacaatcttccaccagacctcagccactgcagtgcctcagttccccagctacaacatgccgtacatgtattcgccggtggccaccgcgcaaacgttgcaaggaccaaatgcggagattgaccgtttcctcatccaacagtatgggacgccgtattcgcagctggacttgcagatgggcgcaatgtcaattggaccaccgacgtctttggcaccaaaccatcatcgtgccacattggaatcgtacatggagaacaaatttgggcagcagcaacaaaacgtcaatcaagcggccaacaatggacactatcaacaaacgcagcaaagtcagcaacaacagcgcggacttgcccaatcggagcaggcaactttgctggggggaccgccaagccatgtgggaccgcctcccggctttggtatgcccaccgcaccgacgcagccatcgtatgtgcagccggccaacatccattcgctttttcagatgcccacttatccgcatccgtaccagcacccgcagtacatgatgtccaatgccaatcgtttccaagctgcacagcgtcctgcacagactt

SEQ ID NO: 89564 - DNA, 631 bp, Heterodera glycines
  SCN-specific regions: Sequence locations=1-5,29-631
gagacatttaatttaattttaaaaaaatgttccgctttttgttcgcctccggccaaattcgtgcgagtgcccgatcagtggcttcctacgaccggatgggccagaacaatttcgccgcgcacatttccaagccgttctcagtgtgggcggcccgcgagaacgcggacaacctgggcgttgtggacgccggaaaaacgctccaggtcactctgtccacggacctcaacactgccgagcccggcaagtcggtgcggttccgcctcagtgcagtgcccgattcatttgtcggactgctcgcggtggaccaaatgccgttgtcagtggggatggcccgcgagaacgcggacaacccgggcgtggtggacgccggaaagacgctgttctccactgccgagcccggcgagtcggtgcggttccgtctcagtgcagcgcccaattcgttcgttggactgctcgcgggtgatcatggaatgcggcgaggaatgatcggcggagggcgcgaatcgtttgtgcctccccgcgtgatgcagtcgcgtgcagtgagcacggaggcacgcgatcagattcgcgcggaagtttgcgaaaagtattctgagatgttggaaaaatttatgtcgaaagacacagcgca

SEQ ID NO: 89565 - DNA, 783 bp, Heterodera glycines
  SCN-specific regions: Sequence locations=1-16,38-783
cgtagtctttctcaaactttcccctcccctcccctccgactctcgccgatttcttcatttgatggacgtgttcaatcggttgctccctcggccgggcaatggcaatgttcagttcaaaaaactcagacatacgtcaaattccgccagcattttcgcatctgacgaagcgacgggtgacaaacagcacaacgacgaaacaacgaacaacggaatgatgccggcgacgaattcgccacgggttgaactcggattgatgctgagcaacatcagtgctgaaatgcgacacgggcaaaacagcgcaactgaaggaaacggaaaagcgaatgggacggggaagcagaataaaagctttgtggaagaaaaggccaatggaaacggaccgtcgtcagaagtgaccgctttaagcaaagggaaaagcaacggaacggccaaaggcggcggaaaacgctttctctctgcgcttttgccgggaaagagaaagggacgacttggcctttcagtttcggagcctcgactaaattttgacatcgaaccgtccaaaaatgactttgaacccacggaaatcgaagggggagaaaatgcgaaaggaggacaaattgcggaccatcaacagaattttggggagaggaaccgattatgcgatggcatttcggacggaagtcgcaaaagtcggccgaattttgcaggggcacttcaaaaggtccgtgaaaaattgaacgttcgtccgtcgtccaattcccaccgctcctccgccttttctcctccgatgaatcgttccaatac

SEQ ID NO: 89566 - DNA, 667 bp, Heterodera glycines
  SCN-specific regions: Sequence locations=1-667
gttaagaagcattgattgaatcagaggaatcgcactgccaaaataacaatttgagaacagtaaaaaaaggccgtcccgaaattccgcccaaaaatgtctcgcgtcggattgttcggccaaatctccgagatcaacgaccacctcttcctcagcggggcgggcgtgttgaggccggaaaagctgaagcagaagggcatcacatgcgtggtcaacgccacggtggaggaaccgacggcgaatttgccgggcattgacagcgtccgaattcgcatcgaagactcgccattcgcccgattggaccattactttgaccaaacggcggacaaaatcaaatcagtcaaggaacgcggtggcaatacgctcgtccattgcgtcgccggtgtttcccgctccgccaccctttgcatcgcttatctgatgaaacacgagcgaatgtcccttcgtcaggcttaccattacgtgaagtccgcccgtccaatcattcggccaaacctcggcttctggcagcagctggtggaatacgagcggaaattgagagggcacaacaccgtgaccatggtgccggcagaagggtcggcgctgcccttccccgacgtttactcgtccgacttgcgcgggcacattctgtccaacccgggcccaccgcagcacgacccgcagattgtgg

SEQ ID NO: 89567 - DNA, 583 bp, Heterodera glycines
  SCN-specific regions: Sequence locations=1-358,381-553,577-583
gtttgagggatggccgtcactttgcacacaacggtgggcgacataaagttggaattgttttgtgaacgttgtcccaagtcttgcgaaaacttcttggcccattgcgcttccggttattacgacaattgcattttccaccgcaatatcaaaacgtttattgtccagactggcgacccgacaaatcgcggcaccggcggacaaagcatttgggacgcaccgtttgaagacgaattgcatgaggacctcaaatacgatgcccgaggaatgatcggaatggcgagcaacggaccgaacacaaatcgttcccaatttttcatcacttacgaaaagcagccgacattggacctaaagcacactctgttcggcaaggtcattgacggatttgatgagcttgaagagttagagaacaccaaagtggacgcgaggtatcgcccggtggtggagcaacgaattcgaagcgtcacaatccatgcgaatccaatcgcggacggagcggcagaacaatgaccaaccaaccgatggcgcattccttttgaagacattggcactttccatttatttatttaaaaatattttgataaaa

SEQ ID NO: 89568 - DNA, 540 bp, Heterodera glycines
  misc_feature (521)..(521): n is a, c, g, or t
  SCN-specific regions: Sequence locations=1-150,217-514
gttaaattcgtcagctacaaaaaatttcgcaaaataaaatgaattcatcaatgacagtatctcttctgctaatgttaatcattggcactgctcttttggcattgacaaatgccatgccaaacgcagatgcttcattgacgcgcgaaaagcgtggcagttacggtagtggcagttatggtggtagcagttacggtggtggacccagcggtggtggtgacgcatttggaagcggaggggccgcaggtttcggaagcggaattggcaacggtttcggaagcggaggcggcagcggttttggaagcggaggcggaaacggtttcggaactgggggtggcagctacggtggtggcagttacggtggtggtagttacggtaaaaggcgatgatggaaaaacattggtccatttgtgacgaggaaattgcaatgtgatcatcctttcttcccgatcactgcttttccaaatttatttgttgtattatttatacaaaattttaatgaaaatgaattgctgctaaaaacnaaaaaaaaaaaaaaaaaaa

SEQ ID NO: 89569 - DNA, 482 bp, Heterodera glycines
  SCN-specific regions: Sequence locations=1-137,159-162,184-204,226-482
atttacaaattaaacgacaatcaactaaactcctcaattagcaaatccttaattaacttcccaaatgactcatcgccaacaaaacgaaggagggggtggagcagtgacgccgaacgcaacaacgacgggccatttgcaggagcaaatggccaacgccatggaacgcgtgggggaggcggcgcacaacgtgggccaacgggtgaccgatttcttccagggggacccttttgggacgctaatcggacgcaaaatcgaattggccaccgatgctacgaaaatggccactgaaaattggggactgaacatggaaatatgcgacttcatcaacggcaccaacgacggaccacgagacgccgttagagcgatcaaaaagcgactgcaaacgcaaatgggaaaaaacaacgcaattgtcatgtacactttgactgtgttggaaacgtgcgtaaaaaattgcgaccaccgttttgctgtgctcgtcacaa

SEQ ID NO: 89570 - DNA, 624 bp, Heterodera glycines
  SCN-specific regions: Sequence locations=1-9,31-165,188-624
ggaaaggaaagttgtcagatgaccatgtcaaatcacaacagaatgatgaattttaacaacgtaaatattagaaaatacgacaataaaaatgagagaaatggtgctgggtttggagcaaattctgacactgcggcgtttgagagctgggcttgcgagtctttcaacctttttgagtttttgggagaagacacatcgccacttgacgaagttgttcccgagaaaatggacgaagatgagatcgaaaaacaaaaggaggatgccatgtattcgcagtttcaatacagtgacatgcttattggggggcaacacccgacaaactctcaccatgattttggcgtaaacgatttcgcaaatgtgccctctgacggccgttccgattttgacgttcccactgctttccatgaaggagttcccttcccaatgccgcccgctacacaccaaatctattcacagaatttggatgcaattcctcacgtgccaagcacttcgaaatcatcgatgccgttaatgaagcaggaacccatctctgagcaagaacagatcaacctgcaattgggcttagacgcgccgaagtcgtctcgcgagtcgagtgttgccagcggatcgatccattttaagtatcac

SEQ ID NO: 89571 - DNA, 982 bp, Heterodera glycines
  SCN-specific regions: Sequence locations=1-14,37-982
gtccaattaagtcgcagctacaaaatgtttctcttaccggggaaatgtcgcaagaattggcgttggaattgttcgaaaacggcgatcttcaaggacttccctaagggttgtgagttcggcatggattatcgctcgtggattgtcggcccaaatttcctcgggatgaaaatgatacctcctggcattcatttcatttactttagtgtaccgggtgcgcctcgcattgctttctttcacaattttcggcaaaaggaagtgattttgaggaggtgggacacgaaaaaggaagacttggtgactgacgaaaagtcggacgaagttgaattggatcgacttcgcgagaatctcagaaacattgatcgctttttgggagtttatccattcgcagactatcgcaattggctttccctttcgtcgtacattacgccaaactccgtccgtcgtctttccccctcaaattcactcggacgcatttcgtcccaaaatgaaatggtcacgcaggaggcgaaattggagaagaaattgggtgatccctttggtctttcgattgtggacagagaacaccgcgggcgcattcgcttcacggacgaaagcggacttccgctgatgagcgaaagggaggaagcgaagctgaacttcactcggatatcgcagatcacattggctgacacaaatttaaggagggcgggcattgacagttccgacagacttttccaatgtttcgaagcaatgggcggtgattatcgcgaagtccttgcagaattccaatttgcttttgtcgtttttctcgtggggcaggtttacgaaggcttcgaccagtggaaacggcttgtccatttgttctgcagttgtacttccgctcttcaatcgcatccgcaattcttcaacgaattgtttgcagtgtttcacttccaaatgaagatggtcccagacgatttttttgaagatgtattggccagcagcaattttttggcatccacac

SEQ ID NO: 89572 - DNA, 367 bp, Heterodera glycines
  SCN-specific regions: Sequence locations=1-39,65-367
agcactatggcattatgccacatttcctcttatttccgtctttgtcaacagaattactaaatttggcatagctaaatgtcacatgacaaaattcacgctgcacgctgattaagataaacaaagtcattaataaccggatattcacaggaaatggtacctcattattgagaaagatccccgacatttttgcgctccctgactctgcttcccgacctgtcatccccgagaatttcttcactgacaaatgaggggccacaactacagaacagacaaactgattaatcactaacaatttttgttgtatatggtagttaatttttttattattatcaggattttttaaaaaaatagcactaagtgttaaaaa

SEQ ID NO: 89573 - DNA, 152 bp, Heterodera glycines
  SCN-specific regions: Sequence locations=140-152
gccaaacatattctgttgcctttcaaacgtaactaccattgcaatcacatgatttactttcacagcctctgcgcaactctttcatacaaatcacgaggccaattcctccttaaattgtttgcaatgaaacttgcaatctgaaaaaaaaaaaa

SEQ ID NO: 89574 - DNA, 579 bp, Heterodera glycines
  SCN-specific regions: Sequence locations=1-68,90-579
gtttgaggaaataataaatgtgatcggattttgttctgaactgcttctgaccatggcagccgacggcaagaaaattgaggactctgagcggccatttgtggtttggcagcggttggacccatcggacaagttgggagcgccgaaaccggcaccagtgccatctaaggtcaaaccaagcagcggacagtcgccgtctccgagtggcattgagaggcgcgtttggcgcggcgttgcgccgcccattccggatgacattttggcgctagccgattcttcgttcgaggacatcacaccggcgcaaatggccgtgcggaggatggcccatagtccaatcgcaccaattggaatggttgccactgtttccgcgctcgtgatgatgattgtctcgatgagaaggcgcgactcgttggccttccaacggtacgcgcgctaccgtatcgcggcccaaggccttaccatttgttcgctggtgggcggcgcgtggtactatttgaagaaggacggatttatgtgaattcgattctttttgtgttttgtgatatttttgtttttaggaaaaactaaataaaactgaaacac

SEQ ID NO: 89575 - DNA, 624 bp, Heterodera glycines
  SCN-specific regions: Sequence locations=1-15,37-476,501-624
gtccaattaagcataaaaaatttgctttttattttcatgaacgcccattttaatggtgccttcggttttaattttgggtttatgcacggggctctctcatgcgcccgtacaatttctgcttgtcttggctcccatgtccatttgattctgccgccaattctgtccgtattggacgaccgcaaaacggaggagaaagtgcgtacgtcggcactggacactttgcttgagttggcccgtcgacattccatcgaggattacgctttgcccgtcatgcaaacatggcttcgttgcattggcatcaagtctcaacagccgcgactgatggagttactcggcatcatcgtcagaaaatggactcagttttctgtgtacaaagagaatgtaaatgccgccttggtgcggtgtcgtgtcgaaccaatgctgtgccatgagtaccaggaacagttggcacttctccaggcgccttcatacgcacgccaacagcagcagcaacaacagaatgccgttggcagtggtggaggcgtttaccaacaacaacagggcacattcagtgccagcacttcatcaccattattcgcgcgtcaagtgtcttttttaccgccgacgcaaaacggcggggcgaca

SEQ ID NO: 89576 - DNA, 234 bp, Heterodera glycines
  SCN-specific regions: Sequence locations=1-234
cggcaaaggaggggaccgaagtgaaacgccaaattgtgcgccatggcattggaccgcccggccccgccggaccgccgggagaagcgggcgaagacggagagccgggcccttgcgaatgttacaaagaccaaaaaagtcaatgaacgaacgcaatttatgcgaatagcacacgaaataaaactagcaaatttaatgttttttaaatttattttggtgaaaaaattttttattgct

SEQ ID NO: 89577 - DNA, 620 bp, Heterodera glycines
  SCN-specific regions: Sequence locations=1-25,55-79,101-104,126 -420,442-537,559-620
ctctgccatgcaccaccgctcactctaagcacaagcacaagcacaagcacaagcgccccaaccaaccatgtcctcaaccctcccgacctcgtcatccaccggcaccaccacctcggccgcgccgcttcccgcggccctgctagccgacctgacctcggccatcccgcactcgccgccgccacccgtgacccccgcgaccttactcgcgacccgcatctcccagcccttttacgcatccgtcagcacgacccgccggtcgggcaccactgccgcgcacgcgctggccctgtcgcacgtctcggaaacggcccagtttgtcgtcggatacacgtcgcgcaatgcgcccattctcaacgacctcaagggatctaacgcggccgaggtgctgctgtcctcgccgccgcccggcacgtcgctggcacgcggccaagtcccgaaagtcatccgcatcgaagctaaatgctacctggcgtgctcgccgcagttgctcatgcggtttccgccaccaagggtcgcgggcgacgaggagccgcggttgacgtgggagcgcgcgcggctcagcgtcttcgcacggcttacgcccgcacagcgcgcaaccctgttgattggtgaacccaatg

SEQ ID NO: 89578 - DNA, 666 bp, Heterodera glycines
  SCN-specific regions: Sequence locations=1-260,282-666
tgacaaaaaacgaggatcaattagtgtatttatttttcgttatttcctttccatgtcaatttcttaatgggaaaccaacaaagtcagcacaacaattctggccatgcgcaccatggcaaaaaacaacttgatccacggatagtgagtgccttcaattcgttgagcaacggaaaagataccatcggattggaacaaattaagccatcaatcggcgctaaattggccctgtccatttggccttcacttcaagacacccagcaaaggattacgttggaacagttcgttgaacgtgccgagacaattctgaattttacgccggacatagccgtcagaatgctaatgccagcacaaaaattggtgaccgcttgccttgaggcggacggaatcgaagttcaaactgaggaggaaaaggcctttttgaattcgctggtggaacatatggaatcgaatgcaaaaacggccgatgctttggttgattggaagaacacgaattgtgctcggatgtgccatccgttggtcgaacgggtgcaatcgcttctcactgccattccgtttaaacaaggcccaaaaatccattcggccattttgaacgacgtgcaaatgttcatccttcgccacgctcttcccaccactgtgttcttcccagacccatcgcgccatttgtcc

SEQ ID NO: 89579 - DNA, 650 bp, Heterodera glycines
  SCN-specific regions: Sequence locations=1-650
gtttgagccaaatgtttcccgctaaatacaaagcctttcgactggaaaataaagtcgcggtgatcacagcagcgacaaatgggattggattggcaattgctgaacgattaggccacgagggagcacgtctggtggtcagcagcagagacgaagacaatgtgaagcgggcgatcgatcggctcgtctcttcgggactgaagcgttcggaccttgccggttgcacttgccatgtgtccaattcggaggaccgaagtcgcctgctgaaactgaccatccaacggttcggaagtgtgcacattttggtgaacaatgctggcatcaacccaattttcggcgatttgttggacgtggacgagtcagcctgggacaaactgttcgacgtgaatgtcaaggcgggcttcatgatggccaagctgttcgcgccagaaattgaacagagcggtggagggtccatcgttttcaactcgtccatcggcgcctatcggtccccccagggaatcgctgcttacggcatcacaaaaacggcactgctaggtcttaccagagctctggcagaatcacttgcacccaaagggattcgcgtgaatgcaattgcgccagggattatcaaaacaaaaatgagcaaagcgctttgggaaggcattgacgaa

SEQ ID NO: 89580 - DNA, 532 bp, Heterodera glycines
  SCN-specific regions: Sequence locations=1-466,496-505
gtttgaggcgcttttgcaaaaatggtcaaaatcatgaagccgggacgtgtggtgattgtgctcagtggacgctatgcggggcgtaaggctgtcgtcgttaagagctatgacgagggctcatcagagaggccgtatggacatgcattgattgcgggaatcgacaagtatcctctgaaagtgaccaagaagatggggaagaagcaagtggagaagcgaattcgcatcaaaccattcctcaaggtcaccagcctccagcatttgttgccaactcgttgcatattcgaggccgatttggacaagagtttggtgaacaaagagtggatcaaagagccgcgaaagaagaagaatgccatcattagcgtcaaaaaagaatttgagaccagctacaaagccggaaagagcaaatggttattcacaaaacttcgtttctgagcggttacagaggggaaacaaagcgatttccttatttgcattgttgttgtttttgtgttatgagtaaagatttaaagaaaaaaaaaaaaaaaaaaaaaaa

SEQ ID NO: 89581 - DNA, 615 bp, Heterodera glycines
  SCN-specific regions: Sequence locations=1-38,60-104,134-141,165 -317,341-615
cacaattacctaatttctcatttccccggtttctttctcttagtaattccctttgatacgccgccttttctccgtccgatggatgtttccctcttccgtttgccttctcttccccattttttcccttctcttccgctgtgtcccttccttctcctttttcttttgtccaatcctccgattttcgcctccgattcggctgcttttccgacgtcttcatgccgtaacatccaacaagcttgtgccgctcaacttttcttcttccctccgttgccttccgtacaggagacggtgccggacgtgccgttggcacagcgactggaggaggaggaggaggaggaggggtccggtgaaggcgcgggtgctgtagacgccggcggatggcattttgtgccaatgtccggccctttgtcttttcctctatacgacgaatttgtgccgacaacgccatcctatgattacaacgcggaaccgctggagatgagacaagtcgacatttgtacatgtccggagaatgatcagtgcagcttcgacactgaaaggaccgtcaaattcagtcctcaaattcgagtcgctttctgcaggccgttggccgaggtgttcaagtcgaagtgcaaa

SEQ ID NO: 89582 - DNA, 554 bp, Heterodera glycines
  SCN-specific regions: Sequence locations=1-391,427-468,497-554
cttaagaccggctcaaaaattgttgaaaaactaataactaattcgaatgtcaaccatcccaatgccaccaccaccaacacaagacgaaaaggaccaacaaaagaaatcccaatggaaaccgctggagataggaaatcggatgcgcacgacctcagaagattcggccgagtcttttgacgcctatggaccggattcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttattttatttaacacttcttctgatttttcaataatgaaataaagacaaacccaccaaaaaaaaaaaaaa

SEQ ID NO: 89583 - DNA, 578 bp, Heterodera glycines
  SCN-specific regions: Sequence locations=1-413,436-578
gtcggtgcaattgcagccacatcaattggtgaaccctccactcagatgacgctgaaaacctttcactttgctggcgttgcgtccatgaacatcacccaaggcgtgcccaggataaaagaaatcatcaacgcggtccgctccatttcaacgcctatcatcaccgtggcattggccgatgagcgggacgaaaagttggcacgacgggtgaaggcacggactgagaagaccacattgggcgatatcattgattatgtggagcaggtgtttttgccggatggcctttacgtactcgtcaaattgaacacccggcggatcagagaaatggaactggaggtgaccatggacaccatcatcgactcaatttgcgcctccaaattgcccgtgtcgcgcattctgtgcgaccagatccgctcggtgggcaagtccatgctgctggtcaggccggtcgagtcgtccaaatcgcggacaaagttcaacaattcattggtgattgccgaagtgttgggcattgaggcggcacggggctcaatcatttccgaaattttggccataatgggaaaacacggcattgagttgga

SEQ ID NO: 89584 - DNA, 870 bp, Heterodera glycines
  SCN-specific regions: Sequence locations=1-870
gtccatttaagtaaaatgggcgaattcttcttcaaccttgatcacggctatctcgaagctttaatccgaggatttaaatcgggccttttgacaagcacagactattcaaacctcgttcagtgcgaaacgttggaagatctcaaattgcatatacaatcaacagactatgggaactttcttgccaatgagcctgggaatatcactgtgcaggtcattgatgaacggctaaaagagaagctcgtaacggagttcactcacttgcgcaacaattctctggagcctcttgcgacttttcttgactatataacttattcatacatgatcgacaacatcattctgctgatcactggcactctccatcaacggccaatcaacgagctgatctccaagtgccatcccctcggctcatttgagcaaatggaggccattcacattgcatcaaacccggctgaactgtacaacgctgtgctcgtcgacactcccctcgccccatatttcgtggattgcataagtgagcaagaccttgacgaactcaatgtggagattatccggaacacactgtacaaggcgtacattgaggacttttataatttatgcaaaaagatgggcgggaaaactgctgaggtgatgtgcgaaattttagctttcgaggctgatcgacgagcatttatcatcacaatcaacagttttgacacggagttaaataaagaggaccgcgctaatttgtaccctcggtgtggaaaactgttcccagagggattggctgggctagccaaggccgatgattatgagcaagtgaagcaagtttgcgagtactactccgactataagcaactcttcgagaacagtggcctcaatccaggcgaaaaa

SEQ ID NO: 89585 - DNA, 374 bp, Heterodera glycines
  SCN-specific regions: Sequence locations=1-352
gatgacacagcagcaaggcgcaacagacactgaccttcgaacgttccgcgactttttattccaatataacgcagtcaccgagcagtgtttcgacgcgtgcatccgcgatttcaccagcagagacataagcgagaaggaggaacggtgctcaaaaaattgcatggacaagtttttgaaggccggccaacgcctgtccatgcgttttcaagaacatcagttactaaatatggaagcacaaggagcaccggtcatggcaacgaatacaaaagtgcagattggaaagtgatacggcggaaacaccattttttgttgtattgtttgaatattttgagtttaatacattttgaaagataaaaaaaaaaaaaaaaaaaaaa

SEQ ID NO: 89586 - DNA, 1068 bp, Heterodera glycines
  SCN-specific regions: Sequence locations=1-60,82-144,184-269,291-1068
ctttgttcaccaaaattgaaccggcgaaggtggccgagtggaaagaactctttggcagtgggaaacagcagcaaaatcagccgaagaacaacggaccaacggcgatgagcagtagcagcagcaaaaaggcaccaaactcgacggagaagcagcagcagaaacagaagaagaaaaaggaaaacatggcggaagagcggggcgaagtgggccaaatttacgcggaagtgatggccaaattcgaaaaagcgaaagcacttttcgtcacaaatgaatctgaaaaattagacaccgaaattgccgcattgaaagaacaaataacggagcagaaggcgcgcctgggcttcaccggcgcattgttctcaccgccgatgccaaaagcaacgccggcaatcgttgtgccaccagcagtttcttccccgcaaacaccgcccaaattgacagcagcgtcaaatgcgagcaaagaacaaacgcaacagaaacagcagccgaaacagaagaagccgcagcaacagcaagcgactgccccggccgatgacaccgtcgacgtcggttgcctcgacctccgtgtcgggcgtatcattgaggcacagaaacacccggacgcggacgcactgtacgtggaacagattgacctcggggaggagaagccgcggacggtggtgtccggcctggtccgatttgtcccacttgagcagctcaaaaaccgtcttgttgtctgtctgtgcaatttgaagccggccaaaatgcgtggcgttgagtcccaggcgatggtaatgtgtgcgtcgacgcctgaaaaggtggaagtgttggaagtgagcccggaaagtgtgcccggtgatctcgtcgtctgtgaaccgttcgtacgccgtccgcctcagcaattaaatccgaagaagaaaatttgggagacagttgcaccggatttgagcgtctctgaaacgggcgaatgcatttacaaaggacagattctccgagtggaacgtttgaacagttcccttagtgcttcgacacttcgaaatgtgcccgtcaaatgaatttgattgattcttgtcttttttgtatgctctg

SEQ ID NO: 89587 - DNA, 1149 bp, Heterodera glycines
  SCN-specific regions: Sequence locations=1-1149
gtttgagcgatggtagatgctcattttgctgggtgtgcacatatcaagtcggagtacgtcgtattacgaagtgaaacgcaacagcaagaaggaggcaacaaaccaccaaatgaatccaatccattggaagggaactcgcacgagggaattctgccaagaaatgtgagggcacgcggaatggaccgccaaagagagcaaaaaatggccaaggcccgagcggaaaaccgtcaaaaaatcgtaagaatttgtccatcggttctttttgagagcgaaggaaggaagtgcaaatatggagagaaatgcgacgcggagcactcgctgacaaaatattgggcgaagaaaccgccggacattggtccgtcctgctttttgttcgaccaaatgggcaagtgctctttctcattgagctgctgtttcgcccgagcccatacgaatgagtcggatttgagccagaagagcaaagcggggcactcggaatggcagtccgttctcaacacgcacactttgcccattcagcaacagctcagaaaacgcacttacgacttttctcgttctgaacgtgctctgcatgaatcaccatcgggttgtatggaacgcgaagcaccgaagtgggacatgcgcactctccgcggcaaaaaatacttggcccctctgacgacggtgggcaacttgcccttccgccgtttgtgcgttgaattgggcgcggaagtcacttgtggtgaaatggcaattgccacgcatttgttgcagggtcttccttcagaactttctctgatgaaaagacatccgtcggaaaaaatctttggcgttcaattggcaggaggctaccccgattcacttggtaaagcagtccaactgatcaccgacaatttcaatgttgatttcatcgatttaaatttgggttgtccgctggacagtgtcaatgaaaagggtgcaggctgttcgttggcgaataaatccaacaaattggtttccgttttgcagtgcatgcaaaagagtgccacgggagtgcctgtgtccgtcaaaatgcgttacggagtgaaggaaggagaacggactgcgcattacaccatggggacaattgccgaacggagtccccctcagctgctgaccctccaccctcggtcacggggacagcgctacacaagg

SEQ ID NO: 89588 - DNA, 548 bp, Heterodera glycines
  SCN-specific regions: Sequence locations=1-192,215-495,517-548
ctgcaaccaacgaaccacttcaatggccgaagaatattttttaatcgctgcggctgccttcggagcaggaatttactgttggaagacgtacctcggcccgttgctcgaacaaccgaagagcgacgatgaggagaagcccaagccggaaggaggcgaagaagcgacgaccgccggcgacaaggaggagaagaaggctggcagcaagggcgacaagcacaagaagtctggcagcaagggcgacaagcacaagaaggacaagaagtctggcagcaagagcgacaaggacaacggccccgctgacgaaaacaaacagccgcaaacgagtgcttatgcaactcccacctaagaacttcaccaatgacgcattcgactgaatagaagacaacagatgaaaacaaattcagtaaccacaacaacagccaaaagcaaaccaacggaggaaaaagaaaaggaagcgacggaaacggattcgaaatgatatttaatgccacaaaatatttgtatgtgtattatacataggtatatccggtcaataaatacctatctaa

SEQ ID NO: 89589 - DNA, 657 bp, Heterodera glycines
  SCN-specific regions: Sequence locations=1-624,648-657
ccaagtttgagatcagctactgctgcgcttcctttcatcaaaagcatttgccgtaactccgttcgcacaatgcgcgtggttccaattccggccaacaccgacaattacatgtatttgatcatcgacgatgacgacaaataccaaaaaggacatcgaccggcggcactcgttgacccggtgaatgtggaaaagtgttttgaagttgtcaaaacggagggcacactgttggaggcggccctggtgacccaccaccattgggaccacgcgggtggcacctaccaattggcaattaagtcacggagcgggttcagcgacctcttgatgaagcagccgctgtgcattatcagcggtgacgcggagcgagtggaacgcactgagaaagtgatagcggacggggagagcgtgcagctgggcaccaatttgagcgttacggcgatgtacacgccgtgccacaccagcacacacgtctgctattatgtggttgaccagcgcacaaatgaacgtgccgtgttcaccggtgacacgctgttcatcggcggttgtggtcgcttttttgagggcaccgccgagcaaatgcatcacgcgctcaacgaacgccttgccgctttgcccgacgaaacgttggtttactgcggtcacgagtacacggtggcgaat

SEQ ID NO: 89590 - DNA, 764 bp, Heterodera glycines
  SCN-specific regions: Sequence locations=1-393,415-764
aactgatccaacccaccgactcaacccaccgactcaacccaccagcaacaaccatgtcgtcgtccgccccgacccaagccctttgcatcggcatgacctaccccggatccgacagcccgctgcccgggtgcgaggtcgacgcttacaagatgacgcagctcgcggccaacatgggcattcccgaagaatccatctctgccatgtcggacgttgccggcactgaggtgaccaaggcggatgttttggcgagtttgcgcgagatggtggacaacgccaaaccgggagacaaccttatgtttacgtggtctgggcatggcggccagcgtccgtcgaccgaattgggcgaaaccgacggccaagacgagctcatctttgcctcggacggtcccatctccgacaacgaaatctatgacatcctgcgcgaccttcccgagggctgcaacatgaacatggtcttcgactcttgccggtccggcacaatggtcgacctggactttgccgacctcgacgccaacatcgtgtgcgtttcggcggcgctcgaggaccaaaactcgctcggcaactcggacggcggcgtgttcaccaaccagctgtgcgaggtgttgcaggagaacccggggattgcgttagcggatgccattgagacggtgaatacactgaatgctgcgaatgacgtgccgcacgtggctatggtgacgaccacgacgggcgccgagcatttgctccaagaacccgcatttggcctcacggatcccgtcgaattc

SEQ ID NO: 89591 - DNA, 413 bp, Heterodera glycines
  SCN-specific regions: Sequence locations=1-111,134-185,207-378
ccacaaaacgaggaatgactgcctttctcggctgctgatttcttcgattgacatctgcaacttggttcaattgaaatggattgttttgacaatgatgatgcgtttggcgagctggtttatgaggaagaggaatttgaacaggaattggaggacaaacggaagcagggccaaaaatgcacgagcactcagcgggaagaagaggaagaacttcgtgagacagaaaatgagattctgccggaattgaggtcggaaagagtgttcattaatattcctgcgatcaaattttccttagttgtccaattaagaggatttacttggtctaaagtaaagcttcgtccaactgttacataaaatttgttcacaataacgagggtcttcaaaaaaaaaaaaaaaaaaaaaaaaaaaaaaaaaaa

SEQ ID NO: 89592 - DNA, 574 bp, Heterodera glycines
  SCN-specific regions: Sequence locations=1-17,47-375,400-402,439-574
caagtttgagctatacacccgcccccgccgcctccggcgcggcgccaccggtgcctggggatgatgatgaagtggaagaggaatgagcccgcatttgagcggccgctcgaagaatggcgggagcgccgcaaccaacacgcgcaaaacaatattcacccgcctccggcgccaccgcaggaggaggaggaggagcactgggcccaggcatggcctgaggaggaggaggcggcgccggaggcggcgttgccccgagagggtttctacctaatcggaggtgtccatgacccgatcagtcttcgttttgaggctgcgatttgcgcgagatgatgcggaacgtgtggcgccgcattgacccttcgaaacgtgccatgttcggcggtggccgctcggccggggtgccttcgcacggcggaggagcgcgtggcgggcgcggcggtggaaacttggccgaaaaatgaccaacgggaaaggacggtttaatttatctgatacatggcatttatattgagcctgcaattgtttcgttgctttatcctttttgaattgattgtctgtttttgatttttaaaaactc

SEQ ID NO: 89593 - DNA, 376 bp, Heterodera glycines
  SCN-specific regions: Sequence locations=1-376
tacctcaaagaacgaggattatgacccggacatttggcactctaaggagcagcagcgccaactgatgcataatgccaaacagtcgcgcattttgaaggaattgggatgccctgctatgggtgacggttgttgttcgaatgcccttttagaggcatcagttaaagcgcgtgtgcgcgacgtagcgcggtaccaactcagacgcgcgttggcctccaacttattgttcaaatcacgcggccgcaatgatcagctgtgatcagaagcagataaatgcttgaccaagaaaacattctattctattttgttgatgtattaggagaattaattatttacacatttcccaaaatattggagaaaaaaatgtaatcaaaacgaa

SEQ ID NO: 89594 - DNA, 467 bp, Heterodera glycines
  SCN-specific regions: Sequence locations=1-467
aagttttctaaaaatggaatttgttctaattgttcgtttgcctaacgacctgaagtacataaccgtccggccatcgagtaccattgcgtttgttaggggaatgacagcatcactgatgggtactgcaacggaaaatgtgcgtctccttcttgatgggatgcctatgcatgatgggcgaactgttgagcactacggattgacttcagacagccgagtcttcgccgagctgatcaacaagggaacggacggagcaggcagctcagcagggaagaccggaaagccaccggccggacgatgatgtgcgcccgtcaaattcgaaattgtcgcatgaggcgttatggggggcaaacgaatggacgagcacagaaaaccaaccgacaaattcttttttcatttgttatttttaatttgttgatccgtttcgtgttaaagaaaaattagttgacaatgcgtaaagtgaacagatt

SEQ ID NO: 89595 - DNA, 895 bp, Heterodera glycines
  SCN-specific regions: Sequence locations=1-141,163-895
ggaaaacaaggacggctcattcttgaacaaaagggacattagcgacccgtactgcgaaatccaagtcggctcgcaagtgttccacacccgagtgatcaacaacaatttgaaccccgttttcaatgagtgcttcgaggcggtggtggaccaggccagtgggcagaagttgcgcatcgaactgttcgacaaggacaccgccggggcggacgaagagttgggacggctgagcattccgttggaaagtgttcggcaggcgggcgaaatggagcggtggcatcatctcgagggctgtaagcatggcgagttgcggctcaaagtgtgttggatggacttgagcacggaatccacgggcgtgggtcgtgacgagtgggagcaggagtggctgggcgcggacaaacccatgcaccccgcccttctgatggtgttcatcgactctgtcgccaatctgccgtatccaaagtccaatttggagccgtctccgtttgtggaggtttcgctgggccgaatcactcagcggacgccggtgaagccgaagactgtcaacccgttgttccagagcaaattcaacttcttcgtcaaacagcccgaggggcaggaactgaaaatccgagcggtggacgaagggacgaaacgcgacattggcgaattgtccattccgttggctgccgttatgagagagccgatgatggagatgagccagcagagcttttacctgacgcatggcgtccattccagcccaattgtgctgaccgcacgtcttcgattcttcactccgccccgtaaagtgctcgaggcccgggatttgtcctcgacatacggaaatgcggtgcatatcgaacggggcgaccgaacgaattcgtcgctgtcggaggaagacggccagtcgaatcacaat

SEQ ID NO: 89596 - DNA, 645 bp, Heterodera glycines
  SCN-specific regions: Sequence locations=1-31,53-233,255-645
agaattgtaaatttaaatggcaacgcaaagtaactttggaaaatttcaacagcgttcaagtcgacaatccagtcggatcatttctcaacaacccacgaaatgctttgatgaagcggctaaacgacggcgcattcagcaacaattggagtcacttgagaaagataatttccaagaggatccccacgcgaatatcacatggcacaaagcggcaccaaaatttgacgatgaaatggtttttggagacaaagaaaagaaaaggcgaaaacggaaaatcgcgtcaccctcaaaagtcagcggagcggagcaagcaacgaaaaagggaaagaaaattgtggccgctttgacaaagacgcgatttaggaagacatttgctcaacttttggaagaagcgcagcgaaagcgcgaggaagaaactcaacagaggcggaaagaggccagcccagaactccttttgcccacctattacgaagtcgcttcatctcccagcaaagtgccctcgcgaaagttttgcgctgtgtgtggtctttttgccggttacacttgcgttcgctgttccgcccgcttttgctccattccctgcaaggacatgcatttggacacgcggtgtttgaaatggactgtatgacattgcgcatccaatttaat

SEQ ID NO: 89597 - DNA, 503 bp, Heterodera glycines
  SCN-specific regions: Sequence locations=1-155,177-265,288-362,397-503
acactatttactgttggtcctctgctggggtcatcaaagtgggaacatgctcgggaacagccgagtggactcgtccaaattgacttgggcctcaacatttgcggacgctctgtacctggcaacttggtcatatgctttgctgtacaacgaggcaccgttgaatattttggtgaccaacagcataaaccatgcaaaaacttaaaaaaaaacaaaaaattattaagtgaaaaaatggaagcagttcgccccccccgccgaaaaattcaagaaaaaattttataaactttccatcgtttttggaaaattttttagaagaaatgcctagtagttcgtcataaaatttcgaaaattgctagaaaacgttttaaagaaatttttttaataaaatttttttttgaaaaactttgccgggaactgtgcacccacaaaaaccccattgactgacccaatgcggcaactgaaaaaggattctcaaagtcgaccgattgacaaatgaccctaat

SEQ ID NO: 89598 - DNA, 615 bp, Heterodera glycines
  SCN-specific regions: Sequence locations=1-73,95-249,271-568,590-615
ggagaaaagcacagatccaattccgctgacaaatgtcagatttcttcctcgacaattccgacatggacgacaacgagctggagctgaagctgaacaatttgcaaatgttgaaaaatcggcgtgccaacaaatctctgaaaatgccacccactgacattggcactaccaaattgccagtgaacggcaaaggcattggctaccgaccgctgccagaaaatgcacaattgaagcgggacattgaaacaaaaatgggcaccactgacagcgaagagaaggaaaaggagccgaaggaggagaacagagtgccaccaaacgaaaatggcaatggcaatcgaccgctgtcagacaatgccaaggaaaaaaatgcccaattgaagcgcgaaatcaaagaaatattgggcataattgacagcgaagagaaggaaactgagccaaaggagacaaaattctgcgaaatgttttcatgggttcagctgttctttggcttggctttcctgctcctttcattcgctgtgttctgctggtgtgcctcaaataaaactcaaacctcaaacactccgactcattccaacagttcttccgtgccttccaatgtccctgtgccaccctttttgg

SEQ ID NO: 89599 - DNA, 724 bp, Heterodera glycines
  SCN-specific regions: Sequence locations=1-292,350-685,708-724
agatgtcaagacctttgcctaacgtaacacaaactgcaaatattttgcgtagtaatgcgccatcgccgcataatcaacagcaggctctctatcaacaacagcaaatgttaccccaccagcaacagcagttacaccctccgccacggctcaattcgcaaccgccgtacacaattgtctaccaaaatcaacaacgcacgcctcaaccgacagttttggttggcactgccaattcgccgctccaatcgcagtccatcagttcgtcatgcgcctcttcaccccaattgtccatgaccagcagcagcggtggcggcgccggcgatggaggcacggcagcgccggtggcatcggcaaatccgcacgacccaaagcggttgcttctcaaatgtgcgcacttcttcaaatcgctgtcacgttttaaaccaaactcttctcaggaacaacaccaacaagtgctgcaactgttgagagagggcgtcacaagtgaaatgagtgcagaggaattcagtgccaaactgcgcgaagtcactggctcacaggacaaaggcactctgttgccctttttgaaattgtcacttccgttgctgcgcgtctcccttcgcaaaggcgaacagaatgaattacagcaaatgcttcgtttggacggtgccggaagcgcctcgcccgaagaaactgcgttgctttctccgcaacaacaacaactgtcagacaacggcgtcgatgaggc

SEQ ID NO: 89600 - DNA, 601 bp, Heterodera glycines
  misc_feature (79)..(79): n is a, c, g, or t
  SCN-specific regions: Sequence locations=1-534,557-563
aaataatgctcgggttgccctacgattttggaatcgacctttggtctgtggctgtgactttgtatgaagtttatacggngaaaaataatgttcccgggcaagtcaaataaccaaatgctcaagttcatgatggatttgcgcgggaagttcccgaacaaggtgattcgaaaggcggtcttcaaggaccaacacttcgactacaactgcaattttttgtaccatgagacggacaaagtcaccggcaaagacaaagttacagtgctcaccaacatcaaattgttgcgcaatcttccggctgaactctccggtgatcaggaacttgacagagatgggtttgccaaggttgaccatttccggtctttgctcgaacagatgacagctttggacccctccaaacgaatttcgtgttcggatgctttgaaacaccctttcattgtagaaaagtgatgtgaactttaagcgcagaacatatttgaacttaattccacttcctttataatttgttttcattaaacaatcgaaaagagtacggaaaataatgacaaaagttttaaatgtcgccgaaaagaaaaaatgaagaactaaaaaaaaaaaaaaaaaa

SEQ ID NO: 89601 - DNA, 318 bp, Heterodera glycines
  SCN-specific regions: Sequence locations=1-40,62-110,136-269,292-294
cagcaggcggacggcccgggggacagtcagagtgatttcaatttcaatgctttcttgggcaagccggacgagttcagcaaggaagtgacggaaggcgctcttttcgatttcaacttttgagctttttctgttttcatttggctttggttgtgctgtaactgttaattctattttaatctgcttatcattatatttggccattttttctttgtttagcattgttttgttctggtcatttcatttgtgtaagtaactctgtatttctgttatttttcccaataaaatcattttttcaaaaaaaaaaaaaaaaaaaaaaaa

SEQ ID NO: 89602 - DNA, 429 bp, Heterodera glycines
  SCN-specific regions: Sequence locations=1-177,199-280,302-379,401-429
ttaagatgggcacgaaaataaaaatattcaataaggtaatttggatcccaaaaagaatttggggtgaatcgttggcatttgctggaattttaattgggctgcactttgtttactactcaatgcaaaacaacccaaatttaataccattgaatgatcgtcgggaactgatttatgtgaaatggatcaaagaaaaattcccgtcattgggttgggttggcattgacgacagcgaagcaatgaaaagaagggaacggatcatgggacagaaagagcaatagacagaagaagaacagaaaaagaatggccaatcggagggaccgatttattatatttatttgtgtttccgttccattatatgtaattgaaagctgtttacatgtagaaagtagaaacaaatgaaatagaaacagcaaaaaaaaaaaaaaaaaa

SEQ ID NO: 89603 - DNA, 705 bp, Heterodera glycines
  SCN-specific regions: Sequence locations=1-399,421-484,506-564,586 -669,691-705
ccaagtttgagacctttattgaaattgagtacgctgtgccaattgtgcggcgctaaatgcgacaaaattggcgcaatctttggcaaattcctggcaaatttttcaatgtgagattttggcggaaaaagccttttcaaagtgctcgccgacagtgcctttgagaagccttcgttggtcgacatctttttctcgtctaaattattccaagcttctctgaatgacgcatgtgaagcattgatcagaacgcaatcgcaacaatttaagctgcttaagaagcgcaacttcgacgtgatcatttccgagcagctcaacttttgcggcgcgggcattggccatttgctggacatttccgtgaacattgtgctcagcagctgttccctccaagagcaccttgcttcgctgattggccttccgtttccctccagtttcgtgccttcattgatggattcaaattggtccgacaaaatgtcgcttttacaacggttccaaaatttgctacacaaattcgccggctacaattatctcagttgtggcatcgacccattgacacaaattttccgaaaacattttggaaatgcttttcccgaccttcgttcaattgtcagcaaatcgccgctcattttcgttgcttctgatgaatttgtggactttcctcgtccccttttttccaatgtcatttatatcggtggtcttggaatggagaaa

SEQ ID NO: 89604 - DNA, 546 bp, Heterodera glycines
  SCN-specific regions: Sequence locations=1-514
acttcctctttttgccgtcacttaactaaggttgcacatcgttttttttcgagcagtgtccgacagacggaactgtctttggagcgacacgagtggcaaacggtgatgtgttccaatggagtgatcgcgtgttggcacccgcccaaacaattcccatttgagcactcgcgcacctttaacatggaaaaggcaatgtcagaaaaagagaaatttcttaatcgtaaacccgatcaaactctttttacaacggcgcccgatgataatgcgctttgcgaaattttccacaccgaaaagcaggaatggaggccgatatatcgagagaagcggctttacaatgcgaaagttgaagatcaattgaagccgattctttccaatccgctggaaactccgactgcccctgtcatcacaaaaaatgtcgaaaacgaagcccatcgaattgaacagggagtcaatgaagggaacaacccaaatattttgtcggaatgatatctcattctacggttaaatttcttcgaaaaaaaaaaaaaaaaaaaaaaaaaaaaaaaa

SEQ ID NO: 89605 - DNA, 864 bp, Heterodera glycines
  misc_feature (863)..(863): n is a, c, g, or t
  SCN-specific regions: Sequence locations=1-57,101-553,577-805,827-864
tgagaatgccatctcttcggatttgccccttcaatttccccaccaattcccttctaatttccgtccttttgcttcttttctgtctccaattctttcctctcaatgcccttcatcattcggtttttgttcgacgtgacttgagccgacccgcgccggatgatggcgtcgcgtccgcctccatcaacacggaggaggatttgggaggactgaacaccgaatggctaactgacgatcagctgagcgaattggcctctgccgggagtaacgaagaacgaatgataaaaatgaggaccttttatgacaatttggaaggcgaagcgaagaaaggcgcaacgaagaaaatagtggaggaatgctacggatgggtggacgaagtggcgacggaggacgagcgaaacgcactgaagcaaatgcaccaccaaagccatgacgaatgcaaggccaaagtcagggaactgatgggacggctaagtgaggagagaagcgaacaagtggagaatcggatgggtttctgcgaacacgtctattacgggaagatggacggggaaggcgacggaggagcaggaacagctggagacgaacaccaccaccaccatcatcaccacaccaaaagacgggctcacaggcaacgcagagaccaccaccaccaccaccatggcgaacatggacttgaggattatttcaaaacgcatttggcatggttaacggatgagcaaaaagcggaaataagcaggatgaaggagtcagggaaaagccgacaggaaataaagcagaaagtgatcgaattgtacgacgcaaccactggagaagcgcgagaaaaggcaaccgaactgctgaagggcgggtgccgagagctgattaana

SEQ ID NO: 89606 - DNA, 668 bp, Heterodera glycines
  SCN-specific regions: Sequence locations=1-108,130-668
gtttgagacatctctttcgcgcctcattaaatgcatattcaaacggtcccgtaattgcagaaaacattataaattcgttgaaaagaaatcgagaaatggggaaggagcaacagaaacaacaaaacaaagaaaaaaaggttgccgcacaacagcagcaaaacaccggagatgaagcggggactaagaaacagacaaggctcgggttggatgtgacaaagacggagaactattccgaatggtattcccaggtgatcgtcaaggcagaactaattgagtattacgacgtgtccggctgctacgtcatccgtccctgggcgtattccgtgtgggaacacatccaagcattcttcgacgctgaaatcaaaaagctgggcgtcaagaactgttactttcccatgttcgtctccgctgctgcgctcgaacgcgaaaaaacgcacgtggccgactttgccccggaggttgcttgggtgaccaaggccggaaacaacgacttggccgttccaattgccattcggccgaccagtgaaacggtgatgtacccaacctttgccaaatggtgcaaatcacacagggatttgcctatcaaaatcaaccaatggtgcaatgttgtgcgatgggaattcaaacatccgactccctttttgcggacccgggaatttttgtggcag

SEQ ID NO: 89607 - DNA, 616 bp, Heterodera glycines
  SCN-specific regions: Sequence locations=1-471,493-616
gtccaattaaggtcacaatgagtaacagtaatgacagtgacgacctaattatttatgacgacaatgaagacattaaagacgtttcatccgattcgggtgacgaagtagcgatggaggaagtcaccaatgcaggcacttctacagctggggccttatctaacgaagaaatcagggactaccaagtgctttctcagacggagttggtcgacgaactgaataagctttcatctgaaacttcagcagtgttgcgtttcaatggctcaatttgcaaggtacttcttcatcacttcaaatggaacaaagtcacactaattgagagattcttcgaatttcctgagacttcaaacaccgattcattcttccgcaatgcaaatcttctcgatcctacaaagcataacaaaatcgaaggaaagggtgattactgcaagaattgctaccatttaagacaactgactggaatgctgtgcaaccatttgttttgccgtcagtgctggtccaattacttgtcgtgcaagtttctcggcgagggtcgaccttatgtcacttgtcctgaacttcgatgtactattgttgcggatgatgaatttgtgctcaaaaatgtcgacaataaacaagc

SEQ ID NO: 89608 - DNA, 829 bp, Heterodera glycines
  SCN-specific regions: Sequence locations=1-328,352-829
gtttgaggtggttataatcttttaattaaaacaattacgcaaaatggtcacccaaaacgaccatttgatggcaaatttgtccgaccaactcacaaatctgcaaaaggaattggacacactgaaaaaggacatgacggcgaacaacgacgcatttttcaattgtgccatggcactgatcatttttctgatgcaatgcgggttcgcctttctcgaagctggagcagtgagaagcaaaaactgcacgaatattatcatcaaaaatgtgcttgattcgcttctcggcataattgcttatgcggcggttgggtgggcactcgccttcggctctaaccctttgcccgtgttggagccctatttcggcttttcccaatttggaatggtcggcaccacggaattctcaaagttcttcttccaatttgtgttctgtgccactgcctccaccatcatttcgggtgccgtggcagagcgtgccgagatcgcctgtttcatcacttattccttggccatcaccgccttcgtttaccccgtgcttacccactggggatggacgaaacagggttggatggcagccagcggatttgtagtcgacgacgctcaccaaatcacttacgtggactttgccggctccggaatggtccatgtgtgcggcggcactatctctttgatcgccgccgcactgatggggccaccgatcggacgcttcccggagaggacagtcagcgtgccggtggggggaccgaggcggaagcagaacgagcccaaaagtgtggagatcaaacgacattcagtgccgctcgcctctatgtggggcttcattctgatagccgga

SEQ ID NO: 89609 - DNA, 568 bp, Heterodera glycines
  SCN-specific regions: Sequence locations=1-199,221-427,449-568
gtttgagttattccagcgttatgaaattctctcatgtactcgcgaagggcaaggttaatttgaacgcgcacacttggttccgacgcgtctgggagaagggctattctggaccgccactgccaaaaattaaacgtactggaaaacctcccgtgccggtgacaaatgaggcggtcaacgaagtgcggacggcactgatgcgggaatggaatgtcatgcagtggctggccaacccgtacctcaacgcggaaaaggaggcgccatatttggagcgtttcggggacatcaatgacgaatggacacagcgaacggtcgaggcgaaacatcgcaaaatgcccaacaaaccgaaaatccggcaaattgcatctggcgaagtggagaagagacgtgccaatgttggcaatttgttacacgctcatcggacggtggaggacgaactgaagaatttggagcgcagaaaccgatgggactgaacaatcgatcacttcaatttccttgtcatttcaacaaatcattgttttagttctacttatatttgctggccacataaaatggggttgttcgttaaaaa

SEQ ID NO: 89610 - DNA, 689 bp, Heterodera glycines
  SCN-specific regions: Sequence locations=1-91,114-120,142-245,269 -485,507-574,610-689
agattttcgtcctcaaacgtcggttgtttttccgccgttaaaatgaccgcagcggcaaaactcagccgtttcttccgccgtttggtgcacgtccgacagatggactttgaattcgctgcttggcaaatgctttacctgctggtcaatccgcaaaaggtgtacaggaatttcatgtacagaaaaagtttgttgtccctctcaattaattcattaatttctaatttcgttcagaagccaaagatcaatgggcccgcgatgaccccgcctttctcctccttttggcactttctctgctcggctcgagtgttctgtttgcattagcgctcaatttgtccttttcttcgttctgcgcctttttcctttgggttgtgttcatcgattgcatcggaattggcattgccattgcaaccgcactttggttcatttcaaatcgctttttgcgtcggacgagggattgcgacgtggtcgagtgggcctattgcttcgatgtccatttgaatgcttttttcccgttgctcattcttctccacgtcattttacctttgcttttctacggattggttgattaccaaaattttctcgcccgcttttttggcaattccatttggtgcattgccaccatttattataattacattactttcctcggctataccgcacttcccacgctggaaaacacgcaattcttc

SEQ ID NO: 89611 - DNA, 600 bp, Heterodera glycines
  SCN-specific regions: Sequence locations=1-600
gtttgagaaaaacgttcaaatgtttcgcttttcgctgcttctgctgcttgtccctctcgtccgctgtgtccccaacccaaagcctttgttcggaattggcatcggtcgcaagcaaagcgcgggagcggaggggaagctgacctgcgctggagagccgttggcggatgtgaaggtgaaactgtatgatgacgaccgcggggtggacacggatgatctgatgggtgagacgagaacggactcagagggacgcttcagattggaggagtacacgaacgaaatcaccaccatcgaccccaaaattaacatttaccacgactgcaacgacgggctgaagccatgccagcgcaaaatctcaattatgatcccggacaaatacatcgcctcgggcgaacatcccaatacatattacgacgcgggcacaatcgaattggagggcaaattcagtggcgagacaagggactgtctgcactaattgcattggaactgatcatttggcactttctgatcagttgggactgaccaattggaactgtctgcactgatcactttcccatttttgtttctgttttgtcaccgattttccccaaagtgttacaccac

SEQ ID NO: 89612 - DNA, 629 bp, Heterodera glycines
  SCN-specific regions: Sequence locations=1-87,109-629
tcatcgtttccttgtgcctcttaatttcggtcaaaattttacgtctgacaaatctcgacattttgtttcgtattcgggacgggcttagaagtgggaagccatttattacggcactttttcgggttgacattgaatctcagaggcatggcggtgaacttgtggccgaagttttgaaggcccatggagttcgcgagcttttcaccctgtgtggtggtcacatttcgccaattttggtcgcctgtgaacaaattggcattcgtgtgttggacacgcgccacgaggccactgccgtgtttgccgcagacgcggccgctcgcctgcgccaggacattggggtggccgcggtcaccgccgggccgggcatcaccaacacagtgaccgcgttgaaaaatgcccaaatggccgagtcgccggtgcttttgttgggcggcgcgtcgccttcccttttgaaggggcgtggggctttgcaagacattgatcaacagacgctggtccgttcgttgtgcaaattctctgcccgagtcacctgtgtccggaacattgtgccgaccattcgaaatgccattgccaccgccgaatcgggcacgcctggtcccgtgtttgttgaactgccaattgacgttctgtac

SEQ ID NO: 89613 - DNA, 617 bp, Heterodera glycines
  SCN-specific regions: Sequence locations=1-617
gagtcgaccatattccaatatattaaaatttcttaactatgtcgacctcttcaaagttgacagtgatcaacaccattgcgacaatgcgacaattcgtgcgcaaacatcgtaaacagaacgccaatctttgcgtggcattagtgccgacaatgggtgcccttcaccaaggccatctccgactggcacaccaggcacgccaatggcataatgacaaaaaagaacaaaatggcaccactgatcagtgcgcctctccgcccctggtgatcgtctccatttttgtgaatccgcttcaatttggcccaaacgaggactttgaacgctatccgcgcacattggaagcggacttggccaaattggagggcgtcgtggattgtgcatttgtgccaaatgccgtggaaatgttcggggaggaaaagcaaccgctgaatcacaaggatgaggaggatgggatcggcattaaatccggacgcattggacgtattttggagggtgtcacacgtccacagtaccatgacggaatgttgctgcatgtagccaaacttttcaacattgtgcaaccaaatttggcattttttgggaaaaaagatgctcaacagctgttcgccatccaccaattg

SEQ ID NO: 89614 - DNA, 628 bp, Heterodera glycines
  SCN-specific regions: Sequence locations=1-440,462-628
aataattccagtccatgatgagaccgtttttgggggttcgtcgaattatctctgtttaccgcacaatttccggtttacgacccttcgattgcgttcaacggacattgacagttcccatcgaagggaaagcgccgaaacgatgcaccgccgaggaagcagttcgggacatcgaatcagatgaacacatttacttgcatcatgccatgtcgtgtcccaccgatttactgagggctttcggcaaacacatcgaaaagaacgatttgagaggaatccgtgcaagccatgccttaacttgcggcgaagtcccatggactgatgagaagctccatgaccgagttcggagtacgaccattttcatttgttcgaattttcggaaattggtgaaccagggaaaagccgactatttgcccgtctttctgtcccaatccgcgcgtctttacgatgaaaaagttcttcgagttgatactgcacttttgaacgtttctccgccggataagcatggttactgctcacttggcgttagtgtcgacatgtccagtgccgccgctcgaaacgcgaaaagagtcattgcttccatcaacaaaacgcagccgcgcaccttcggagacgccgaaattcacatttccca

SEQ ID NO: 89615 - DNA, 347 bp, Heterodera glycines
  SCN-specific regions: Sequence locations=1-316
gtttgagccataatcgtttcacaatgttgattttcccgcacatcaaattttcgacactccttaaacgcgcgactgtcaacagctcctattatgtctcatacgctgcctatggtgcctctgcttttcttgtgttggtttacgttacggaatggaagcgtttcgcccgttatattcccggactccgttcgcagatcaaatcggacgaatgaatgaatgtctcgtggggtgtgcggaacggtcgactaattaggcaatgatgatgacaatgctgctgttgttgtgtttaagcatagaattctgacaaaagcacgtgtataaaaaaaaaaaaaaaaaaaaaaaaaaaaaaa

SEQ ID NO: 89616 - DNA, 328 bp, Heterodera glycines
  SCN-specific regions: Sequence locations=1-91,114-301
ttcattcttgattatgtctatgctcgatgggagcggggatagttgttttggggcgggagctcttgtcggatttggtattcggtattttggcgcaggacccacagcagccacagcggacgaaactgatgaatttccggagaacgaagttatcgatgaggggccgaacaacaacgggcagccgccgaatcctcaccatccgctgccttttaacgaggagagtgattaagaaaaacattgtgacatttaattagcgtattataaaatttgatttatgttgttttttgaataaattattgagtttaaaaaaaaaaaaaaaaaaaaaaaaaaa

SEQ ID NO: 89617 - DNA, 621 bp, Heterodera glycines
  SCN-specific regions: Sequence locations=1-373,395-621
tgagaatgttttaaatgttcgctggtattgatgggcagcaaaatcttctcctttccgctcaattacagcgtttactttgccaccacggagaaacggcgaatgcattcgttttctgtcaccaaatgcaaccggagctgcaaaaggggccgacttgcggattcgccgttcttttgatggcgttgcgctgttccgtcggcgatggtacgttggaccgattggtggaaatgggcaaacatttcgggatcacttacaacggcgaactcttttccgctgattggatgtgtgaatttgtccaaaaacattggccaaacgcttgcgaattgcgagtggcccaatttccatctccaaattccatcgtgcggcatttgatttctgggaaaaaagctcatcatcaatgtacaacgacagttttggtgccgtacgattgtgacaaaaatttcgagccatgcaatcggcagggcgttgctgcacattgggcaatcattattggatttgttatttttgatgtcaccgctcaaaatgggccagaaaatcatgcgaaagttattgcatttgacgaaaatgacttccgctgtgatggctttgacaacgaacaccttttgtatcttatagcgcttcagg

SEQ ID NO: 89618 - DNA, 643 bp, Heterodera glycines
  SCN-specific regions: Sequence locations=1-507,529-643
gtccaattaagtgtttttttaaatttatatttctttgctctgcatataacaatcaacgagagaaatggggaattgtaagcccgcggatgccactgagtcggagaacgcgtcttctgtcgagacggttgaagttgaagtacctccggaccctctcgttaacccattctggaagatgcaaaaagccttcgagaagaaactgcgtaatctgttgaagcgtgagaagaagcttttgcaactgaaggaagaacgcgattccgacaagccgatcactaccgaccaacacgaggctctcagcaaattggacgaagttaaaaccctcattgggttcgttgatgagatgatgaagttgaaccagcagcagttcagccagtataagaaagccatcaaaaatcgtgaacgccaactgaaaatgcagaaggcgcgttctcaaatcggtactccacaattgtcggatgagctgaaaaagtcgacggaggtacagacgaacggagtcgccgaggaagtgcaggcggcggtgggcgtcgtgggaccttccagtgaggtttagaacgtgtgcatttgggacgaaagagacggacaaattattgatgtttatcaatcagatgcttttgttggtaaataaatgtgaattgtcaaaaaaaaa

SEQ ID NO: 89619 - DNA, 1070 bp, Heterodera glycines
  SCN-specific regions: Sequence locations=1-447,469-1070
gtccaattaagatcattctgcacacatcgcatcattcatttattgttttcttatgacaacggaaccaaatggtgccgttgaccagcagcagcagttgctgtttgcctcaactgcttgcgcatgtcgtccgaacaccatggaatggtgcaaaacaacttcatttattgcgtttgcttctcagaggaccatctgcatcgtctctgatcagctgccataccaccgaatcatcgaaactgtggagagagcgcacggggctggcgagataacctcattgactctgttgagaggaggcaccgttggcaattgcaaaatacgttcactgttctgtaccgccgcttcatctggggaattggcaatttggaaaatgtttaaaacaccaacgacgacaacaattgctgatggtgatcgtcgtcatgtaatgtgcatcaaaagactcagcaaaaaggcgagcattgaactgtccaaaatggctgcgtatgcaggcgacactgacgatgtactgcttgcaattcttcaatttgaccacattgatgtccaatttctgaacttggatggcgatgatgatcaaattggtgccgccgtttcgtccctcaaatttggcagtgccattccatccacttttgaactttcgcacatttgtggtgccgttgtcatggctgttggcttgtcttatggactcattgacatttttgtctcggaaacgaattcttactccatccagaagaaattgtcccttgacttatgcggtagcaacaaatcatggacccgcgccttggcatttaatgttagcgaagatggacagtgccacaatttgtcgcttgccgcagcaaccgatgggctaatcaaaatttggcaatttgtcggcgatggtgacaaaatcactgtgacaccactcgcaaatgatgatgatgaggaccaacagctcaagatgaaccaacaaacattttgcatccaaaatggcgtcgctcatccgatctctgtcactttggaatccgtcctacacgcgcagaccggcccaatttatgcacttgcatggcatccaaagcgtttggagttgctttcgtctggcg

SEQ ID NO: 89620 - DNA, 624 bp, Heterodera glycines
  SCN-specific regions: Sequence locations=1-235,258-437,459-624
gtgtacaattatttaaagaaaacagcgctttctgttcttttctcgcttcaaaatgtctctttttcttcttcgtgctttgcctcttttcttccttttctctctgtgcttcgctgcctctcccttcaattttcgcgcaaatcattcgcttggtgccgaaaccactcaacagattgtgcccaccgtggcgactgaaacgaccgacggaccgaagcctacggaaaatgttccccttatgttggagaatgacaatgtcaccgaagttgccaaagttgaaggacggaatgccaatgacagcgaaattgaaacgagggaggaccaagcctttgccaacatcactgctcattcctccgacaatgcttcgcttactgagagttgtggcttcttttgccgaaacgtgcctttattcgtcggcttcatcttgaccctcgtctgcgtttctctgctcctcattctttccattcttttgtaccgttattttacgcggcgcacttacgccgacgagtgaaaagacagcgaatggacgcaaagaaacgatgattcttcttaaaatgtcatttcatttttgctgatgccatcaatcaatttgttgcttttcccttttgttggcctcctttttgaggcctt

SEQ ID NO: 89621 - DNA, 626 bp, Heterodera glycines
  SCN-specific regions: Sequence locations=1-377,399-626
gatatcttgaatttattttgtttcctcatccgatggcctcgagaacgttttctcgttttgcgagcaattttcgtcttttcggttcagttatggcgacaaatttgtcaggaaggagtcactgtttcgttgccaagaagtccttaagcacgtcccctttggtctatgctactgcagcagccgcttcgcagccgaccactccaaaggcgaccgttaagggaaagaaagggcgtgtcgttgctgtcattggtgctgttgtggacgtgcaattcgatgagggacttcctccaattttgaatgcgttggaagtgcagaaccgcgcttctcgcctcattctcgaagttgcacagcacttgggtgacaatgttgtgcgaacaatcgccatggatggtactgaaggtttgattcgtggtcaggaggttgttgacactggtgacccgatcaaaattcctgtcggacctgagactcttggtcggattatcaatgtcatcggcgagccaattgacgagcgagggccaattggtgcgaaaaactatgcaccaattcatgcggatgcaccagaattcgtggaaatgaatgtcgagcaagaaatcttggttacgggaatcaaagttgttgacttgttggca

SEQ ID NO: 89622 - DNA, 646 bp, Heterodera glycines
  SCN-specific regions: Sequence locations=1-188,212-563,587-646
aaacaactcatcggacagaacaatttgcaaataaatttctgatgtcaaaacatcaaaaaagtgctgttacgccaccaacgacgacgacaacggcggcagagagtggcggcgaaagagacggacgcactgagacgacaagcggacagcggaaacgacacagcgcaaaccaaacggactcggcgaacggcgccgctgggggacaagggtcgaataacgccgttgttttgtcctcttctgagtcggctgcaaaggaagcaaaggtcagaaagatgtcgacaacatcgcagaacaagggccacaaatcgaacaccatggcggaggacagcggcggtggcacgggcacgtcggctgcctcttcgggcaacggggcggagcagaacgacaacagccgagcgaccagacggccagcggaactgcagcatttgattgactacttcccggaccagcagagcacggacggaaatcggatgacgcgttcgaaggcgagagcgatgcaggacaaaagcagcaacagtgcttctggttcgtctggtgttcagcagcagggctcaagtggaaatgggagtggtggcaatggtcctggcgggtcgtcatcggcaaaaagtgttgggaatggcgtcgccgccacaccgaacacacaccatgg

SEQ ID NO: 89623 - DNA, 812 bp, Heterodera glycines
  SCN-specific regions: Sequence locations=1-193,220-240,278-812
gacccatcttacacacaagttcgattagtacaaaaattttatcatccaaaactacgtgatgcgacatgctgcagctccaattcgtgactatgaccatttgttcaagttgctcataattggcgatagtggagtgggcaaaagcagtttgctccttcgcttttcggacaacactttctccaccagttacatcacaacaattggtgtggatttcaaaatacggacgattaccgtgatgggcaaaaagattaaacttcagatttgggacacagccggtcaaaagcgattccgaacaatcacttccacttattaccggggcactcatggtgttatcgttgtgttcgacgtgaccagcattgagtcgttcaacaacgtaaagcgttggcttcacgaaattgacaccaattgcgaaaacgtgcaaaaaatactcgttgggaacaaagtggacgagccgagcagacgtgccattcccgaagctgaggctcgacgttttgcagagtcaatgagaataaattatttcgaaacttcggccaaagaaaatctcaacgtggagcagatgttccaatgcataaccgaaattgtgctcgagtcgtgcgtggaccgggagaagaacaatccgagacaggcgacggatgtgctcaaattgcgacagagaccggagaagaaaaggaaatgctgcggctgacgcccccccccctcccttgggaccgctgtttaaataacttttgtttatatttggactgtatgcattacatccttaaattttatcattaatttatatgatcatatttcatcatttgaagcttttacttttg

SEQ ID NO: 89624 - DNA, 955 bp, Heterodera glycines
  SCN-specific regions: Sequence locations=1-168,199-468,490-553,575-955
aaaatataaaagacgagcgatcattaagccaaatcatttgttaaacaaattcaaaattgacttttgaactgccaatctccaaaatggtgcttctttgctgttcccaacataaaatggaccgctcattgcccaattgcctcagggggtgccgttgtggcattttggtcggcagaaaagggaagaaaaatgtgccgaaaagcagcggagaggagggaaaagcggagcaatcgcagcagaggaacgaacggaaacagaacaacgaaaattattattgttcagtggaagagatggcttacgatgcgatgtacgacgaaaaaatgccggcggatgaacgggacaaaacgggcacagtgcttcaacgagttgcgatggcacttcagggaaaggccggccccgaacaataccaacagttcaaatgaaaagcggtggaagagaagaggaaaagccgttttgggtggaaaatacaccaaaaaatcaaacaaattggaatttttttcaattttttgttccagacaaaataagcatcacaaaagtaacagattaaattaattggaaaatgtttttgctttgctttgtattgctaataaataacaattacaatttgctatttacaactccgcttcatcagagatatgctcaaagtaaagagctaataaaacttgaaaatgaaaagggaccaaaaataaaacagaagaaaaaataaacgaaagataaaaaaggataaataacgaaggatatggcaaggaaaatattgtcggatggactaaccaacggagaaaggcccgcaaaagggagaaaacctaacggataattgagttaatggtataattaaaatttaaaatgaaaaaacggacggaatggaaaataatttacaaaacgaatgaatgggcgaacgatcgtccgtttttggctatgtacaaacaaataattgcgtgattcatacaatgcgtcgtct

SEQ ID NO: 89625 - DNA, 1268 bp, Heterodera glycines
  SCN-specific regions: Sequence locations=1-36,64-86,108-112,134-1268
ccgccgtttcgcttccacaccgacaccgacacgcacacttgacttgacttgacgacttgacttcaccaccaaatcttcccaacatgtttggcttccgcaaccccgctggctccacccacaaccccaacatccttgtcactgaaggcgacacttggaccggcttctacgctgcctggtcgctcttgcgccaccaccgcggcggccacgactcgacctccgcacccgcgccaaccggccaacccggcatcaccccgacgcaccacggccatgtcaacaaggtgattgtcgatgtgcgcgactccaactcggactttgccaaggaactgcacaagctcggagccgagttgcgtgaatacgacccctacaacatggacaaggaccagatccaaaagcacctgctgcgcaacgacgtggacggcgtggcctttgttcccgtgcacgactcgattggccacatgatcaacatcaacaagatgctgctgcgcgcctttgaggaagaggagcggtgcaagtgccttgtcatgtggtcgtcgattgggacccagattcatccgggcagcggccacgatgacgacgaggatgtgcttgccaagagcaagggcaagtcgacggccacgcggacctcggccacgggcggcggcatgccctcttggggtcagcttttcgagaacaagtcgcagattgaagggccgtgaggaacagcaagtttgagcacgagtgtatcttgcgcattggctttgtctcgcaacaattctttggcctctcaaacgtgatccagtcccgcggcatgttccccgtcacgtcgcgctccaacaagtgggctcccatcaacgccaaggacgtggccatggtctctggtgctttgctagccaacccgtcgctcatgtccaagttcaccaagcaaaccctggtgctcacgggcccgcagtcgcactcgggcaaggacatggtcacggtgatcaactcgacgctcaacgccaagctgtcgctggaggaggtgtcgctcaaggacctcgagaccatcttgctcgaccaagaagatgtgcccaatgagggcgagctcgccatgacgctcgggtactaccactacatcaaggagaacaagctcgacattgtctcgaacgacgccaacaaggtgcttggtcgtgtgccctcggacattgacgtgttcttcaaggagaacggcaacttgttccgccctcgtcggaacgtgaatgcgaccccgtacttgaaggatctcaaacagtaaggcaaggaccatggcgtgc

SEQ ID NO: 89626 - DNA, 627 bp, Heterodera glycines
  SCN-specific regions: Sequence locations=1-627
ccgacgcggtcgcaaagcataaaaaaagtgactgaacatggcagttcgttgaagcggggccccggcggaagtttgggcgcggcggacagcagcggggcaatttcgcaactcgccattccgacggtgggggcgctgaaggccagctcagccggagacatcgcgcaacagcagtctccccactcttgcttggctggaaccagctcgacctcatgtgttgagctgaacgcggaggcggaggagcgacgcctggtcgagctggtggagaagttcgacatggactggggcagcgatttggaggttgacactgaaattccgagtctcgagtcgctggtcagttgggaaattctcaagcatctgaagccaaaagagaagaagcgccaggaagtggtcaacgaactgtaccaaaccgaacgtacccacgtgttgcgtctgaaggtgctttacaaagtgttctatcggcccatggttctgcagcgggtcgcctctcctcacctggtcaaattgttattcggcaatttggacgaattattaaaagtacacgcggaaatgtgccaaaaaatgaagcgccttcggcttcagaatgggctgtacggggagttgggctcggtcatggaggagctgttctgt

SEQ ID NO: 89627 - DNA, 1013 bp, Heterodera glycines
  SCN-specific regions: Sequence locations=1-925,947-1013
cacaattaataaatttatttgacaaatgccactttttcttggcattgacctcggcacaacgtcagtgaaaattgccctaatcgatggagacaaaaagacatttttggaatgggacagaaaacacaacgcattaattgagagagaggagaaggacaaacacgaacaaagcccaaagaaaatattggacaccgtacagaaattgatgggagagatggaaacggacaaattggcacaagtgaaaggcattggcatttcgggacaaatgcacggagtgatgctgtgggaagccgactcaattggtttgggcgtggaccgttgccactgctcccctctgatcacgtggatggactcgcgctgcgacgagcaattcctgcggaaactgccaaacatccctcttgactcagtccaaaagtgcgtttatttcctcacaaaatgccgagtcgtggggtttcgtctccgacttcatttggaccgtccaacagataagctgattgatgccctccctctgtttcccatttcattttgcttttcctcacgcccatttccccactcatttgctgccctccatcgtttcccccggcactttcattggccgcacttcgcttcccttcgcccatttgccaaaaggtgtcccagtgactgtgcccctgggcgaccttcaagcgtcgcttttgccctttctcagtgctggagtggcagctcttcacattggcaccgcttcgcaaatagcctttgttagccagcgattagcagaagaaatgtccccaaaagtggtgcttcccaattccatccgtcgcgaccctttctttgacgacgactttttgctggtcgccccttcacttaacggtggcaatgtttttacgggcctttttcaacaaattgcttcttggtccgccgatttgttcggctttccttccgatttctctcctttgtccttttctgctgccttttctctgctcgaccgaatatttaattcaccaaattcgcagccaaatgacggcgaagtgccgccg

SEQ ID NO: 89628 - DNA, 630 bp, Heterodera glycines
  SCN-specific regions: Sequence locations=1-630
attaagcaaaaatgacttccaattctactgatggttggggatgtaacaacagtgggtggggtcaaagccaagcaaaaatgacttccaattctgctgctgatggttggggatgtaacaacagtgcgttgcgtccgaaccaagcaaaaatgacttccaattctgctgctgatggttggggatgtaacaacagtgcgttgcgtccgaaccaagcaaaaatgacttccaattctgctgctgatggttggggatgtaacaacagtgcgttgcgtccgaaccaagcaaaaatgacttccaattctactgacggttggggatgtaacaacaatggctgggctccgagccaagcaaaaatgaccaattctactgatggttcgggatgtaacaacagtgtgaggggtccgcgcgaattttctcggagtttcagtggacgcccaggatttaatcgccaacctgtgcctctaatgaacaagttgcctccaattcctccgtccacaatacttttcgtcgacggcattgaaaataagaacaagaaattgccattgctttctgtcgaagagatcacaaagattttttgggacattgccaacatcagtgtgcttgacgttacccggcccaaacagcacatgcgca

SEQ ID NO: 89629 - DNA, 448 bp, Heterodera glycines
  SCN-specific regions: Sequence locations=1-37,61-448
aaaaaaactacttcaaaaacaaaaccaaaagttactatcccttcaaccctatcctccccctctccttacgcaaagaaaataaaaaaactacccaaacaaaataaaaatacaatagacgcacggggcttgtaccatacaggtaaacacaacaagaaaccaagccgagctatcctggaattgcctggatggcaatgggatagagtacctataccgaaagacccaacggaagaatgtggtaaaatagtttttgaaattaaggtagatgcaaatggggaggtggttgcagttcgaaccatagagaaaaccattacgcccctcgtagaaaaaatctatgcggatgaactgcgtagccttacgtttagcaaaacaaaccataataatgcgtcttatcgtaacctatctacaggaaaagtgatcttcatactcgtagcaaagtagtagctgtttg

SEQ ID NO: 89630 - DNA, 895 bp, Heterodera glycines
  SCN-specific regions: Sequence locations=1-44,151-362,387-406,430-895
ccaagtttgagaatctgatgccaacagccggagaaattgtgcacgaagaaaggcagcaggagaagatgaagaagacgaactttgaagaagcaaaggaagaaaaagggagaaaaggaacgattaaagggggaggaagaagaagcaaacgaaagcgatgccagcgcaaccgaactgcttcatgttcatcggaaaaggaaaagcaaacgcagcaattcgatggcattggcggtgccacaccgccgcgacagaaacggcactttcctcaagcggcggtggtggacaatggcgccagaagagtgacaaaagtgtggcacgatgaaaagcagcgggtgaaaatggcacgcgtggaaacggcggtggaagggggcggcggagacagcgacggcacaatggcaggcggaagaacacttagcagcagcagtgtcatttctgcgcgccaccatcagacgcagtcgcgcaacgcgctcaaaccgcgggcaccaaacaacacaacctctttcttgatgagcgatttggagaagcggcaacagcacgaggaagatgatccgcaacaacacacggacgcacttggccaagtcgcggggacgcagcgaggccaaaaagtgttggggagcaaggaggttgggggtgccaccaatggtggtcatcagctaacgacgccaatgatggcaggcgaaagcgcactgcttgcggagggcggcgacggcacggacattgaggagcaaagggacgccgacttcgaggagtgccttttctccacttccatcgaacggattgaaaggctatcgcgcgaagaggttaatcgggagttgctgctcgcagaccgcgacaaccgaatgctgaagcaacgagttacgctgctaagagacagctaccagcaagtccaagaagaaaa

SEQ ID NO: 89631 - DNA, 635 bp, Heterodera glycines
  SCN-specific regions: Sequence locations=1-15,37-600,622-635
ttgagtttttgcatttcaaaagttcgctgtgaattgtgcactgtatggggcgaccttttctagagcatatgggcggcagaaaatattactcatgtcgaagatgcaaaacgtacctcaccaacagaagggagttgatttcgcacaccttcagaggtgcaaccggacaggcgtatctcttcagaaacgtcgtgaacatcgtcatggctaaagtcgagtcgcgtttcatgatcactggtcagcatatggtccgcgacgtgttttgtaaaatttgcaacggaaagcttggctggatgtacgaatttgcccatgagccacaacagcagtacaaagaaggccgagtcattttggagcgcgaattgttaaccgaacatgaggaaacggaccccgggcttgcggagcggaaccgaccattgacccgcacttcctcgtcctcctccgtgagcagcagtgggatcagttctgttacaatcacctgacaatttcggactgaataaatgatagaatccattcctcatcctctgtgctttcgccaaaaaatgactggcttcctaattttacttttatcattcattcatgcacatatactcactcaatttcccacaactgaacgaaatttattaccaacgatttgtgta

SEQ ID NO: 89632 - DNA, 609 bp, Heterodera glycines
  SCN-specific regions: Sequence locations=1-123,146-609
aaagtattttaatgcgtcttgagaagtgttggttttgttcatcaacaatttatccgggccacggaattcaattcgtacgtaacgacgcaacggttttcaagttttgtaggtcaaaatgcaacaaattatttaaaaagaagaagaacccgcgcaaattgaaatggacgaaggcatcgcggcgaattcggggaaaagaattggtcaacgatgttactcaagcgatggaaattcgcagaaacgaaccgacaaaatatgatagaaacctttgggaaactgcagttgaggcagtaaaggaaattcacagcattcgacaccgtcggtacggagagcacataaaaagcactctgaagccgggaaaacaagcggtgaagagggcaatggtggagaaggcgcgcaagaaagtgcatttgataagggcgccagttgccatgggcgaggacgacgagaaattggaggtggtcgaagacggagagcaaaagacggaggagggcgaattgcaaatggaagtcaactgaccgccggtgcccacttcttccgttcctcatctcatgtttttgttgttgtttctttttgacaatttgattttttcaagaaaaatcttttatttgt

SEQ ID NO: 89633 - DNA, 633 bp, Heterodera glycines
  SCN-specific regions: Sequence locations=1-191,213-282,304-633
aaatgacaggcgcgtgcatttgtacgatttgcctgccaacggcggcgcatttgttgagaaaaaagtattacaacatgcaggtgccataacctcggtgaacttcagcccaaatgggaagtatttggtggccacggacattgccagaaaagtggtgccttacagggtggacgacggtttcaaagtggcatctgaaaaagaatggtcttttcatacagcccgaatcaactgctgcgcctggtccagcaacagtcggtacatcgccacgagttctctcgacaccaatgtgatggtttgggacttgcaacaaagcggtgaacatccgctagtcatccgcggtgcccattcgatgagtgccatcaacggagttgcttggctttccgacaatcgactgcttactgttggccaagactcgaatgtgaagcagtggacactgaaactgtgaagacggtttacgcagacaatgagaaaacggcctttgacttttcaatactttagtccaaattctcattttgtggtgctcttgctctgtccccgctaatctcgacccttttttatttacccgcatttgatgtgcatcccccgagtccattcagattactttgtatgctaattaattttgccttttcaagcttt

SEQ ID NO: 89634 - DNA, 720 bp, Heterodera glycines
  SCN-specific regions: Sequence locations=1-1,26-720
gagcttttgaaatttttgagtttgggtaattttggcaaacaatgctaacccttctgttggccatttgtctttctttgggcccaattttggcctatttgtccattgcacttttctctcaccgttttttgatcgtcgatcgttctcgcaatcggccaatttgcacttcgcccggctgtgtccgatgtaatcggaatgcaaatgaactcgcttccgccatggaccgctttcaaaaggctcgtttcgccgcccgcgcgcaattcgcacgcgttcggagtgcgctcgagcgcgcgcgttgcgcgtcggtcgacgacgcgcacgaacttttctttcgcatgaaatttgagggtgtgcaacgacccgtttggacgcgttcgcaactgccgccggcttttgtcgcaaaaatggaattatttgaacgccaacacgcggccattgcgaaggaatgcgaaagggcacttgaccaatgcccctatttgtgggcccggaacgaggaaagggcgcccgcactgcacacggacaatggcgcggccttctccgcttggttcgtttttccgctgatcaaccagggcgactggcaggaaaaacagtgtcgcgagtgcccgcgcatcaccgcattactccaccaattggccaccgacgacggcgtcgttgggacaaccgacggagtttctgctgtgtctgactgttcctctgcttctctgctcactgactgtttgttcg

SEQ ID NO: 89635 - DNA, 628 bp, Heterodera glycines
  SCN-specific regions: Sequence locations=1-628
attttttcctacattttttgcatttcccgtttttgttcgcaatgtttgagcttgcggaccagtctgacggtaccagcggcataaagcagttgtgggctttgatagacccaatttggaaatttgaccgtgccgaattggtcgactgcatggcaaaacgggtcatctacgagactgatgaccttatcgcactggacaaaccattccaaatggcattttcgtcgggcccggatgaccagccccaactggacaggattttacaggacttaaagaagcacattgcgcccaaaattgaccggctgtttctcgtcagatcgttggacaaaaactgcagtggcgtcatcgttttcgccaagagccacgtcaagcagttggagatgaaggcccaactgcagaacgacgccctccttttccgttaccgagccatttgcaagggcgtcccgaagatggccaaggcgcgcatttcaatcccattgatcaaggttttgcgcggctccaacctcaaattttgcccattggttggcgaggcggacgagcggcagcaactgtaccacttgaacacggacgttcggatggtcaacggaaacccaaaggtccagtgcgcactgctcgacgcctttgaacggagagg

SEQ ID NO: 89636 - DNA, 1000 bp, Heterodera glycines
  SCN-specific regions: Sequence locations=1-737,760-910,932-1000
gcaacatgggcttcgaggattgtaaggctcgcttctactcgctgaaaacggtgtcgctgccgatgcaaggtgacaatgccaagctgatccaagtttgcggcgagctgacgctggtcaaggcggctgtgcaaaaacagcagcctgttcttccacgacgctttgtccaaaccatcatttaggcccaccaaacgcccaccgttttgtacgtgaagagcgatgtgtttcagtggttggataccgcctttctggttaccgttagtgaaaaatacaacgcggccaacaacgccggtgctactgtgccaagtccgccgactactgtcgctgaacagcaacagcccctcgaaaatggtggtggccaggttgctcctcctccaatggttaatggtggaagtggcaaactccatcaaatcgttgttgagtcggaacctaaaaaggcgtccgttgtcgtggatcactcacctcaaaaggaaccggagaaaaagccggatgcgccatctgatgctgctccaaccgttgttgactcattgccctctccgacgtctacaccgaataagaaggatgaagttatggcgatttccgccgttgctcctccctcctccattgtcgatgttccgaaaacggatgataccgccccgccgccgtctttgtctcagccggtggccgcaactgccgccgctgcaccaccaccaacatcggaacaacagccgaaccctgcggttgtcaccactgccgcggccaacaacaccaacaatagtttggctcaaaggccaaagtctgtcgtggccggctcgtacgcggccattgccgctgccgcacgagggaatgggccgaacaatgttgataacatcgtgaccgtgcacgttcctgctgcaacgaatggtccgacggcacctactccgtcaaaggagattccacagcacaacaacaacatcgcaaagcacaatcccgaacaccaaattgctgtcaaacaacagcagcaaacgccgccatctctgccgcc

SEQ ID NO: 89637 - DNA, 616 bp, Heterodera glycines
  SCN-specific regions: Sequence locations=1-70,92-269,292-616
catccgtttatttccttctcacccatttaatctcaaaaactgaattaatccaattttgtcatggatccgtccgccgtttcttcttcgtccagcaccgatcagcaacaaaatgcggaagaggcgcaaaagggcgatttgacattggcacagcaaattgcggaggacaaacagaaaatgtttgaacgctcccagcagtaccaacaggaaattgaggacgaaattcgcaagactcagccgttggtttcgtccaagcaaaacattgtccatttggttggcgaatttgatgagaagacgagctctcagtacttcaaaaaggcgacggagcttgccggcgtttactcggacattcggcgaatccgtggcgatggcaattgcttttaccgcgctgtactcaccgcccaactcgagcgctgttttgaggacgccgaggagctgaaaaggttcaatgagcttgtcaaaggttggcgtgctcgtctgatggccgtcggctgcttccccgaattgaccaccggtgactattgcgattcgatggagcaactgatgacttcgctgctcaatggcacaatgctaccccaaattttgctggacgacctcaaccaggacggaattgccaatt

SEQ ID NO: 89638 - DNA, 1038 bp, Heterodera glycines
  SCN-specific regions: Sequence locations=22-96,128-155,177-201,223 -330,356-952,974-1016
ttttttaatttaataaaataacagtcgcaatgtcttcaaaaagagttcgtttcaccgaggaaagaaatgcaacagaaagagtgaagagaagtcggacggaagcggcggaggaggagaaaagggaacgattggacgacgaggaggacggaggaccagccgaaacggcggaaggaatgaagacaaaacggacgaagaaacacacgttggactcggacgaggaggacgaaacggagggctaccaacggctggacatggacaaggtggagggtcaggaggagtcgaccctcgaatatgagggacacgtgaagatcatgcctttcaacatgaaagacgatttggaggaggggcatttcgacgcgaacggcacattcatttttgacaagaagcaaagtgtgatcaaagacgcgtggttggacaacatcgagtgggacaatgtgaagaatgcggccgggaaacattggggcaaattggatgacgaggatgacaaaaaggcggacgatgagaaggaagtggagccgaaggaagtgtatcgacgacttgtcgaattgctaaacgaaaaagagacaattggcgctgcgctgaagagactgaacaacgaaaaaaagtcaaacgcagcggaggagcgcaaacgccgttgggcggccaaaaaggcgggtgcgaatgtgcaggaggatgagaagaccaagcaaatcgcggaactaacctcgttggccgactcactgatttcacttggcaacatggaagcctatcagttggaccagaccagcatcaacgctttgttggacgacttgcaagcgaaaaacaaaattccgggcgcaaaagaagcgactttggatatgttttcggaggggtgaaggagaactgaattttaattgaatttggacctttgaataaaggcattttgatgtggataaaatttgtgatcactgatcaactttgctcgtaatctatctattttttttatttaaattttcctttgtacaaaaattctttccattaaataaaggattgtcattaaaaaaaaaaaaaaaaaaaaaa

SEQ ID NO: 89639 - DNA, 964 bp, Heterodera glycines
  SCN-specific regions: Sequence locations=1-673,695-964
ggcaatggccgagaatcagttgagcaaaagcgcgaaggatctgccagtaatcattgcgcgtccatcaatcattggtgcaatttggcaagaaccattgccgggatggattgacaatttgaatggggccacgggcatatttgccagtgttgggaagggactgctgacagatatgtgcggtgatgtgaaatccgttgcggatattattcccgtcgacatcgttgccaatatgctcatcgtggcagccgcgtgtcgctcacagatgggccaatgcaaagaaattcccgtgttccattgcacttccggacaattgaacccgctgacgtgggaaagaattgtcgtttactgtgaacagtttttcattgcttttccgttcgacgagtgctaccgtatcccatccacacaatttcatgccaaccataaccttttcttggccaacttttatgctaagcatttgagcgttgcttatgcattggacggcgcttatcggctgttggggaagaaagcaaaatttgtgcgaatttactcaaaaatttggcgaatcatggaagttttgcactatttcacttcacgcggatgggttttcgagtcgcaaaatgcgctcaaaatgtgggaacggttaagcgaagaggacaaaaagctttattgtttcgatgttcgtaaagtcgactgggacaaatatttgtttgactatttgatgggaattaagatttatttgctccgggaaagtttggacgacgtgccgagggcacaagcaaatcttttatggcaaaaacaattgaatttgtactcaaatggtctcttttttgctttgctcgtccgtctttttgcgtggaggcgatccaaaagacaacgctgggcattttggctcagcggctttctgctgagctttgcctaccaaaatgccaaccattggttgcgtcctgctgttcggctgcgcaatttggaggagtacaagcggacggcg

SEQ ID NO: 89640 - DNA, 627 bp, Heterodera glycines
  misc_feature (347)..(347): n is a, c, g, or t
  misc_feature (392)..(392): n is a, c, g, or t
  misc_feature (472)..(472): n is a, c, g, or t
  misc_feature (592)..(592): n is a, c, g, or t
  misc_feature (620)..(620): n is a, c, g, or t
  SCN-specific regions: Sequence locations=1-4,26-278,324-370,502-627
aattagttgaaaaccaaaaattaattggccgtgacgaaaacaatatcatcaaccacagaaaaatgaactgctccagcgctgcaatgttgatgctgttgatgaccattttcactgtgctgtccaatgtcaacgaggtagcagccgaggagcacgagctggtcagccgcattaagcgcaacggctacggatacagcagcggttatggtggtggctgttcagcctgccaaagcagctgcaccacctgtggttacacatcctaccataccgtgcctgcggctcccgctcccccgccaccaccgccgcctccgcctccgcctgcgcccgtctacagccagtcttcctactcntcctgctccacctgggggggcagctcctactcctcttacccgtcntcctcctactcctcttatcccgccttcttcctcttcctactcctcttaccccgcttcttcctcctcctactcgtcctacncgtcctactcctcctcttcctcctgctccacgtgcagcttgaacgggtccaggaacagctggaactacggtgggcagctccgcccaacacgtggaacagccgccgggcgcgtccatagtnggcgggataacggccggtggcataccgnctacggc

SEQ ID NO: 89641 - DNA, 644 bp, Heterodera glycines
  SCN-specific regions: Sequence locations=1-328,350-492,516-622
aatcctttaaaaaaaaatgcacattccaaaaatagaattccccaaagaaattgttccaagtttggccaatttgtcgctaaatcgtcaaccaattgatgaccgtcttttgaagttactcgaacggacgcaaaaggatgtccagcgcctgacgaccgccaaccaacagctcaccaccgccaaccaacagctcaccaccgccaaccaacagctcacgacaacaaaccaacaacagcagaacacaatcaaccaccagcagcaaaacatccaacaactccaaaacttattggccggtcagcaaccgcttgttccagcgtttgcccccggggtttttggtgaacaacagcagcatcatcatgcgccagcggactttctcggcgaccagcatgcgctcggcggccagaatccacacgcggcaccttttggccccgactttttcggtggtcagcccgaaaattttggtgttcagcagcagcacatgcaggagcagcagggtccccctcctccgccgccaccgcagtaagacgttgcaagtggaagtcgaatgatgagttgacgtttgaccttttaacctcttatgttttaacgttattttgtctgatgaagaataaatctaatgcctcgtaaaaaaaaaaaaaaaaaaaaaa

SEQ ID NO: 89642 - DNA, 645 bp, Heterodera glycines
  SCN-specific regions: Sequence locations=1-557,579-645
ttgtcttctcgacggacaatttgcgctctgcaaggctggcggaggtccgccaacatttcaagcagaattcgcggattttcttcgccaaaaacaatttgatggccgtggcgttgggcaaatcggcacaggacgaacaggcaaacgaattgcacaaagtgagcgcacttttgcggggccaaagtggactgatgttcaccaatgcgaaggcaaacgaagtgcaaaggtttttcgccgagcacaccgaggctgagtttgcccaggcgggcgccgtcgcctcggcggacatttcgctgccggccgggccaatgccggcggaattgcacttgcacggcgccatggaaccgcagctgcgcaagttgggcatgcccacacggctggaaaatggtgccattgagctgttggaggagttcactgtgtgcaaaacgggtgaccaactgtccgcggaccaggcccgcattttgaagcagttcggccaccgattggccaaattccgcgtccgtctgctcgcccgatggagcaaaaagaagggatttgaacagattgacggaggagcggaagaatgaatgaataattgttgtgtttttcggatggacccatctaccaatttactttgttaaatttgttttttttatttaaattgaattt

SEQ ID NO: 89643 - DNA, 492 bp, Heterodera glycines
  SCN-specific regions: Sequence locations=1-492
cttgaccattttcttcggccaaattcatcttcttctttccataatttattttgctaaattcggcgctacagtatgtgccatcgatctcaggccgcgacggactacggtatctcttcctgttgctgttcctactgtagcacatgcaattgttgctcaataacggctgtgccattgccgacaactgctcaaccagtggttgcagctgtgaccgtaactgtttcatctcatcatcgtgttttaccgtatcatcggccgtcaatgatcagaatgttgctgctggctttgctgatggtgtattgttgttattgccatacggtacaatgcagcccgagcactgtatggaatacggtatcgggtgcggaagacaacattgacactgtagtggcggcggctaacaatggtggcggagccacatttctggtgccacagcagcaactgctggtgccgcttgtacgacaagaggtgcgcacaatgcccgaggttgcagcgtca

SEQ ID NO: 89644 - DNA, 1164 bp, Heterodera glycines
  SCN-specific regions: Sequence locations=1-598,620-1017,1049 -1094,1159-1164
atttgacccccgtcggcccttctgtcgctccgttggctttttcttcgtcttcaaccgatgcttcagccgttgaattgccatatgccgtcccaaactttggcacacccactgaaaaattgttgctgggcggggagctgattgccgtgccaagcgctctgttggccgatgagaaaatctttcgttctgtgctctgtccaaaatcgttttggtcactttcgcaggcgtcgcgcgaccacctcgagcattttcttcccctcccttccatttcgtccgccattaaatcatcgtcagtttctgtcgctcgtcgcaattgtggcgccccgctcgacgagttgctcagttgcgcattcaccagcgacccaaatttttgctttggcaatccgttggccaaattttttgcgcgcattcgaaatggttacttcagttcacccgaacaagtccaactgagggaccaccggcgagtgctgtacgaccattacattcgccactatcagatgaacttgctgaagaccctgttgatcaactcccatgtgctgctcgagcagtccaccatgctcaactcgtttgatgagcacgtacggttgaacccacgcactttttgctccctgagaaagttggccaagcacaaggaagtccgggccagggcccaattgcgtattttaacgcatgataaaagactgtcgtgtccgcgcgggacaggtcgaagcggacggctgttcatcggacgactcagccccggcggatgatgttgacgatttggcaccggtgccgccgaatgcgcgcagcacactgtacgagccgaagatgtccagcgtggacttggacctgtaccagccgagccgggcaaaggacgtgcagacgctgtaccgggagtacgcactgttgcgcgagacggagcccgactgtcccagcctggacatcagcgacatcacacttgaagaagtgtacgaacgggcgggcatctctttccaagcggagcgcaatttctcacgcatcaccgaacagatggtcaagcagaagcagcaacaacagcagcagcaccgccagatgaacacaatgcaaccgcagacaatgcctccgaattgacatggcactatttttttgaatttattcttattttattcttttaatttgaattattttttaaataaattttttgattgc

SEQ ID NO: 89645 - DNA, 647 bp, Heterodera glycines
  SCN-specific regions: Sequence locations=1-647
gtccaataaagatgttttggtcttccaattttgcacttctctcccgtcgtctggcaaacccgtcatgctccaatttttcgaccaatcttcgctttttcaatgttggcgcatcccttttcggtaggaaacgtgccgatgccatcgaagagagtgaaaaatcggtcgatttcggccgattggatgttcgtgtcggtcgcgtggttgcggttcggaagcacccgaacgcgaactcactgtatgtggcccacgtggagctgggcgagttgcagccgcgcacagtcattgccggactcgtcaaattcgtcggattggaagagcttcaaaaccggctcgtcgtttgcctttgcaatttgagaccgtcgaaaaaacgtggcatcgattcgcatgcgatgattttgtgcgcatcgaccgaacaaaaagttgaaccgttggaattgtctgatcagtcgtcccctcccggctctttgatcatttgtcccaattttgctcgtcagccggacaaagtgttgaaaaagagtgtgtgggaagaaattgcgttggatatgcttgtttctggcactggcgagtgcgttttcaagggcactccgctgcgagtggacgccgaagacggcgcttcttcgctggtgaccgcgccgacactgcgcaat

SEQ ID NO: 89646 - DNA, 559 bp, Heterodera glycines
  SCN-specific regions: Sequence locations=1-349,371-559
gtccaattaagccgttcaattccaaaatgggcactaattactccacttcaaattcggctccgtttgattacggaatgacgtcacggaagaaaggcaaaaatcgaacatacgaatccaatcactttgataagaattatctgatcgaaggcaccgaattttgggcagagaacgaatatcgcaaggacagttatttatttgagaggagaaaaggaagcgatcgggcaaattttgccgaaatttacgtaaaaactccggcggagtacggaagtccgcgcgtctcctgctgggcattttcctgctcaccgtgcgcttcttcaaaagaaagtgccgttgccattccgtcccattccctccctccttcttccgccccgtggtcttcaccaattcaaccgaatggtgccaaaagtgctcatggctcccgcccggtgggcgtccgatcgaaatatttgccaacctttgggtgaatttggccaattattgtgtatcgctttttgtttgtaaatttttaacaagttgttaattttaagtaaataacgaataaatgacattcattgaaaaa

SEQ ID NO: 89647 - DNA, 965 bp, Heterodera glycines
  SCN-specific regions: Sequence locations=1-94,117-965
gtccatttaagttaaattgttttttacatatttatttacttttaaaagcacttttgtttttcatttgtcaacacctttctgagtcccattagtcatgctcaacacgggaaaatttctcggcaaaacttttgtcataacgggggcatcgcgtggcattggcaaggaaattgcacttaaattggccaaagacggcgcgaacatagtcatttgcgcgaagacaactcaggacaacccaaagttgccagggacaatttacagtgcagcggaggaaattgaaaaacttggtgggaaggcccttcctctccaagtcgacgttcgtgatgaacagcaagtggaggaggcggtcgaaaaggcggtgaaaaaattcggtgccatcgattcgctggtgaacaatgccagcgccatttcactcaccaacactttggacactccgatgaaacgttacgatttgatgcattcggtgaatgtgcgtggcacttttttaatgtcccaaaagtgtgtgccatatctgcgtcaaacttcgaacccgcacattctcaatttgagtccgcctttgctgatggataaacaatggttcgctcctcacgtcgcgtataccatgtccaagtacggcatgtcaatgtgtgtgttgggaatgcacgaagagttccgcaaagatggcatcgcagtgaacgcactttggccacggacgaccatttggacggcagccacacaaatgctcacttcgggcagagggcagcgcaattcgagaaaacctgaaattattgccgacgcggcttatgtgattctttccaaaaactcgcgcgattacacgggaaatttcgcaattgacgaagaagtgctaaaggaagtcggagtcaaagacttttcgcaatacgccaacgatccgacggctgaacttttccctgacttttttgtgcccggtgtaaattacgaaaaagcgatcgaagcggcctttgcagcgg

SEQ ID NO: 89648 - DNA, 635 bp, Heterodera glycines
  SCN-specific regions: Sequence locations=1-7,29-144,166-257,281 -297,323-541,563-635
gtagcctttaagagcagaaagcatgtgtttgtcgtaacactggaactctcccgcgccagagagcttggcattatgttgatgagaaggatatttcagctcaccgtctggtcccaaacctaatgtgattccctgcaaagcaatgaacagaaaatcagaaacttaaaaccagagtagttaaactcagaatgtaagtgcaaaaacaaagatgatttgtgaaatcataccgtgattgtgttgcccatgtaatctgcgaaagcagacttgaagctctcacagaaacctctgtaaacctccataggagtcttcccatcaagaacaggaacatcatcaacagcaaacgacaaacaatctttgtactgttgtccatatctatctgtaaaatagatccctggttcagcatcaccaatctttgccacccaatcaggaagacctatctctgtttgtttcgatccatggaaagaaagtgaagcatgaagcttaagtcccactttcttaacaatctcagctactgccaagtacccagaccattcatatttcccagcagcttctttctcaacaactccccaaaagataggtaactcaataccttctacaccaagtagcttcaaagctttaagcccagctgtaatagcttt

SEQ ID NO: 89649 - DNA, 648 bp, Heterodera glycines
  SCN-specific regions: Sequence locations=1-648
ccaagtttgagttttttccacttttctgcaatacaataaacaacaaatgcaagcagtgacgcgtccacccattgttttggagcgtggagtttccgggcgtgtaaaatggttcgatttcagtaaaggttatgggttcatcacgcgggatgacggaggtcaagatgtgtttctgcacgcatcatccatcgttcgcaaagtcaatatgtacttcgtgctgattgagggccagcgggtagaattcgacgtcatcgatggtgagaagggcagggaagcggccgctgtgtcggggcccggcggaattcgcgtgggcaccgccatccaatacaacaacactgcgcgcagtcagccgttgccggtcaatgccaacaattccgccggacggatgttcatcgccggcagatttcggcgccccgttggcaagccgaacaacaaagccaagtcggccgtcgcttcggtccccgcggtggtcaatggcggcgacgacagtgcaaagtgtccgccgctctctctgtccggcgtcactcgcaaaggccgtcgcatgttcaaagcgaatgatggcgaaaagggcaaaaacagcgacaaaaaggaaagtgccagtgacggcgttggcaaagaaaaggacaacggaggacgggagggcgaaaacga

SEQ ID NO: 89650 - DNA, 580 bp, Heterodera glycines
  SCN-specific regions: Sequence locations=1-525,547-580
ggaatacatcctttctgtaacattggtgtactgcgaaagaccgatgataaatcattaatgaatggacagttggcgttaaaggggtgtgaaatcatggcactttatttcggcgctcacatgagtcagcgatgtcgtgaatttataccggtgctcaaacaattctacgatcagttgaaaaaatctcccgaaacaatgccttttgaaattgtttttgtgccctttgaccgttccgaggatgaattccgcaactctttgcgcgatttgcacgacgattggctgtacattccctatgggagtgttcacattaactcattggccgcgaggtttaacatcattaattggggagtcattccgacattggttgtgcttaaggaggacggcactttgataaccatggctggacaagcaaatgttcagcatttgtcggcatcagaagcaatggtccgctggcgctctattcctaatcccgaatccggattcaaagatttttcgaaattttaaatttccatatcttttttgttaatgttgctaaagcattggtttgatgtgtacaaccaacatgtgtgtcagggatggcacg

SEQ ID NO: 89651 - DNA, 978 bp, Heterodera glycines
  SCN-specific regions: Sequence locations=1-978
ggagtgccttagaagtcaaaaaattcacttttatttttgtttttgtgccgtcatttcccattttgtgccaccgcgctccgttcgcttcgttttgtgccgtccaatgcaaaagggaggatgccaagtctgctgctgaacccgggcccgtcaacaatgaactttttctcctcctccctgccgttgccttcctttttcttccgtaaccgaaaaaaatgttacgatttgaacccgccggaagagagccaccaagtgacatacctcggcaacatgttgacaatcatgggcaagggcgacacgtccattgaccgtccgttggaagtgattacgcgcgcgtggggcgccaccgtcgccaaaggcgcgacgcgccacggcgccggcgccacttttggccagcaacaggcgcaacagttggcgatgcgcttgtgcgtgtgccaatcctgtcgctcagtgccgagacgtgcattggacgccatttctctgttcactccgctgaacacgccctcaaaatgggcgccaggtcatccacgacatgtggccgtttgccaacggcagttacgtttcgggccgggccgtcacaaagtcgcgggaagtccagcacaatgtccgtgtccaccatgagcaccgcaactgctgctcccgcgacttgccacagatgaggggagggcgacaggctggcggtgcaacacagacaggagaaggaatttgagcgcacaattcgcacttacaaaagcccatacatcagcttcacctatttccactcacagactttggccgaagaagcgaaacgcaacgcgcacacgctggtgctccattttgtgttcgcctttttcattctctttgctcctttctcggcgttgtacaacatgtcccatctgtcgtgcccacaactgttacattgactggacactgtccaagccatttctggcaattttgggtgtggtcaacgcgggcatgggcattgtgacggccatcggatat

SEQ ID NO: 89652 - DNA, 654 bp, Heterodera glycines
  SCN-specific regions: Sequence locations=1-630
gggacgacgaaatgtgtccttcaaaaacgcaacacttggaacagttccattcgcttaatattcctatgattttcattctctccgcacttttctcactttctgcgacattcgcacagtttgtcccggccaaaaatcgctgctacagttgcgcatcggacaatatgaaagaaaatttcctcacgcgcagccgcggacccccggggcgcgtgcgcgagccgcgtctgttcgattcgatgtgcgactcggacacgtgggtaattcgggaaaaaagtgccatcgaatgtcagggcgcttgcttcaaatggcagcagacgctgaacaattcgggcgtcctttcatacgccaccatcagaggatgctacgaatggatgttcgattcgtccgttggtggccccactccctcctccgacagttcgtcgtccgtcgccttcaacactgaatgcaaacacacgcaacgcgcgttggtctgtctggacgagttcagctccgtcgaggagtccacctgctggtgcttcggcgacttttgcaacgcggcgacggcgaaaggcgacggaattcgaaatgccatccgagcgacggcatcggcactttttgcatcatcacttttcatgtcattttggaaattgcaacaaataaattgcaaataaataaaaa

SEQ ID NO: 89653 - DNA, 522 bp, Heterodera glycines
  SCN-specific regions: Sequence locations=1-522
cacagtctcgcttccatcacatcaacgcccacccaatccaccagtcaaaatggccttcctttcctacttctcccggaccttccgccaataccccgagattctccctctcgtcggtgccgtttgcgctgtcacctcattcgggatctactcatccacggccaagatcttgggcgatcaagacttgcgcatccgtcaaaaccacggccacatcacttgagacgagcgcctcaggcggtgggaggaggccaagaagcactaagctgctccgctgtttcaagttcccgtcctcaacctgatcctctccataccaagtcaacccatcatcctactttctttcgtctaccgacataaacgaccgccttcaccactcgcttgtggttgcatgcctattcaatttgttgttggttcccagcctgctgttgcaaccatcctcgcttcacactttggacatgtcttttatgaaccccactgtttgcacgcttttgtttgccttcttgatgaatgcggaaatgtggaactgaa

SEQ ID NO: 89654 - DNA, 845 bp, Heterodera glycines
  SCN-specific regions: Sequence locations=1-845
ctttttagctaattaactaaaatggcaacaacggacggaatggtcgaagatggcaaagtgggaaatgacctccaatcagcaaagttcacaaaggacaaagaagtcgttgacattgtgcagccaacggccaaattgataggattgacgaaggagcagctcgagcagtaccgaaatgaccccttttggaaggcgattcgttactcacttttcgtcgccttttggctgatttggctggccatgttcgtgggcgctgttctgattgttgttttgagcccaaaatgtcagcaagtgaattggaccgaaaaaatggtcgcttacaaaattttcaccctcgcatacaaagactctgagtccaaaaatgggttcggagactttgaggttattgagaaaaagttggaccaaatgaagggaattggagtcaatgcaatttggccaactcccgtgctcaaatactataaaaatgcgcttggcccagaggcaatcgaaaagttggaagtgtcggaccaactcggcggggctgaggggttcaaaaaactgatcaagcgggcccatgacaatcaaataaaagtgatcgtcgatttgccattgacagtcaatgccaaaggaaattgggccaacaaaacttctgatacaaaaaatggtattgccctgatcgaccttgacaatgcagcaaaccgagaaggacttaaagaagcggcagtgcgctttttggactttggcgtcgatggactggcaatcaccgattacggcctttttgccaattccgtccacttgggttctcttgtcgatcttattcgaactataccaaaggcggaaaaaattcccatttatgcacgtggctcttt

SEQ ID NO: 89655 - DNA, 250 bp, Heterodera glycines
  SCN-specific regions: Sequence locations=41-144,166-169,191-228
atttaaaaatgtttaaattttttgctctacttttcctcttcatgagcaccaaacaacaacaggcagcaagggcgcaatttgaaagcgatgaggtgagcggaagagtggggcacggacagaaaaatgcgcggtcgcgcatcgctatttggaaaataatttcactatgattaaaaaaccaaataattttgtattattttcacttgatataaattaaaatttgaattttttaaaaaaaaaaaaaaaaaaaaaa

SEQ ID NO: 89656 - DNA, 609 bp, Heterodera glycines
  SCN-specific regions: Sequence locations=1-609
ccaattaagcgctaaattgacccaaaatggcggccacaagtgccaccggttttcctgtttgcattttgacgccctgcagcaactcacatccatttgaggaacggagaattttggtcacacggacggaggaagacgcggtgaaaattggccgatcggtggtccgactgcagccgtcatcgaacaacgcgatttttgactgcaaagttttgtcacgaaaccatgccgttctgtgggcgaatggcgccggtcatttcatgatcaaagacacgcgctcatcaaacggcacattcatcaacaacgaacggttgagcgccagcggggaggagaacgagccgcgcgagctgttctccggcgacattcttcagcttggtgttgaaataattgacaccgcaaagaaggtggccagcggctgtgtgacgtgcattgtccgactgctcaacgaacgtggcgaagaatgcgcgggccgacccaagccggaccatggcacattcccaacactgttgcaacagatcccgcccaattacacactggtgaagaacgaccagctgttcatcctggaccaatacatcaaagaggcacagcacagagaaaatcagcttggactcaagc

SEQ ID NO: 89657 - DNA, 506 bp, Heterodera glycines
  SCN-specific regions: Sequence locations=1-63,87-260,289-327,373-506
atcaaaatggctgtcgacgcttcgtccgctaccatccgtactcgcaagtaccttaccaaccgtctgcttcagcgcaagcagatggttgtggatgtgctccacgccaacattgccaacgtccccaaggacacgattcgcgccaagttggccaagatgtacaaggtcgagaaggaccttgtcgttgcctttggtttccgcactgccttcggtggcggcaagtcgactggctttgccttgatctacgactcgattgactcgctcaagaagttcgagcccaagtaccgcctcgtccgcctcggtctcgccgaggaggccaagactggtcgcaagcagcgcaaggaacgcaagaaccgtgccaagaaggcccgcggcaaggccaaggctatcgttctcggccaccgcaagtaaggtgttttggctgttttcaaatcatggcacttgtgtctttgtgcttttcttgtggtgaactcgttgtcatgagtaaagtatattgtgcatttttttca

SEQ ID NO: 89658 - DNA, 683 bp, Heterodera glycines
  SCN-specific regions: Sequence locations=33-683
cctcgtgccgaattcggcacgaggattcattctaattttctttgcattgtcaaacaaacactaaaaatgcgtggtccttttatgcgtggcactatgccgctccgtcggactttttattatcttggccagggaaaaatacatttgcgtgaggaagtgaaggtctttgcaattgctttccacaatttcccaaacgtggcccaggaaggggccaaagaattcgtattttggcactgggcccaactccaattcaagaaccctcacgttcaattcgtgaaactcgcggatgtttgtgtgacgccatttgtgcaagctttcttaggcgatggcagagaagttgtttttgatttggagtgccgtacgagggagcaaataagcgaagcattaatcggaacattgggcatgacagagactgtacggaagcgaatgaaaatggacagttacaaaagggagaacccggccgaattcggctgcgactgcgaaaggcaatgcatttgcgaaatgcaagggcagcacccgtgcactgccattctttacgcgccgaagcatttgcgcgggagttggcgatggaatcactccacttacaatcctgaaaagcccgttccgtttccgcctgtggagggctacgactgatttgcgtttgtttcgatgctttgttttgataaacatttgtccttttgattggt

SEQ ID NO: 89659 - DNA, 670 bp, Heterodera glycines
  SCN-specific regions: Sequence locations=1-670
ggggaatttactttgggttacacagcttcaagggaatttactttgggttacaaagcttcaacaacatgcaaagtgtccaatcgtcggccaccgcggcagtgaccgccgcttccaccgttccgttgagcattcagaatgaaattttgtggatcaagcaggacgctctccaagttcgcaacgccgtcattctcttggagcaggagaaggacagtcttcgcaaagcaattcgcaaactcaagttggagaatggccgcctgaagacaaaggtgaaaaccttgaacgaaaaggtggcaaagattagcaacgaggaaatggacgatgaagagggaaaattggcgcctgaatctgaattggactatgacgaactaaaccgaggggatttctacctaatcggaggtgtccatgacccgatcagtcttcgttttgaagctgcgatccgtgaccaaaatgccgtcgaacataaaagtgccgaacgctactactggtacaaaatggcggaattctttggtgacgaggaagccatgaagagcattctgcacgcgcagaatgtccaacaggccgaagaggccatgaaaaacatcaaaggcttcgacgttgccgaatgggacaaagtcaaacttaaacattgggaggacggacagcgactgaagcttgagcaagtccgttggat

SEQ ID NO: 89660 - DNA, 768 bp, Heterodera glycines
  SCN-specific regions: Sequence locations=1-330,354-768
ctcgattttgctttaattcagcaaatttttgttctaagaaactatttcatcttacatctgatcaatatgcttaccaacaaattggcaaaatgtgccgctatgaccatgacccgttgccaaccgctgaacgcgttggcaatgttgggcggggcccgactgtgccaccacacgccaccaaactgcatggacgccattcgtccgcttggtccgaaaagcagtgtgccgagttttaagggccaggcaattgtgaacgcggaaatgaagaccatttcgtacgacgactacaagggcaaatggttgatcttcttcttctacccactcgactttacgtttgtgtgccccaccgaaatcattgcgttcagtgaccgcgtcgccgagttcaagcagctcggctgtgaggtgatcgcctgctcatgtgactcgcagttctcgcatttggcttgggtgaacacaccgcgcaatgatggcgggcttggcaagatggaaattcccgtgctcagtgacttcagcaagaaaattgcggctgactttggcgtgctggacaaggagaccggactgtcctatcgcggtctttttctgattgaccccaatggcactgttcgccattgtttggtcaacgatttgccggtgggccgaagtgttgacgaggcattgcgcattctgaaggccttccaattctttgagaaacatggcgaagtttgtcccgccgattgggaggagggcggtgaaacaattgacgtcaaatcgcccaaggagtacttcaaaaag

SEQ ID NO: 89661 - DNA, 651 bp, Heterodera glycines
  SCN-specific regions: Sequence locations=33-150,172-253,279-425,448 -651
cctcgtgccgaattcggcacgaggttgagatgcagccatcggcggagagtgtgcctccaattgacccaatttggcgcattggtctctacgaacggcacgtgttccgtagtaacgggcgggtgggggcattgtgcttggaatgtggcgaaatgttctgggaaaatggcactgatgagaaaaagcgcatgggccgagcgttgaagaggcaccttttgacaacgcacagacaatacggactgaaactgttggagcagatgttggaggaggaggaaagagagaaggcggaggggagggccgaaggtggacagatcgccaaagatgctaactcaactgtctgtggcactgtgcattcgcaatttgttgaggcatttcaccagacaattgtcgccactgaaacaatgccaacggagctaatcgaagagaaaagtcagctgaagcgaaaggatgtgccaaatccggaagatctctcatatcaaatcgacgcacgcgacgaggaattgtcaaaaagtttgccggcggcacaaacggacggcactttgacgtccaccgaatgcgatgccaacacctccatcacaactccgtccatttcggccgacctttgggcggccgcgcaacaacttagcacctcactgcataataacaataaaacct

SEQ ID NO: 89662 - DNA, 543 bp, Heterodera glycines
  SCN-specific regions: Sequence locations=1-409,514-543
aatgtgcaaagcgttggggcaagcgccgggcattgtcacgcgggagggaattgcaaaaggcgtgcggatcattgacaacggcggacagtacaaagcggcaattggtggcgaacgtgaacattgtcggcgcgggtcgtctcttcaagcgtcaaatgtgcaaagcgttggggcaagcgccgggcattgtcacgcgggagggaattgcaaaaggcgtgcggatcattgacaacggcggacagtacaaagcggcaattggtggcgaacggtgagtggggggggcgacggacgaacgtggcgctggtccaaaaacaatcgtttgggatgggttcgagtcgacttggcctaaagggtttttcgggcatcccatggcattctgttgtaccctcatcagttcatattttctttcccttttttttgccttttcatttgcatttatttgtccattttttatatatttttcatccattcgttttattttcatatatattgtttattcattctttcatttgtttacaaattgtgctgataaaatcattttttgtc

SEQ ID NO: 89663 - DNA, 648 bp, Heterodera glycines
  SCN-specific regions: Sequence locations=1-35,61-138,162-438,460-648
ataaaccaaaatatcaccatggttttcgtcaaggccgtcaagaacaaggcttacttcaagcgctaccaggtcaagtaccgtcgtcgccgcgagggcaagaccgactactacgcccgcaagcgcctcgtgacccaggccaagaacaagtacaactcgcccaagtaccgccttgttgtgcgcatcaccaatgccgacgtcatctgccagatcgtctactccaagatccagggtgacttcgtcttgaccgctgcctacgctcacgagctcccccgctacggcgtcaaggttggtctcaccaactgggctgccgcctacgccaccggcttgctcgttgctcgtcgtgccctcaagaagttgtcgcttgacgacaagtacgagggtttcgtcaaccccgacggcaccatcgccgaggtcgagccccttgaggacggtccccgtcccttcaaggccttcctcaatgtcggtcttgctcgtaccaccactgggtgccaaggtcttttgcggccatgaagggtgccttcggacggcggtatcttccggccccactccgagcagcgtttccccggctacgaccgcgagtccaaggagctcgacactggttgtggtccgcgtcgaacatcttcggggggccacgttggcgaatacatg

SEQ ID NO: 89664 - DNA, 590 bp, Heterodera glycines
  SCN-specific regions: Sequence locations=1-590
tgtctctcctttccgtggttcttttcccctctttttgcctttgttctttgctccttttccttctcccctcggctcttttcgctgatggcttttcgtcgtctggccaaagagttgttttggcccgggtgatcattttcaaagcatccgaaaagcaggggacgattgcttctcaacctttgggcactgtggacatttccgagaccgttcccgggaagacaacgctgaacggcacaatcgaaggcctttccccgggcgaccacggctttcactttcaccaattcggcgacatttcccaggcctgcaaagcggcgggtgcgcatttcaatccgcacggaaaacgccacgggagcaaagaatcggaggaaagacacgtgggcgacctgggcaatgtgaaagccgctgagaatggggtggccgtggtggacattaaagactatttggtggcactgaacggcgtcaacagtgtggtcgggagggcattggtcgtacatgagaaggcggacgacatgggcaaggggggcaatgaggagagtgggaagacgggcaatgcgggaaaacggatcgcatgcggagtggtgggagtgatccca

SEQ ID NO: 89665 - DNA, 730 bp, Heterodera glycines
  SCN-specific regions: Sequence locations=1-173,195-230,252-266,310 -355,378-638,661-730
ttactcggcaacgaggtgaatttgcttacggtttaatgaatacagttacagtacaataactcaatgttcaacaaataaaaagctggaaaatgaagtcccattatttgttcgaattcttcttgtccaaatttgtttaaatgttgctgttgaatggccgcaaattggacgtatagaataaagaaggaaggaaggaacccagcagctcgtctgtaccccaaacagaccaacaaggaacaacaacagcaggggggcggaccgtccaacggttttcatgacatcacatccattggaggcggtggtggtggtggctcggcattgttccacagtagcaatggtaccgctgctgctgggctcagttcgtcgtccggctcgtcgccaaccatcctgcagcaacaacaacatcgacagttttcttcggcaatttcgcagcaaaaatcgttgacaccgccgcctctgtcggtgggcagttctaccttcaacccgacgcttgaacaactgttgcaggcaacgcagaacatatcttactcgctcagtccgctcaactccaacgggggaatgaatggcagcggtggcgagcaacacgacggcacaaattttaattctaacggcacgaacaacaccaacagcaacggcggtggtgggtcgtccccgttcagcggaacaacggcatcggatatgttggcagtgggagggcatcgttcagtcggtggtaacgcaaagacgctgcttt

SEQ ID NO: 89666 - DNA, 378 bp, Heterodera glycines
  SCN-specific regions: Sequence locations=1-35,58-198,221-266,288 -298,320-351
aaaaattattttattgctacaaatgtcgatgtttgctttaattttcttctttttattcatcaatatttttattgagcccgtttcgatggcaatgaaaaaatcgagcaaaagctgcaaagttggcgtaggcaatctgacggacgaaaatggcaacgtggtgatgaaaggacgattcaaaatgtgcccaaaaggattcaaaaaatgtgccaaaaatgaggcttttggcaccacggcattctgcgttgagctgttggaatgaatatgaagaaaattggaaaaatatgggaaaatgatacttaattaattcaaaatgttaataataatggaatataataaatgtgacattgttgtaaaaaaaaaaaaaaaaaaaaaaaaaaa

SEQ ID NO: 89667 - DNA, 636 bp, Heterodera glycines
  SCN-specific regions: Sequence locations=1-74,119-152,174-180,221 -244,321-380,402-450,532-552,593-596,618-636
aattaatccagataaacaattctaacttacgtcgaattaaactaacctcacgtttaaaaaatagaagaacagtcttaaaaagtaaaaaaaactaaaaattttacttatttataaaaaacaacaccgatgtaaaaaaatcctgttaactctagagaaattttaaaaaccaaaaagggtcacaaaaattataaaaaattttaccctaaaaaaaataaaaaaacaaatttctaaagacttctcttggtattataaaaaaaaataatttttaattttttaataaattattaaaaaaaataaaaaaaaaaaaaaataaaaaaaaacattcatcctcgaatccattaaaaaaactaattaatttgctaccttagaccaatcacgctaaaggtgcctttaaaattaataatctataggcagcccacacaaattaaaaaaaaaattaccaattattctaaaaaaaaactttaagaaaaaaaaaattaataaaaaagggtggagagataaaaaaaattaaaaaaaataataatagaaaaattttttttttcttaataaattaaaaaaaaataaaaaaattaaaaaaaaataaaaaaaaaaactttaaactttcaaaacattttttcaaaaataaaaaaaattttc

SEQ ID NO: 89668 - DNA, 650 bp, Heterodera glycines
  SCN-specific regions: Sequence locations=1-650
ctttaacaatttgtcgtcaaaatttttgaaaaacggaccgttcacaaaagtcgcacttccattttttagtcgcttttgtttttcaaccgaagcatttgagaaggcgcaaaaggacatgaaacagctgaaggacgagccggacaacgacaccaaattggagctgtacgctttgttcaaacaggcaaatgaaggcgacgttcggggcgatcgtccaaaaatgctcgaatttgtggcgcgtgccaaattcgacgcctgggaaaaagtcaaagggatgccgaaggcagatgctcagcacaaatatgcggagattgtcaattcgttgttgaaaaatgcggggattaacaacgcgaacacttcggaaacagaatcggacggaatccgacggacgaaggagggcaaagtgtacaaaattgagctgaaccgttccgacaaatacaatgccatcacttgggagatgtatgagggtctgatcagcgcacttggcgatgcaagcgccgacagagaaacgagtgtgacagtgatcacaggcgttggttcctatttctgggccggcaatgattgggccaatttaacgcgcggcggcaaaacgagcgacgatttgcgtgctatggccgaccgtggggagcgcgtgttggagcgttacgtgcgcg

SEQ ID NO: 89669 - DNA, 636 bp, Heterodera glycines
  SCN-specific regions: Sequence locations=1-636
attcgccagtcgacctttaaccatcagaaagcattgaagaatttgacagccataaaagaatatgtggcacatttggagcactttttcgactcaccgcaaatgaaggaacatttgaagacattggaatccttcccggaggcgcagttgccgcgcaatttcgacgcgcgtgacaaatggccaatgtgccctagcatccacgcggtgcccaaccagggcggttgcggatcatgctatgcggtgtctgcgatgggagttgccgccgatcggacgtgcattcacacgaacggcaccgacggcactcagttgagcgcattggacgtaatcgaatgttgcgaagtgtgcggcaattgcttcggaggcgacccgctgaaagcgatggtttattgggcattggaaggcgtcgtctccggtggccccgacggatgccgaccgtacgcagtgagcagcgcttgtgggacgccgtgtacgcccaacctttacgcggaggaacagacgaaacggaagtgccggaaggataagtgccaaacggcatattacaaaaacagtgccggaggggaatacgcggcggacaagcgaaagggttccttcgcttacactttgttcccccgcaaaatgagcgtcgaccaggcgggcaat

SEQ ID NO: 89670 - DNA, 625 bp, Heterodera glycines
  SCN-specific regions: Sequence locations=1-41,64-498,529-625
gagaagcatggcaaggttgacaaggtcaaacggatcaaggactacgcatttgtgcactttgaggaacggtcagccactgtacaggcaatggaagcattgaaaaacacggcaagttgatggtgccccgatggaagtgtcgttggccaaaccgcaaggagaccaaaaccagaagaagaagctggccatcaagtcacggttcaacccacaacagtacggcgctggtgttacccccggcattggcccacgtggacgcaaagggtacgagtacatgggagcttttcgtggtggacgcggcggtgccggcccaagcatgcacatgggttatcaccaaccgtacccgggctacccgccagccggctacggtccgccaccatacgacccctactactccggttaccgtgcctacggcggtggtggctacgacatgtacggcggctaccccgctgacccggccgctgcttactatggacaacatccggcgcacgcgagcggatcgtacggcgccggccccggcggtcccccgggcggaccagccgcaatgcgtggcggggctgccggctatggcgcattcggcggcactgtccagcgcggacgcggtggcaaaagtgctggcgcgggccaagga

SEQ ID NO: 89671 - DNA, 669 bp, Heterodera glycines
  SCN-specific regions: Sequence locations=1-11,33-169,192-284,308-669
gaaataattaattaattcaatttgtattttctcgcttcttatcaagtgctattagtagaaacaaatgaatcgtattggttcagcactttcaaagtcggttttcatccctcgtttgttctgtcaccgtttcttcgccagtggacccaccgatgcgcgacaaaatgtgctcgttgtcattgtcgatttcaacggcgaacagcaattgcttgtcaacggaaagtacagcgaattgctcggccgttcccccgactttccatttccgggcaacgtgaaaccgttggctgaaatgcaacagcaacaacagcagaaatttccattccctttggacgccttgccaaccaaacaactcggcaatggcttgggtgctgtcatgccactccacaaaatcgtcgagccttcatttgttgtttcggacgatcgtaccgccataccacgagcgttaaggcatcaccgaatgtggcaaatgggtgaagatgatggacggatgacggctaacacaaccaccgccaaatatgaatggaccgtggccggggtggatgggattcgaatgctgtgcgaagaggtgaatgcaatgttcggcaaacgctttttggctggcagtgaaataacggtgatttcgttgcgcgcaaatgtttcggaagcgcaacaaatgacgacgacaaccgcaac

SEQ ID NO: 89672 - DNA, 628 bp, Heterodera glycines
  SCN-specific regions: Sequence locations=22-189,211-310,332-628
aatttaaattaaataatttttcatttgctgtatgatatggtccataagcagaaccagttagaaacaacagcagtgccaattgctgtggcacataatgacaatggcacggccgacatatttgagcaattcgaaattatgttcaacggtgacaaatcggtgttctttggcaacgaaacagtgacaggcagtttgaagatcaaattgaagcaagagaccgttctgaatgctatccatttgcattttataggtgtagccaaatggattggcacgggacgaaaggaggacaaggagggccaaaccgagaagatttattttgacaaaaattttgttttgctggaacgtccgcctggccatcccgggcctggccacttcaaatttgttgcccattttgcctattcattgccatttgagtgcccattgcccagcgggtgcgagacaagctacgagagtgggtcggcacacattcgttactttgcgcgtgccattctcgagaccgagcagcgggacaaattcatcgcaaagaaggccttcaccattgggtcctctcccggtcttgatcaattggtcccaccacaaccccagcccatcacgtgcaaggagacggtccggtatggcggctgttgctgct

SEQ ID NO: 89673 - DNA, 652 bp, Heterodera glycines
  SCN-specific regions: Sequence locations=1-469,598-652
caagtttgaggtattttcatgtctgaccatttttgggacgaaaatgtcttcgatctgatcgttgaactagagaaggaaggccgccatgtacggcttgattggctgtcgtcaaattcagcgttggtcgaccgctttcaaacggacattgcgcgattgtccgaggaggaatattcgctctatgccgcctccagcagcaaacttcagcggatagcagcagccgaatgcgcgtacaaatacaaccggacggaggagttggataaactgtttgagaaggaccgcgactcggaggcgttgagggaaacaaatgtgaggcactttctgattaatcgcattctcgacgagttccggccgaacatccgtcgcctttctgccctgccaattgagcggacaattgacgcgttttgtttgaatcagccaaaggacattgaacagcacgtgttggatgtgtacgattttctgatggattgcccagaggcaccagcagcggcggaagcagcggcaccgagttaccaaggaggacaggagagcagcggaaccgcagagcaaccgcaggaagcggcagcgccagaggcaccggctgcggcagaagcagcggcaccgagttaccaaggaggacaggagagcagcggaaccgcagagcaaccgcaggaag

SEQ ID NO: 89674 - DNA, 930 bp, Heterodera glycines
  SCN-specific regions: Sequence locations=1-7,29-747,769-930
gatttgtgataaatttgatttttcctttcgtttcttcttcccgcttttctaatgttccctttcaacactccctacaaccatttgcttaattggtcattggtttgttttctgatcccatggttctacagctattacaatgagcaacaccggctcagcagcatgcccgtggagcaggcgatgctcaaatcttgggacaccgtcatttcacagccatccataaaatttcggaaaattatggtcggcatcaattgcaatgttgatgtgatcgttagcggagtcagcatggtgaacaagctgaacatctcgtcaccaaatccaatcgcggacaaagaagtgctcaacggatttgaggatttgtacgaggcgtttgtgcacttttttacgcgtggtgcgcctgccgagcgatgtatggtcaatgacgcggcctttgaccggatggtccacaccgttgaagacaaacatctccgtgcacagcattatattggtggcaatgccgcattaatggctcagaaaatcgcctcttcgttccccgctgcaacggcttatttggttggtccgattggcccgcgaagccacgcgctgttacacccggccatcgttcgaaacaattccacacgaattgcggaggacgaattgcacctcattttggagtacaaacagggcgaaatcctcggggagtacgtttcgcccgcctcttctcgtttcattgtttcccatgaccaattcagtggcagtgcgatgatcatcgaaatgtttttcaaggcaatcatgcaattccgtcccgacctgatcattttgtccggaatccatggtctggaagcgcagaaccaagacgtgcgattggaaaagctgcgactgatcaaacggtcgctgatgcaagtgaatccgctgattccgattcatttgcaattgggcagcatggcggacgac

SEQ ID NO: 89675 - DNA, 761 bp, Heterodera glycines
  SCN-specific regions: Sequence locations=1-402,426-592,615-715,737-761
atttaagtcaaaatccaagcttaataaataaaaggaaggcgacgagacagaagacaaagcccattttgatgagcagtcactgcaaaactttggaggaggacgaagaatggatggccaatttgcacttcgtccgctcggacattgacccggcgacggtgaaaccaatcgactcccgacaattggcttctttggtcaatgaattccttctccgttcggcagacattctgaacagattttgtgctcaatttgaaaatcggatgatggaattggactttcgtttggacacttttgaacgaatgttggcacttatggaaagaaaacttgaaaatgttaatgttgacgaagtgaaaaaacaatcggcggaagagaaagaaacggcggagaaagcggagggaatgacgcgcaaagaaaaaggggaagaaacgcccgaagggacgggggaagaaaaacgcacagacaaaaggcaggggaaggaaacggcggcggaagggacaacgaaggcgaatgaacaccccaaattggccaagtatttcaaaatgctcaaaatgggcgtgcctgaggcggcggtaaggcaaaaaatgagaagtgaaggaatggacgacgcactcccaaatgacccagagaaagaattgccattggaatcaccacaaaacaaagcgcaaatggtacatgatgcattggcagaggacgacgaatcgtcctcaaactcagatgaatgatttcctggccttcattcctttttatttaattttataactgaa

SEQ ID NO: 89676 - DNA, 464 bp, Heterodera glycines
  SCN-specific regions: Sequence locations=1-373,395-442
catcgatttcctccctacaaaaagcatcaaattctcgaagaaaaaatgaagccatcattcaacttcaaccttttcgcatccgtctttcttgtgctttgtgtggcctcgcttgtcctctgtgagcataagcgagcagccgcagcagaagcatgtaatccgcccaaagacgtgggaactggcaacttggcactcaaacgatggtggtgggacggccatagttgtaagcaattcatctacaaagggcagggcggcaacacaaacaatttcccatcaaagaagcattgtgtccaagtgtgcaagccatgaatgagccgtggaaagaaggtgcagcgtgaagagaccagcaaaagaagaaaagcgaagaaattcaaagaaatttttgaaaaataaaatttaccgctaatagttaaaatgattttggtggaataaacaaaaaatttgcaaaaaaaaaaaaaaaaaaaaaa

SEQ ID NO: 89677 - DNA, 452 bp, Heterodera glycines
  misc_feature (425)..(429): n is a, c, g, or t
  misc_feature (431)..(431): n is a, c, g, or t
  SCN-specific regions: Sequence locations=1-102,209-429
aaagaggaggcggaaaagcggaaaaaggacaaaggcttaagacaatttcaatccatcgaaatgaatggccatgacaacaaattagcgaagtcagttgagcctgaagaaaaaataatggggcaagaagagacagacgaaagtgagggggaggaggaagtgacagatgatgaagaggaggaagaaaaaaagggaagggaccaaagaaaagccaattgcaaggacgtctgttaggcacagaccgaccaaaatgccattggccactcattttggccattgacctgtcacggtctttacgaggaagaaaaggagacggtgagcacgcaattttgaaaggaccagcaaatttgaaattgcaaaagtcaccattctttgaaatgtacaaaacaccatccgattgatcgttaattaatcacctgctgagatcnnnnnanaaaaaaaaaaaaaaaaaaaaa

SEQ ID NO: 89678 - DNA, 624 bp, Heterodera glycines
  SCN-specific regions: Sequence locations=1-14,37-226,253-276,302 -579,601-624
cacacaaatcaaaatgttcttcctttgccctcccattgttcttcttccattgacccttttctgcgtcgcttcccatggcttaacaaatcattcgaaagcatttggaaatgaaagcgaatcgaatagaacggacttttttggcactgaacccatggaaattccccgtcataaaagtgccgacggattcgacccaatggtggacgacgtattcgctttgctttctgctggagaagagggggaagaggagggaaatgggacgaaggtgggaattacggtggaggaggaggaggaagaggaagagcagcagctgcttctccgttgtgccgatcagctgtcgccctttgtgccgcttttgctcgtgccgccccattaccatcgctgggacttcagttgccattttcaaggcaatcagtccgaaaagcccgccgatctttccccaaacaatgccaatgaaaatgccgacctcttcttgaaaatgtcaaagccgtgccgctccagccaatcatttcgcgatgccatcacttccgaacctaactgtcacctttttgttggttttgtcgaccatttccactcattccccacaaacactttggtcacaaaactcaacggaaaaactatgaacgg

SEQ ID NO: 89679 - DNA, 624 bp, Heterodera glycines
  SCN-specific regions: Sequence locations=1-67,110-121,146-228,273 -357,381-540,564-573,605-624
ctcaacgccacccgctccgccgtccgcgccgttgcgcagcgcatgcccctggcccgcaccatggcctcggccgcccccgccggcgccgttgccgctggtcagatcaagtcggtcattggtaccgtcgtcgatgtccagttcgatggccccctcccgcccattctcaacgccctcgaggtccaagaccacaacatccgcctcgtcctcgaagttgcccagcatctcggcgagaacacggtgcgcaccattgccatggacggtaccgagggtcttgtgcgtggccaaaaggtgctggacacgggtgcccccatcatgatccccgtgggccgcgagtgcctcggccgtatcatgaacgtgattggcgagcccattgacgagcgtggtcccatcaacgccaagaacaagctccccatccacgccgacccgcccgagtttgtcgacatgaccaccactcccgagattctcgagaccggtatcaaggtcattgacttgcttgccccctacgccaagggcggtaagattggtctcttcggtggtgccggtgtcggcaagactgtgctgatacaagaactcatcaacaacgtggccaaggcccatggtggtttctcggtcttcaccggtgtc

SEQ ID NO: 89680 - DNA, 619 bp, Heterodera glycines
  SCN-specific regions: Sequence locations=1-619
ctgctttctcgtccttcgctttgtcctcccttctcccacttttcctcctttccctttcgtcctttgtgttttgtcactttcgcccccattttcctccgttccttcaaaaagcgtcggttgaacaacgtcgtcagtacaacagaatcgtgaccagccaaaacgacaccaaagcacaaatcaacagcaatgtgcagaattgggcttcaaatgcgggagttgcgagcgattacaacaatttcacatcggagcagcagcagcggtctcaacaattccatgacgcagtctccggcaatttgacaggccaagcgctgcaattattcaacaacctctggagcattcgtcagaatgatcaaatcactcgccttgccgagtgccagcaaattcgtgccgctttgaatgccaccggacgggaccacgtccttcaccttctcgtccccattcctcctccatctattgttggccctccgccttccggatgttttcctcggcctccttactcgaagccatttggcgggggatttgggccaaagtccggcggagcagccattccgggaagaggaggaccacagacaccggagagaagaaataacattggcactgaggagggtgaagagaaaaa

SEQ ID NO: 89681 - DNA, 639 bp, Heterodera glycines
  SCN-specific regions: Sequence locations=1-212,235-354,379-486,529 -557,580-598,620-639
cacaacagtacaaatttgatggagcttttgtctcaacaatcggcaaagtcggcggcgccggtcgatggcccacaaaaactttggcaccaaatcaatgacgaaaacggcaccgaagcatgcgaccgccacaacaatgggcgacggtgctgcttctgtttagactgtcgccgtcggcattgttcctttaccatttcgcccatcgacggcatggagtggctgcagcagtgccacccatcgtacggcgttgacgcggatttgtcggcaaaacggttcctggaggaaaagaagttgaatttgtcgcgccgtttccaactcatcgagcggggctatgtgctcaaattgaagaacgacgacggagaagggccggggggagggaaagcgcagcgaaggcggtgctccaaatgcgggtgcaagggaagtttgttcgatcagctcactgtccgtttgatcgccggtagcgaaatcgaaaacgaaggcaaaacgacggacgaagaggagagggagggagagcagcagaagcgcagcggcggggaagaagcggagaatggtgcgcaatgaaaggggcgaaaaaagcggcaatgccccggggattggtggcattaattaatttattactcatccatcacttacgaccatatt

SEQ ID NO: 89682 - DNA, 614 bp, Heterodera glycines
  misc_feature (389)..(389): n is a, c, g, or t
  SCN-specific regions: Sequence locations=1-51,74-614
caattaagaattttaaatactcatatttattacaaatgtcggattgtatgaccgacgacgacgccgaggaggccctccgacagttcgctgaaataactaatacggacgaagcatttgcccattttattctccaggatgtcaatttcgacctcgatcgtgctttggcccgttattacacggccgatgaccccgaggcctcctacaaaaaattccaaaccgaaggtttggacagcgcacaaaacacgggcagtgaggtggatgacgaggaagggtcgggtggaaccccaaatgacaaatcaaagggtaaacagccgccgcacaaacgttcgcggcatgaggacgaatcgaaggaaagctcgaaattccctgccgaactgacgctgatcacnttggaatgtggacgggacggacggacgcaatttgaacaaacgattctatgcggtgctttacataattgcaagaacgaaccccgaagtgattttcctgcaagagatgactcgacctctgatgccccaactcaatgagctgatggccccgatgtacaacattgtggtctccgacgtgtacaacccggattacttctgtgtgactctcattagcaaaaacatcaaaat

SEQ ID NO: 89683 - DNA, 391 bp, Heterodera glycines
  misc_feature (82)..(85): n is a, c, g, or t
  misc_feature (360)..(361): n is a, c, g, or t
  misc_feature (363)..(364): n is a, c, g, or t
  misc_feature (366)..(366): n is a, c, g, or t
  SCN-specific regions: Sequence locations=1-364
taagatgcctataatatgttttgaaattgaccaagagtacccgcatgggcaagatgcccatgaggacatgctccatgttcannnnagtactgcgccgaaatggttgaaacatttctcggaaaaatgtcggacaaggacgcgttccatttgcgcaaggagatgaatgatgttttgacgaaatacgaggccgccgccatcgacgacaaatgagaagagagggattgattgattgtctgccaatgatttattacgcttgcgcatattcatttgatcacaaattgtcactgcttttacgtttttgatcatctgttggattgtctattatcccaagttttcttggttccgtaaattgtgtttacnncnnanaaaaaaaaaaaaaaaaaaaaaaaaa

SEQ ID NO: 89684 - DNA, 557 bp, Heterodera glycines
  SCN-specific regions: Sequence locations=1-46,68-557
taaattaaaaccctaatcgaccgtttttctatctgcaaaaaatgctgcaattcgaagaggtttgtcctaatgtcgtcggtgattcgccatgaaatctgttcgaaactttcatgcaggcaatggcccaattcaacgcaatgtttccaaatttgaattcgtccgtcgttgagtcagtgctgcgcaattgtgacggcgatgtgagcagaaccatcgatgaattattgcgacgaagtggccaagaagaaggaaataattcggagacggatgaacggcgaaagagtgtgtccactccgccgagggaccaatgtgccaatgacgagaaaatcgctttgctggtccaaaaccgcgagtttctgaggtatctccgtcgcgacccaaacttccaacgtgaaatgctcggccgttccaattcatctgattatcgacatcggcaccattcttcaactcatcgaagacgcaatttgcccgttctattaacgtcgtctcgcacttcccaatcgcctaattcaatccgtttttttcgtacatccgccgatgttatgaccaatccagcggaa

SEQ ID NO: 89685 - DNA, 647 bp, Heterodera glycines
  SCN-specific regions: Sequence locations=1-647
caattaagcgtttttgactcaaattacttgtcgcgcaaaatcacaagcacactcgatgcctgcattttggtgtcacaaatgtcgcagccgatgcatagcattggagcgctatgaggacggagtgcgttgtgggcgttgccacgagggattcattgaggaaatcgacgatattcaggaagaccattctcagcgttccgcgtccgattcaccgcagcaaacgccgccgccgcttgttttgcaggggcacgagaacccattcggcgcatttcccggctcaccgtttgctcggctcttccaactcatccacaacaatatttttcctaccaccaccgccgcggctgggaacgacggtcgtccaacggtgctcatccatcgccggtccgcaagcgaagggccgtccacggcgacccatcagccgcagcatcgccaggccgctgccacgccgccaccagtgccgatggatcagcagccgcacacgcaacgcagtcacgctcagcagcaggcttccgaccgaccgcagccgcagcagcacgaacagatcaaccacaacgacctcctcactttgttcatggaccaattcctcggtccgatcatgaataacgctcaaatggacaacacgggtggccggacgcaagtcatcattcaat

SEQ ID NO: 89686 - DNA, 488 bp, Heterodera glycines
  SCN-specific regions: Sequence locations=1-418,445-451
gtttgaggttcggttaaattacgtgctgggaagaggtggaaagagcgttggacgaattgattgagcaacgccgccagcggggcgtactgcccgaggtaaccgaatgggtaccgcccgctggcggaggaaggaggagagggaggaggtggaggggaagtcgacaacttcgtggaagtgctctgttggtttgtcgtgggagattggacggggcagtctcaccggatacatcatccgcagttctttcgttgacccgttttacaaaaaatgcaaagccaggagaggaaggagaccactttagtggcctggtcaacggaaagctgaccaaacatggccaccggcggataaacaaattgatcgaacgcaagaaacaatggacgcaaaattcatgatcagcgctttttcaaaccaaaattcattgtaaaaattttttaaaaataataaaaacatttggaaaaaaaaaaaaaaaaaaaaaaaaaaaaaaaaaaaaa

SEQ ID NO: 89687 - DNA, 1199 bp, Heterodera glycines
  SCN-specific regions: Sequence locations=1-51,73-320,342-672,714 -1152,1174-1199
ccaagtttgagcgaagatcactcaaaaggggacgcccatggagagcagcgacgccaacaataacatcaacaacagcgagggggaggccgaaaataccaccaaaaacggcggagaggagggcgtcgagaagaagatcttgagcaaaggcgtcagcggggtggtcaaatggtttaacgtcatgaatggatacggcttcatttgccgtgatgacaccaacgacgacatttttgtgcacaattcggcaattacagcaaataatccatccaaaattcagcgatcattgggcgatggtgaaaaggttatgttcgacattgttgatggtgctaaagggccagaggcggccaacgtgactggtccggacggagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgaagtgccggtgggcgaaaagaaagaaggcgcagaaaacaatggaaaagaggctaagaaggaagaggttgcaaaggacgccaacggaggacgtggcggtgggcagcgtcgaggccggggcgttcgtttccgcgggcgccgcaacaatcgtcgaaacgtcgcgggctcaacatctggtggcacagaaaatgaaggcgaacagaaaaaagaacaaacgcagccggaggaagagacgaaagtgaacggaggcgaatgagcgaaatgcgacctcttttgtttagcgataattaaaaaagtaataagtctgcttcctacgatgtgttatgaattgtgtcgacaatttaaaggatttgctgacacaaacatattacaatgctttttcccacctctcaattggattgaatgatatcctcacttttttaatcggttttacatttggactcatcagcacaataataattcaaaaaatagtttgaatattttacgcgaaacaattaaacaaatcattgagttgcccatcgggaagtgcttacagccctttcacacgggtttgtagtcaagactggtctccaactttttggcgtccgcaactttacggactgccttcatgaagtcctcctgtaccacgccgtccctctcctttcggatcgcattcagtccagcttccgtgcacacattgcgcaggtctgcccctgagaatccct

SEQ ID NO: 89688 - DNA, 747 bp, Heterodera glycines
  SCN-specific regions: Sequence locations=1-414,436-747
ctgaataataaaaactcaaattcgagacttggacatttcgtgggctcgacattttattttacgtcattacacagcttttttcgcatttggtgaacttaacttcatccgattactaaaaagcccgtctccgaaggcgacttgtgacttttgttttttcgccgaatttctctccgcgaccattttctcgatgtcagagtttacttcgtccgacggatcagggaaaagcgttagcagtaaggtcagtgagtcggaaagctacgacgcgaccacgcttggtaaattgatgaacctcgacgccaaagtggtcgaatggctcgagaaagagccatatacggacgacgatccgctcttggttcttgacttccttggtccgtttaacaatcttcatggcgactacaaccaaaacaaggcctttttggtgcagaagttggttgccgctggaggggctagaatcgccgcgaacgtggacaacgttatcaaatttgcgacttgggacatgtttttcgaagcgcgtcgcattttgcaggctgacatggaagtgcgtcactttttctacaatccaaatccggcaatggctcttcaaaacaacattaaccaatttccgatcgtctctacaaccgtggttacgttttggtcagatgactcgcagaaattgaagacgcagccgtgtcagttcttcgagttttaaaggatgatccattgttcattcagcattttttgttgcaaataaagacttattacatactt

SEQ ID NO: 89689 - DNA, 705 bp, Heterodera glycines
  SCN-specific regions: Sequence locations=1-529,551-705
attttcttccactgatcagtcacttctgatcaatcgttcattttgcttcttcgtttccctaaaccatgatgccctcgtcgccatcctccgcccccctaggcgcaaatgttttggtgaccggcgccaaccgcggcattggccttggcattgtcaaggaaattttaaaaactgacggcatcgtccatttgttagccggatgccgaaacccaagccaagcggaggaattgaaagagctgtcaaaatgtcacaaaaagctgaaattgatcaaaattgacgtgagttgcgatgaaagcatagcaaatgcggtggccgaagtgcgcaaaatgttgggctcagaagaggaaaaaggactgcacacactcattaacaatgccggaatattggagaaagagggcggcactttgttggcgcccgaccgcgccgcgtatttgcgccatttcaatgtgaacgtcgtcggcaccgtggccaccaccgccgcctttttgccattgctgcgaaaagcggcggcaacaaattcggagggccaaacggaggagcagcaggcggcgcccgttgtccgcgtggtgaacattggcggagcgttgggatgcattggcaaagtgttcttaaagccatcggagtgtccgtatcagaacatggcctatggcatgagcaaggccgccgtccatcacttcaacaaaatgttttcgattgatcagcccgact

SEQ ID NO: 89690 - DNA, 716 bp, Heterodera glycines
  SCN-specific regions: Sequence locations=1-679
aagcagcttaacatttccttgcaccgcacttcggtcactctcttttctatgaagggcccaaatgatgccaattcgtccatgcaatttgaactgaggctggtcagtggccgaacagaattcccttccgttttcctcgccactcgcgccaattttctacttcaaaaaggcgaaaatcgcaactcggccattatttcgctgagggaccctttggatgggccgcacgaagtgcacctggaacttgtgcttcgtctgagtgtccgcggaatatttgccggaaaatacatggccaatttgacggttttcgtctcccaacaaaaagcgcaaccgcaccatccgccgcaattgcagcagaaaaacagcgcaaaaagacatcggaggaggagacggacacaccgtaacagagaagaaagaggcgcaagcggacaccgtaacggaatacgtaccgtaaccgaaaaaatcggcggatggtagtcaagtcacaaatcaaatcactcactgtcagcaactgcttttaaccggccatttcggtgtttgttctgccgaatacctcaatcattggaggatgctttttctctttttgttcatttgttttgtgccgcgaattgcaaatttcattttggcatttcattttcattttggcattcgcttttattctgattagataaatcgctagagaatgaaaaaaaaaaaaaaaaaaaaaaaaaaaaaaaaaaaaa

SEQ ID NO: 89691 - DNA, 667 bp, Heterodera glycines
  SCN-specific regions: Sequence locations=1-65,94-104,128-185,208 -621,647-667
caagtttgagtttagtttcgagtatttattattacctaattgtttatcattattgtcattcggtttaagctgcttttactttgtttaaatgtcatccggagtcgaagttcctcgtaattttcgacttcttgaagagctcgaagacgggcagaagggtaaaggggatggcacaatttcatgggggttggaggatgacgacgacatgacattgagtcggtggactgggatgatcatcggaccaagcagaacgccatttgagggacgaatttacaatttgcgcattgaatgtggaccaaattacccgcgggaagcgccgatcgttcgctttaccactaaaatcaacatgaacggagtgaatcagcagaacggagtggtcgacaaacgcgtggttccgtcacttcgtcagtggaacccttcttatcatataaagactgtgctcgaggacatacggaggcacttgatgactgccaaagagaattcgaagctttcccagcccgccgaaggttcgtcgtactgatgggttgcactccgttccttcaaacgaatattccttccatcggtttttgccccaatttgtcgtggtatttcgttataatttgagtccttcgaatttagctcctcctttttgttcgttcgtttgttttgtctcttcactataactgatttt

SEQ ID NO: 89692 - DNA, 849 bp, Heterodera glycines
  SCN-specific regions: Sequence locations=1-41,63-629,652-671,695-849
ccctcttggatctttttccgctgtttctctgctcctccgctgctctctcccacctttcccaattgggcaattcgcccccgcgtcagtcgtccatctttgacagggtcaaggtcagctgaaacacatggaaaaggaaaactgaggaggcggagattgccaaaaagcgatggagccaaacttaaaaggattatttcaaagttggggtaccaacgcttctccccccaggccccgctctgccatcccatcgacatttcgttgtgccgtgacatcccttacaatcggacaattcttccgaatccgttcatcgatggattggacccgcaaagtctccaagcgcaaacagaacatttcaagccgctgattcgcaccaaatgttccccgcacattctgttcttcgtttgctcagtgttcgtgccaatgtgtcccgcacaattgccacaggcagtcacttcgtgccgttccgtctgcgaggaggttcgacatgattgcattaaaattttccacgagttcgactttccatggcccgccgtgctcaactgttcccgcttccccgcttctcccgaattgtgcatgcgtcccgagccaaccacgcccgagcagaaaccgtttcacagtttggcacccgcaaacagaaaggcgcgagtgccggagtgcccccaggatttggtggatttggacccggccgacccggcggcgaaatgcgcttttcgctgtgagaagagcacaatgttcaggaaggatctgaaggaaaaggcgcgtgtttggcttatgatgtgtgcctttctcaacgtttgcattggctctttcgccgttttttccttttgcatccatcgccgtcgctttgctttc

SEQ ID NO: 89693 - DNA, 621 bp, Heterodera glycines
  SCN-specific regions: Sequence locations=1-398,421-621
aagtttgagtcaaaccaaaattaaatttattcatgttcttcgtgaaccttgctgcaatcttaattttcctgcaattttatttggatttgaccgaagcgggcatcgaatgccaaccaaacggagtctgtagagacgtttctggctcaactcctgcgagtaccgtatgctcaaaaaaatgctacagttgcacttacaaaaactgttgcaacaaagtgtacacgagccagtacgccaaatgctcaattaaggggtggcgtaaaaaaggatacattggcaatgtgccagtcgaaattggtgcaacgaagaaacgagacgtttactgttctaaaagcaatccatgcgcaaaagagggctacaaatgcgtggcctataaaaagggagatgacagaggcttctgctggagagaaaaagttgagaaagcgcctccgtcaagctttgctttggcaattgcgatcgcaggcctcgtcattctgctgtgatggactgatcagaaacagagttgaagggatcaaggaattacgaacagcgattttttgggattaactaatcaattatataattagtcatgccgtttacatttaaagatggcagtttttatattaaaaaagcatctgcgtggta

SEQ ID NO: 89694 - DNA, 1152 bp, Heterodera glycines
  SCN-specific regions: Sequence locations=1-158,180-1152
gtccaattaagataaaattcccatatttatgacacttgacgataaattaacttttcctccattagaagaacaaactgctcgcaagaggcgcgaacgaaaacatcaaaaagttatttcgtcaggttggaagaccaatacactcaattccatttgcttctctactgcacttttgctttgtttcgcccattttgaacaccttcaaacggatgctgattataaatttttcgaaattcaaaatatttcaatccgtcttcaaaaagatttcctcgctggaatcgttcgtaatggtcattctatctcagccgtcatgttcttgttgcatattgtcgctaccaaattgtccgaaactcgtttcactttccttggtctgctggctgtcctttcatggccggccttattcttcgtacattatgaacagattcacaaccgagattatctgatcagtcgcttagcactttctgcctttacactgctcatcagcacagcacttctctttttaccaaaaaagccgaaacgcaagaaaagaccgaacactttttacagtgccttttccgttgccagcactcctctctcgcaacgttcacgttttactcgggactcatctgttacagattttgtacttgataattcaaaaagaatgatggattttgaggacgatgaccaatcgctttcttcaaaatattctacgaaaatcgtacttcaaatagaatcagaaataggtcgtttttggacaagtcgaatttactgtccaagtccgcttccaaaaagtcttccgcgccttcccttcgttctttttccgtttgttcttctaccgttccttcgcattcttttggctggcgtgaaaaaagagaggaaactccgttaaaagaagtaaatcagctcatcgaccaactgatgttgtacagcaccgacgaagaaacggcagagaatgaattggacgacgaagcgattggaaggcaaagagaaatggccattggaacggcagcgaaaaacgaaggcaaaacgatgctgagcactcgagcgatttcgccaggaaggcagtgccgacacggcaaacagcagggaccattcgcatcgctcactttcaacccggccgtgcgtaaaattgccgctggccatgccttcccttttgaaggcggtttatttggctca

SEQ ID NO: 89695 - DNA, 485 bp, Heterodera glycines
  SCN-specific regions: Sequence locations=1-162,186-455
gtccaataaggcttttaatttatcctttattcaaacataaatcatggccgattcttctaaggtccctggcggtggcaaagtcgtcccacgctctgctgctggcggtggcttaagacaacggcgagctggtggggcggcaaacactggtcgtactcgaactgctggcggaggagggggcggaggaatgaacagcggcggactgtggcgcttttatactgaggactcgaccgggttgaaaattggacctgttcccgtgttggtcatgtcgttggtgttcatcgcttctgtgttcgtcctccacatttggggaaaatacagtcggactcattgaattctcactttgccgattcattcggtctatcggcaaaaatgcgattttattcatagtttttacaaatcacttccatttaatggaatatttgttttgtatgtaattctgataaagtctttgttataaaaaaaaaaaaaaaaaaaaaaaaaaaaaa

SEQ ID NO: 89696 - DNA, 474 bp, Heterodera glycines
  misc_feature (453)..(454): n is a, c, g, or t
  SCN-specific regions: Sequence locations=1-396,418-454
atttgttccaattttaatatgaatttcccatcaagaactcgaactcagttggtcacggactgcatcgattactcgaacgaaatcgaaggaattattcgtgctgttcccctaatatggcaacgatttgaagaagcatccaaattctttagagtgatcaacaaatttgtcggctatttcccaccacttcgcgattcatttcctacgccaggcaacgaaacattggacgaaattctgcgctgtgctggtgtcggagtcagattgttagttgaggcagagagtgtttcggactattccctctcaaacttacgtggcgccctgttcgccatttattattcggccgtgtactacatgccaacgactgatgactgattttgctgatggacttattcgtgacgaaaataaaataatttgttgttgcatttctctgttgttctgataaaaatttatttctcnnaaaaaaaaaaaaaaaaaaaa

SEQ ID NO: 89697 - DNA, 738 bp, Heterodera glycines
  SCN-specific regions: Sequence locations=1-184,206-669,691-738
gccaattggaccatctaaaaatctgcttaatttgccatgaacaaaaaattcatcaacgcacttttccatcaacaaatgttcaaaaatgcagttcttcttccgttccgccacttcgctgctttgactgccacgcaaacgcacattgatcccgttcctttgtcctttcttcgccaatccgaagatgaaagcgaacagaagacgacgattatgccaaaatggaaggaggagggactgaaaattgagaggaactgctcaaatcgcattttccaaaccattgccaaagacattgtcgacgagtgcgggttggacaattccgcccaggactacgccttgtgggtcaaagcattcggctccaacttcagcatgttttttgcacttgaccaaaatcggcatccgatgggctctgttagcattgcactgtatccgcaggtggcacaatggagcatgttctttgtgaaggaccgcttccgtggtcaccggctcggaagtacgctcactcgacggtccatggaattgcccgggatccgacccgttttctgttacggagcggccgatatgtggttcaaatacgcggaggactacggactgaatcatttgttggactggcgcctttggtcaatgcacgccaattgcgcggatgtgcgtccagaacggttggactacgactcgagcgtggagctgaaggagtggcgcgaagtgtccttcgaccaattgttgagttttgaccgtctgcagacg

SEQ ID NO: 89698 - DNA, 1419 bp, Heterodera glycines
  SCN-specific regions: Sequence locations=1-926,950-1132,1172 -1362,1384-1419
cttaagagtattaaatggctggacccgactctcgttttattctcgaattcttcaaccgtgaggctaaagagcttggagtaacgcaggaattgcttaacaattcacagcagtccgatcagttgatccaggcctactactttctgtgtgatttgatttttgaaaatgtcggcaccaccaaagagaacgagtgtgaagtggccactgatctgacgagggctcgtcccaagatgatcatccgaacgcaacagcatagcaatttggtgttcaacaagttgttcgatggttctaacgaatttctctactccgatctattgcaaccggacccccgcagaacgaagatgcacattgctcaactgattcgcttgtacaccacaaagtgtgacattgccaaagagctttcggcggtggacaatcacattgatgaacaaatgaaagcgcatgactttgagaagaactgtgaacgttccacacatgctcaactgaaagatcgcgaagaagcgcttaaccgcatggagaagcgaaatgacgaaatgggcagcaaagtgcgacgactcaaggacaaattgaacgatcgacaagcgctagcggaggatgagaaaagaaatgtcgaacgcattgacaaaattttgttgggggcacagtgcgaaaatgacgaatgcaaggaattgtttgcccaggaagaggaaaaccgcaaacgattggacaacaaaattttgagctcaccggaacgcatcatcgaagagctgtccaacatggaggtcgaagtggaggacatccgtcgcaaaaatgatcaagcagtgcaaaacgaccgaaagttggagagggaatacggcgaacaacgcgtgaccagccaatgcgtggagagtctgatcaacagcatgcaacaattggagatgatgcaggaacaaatggtggagatgcgggcgaaggaagaagagcgacgaaagcaaatggacgacttggaaatgacccgcaaaaatttggtggccgaaattgaagtgttggagagacagtcgacgaccgacttggaatcgttggggggcgaagtcaaccacagggctaagtcgctggcgatgctcaaccagcagaaggcacagctcgaaagtgatgaaaaggagttggccaagcaactgaagaagaagaaggacgacattcgccagcatcagcaggagatcaagcgaaaagaccgttctttcatcattctcaccgacacttacgacgattccgtggccaaacttttcaaaaatttgagccttgtggagcaaaaggtccaagtgagtcgctcaaaccttctcagcctgttcgacgagaaaaagagcgaaatttttggtccgttcaatcagtgaaatgataattattatgatggtggtgaacccccattggtctcgtgtataatttctgatcatgaaatatctcttc

SEQ ID NO: 89699 - DNA, 720 bp, Heterodera glycines
  SCN-specific regions: Sequence locations=1-601,624-720
catgaataaatggcttctactattacgcacgtggtcttcgaccttgatggtgttctgatcgacactgaacgtcattatacaacggccaacgagcggacgttggagaaatttggagcaaaattcactcgagaaatgaagctcaaaatgatgggacgcaaaaagacggaggcggtcacggttttgctgaaggatgcggggatagcggatcgcgttacgatggaccaatacattgcggagtacgacaaacacgtccttcaaatcatgcgcgctcttacggaggaattgcctggtgccaccaaattgatcgaccatttgtacgcccacaacattccaatggccatctgtacgggatcggacaacgaggagtttgcaagcaaaatgcttaaatttgacgaatggcttaagaagattccgcttcgtgtgctgtgcgggagtgatccagaggtacgcattggcaaaccgaatccggacgcatacgaagtgaccattggacgttttgctgccaaaccgacttcgccgaagaatgtgctggtgtttgaggactcaattaacggagtggaaagcgcgttgggtgcgggatgcacggtggtgatggtgcctcagcgtgagtttctgccgaatgattggcccgagaaagaactccgttcgcgtccaaattttgccgccttgctcgattcgcttgacaatttttgcccgaagcaatttggattgccggattat

SEQ ID NO: 89700 - DNA, 532 bp, Heterodera glycines
  SCN-specific regions: Sequence locations=1-41,63-481
caagtttgagatccattttcataaaaatgcataacttttattttcctcttctttcctttgtcatctttgtgtatttagcccatttctcagacgcaaccaaacaaaaatttcttggcggcgcccatggtaacgatgtggacaatttggatgcaccaaagcaacacattctcggcggagttggtggtgaaaaacagctcaaaccggacgatgcccagccaagaagaatgcgtggagcatggccatggattccacctcggaacgacaccaatggccaagaacagcgaaaatttctcggaggagcgaaggttgaaacagtgatgatcaaaccgccggaggcggatgatcagaaacagcagcaaaccattcttggcggagttcatggaaacgatgctaattgaatgaaaaatgtgatcggatatacacccgtccctccctcatttaaaaacatttgcaatttgacgaaatatccataaagataatgataaatatataaaaaattttttaaaaaaaaaaaaaaaaaaaaaaaaaaaaa

SEQ ID NO: 89701 - DNA, 374 bp, Heterodera glycines
  misc_feature (84)..(84): n is a, c, g, or t
  SCN-specific regions: Sequence locations=1-12,55-125,148-171,201 -230,281-293,351-374
cctgaatttttcctggatccaggtccaggtccaggccatttttgggcaacctggatctttcctggacctggattttccagaggnttgtccaggaaatcaaggtccaggtcaaatgtgaaaaaaaatccaggtccaggtccaggcaaaacaggaaaaaacctggattttcctggacaaaatttttgaatttattttttcaagtgaccgatgtttgtcaagttttcaaaaacaatttatataaatttaaaaacacattatgatttttaattagatatttttagatgcttctaagcaaataattaatttttttcaagattttttttgatttttaaaagaaatttcaaaaaaatccaggtccaggcctggatccaggt

SEQ ID NO: 89702 - DNA, 639 bp, Heterodera glycines
  SCN-specific regions: Sequence locations=1-191,213-578,601-639
atacgaacagtcaagcaaaagactcgtttcgcatttccatttttttcttctcccattcctatggcctctgccccgtcctccgatcgcttttcctccgatcactttttctccgatcggtcccttcgcccgcaatgtctgcccaattgcgcttctctctcttttggctttgtagtggacaaattggcccagcattgtcactgctttagccatttgttcgaatgcggccaacgcattttcgaagtcagtgccaccgaattgagtcccaccaacggattcacttcacgagtgtttcgctgtgaattcgaatttggcacatttgtcggagaaaagcgaatgccaacgccaaagaagcggacaatgagtgcaattgcaaaagtgatttcactggagagaatggacactttgtgggagaatttcgttggcaaaaagcaaatggaaaagatgcgaaatagcagagagcagacagaaatgataaaaagcactcttttgcaattacaccgcaacgaatgcaatttgtacaaatttatcggctcttccgcgccccttccgcttccgaaggttttttacacgcaaacagcggaagagggggagggagtgggacttatattgatggaggacctcagcaaaagcacgcatttg

SEQ ID NO: 89703 - DNA, 428 bp, Heterodera glycines
  SCN-specific regions: Sequence locations=1-365,387-389
gtccaattaagtggatttttcgcgcaaatttttttggcatttttggtgcataactactttttttttgacaatgtccatcgttggagggcactcgcttcgtgccgaagtgattcaactttacaagacgctgtaccacttgggcaaggactatccgcaaggctcgcgttggttccatgaacggctaaaaaacgcattcgcacgcaacgccaatgtgcaggaagaggccaaagtgcgcgagctgatcaaacggggcgagtacgtggtcaaggagttggaggcgctttatcggctgcgcaaatacagggcaatgaagaacagatattacaatgattaaatgtaaaaaaaaaacattaagccaaacacacacatttatttgaaaaagctttcacatttaaatatttaacttaaaaaaaaaaaataaaaaaaaa

SEQ ID NO: 89704 - DNA, 740 bp, Heterodera glycines
  SCN-specific regions: Sequence locations=1-645,667-740
caattaagcccccgttccggtccaaattcggcccgctcgccgtcctccgcgcacggagtccttcaccaatacgctgatcagccgcaacaccaattggactccgcccgttcgttgagcattgaattggcctctgccacccattcgctttcaaacgctgtccaaatggcttccaccgggtcgaccaaaaagatggctttgcatgcctcggaatgcattgaggagatgacacgcgcatgtgacaaattgatcggcactcggcaattgatcaacaacgaccccgacatcagcacggacgaacggcgtcttctgctggagggtgttaaccgtgccatctccgccttccgtcaacggcttcattctgtccttggcaacggtgacgaaggtggcgccgggatggacgacggccaaacatcagcgactgctcacgtgggcaaatgggacggggaagaaagcggtggcctgagggtttgagccgaacgcggaggcgtcgtactgtataatatttggcgggtggacagaacgccaatttttgtgtttgaatctgtgcaactccaccatggttgtgtgtgccctcctctcccctcttattacatttctttgcattgtcatgacgtcgtcgcaactgaaattccaaaccctgtcgcattatgtcactcttttttccttctggtgctcatttttctccccttttgcgcaactgtcacaaattatttttgctcccttccgcagtgaccttcaca

SEQ ID NO: 89705 - DNA, 1126 bp, Heterodera glycines
  SCN-specific regions: Sequence locations=1-1126
tttaatttaacctctgacattggtcgggcgcccacccgaaaatcagcgaggcgctgctgcgccattgcgacggcggtgccaccgcttatggcgccagcgttttggacagaaaaattgagcggactttcaacgaagtttttgagcgagacgtggcggtgttttttgttggcactggcaccgctgccaatgcgttgtcaatggcttatgtgaatcgcgcgggtggcatcattttcgcgcatcggcatgcccatctgattgaggacgagtgcggcgcgcccgaatatttcacgggcggcgcccggttggtcggcgtaagcggtgccgagggacgcattgagccggaagcattagaggaggcaatccaacgctatccgccaaatcccgtgtcagtgcacgcgggccgccctatggctgtgtccatcacccaaagcacggagagcggcacgctctactcattggcacagatccgtcgtattgcgaacattgcgcattcgcatggcattcccttgcacatggacggggcgcgattcgcaaacgcaatggccgccttgggctgcacggcggccgaaatgagttggaagagcggcgtggacattttgtcgttcggcgcctccaaaaacggctgttggtgtgccgaggccattctcgtgttcaacgacttgcagcaggctcacaaagactttcccttcctgcgcaaaagggccgcccatttgttctccaaaacgcggttcatcgccgcccaattcgaggcgtatttccacgactcactttggctgcgcaatgctcggcatgccaacaagatggcttcccatttgacttcggcaattcgttcgttggatccgtcggtgattcgtttggcatggaccccccaggccaacgaagttttcgttgtgatgcgtcgttcagttgccgaaacattgcgcaaaagtggcgaaatttcgcatttttatgagtggaatgttccggacggagagcgacgcgagttgaagctgtacacggaggagggactgttccgtttggtcaccacatttgccaccaaagaagctgaagtggacgagttcgcttctcttctgaaggcgcattatttgggaaaatcggagcaaatgcgaagcatcgcttaacagca

SEQ ID NO: 89706 - DNA, 885 bp, Heterodera glycines
  SCN-specific regions: Sequence locations=1-885
taatttcttaaaattactaatttatttcatcacattaatattatttaaaattgccgaaaacagcaatgtctgcggtacacactgtggaaaacccgccaatgccattccgatggccaattgagtacggcatgcaaactggtgccgaagtgatcatgacgggtgccacatacaatggccaacagaagcaatttgttgtcaacctgaacggtcgtggtgatgatgttgtgctgcatgtgaacccgcgcttcaaattcttggaggacacaattgtgttgaacaatcgcagctatgcgggctggcaaaaggaggaacggcaccggaacaaatttgctgtcggtgacacttttcgtctgcgtattgtgtgccatcattcgcactttgtgatcattgtcaatgacaaagaaattgctcaatttgagcaccgtatgtcacccgacagtgtccgatcgctggaggtcaacggcgatgtggtgttgcaccgtgtcaatttggtgaacatggcgcaaccagcgtccgcaccagcaccaacagtgcaaccgatggctccggcaccacagtttggccaaccgatgtatccgccgccgccttcccaaccatttggctatgcggcaccgcctccggatgttggcttttcgccctccattggcggcggtcattatccctcaatgccaccgtatccatccgcttcagtgccgcagccgaatgctcctgccgacgcatcacaatggcaccagccagattatggcacgcccaagccaaatgctccatatccgccatatggccaccattgagatgctgtgccaaaatgaaatgggcaatggatgaattttaccgtgataaaaaatgagtgtggggaaattagagtccgtaatttttaaaaatcgg

SEQ ID NO: 89707 - DNA, 260 bp, Heterodera glycines
  SCN-specific regions: Sequence locations=1-212
gtccgtccgaactccgccgtaatgaaaaaaccgctttttgcttccttgccttacccgaataatggcgttcatcccgcgcaccattccaacgcttaacgcaaagagcagaacggacagaaggcattcggcaaatgggaaaaaactggtgatggctacggaaaacggcaaaaattgggacggcggaaacatttctggcatttctcgttgtttcgaaaattaattaataaataaatatgctaaaaaattttttataaaaaaaa

SEQ ID NO: 89708 - DNA, 655 bp, Heterodera glycines
  SCN-specific regions: Sequence locations=1-217,239-503,525-655
gtccaatcaagataaaaaaacggactaaaaaaacattttcttaattcgccctcgaatgtctctttcttcgatccaccatatgtcacgtctgaaactttggatgaccccagtgcgcgacaatcactttgggttggatgacctcaaaattttcaacagcgatggttactctgaaaatgccccattttctcgtgagagcagccgaaactcttccgcggatggcagcatcgcatgcaacgcggatgctgctgatgcggtcattaacatgaaaattggcgtctggaaaccattgcctcagaaaacttgtggcttctgctacatacaatacaagcgtcactgtcagcgactcggagttgcatttccgcgtgtcaccgataagggcttctgggtcggacacaccaccaaagacgagcacggggatgtcatctgtccggagttgcgcaagctgaagtgcccgttgtgttacgcttctggaaagaaggcgcacacattgaaattctgtccattgaacagcatcaaagggaggcgtgacgaagcataaagtttcgtagaacaactaccaaaataacttgtttgtcggattgtttttgtattgaattttgttatcaccttgcttattgttagtttgtccaccattgctattctgttggtttgtcat

SEQ ID NO: 89709 - DNA, 837 bp, Heterodera glycines
  SCN-specific regions: Sequence locations=33-323,345-837
cctcgtgccgaattcggcacgaggaattttgtaagtgaagaagagttgcaaaagcagcgtgaagctggcgaagaaaagcctgagagttcagagccggtggacaaacgaacactttacgaacggttgaaagagcaaaaggacatcaagcaattggaatacgatgaaacgcacgcattgaagaaccaattccgtggcattgacgaggccgagtcggactttcttacacaagtggagcgggccaaggaggagcaggaggcacgcaagcgcaaggaggaacaggaactggtgcgattgagtcgacaactgacgcaacaacacgcgaccggtgccacggctgagcagcaacaacacgcactgttggagaagccacaaaaagcgagcaccgccgcttcgtcagggatcagcagacaggcggcacttatcacatcgctcgtccgccgcaaaagaccgctttcaactgattctgaaccaaaatcggcgcgtggcgaagtgccatcgccgccctcgtcgtctgacagtgacaagcgcaagaccaatgaaccgtcgaaggcttcaggcggtccgccaccaaaacaacggcacgaatcgcattgccaaatcattggagtgcttcccggcttaccgaactactccgattcgagtgacgaggccgagagtagcaacaacagcgagagtttggagtcgggattgccatgtgtggcaatttacgcgggtaaaggcgcaccaaagccgcacggagagtgttgaaatggataccaacgaacgtgatgaggacatgctttttatgacgtatttttgcgaaatcccgctcatatttgtctaatttgttaataaaag

SEQ ID NO: 89710 - DNA, 653 bp, Heterodera glycines
  SCN-specific regions: Sequence locations=1-121,143-653
gtttaggattcttcttcattacaacatttgtgatgtcgaaccaacaaaatggtgatgtcgctgttccggcagcagttgctccgaatgaacaacctaatcaaaacaaccaattccaactttggccctttctcaagtccattttgacccgtcttgtcatgttctggctgatctcgtcacttattcgaaactttttcggccctaaacaggaacgtgacgccgaccaaaatacatcattgaccggcggtggaaaaacgtacccgccctcttttaatatgttcatggcaaatgagcattttgacttatttgtttacctttctgcaaagtccgaacgcttccatgatttcgacaatgttgaatctcttttttggcatgaacatgatctcgtttacggggattggacctccggtgccattggtgacggctctcgacaaaaggcggtgacgatgatgccaactccggaagtgctccagcggaacggctcactgtatttgcacgttttcctggtcaaacagggacagtctcatcatccgcgtgccaaaaattatggcgggagggaaattgtgtactccagccatcaactgaacaaattcaaaaagaagtactaccaaaaaacagccaatttgctgacaggcaaaactggacaaagtgaattg

SEQ ID NO: 89711 - DNA, 584 bp, Heterodera glycines
  SCN-specific regions: Sequence locations=1-53,75-160,182-402,426-584
ttacttcgaaagtgcgcaaagcgtttgtttggagtgcgacaagtcgtgcgcaacttgccatgggcctggtccgctccaatgcgacgaatgtgcacagggctttgccaaccatacgatgggttactgtcgccagtgctgttctcccgaccaattgactcagaaggacttgcactgtgaagattgctccaagagttaccccgaattccgcacgaaaagccatctgtcaatgctttctcttttggccaactttttcacaatcattggcctcgtccttttgggcactgttcttttttatttgtgtcgccaattgatttgctgttgtttcgagattggtcgcaatggaaatcgttctgatctcgagtacactccgctgacaacaattggtgatgatttggacggcagaaaaaaggaccaaaaacaaaacatgggttttgcgctagaagatgatgaatccgaatccgacagtgataatgcggagtcattgatggaaggtgaaaagagttcgccagaagccgagaaagagcagaaacagcagcggaaagtgccgacggaagaagccgagagctaaaaagcgtcggaggagg

SEQ ID NO: 89712 - DNA, 325 bp, Heterodera glycines
  misc_feature (320)..(320): n is a, c, g, or t
  SCN-specific regions: Sequence locations=1-292,314-325
gtgggccgggccggaaaacggcaacaaattcgaggctcaacgctatgaacatggccaaacgtgttggaatggaccggagaggtccactttggtgcagttcgagtgcggtgaacagttcgaacttgtggaaaccagcgaaccgtccaagtgcgaatatcactttttggcaaaatctccgaccgcttgtgctaacccggaagagctaaagggggaacatgctgaactctgaaggataatttagcaagactaatgttgttcttctaaatgaaaattcttaatttaattcgacttgtttggttaaatttgtaatttccaaaaanaaaaa

SEQ ID NO: 89713 - DNA, 944 bp, Heterodera glycines
  SCN-specific regions: Sequence locations=1-145,186-944
gtttgagggagagctcagcagaagtgaacggcccttctgtgcccggcattccgactgcttttctgcccaatcgccgcctccgtccgcaatgtttctgactccgttgggcaatgtgaagaacgaattggtcgtctgtcccaccgatttcggcggagatttcgtctttggaatggaactcgaaccatccaacagcgacttttgcgcgtcaactgccgcctttgccccttcgatctcaatgaatggtcctttcccgccgatgcaaacacaaatgattagaatgccaatgccatctttatcagcttcaatcacggaagaccagcagatggcctatttgctgtcctccgccggacagagtccgtccggctcgtcccaacactcgtccctggaggggtcgcctctgcagccgaactgccaccaaacgatgcttttaagcattggtaaatacgaactcaacgacagaaaaatgctgaccgaactcagcggagaagtcaaaacggacggcgcaaagaaaatggctgcgacggacgcagcgatgacagcaccgaactcacccgggggcagaagttccgggaccaaccaactcggccgcacttactccccgggacttcccttgtccatggtggaacggcaaaagattgtgcaactgtttcacgaagggtggaagatttgtgatatttccaaatatttgtgtgtcacgcacagttgcgtctccaaaattctccagcgattccgcgcgaccggttcagtccgcccgaaggatgccaaagaaggccgccaggagtcgcctttggtcgcggccattagggactaccggcagagacttggcattatgcggcagtcggagattcgggagcagctgatcagagacggactttgccgtcgcgaaaacgcgccctcccgctcgtccataaaatcatattttgcggacaaaacttagcggctta

SEQ ID NO: 89714 - DNA, 648 bp, Heterodera glycines
  SCN-specific regions: Sequence locations=1-626
caacaacatcaaaatgcaccggcgacaatggaaattgacgagcagcaccaggcgaacagtgcgggccatgttgttgcgtcgggggaatgcgtacagcaaagggagcagcaacaggaaatgcccgatttgtcagcaatgaccgaagaggaacatttggagtatgttatccggtctttccatgacaggaaaccaaccgacgcaaagtgctcaagatggacagcacaatcagcaacacactcgctctccttctggcgcaatgagtacacctgctccaactccgatggaagtggaggagggaactgctggcggtaacaatgctaaagggccggctggtggcggagtccaactcggcgatttgttgcaacacccggaaatgcttcatcaattggttggtcaagtgccggttgatagcagtgaggcaacaacaaaggaccaaccgacggaagtcaaagaatctgatgagaagaaaacgagtacgaagaaagaggcggaacgaaaggacgacaacaaaaagggaaattccagcgaaaattgaagggcaaatgctgcgaaacgtcgtattattcgataaactgaactgatccatcatctgttgcttgctgactaataaagtttttttttttgttaaaaaaaaaaaaaaaaaaaaaa

SEQ ID NO: 89715 - DNA, 633 bp, Heterodera glycines
  SCN-specific regions: Sequence locations=1-6,128-633
taaggttttctttttcttttctcaactttcggtctttttctgattctcaacatttcctttcccttttgcttattatttttcttcattacctcacttttcttcccctcacttttctcttttcattcttcccaatgtcctcccaaaatggcactgattcttcccttttggacgatggtcaatggttggacgggcatttccccctgcaccacgcagtgtttgacaacgatgtgccaaggctgggacaattgctcaaagaggcagcagcagcagcagctgaatcttcggtcatcgacagagaagacacccacgggaatacggccgtgcacatcggctgtatgcttggccacagagagtgtgtaaaattgctgttggaacatggggcatccgtccaatccggcaacaatttgggctggtgcagttttcacgaagcgataagttacggcgatcgcaaaacgattcgaatgatgctaatcgcgctcaaaaaacagtccagcggacagcttaaaagtcgactgcctttgttgggcgaacatttctcaaaattggccgacttttatatggagacaaaatgggagttctcctcgtggattcctcttctctcgcggattctcccctccgacactttcaaaattt

SEQ ID NO: 89716 - DNA, 634 bp, Heterodera glycines
  SCN-specific regions: Sequence locations=1-634
gcgctcaagtttgttgttctggcactagccatctctgctgcggcaggaaaatcatccctttcgagcgctaacattcaagagctgcagtaccgggtggagggatgtgccgcagacttccccggccgctgggccggctccttcaacagctcaccccaggaacagtgcgttacaaacgctaaatacaatgccaggaacggatccagcccccaaaaccaaattattaaggaactgccaaagtgtatgctatccgccggcgccgctgaatcccacattacgaaactctcaaagtgtctgaacaaaaacattcttctgccatggaccttcgtcgaacgtgacaccggctacacccaattggaaacttttacgcacatgttcgccattcaagactgcctggaatcgtctgcggatgtgaagaacgttgactcactcgtgggcaagacctgtgcctaccagctgtacttacaatatggctacggcgcttcagaggacgcagcaaagaagtggttggaagcgtgcttgcacacagcgaacgttggtaaggccaccgacgccctgaaatgctatagcagtgctctcacagaccccgccgtcatccagcgcgcagcggactacattgctaagatgaggggttagg

SEQ ID NO: 89717 - DNA, 629 bp, Heterodera glycines
  SCN-specific regions: Sequence locations=1-42,64-506,530-629
tatgtctctcaaccatacgctgtcttcatcatcgacaatcctttcggcggcggccgccggtgccaatgaaacgaccgaacgatttcgactggcattggatgactttgtcactgtccatccccatttgacttgtgcactcatcgccgtctccgtctcgttggccacccatctggcgctgttcgtcttcgcccgtctctttgactttgcgttggcaaagtttcgcccatttgtccgtcgttgtcgtcttcgtcgtggaggaggacggtcattccgcgttcacatcagcgatgcgccactgttgtcatccaacggaccgttcattcactcacaatttacgcaacatcagcaacgggcgagtggcaaaagccaactgctgcacaaagtgccaacaattgaagcggatggcggagacgacgacggtggcattgccaacgctgaaaaagcgaaacggacgacgacgcccgtcgccacgtctcgacaacgtcatcagcagcgcgggttgaggctgagcagcagcggcagcggtggtcgcatcggcacgcgacggacgacgacgacggtggacaccaccggcgctgccgcaaaagcggtgccggaaaccgctgccgggagcaaagcggcgccgaatg

SEQ ID NO: 89718 - DNA, 693 bp, Heterodera glycines
  SCN-specific regions: Sequence locations=1-693
attaagtaataatcataaatggtgtttgcgggtgttaattgttctaccaatattcggtgggtgcatcgttgggcatggacgtctcgccgtttgtgctcttcgaccaaaattatttatgagcaaaacgggaatcccgctgaggtcctcaaacttagcaacgaaaaaatcgaccaaaatgccattggagcaaacgaagtttttgtccgatggatggccagtccgataaatccgtcagacatcaatcaaattcagggggtgtatccgattaagccacctttgcctgccgttgcggggaacgaaggctgtgcccgagttgagaagattggttccaacgttcgagagttgaaagtgggcgacatcgttcttcctaccaatgccggccttggcacttggcgtacccacggcatttatcagtcgactcaactgttccctattgacagttctttgcaactcgactcaatcgcaacggcaatgctccaagtgaatccgtccaccgcctatcgaatgcttcatgactatgccaaattggtccccggtgacattgtggtacaaaacgggggaaactctgctgtcggacgcttcattattcagatgtgtcgaaatttgggctttaaatcgatcagcgtcgtccgtgaccgaccccaaattaacgagatgaaagatgagctcaaacaattgggggcaactgaggtt

SEQ ID NO: 89719 - DNA, 933 bp, Heterodera glycines
  SCN-specific regions: Sequence locations=1-697,720-866,888-933
gttacaaaaatgctttcttcttccgcctgctgtactctgttggccgccctcatttcggcggcgtttttcgccatggcaaacgcacaaacggtgaagcagtgcctgtgctccgaaattcagccctgttccgaaaagtacatgaacacatggaagacatgtatgcagcagtgtaagggccatttttccagcgtgggcggcgacgtggaaaaattgggccactgtttggacagcaaccaggcactgctccagtcgaccatcagatgcacccaatcgcatggggacgagtcatgtgccaaatcgccggccgcggttaagcaggtgccaaagcgatacccggaaacgttggaaattgcaacaatcagtgagatcaaccggatgatcaacggcatgggcctcgaaggcgcaatgaaaggtttgatggatgccggcaagaaagcgttcggctgtacgcgcaaatgcatgaacaccaaggcgggcaactgcgagaagacactcaagtgcggcttggacttcccgccggacaacgtggcggtgcaggaagtgaagaagtgcgccctcaacagcggactgaacaccgccaacgcgcaagcgctgtgcaaatgcgcgtccgccgcgggcgttaagaatttgacgccagccatctgcgcaaaggtcaaagtcacctaaacaagttcatgtcgtccgggcgctgctgatgactgactgatcagtgtagtaacagagagatgagcaattttagtgatcgattgaccgaaatcccccaaaatgttttgacaccggtgattgatcgatagttatcatttatcattttggtggtcccttccaccccatttgtttcccatgacatcacctttttcaatttaacacaaagcatttttctcttttcactggcaaaattgctttttcttatctgtagtaaaaaaaagaacatcc

SEQ ID NO: 89720 - DNA, 494 bp, Heterodera glycines
  misc_feature (477)..(477): n is a, c, g, or t
  SCN-specific regions: Sequence locations=1-372,394-494
aaaaaatgatgcgggagataatgacgaacggacccatccaagttcaagtgaagtggtatgtggatgcctatttatatggccaaaacagcacacaggtcaatgtttacatgcacaccatcgtcaatcagactgacaagggtgattaccaagaaggatcattgaaactaatcggatggggcgaggaaagcacggacaaaggcgagctggtcaagtactggttcggcgtcaatagttttggcactgactggggactgaatggactgttcaaatggcgtcgagggacggatgaatgccgcattgaatcaaagggtatcagctttggcacccccgatgtttgagaaggcttaacgatatctgctagatgtcaattggaaaaaagaatttgacttaaaacccacgcgtctctaataacataataatgttaagtagatggttaaatgttgttgatacagaataaaaattaatagggctgaaacnaaaaaaaaaaaaaaaaa

SEQ ID NO: 89721 - DNA, 729 bp, Heterodera glycines
  SCN-specific regions: Sequence locations=1-20,42-79,101-729
gtccatttaagcacttgatcagtgttttcctattttcttcaacaatcaatggatcaaactgatcacagtgccgttggtccctcctcatcctcgccttccctcccagtttcgtccaccgtcccgcgaaatgcgcttttattcgacccagcggcaccggcggaagttcaacagcaacaaaatgcggcggaggaggaggacgaccaattctatgaactgacggccgaagacttgcgcaaaatgctcaaagcgttgcaggatgagagcaaaagacagaattcgctgttgccaaccaaactgatgaaagagagggaccaacagctgaagcacaaggcgtacaaacattcgattgtgcgctttcgcctgaacaatggtcaaattttacaggcgcaattcctctccaccgaaccagtttcggcactgttcattttcctgcgccaaatcatttcgccaacgattcgtttcgaattgcaccaaattccgaccaccagtggaaaattgaaatcagacgactcgaccacttcgctgttggacgcgggcattacgccgaaaagtgtgctcattttgaaaattgtggcggccgacaattcaccggaatcacctgagcaaatgaacgccgaccaaatttttgtggccgacagttttcaaagctgcacacaaacggaagcaaaggccgaagctcaaaaatggctgtcgtcaaacaccgaattccgtccctatttggacaccatt

SEQ ID NO: 89722 - DNA, 435 bp, Heterodera glycines
  SCN-specific regions: Sequence locations=1-8,41-284,306-435
gagagaagaacattcacattttcatatttcatttcatctttaaatctgccattaataaagcatctcaaataatccgccactgaggtcaaaatggtcgaagttcagcaactgatcgaactgatcttctgcattcttttgcccccggtcgccattctgttgcacggcggcttggacattctgcatttgatcctcaacattgtgctgtgcattctcggctatgtgccgggcataatccacgccctttggtactgcttcttctcgtgatgttaattgattcactaattgatgaccaatttcaaagtattatgccgtagacaaaatggatacccccgcattactcatcaaatcagatagcatttagctgaatttcaaaaattttgcttaaaatgttaataaagacattttttaccaaaaaacaaaaacacactgacaaaa

SEQ ID NO: 89723 - DNA, 641 bp, Heterodera glycines
  SCN-specific regions: Sequence locations=1-318,342-594
caagtttgagagaaacttaaaaatattttatgatggaacgccgaaacagaaccaaaaatggcggtctgtcccccacccctcaagagacgaccattaatttgcccgtttcctccaatcgaagggcttcgtccgcttcgattctttttgcccaggcgagtttcgacacgggcctcgacgtgagccgcgcctcgcaattgtcgtcccagcggaatgtgctgagtacgcacgtgatggacttgggcagcggcagaccgtgcagtggcatccaatgcaaagcgttcaaatgggacaaaagccattcggaatggattcaaatcggagacacggtgaccaatgcgcaggggcgcattccgctggtgcaccccggcacttcgctgtccaaaggcctttacaaattgcgttttgccacgaaggaatattacgcacgtcaccagctgaagtcactgtttccgcaagttgacgtggtcattgaggtggacgacgccagcgaacattgccatgtgccggtgttactcaaccatttcggctactccgtttataagggacactgatggaatattccctctctcattaattctcattttggtgtatattaaaaacaaataaaataaataattaaaaaaaaaaaaaaaaaaaaaaaa

SEQ ID NO: 89724 - DNA, 845 bp, Heterodera glycines
  misc_feature (819)..(819): n is a, c, g, or t
  SCN-specific regions: Sequence locations=1-717,739-819
gtcccgagtacatcttcatcttccgagacggtctttcggaggggcaattcgcaatggcatgcaaggaagaattgcgtgcactgaaacagggctgtgttgaatacgactcccgctatcagccaaagtttgtgatgattgtcgggactaagcggcacttcaaaaagttcttcctcgaggaggagggacgcaagggccgtccgttcaaccagaatttaacaccaggctccataatccaagataaggtgactgtgcgcggacatcacggaattctttcttcagccccacgcaccgattcacggaacgggcaaacccgtagaatacaccatgttggaggatgagattggcatcagcatggacgaattgcaaggagtgattatggcgttgtcttactcgcatcagattgtcaatgttgaggtgagcatgcccgaccctgtataccaagcccacgaattggccaagcgagggaaaaacaatttcgtgactttgaagcgtttcaagccggagcgtgtgccaaagattgacaagcaaattgtggcaaagggtggcaagcgtcagatcatttcaattgtcgactacaaagctgtgacgcgtcttctctcttactggggtgacgggacgttcaaattgtcgcatcgcttcactgcttgaattccgatggaccttataaatatataatactcttaaatacaccagataacatatttcttgctatttagcttcttccttctattttatttttcgtgtcattatgtattgaagcgctttgacttattgcttcaatggatgtaaaactcttaaataaagctgttgacagccccnaaaaaaaaaaaaaaaaaaaaaaaaaa

SEQ ID NO: 89725 - DNA, 1016 bp, Heterodera glycines
  SCN-specific regions: Sequence locations=1-674,697-844,866-1016
aatcattgatgagtcacccgtcgcaattggcaatggcggcacagaaacacagctgtcaactccattccgtggcgttttggacgtgcgctttgagcccggccaaactttgacagtgaagggaatcgtcagggagaaggcgcgccaattcagcgtcaatttgcacagtcggacggccgacttcagcggcagcgacgtgccgttgcgcgtcgcggcacgcgtcgaccgggcaaagattggcctcaattcgatggtgaacaaaatgtgggggaaggaacagcggaaggggcactcgttgaagcccggcaagcccatcgacttgcgaatccgggcgcatgacaaggaatttcagatcataatcgacggcaaagcgttcaaacggtacgcctaccaatcgccgcttcagtccatcacccatttgtccattgacggcgacttggccatacagcatattcattggggcgggaaagtttaccctgtcccctatgaaacgggccttccccacggcttcccaattggcaaatgcctgaaaatgtccggcactccgtcgctgagaaagggcgggcgctttgaagtcaatttgttgcgcaaaaatggtcacattgcgttgcatttaaacgcgcgttttgacgaaaaagcggtggtgcgcaattcgctcgaggcaaatgaatggggaaatgaggaaagggagggcaaaatgccattcgaaaggggccattgcttcgatttggccatcacaaatgaagccaatcattttgggattttcgtcaatgggcaacattttgccaattttgtgcatcggtcaaagcccgaagacatttttggcctgctaattcagggagacatcgaactgaccggactggaaatggaatgactgacctaattaccgtcattatgaaaaaaacttttggccaatctcaaccaaaataaattgggaaatatattcataaattaatgaccacaatttgttgacatatcttttaatcattaattaattggcaaaatactgactaattttc

SEQ ID NO: 89726 - DNA, 593 bp, Heterodera glycines
  SCN-specific regions: Sequence locations=1-220,242-593
attttcctctgtttattagtcatcaaaatgggaaacattgtctattctgacaagttgtcctgttacgaaagtgccgactattgtgctcgttcatgctccgcatcttcgcagtgcgtttacccggacaattgtggcgactcggccaatgcgcattacgcgtgtttgcccttcgacacgcgactgctcacgtttgttctcgttccgatgatgtaaaagcattcagagagagaagaattaaaacaacgatagatagaaaaagttgtccaatgcctcaacaattaatcaggtggattttggtcgtttccttcctggtaatcgtcctctgctgctccgctttggtggtgttctacgcccttagggtgatccgacgatcattccgaaatccggtccaaactgacggagacatcgttttctacaatgccagaaacgtgcacaattttccgcaccctgcagcaatgaaacagccaacggtcgaagacgacggcagacaggaatattattacaacaattcacgtagaaatgattattactgattggttgtgaatgagtgacatgggattgttacggaaaaagtttttctttgcccaaaaaaa

SEQ ID NO: 89727 - DNA, 607 bp, Heterodera glycines
  SCN-specific regions: Sequence locations=1-125,147-325,347-607
gacacgctgaaaagggacagcggagcactgctgtcccagttgttgacgttggaagggttggagaagaacagcaaagtcagtcagtccaggggcacagcgacgcctttggtcactgattaatttggaggtggccaagcgaatgagcaacggcaccattttcatcgacagagacggcgaactgttcgcctatgtcctggattacctgcgcaccggcaaattgcttctgccggagaattttcgcgagttggcacgccttcgagaggaggtgcaattctaccaaatcgaccaattaatgcagcagctgatccccttttacaacctcaaattccccccaaagacacccaccggccaaaacaacggaagtgtcgctttgaccgctgcggtggcggcagccgtggcgaaaacgaatgctttgtacgaaacgggtggcttcatcactctcggctaccgcggcacttttgcattcggacgagaccgacaagcggatgtcaaatttcgaaaattgcaccgcattttggtgtgcggaaaagcccaattatgcagggaggtattcggggacactctgaacgaaagtacggacccggacagagagggggccgaacggtac

SEQ ID NO: 89728 - DNA, 666 bp, Heterodera glycines
  misc_feature (154)..(155): n is a, c, g, or t
  misc_feature (282)..(282): n is a, c, g, or t
  misc_feature (291)..(291): n is a, c, g, or t
  SCN-specific regions: Sequence locations=1-364,388-575,598-666
gtccaattaagatcattgatatttattgctaaacggcaaaacgtttcccaatctttaaatggaggatcaaccacaactttcacaaggatttttccagacttttttggatgaaaaagtgccggccgactttcagccgattttgcaagtgcttganngactcgtaccattggctcatcgtcggcgatgggcggctatccgccacaggggcagcaaatgcgggctcgtctcagcgacagtttgtactcgtacagcggttgcgtcattccacagacggtgacgcgngcggttccnaagacgacgggctgagcacccacaacggcatcatccaagtgaccagttggaaacgggtcgacggtggaaagctttgtttcttccaagtgttggattatacgctgtactcgcttgactttcctgtcattggcaacccgcaaccacacagtggaaacccggcggaatttcgccgagttgttcagcctcaaaaagatcccgacactcagcagacagcggccgaaagtgtcgccctttggcgcggcacccaagtgaaagacgagcctgaaaacgcatggggcggcggtgggtccgcgaagagggggcgcggctcgtcaccctcagaccagcgacagccgttgcggaagcgccagccggatgcgggcgcgcaaatggcac

SEQ ID NO: 89729 - DNA, 431 bp, Heterodera glycines
  misc_feature (410)..(410): n is a, c, g, or t
  SCN-specific regions: Sequence locations=1-305,327-410
agcactttaaattataactgttcactcccaaaagtgaaagatgactgctaaaaatgtgtccccatcttccaaagagagcagttgttcaaggacttcttgcaactctgaaacgagtgaaactcgtccactttccatttgcaacgcacaatccatcgtcaatttccaaaagtcattgcgcgtttacaacggcaaatcgaaatttgctacgaagaaattggcttcctctgcgtccgttccgaccaatgcaaacaaagcaacaaccaaatagaggacaacagaacactcacaagcttttgttctaatggaattttcttacattctgtgtaattatgattgtctcatcttttacgacttcgatctctgatgtttttatttccatgaacattgaacaataaatcattacaaaattnaaaaaaaaaaaaaaaaaaaaa

SEQ ID NO: 89730 - DNA, 598 bp, Heterodera glycines
  SCN-specific regions: Sequence locations=1-472,495-507,530-572,596-598
cttcggcgtcgtcgcccaccaccggctcatccgccgctggcacttctcatctcggagcagcggtggcccctcccaaagccgctgtggcgtccgacagcggagcattgccgactggcacaccaacaacgacagaaaccccaccgtcgacgacagcaagcagtacaacgacgaaagccactgcgaatgaaaaacgaattgcggaggagggctccggcggtgggctggcgttcgtcaccatgttcatgctgctcggcatctccgtctccgtttggctgctgtacgcctacttcaacccccacactcggtccggccaactgctgatcaaatatcgcccttcaaaatggcaaattccgagcagtcatgtcagatactcggcatctgtgcacatgtgatgaatggttttggtggtggtgctgcggcacagacagagagcagcgaaagccgggtgcagtgaaaggcggtgagcgggtgccgggaaacttcggagggaaccgtttgtctcgaatctgaaatttccggaaaagtccacccctttaaatacgatttttttgcatcaaagtacgctacaatttctcattttaattaaaatatgtttttt

SEQ ID NO: 89731 - DNA, 686 bp, Heterodera glycines
  SCN-specific regions: Sequence locations=1-347,369-455,477-686
agacagcgaatgtcagtcaaagttctctttccatttatccgacaatcacaaccagttgagttgggccgagtgtcacacaaaaataaatcggcgatttggacttctcctcatttaccaacaaattcacctattagcgaagccaacaattattcataccttccattgttattgctccaaaaagaagaccaaaaatggaagcacccgctgaaattgacgaaatatacaggccacatgaagccagaattcacgaagccttttttaatacgctttccaaaccaattcatagcaaaaacgaaagaaggaaccgagcagaaggaatcttcacaacatcggaaagtcaacaggacagggaaagaatacacgtcacatggcgccattttggtcaaaagaccaagttcttccttgaccgtaatgaacatgatttgtttgaggcgcttcaccggaaaattcgcagtgaattgccaaattttcggggcaatttggccttccgagatgacaacagtcgtgaagttattctcaaatgcgatcggcaaatcagagaagcggctgcccgaagggacaatcgcctgcacattttcaccactctctccgaaagcccttcccttttcttggccgcgtctgagattggcactttgagtgcgagtcgtccctcctcgagggcaccgcttggctctccgatatccgcg

SEQ ID NO: 89732 - DNA, 632 bp, Heterodera glycines
  SCN-specific regions: Sequence locations=1-632
aggccaaggagtgattttggtgtacgatgtgtccaatcggccgtctttcgagaatctcgaccatttgctgttggaggtggacacttactgcaccaaaagtgacaccgtcaaaatgttggtcggcaacaaaatcgacgcggagcgaagaatggtctcgcgggaggagggccttcaatttgcgaagaaacaccgaatgcttttcatcgaggcgagcgcaaagacgcgcgaaggagttcaatgcgcatttgaggaactcgtggaaaagcaatttcgacatggtcagtctgtgctctaaggatgaacatactcagtttttgtctttgccgcgccgttgcgccgtgtacgaaattgacactgcgcagtcggtgttgacgccgagtggaacccgctatcaatttggcgacgacctcgccatgctgcgcgctcgcttgcccgcctgtgtcggcctctatcgcccgcagggcattgtgtgcattggacagttggtagatgaactcaaccgtctttctttgccgcggctgcccgactttccgttgcacaaatttctgttgccgctcactgaacagcaagaggagaagctcaaggagcacacgcgacagatcaaaccgccacgttacgacgcagtgacaaac

SEQ ID NO: 89733 - DNA, 663 bp, Heterodera glycines
  misc_feature (641)..(641): n is a, c, g, or t
  SCN-specific regions: Sequence locations=1-81,116-634
ttcaatttttattattttattccaaaatgttttctcagctttttctttttctcatttttctcgccttttctgctgaaagcgccccgcggggagaaaagaaaaaagacacaccaaaagatcggtattcgctttgcagaaaaggcggagtgccaattgcaaaacttaacgatcagatcaacggcaaagatttcgacaaactcttcgcaccgctgttcccacatccacttctcatcagtaatttactgtcattggaaggcttaaaatgcccggataaaattgcgcctttcatgaaaaagtgcgatgccaaaaaagatggcgaaataaatctgcgcgagttcaaatgctttgttaaatcactgctcgcctcatatttggtggacgaggaccggaacaaatgcatcacggaggaggagctggagagtttttacaaagaatgtggattaaaagaaatggaagaggaaatgatgggagacggatcagtgcgaaaagagtgatcggagagaggacattgggaaaagagcgatcaattgataatgtgatcaatcgataatgcctagcaataatatggaatttatcggtataagatatatgattagaatggtcacgtagaaataaataaacgacggtgattagtaaaaaanaaaaaaaaaaaaaaaaaaaaaa

SEQ ID NO: 89734 - DNA, 623 bp, Heterodera glycines
  SCN-specific regions: Sequence locations=1-623
gtccaaataagtcaaaaagttgcgtaaaaatgcgtttcgttgcggtgattggcgatgggaaagcagtggatattttcgtcaaagtggcagcggtcgtttcaaaattgtgtcggaagagagcggtcgtccgaatcacgccgaatgagttcagttttgtcaatgtgtacaatgtccgtgagggaatgcacgtcgacttccgcattcacaaggataatttatttaattcatggagctttgacggcctttccctggacaacaacgcgattttcttcgaattgtccaccgacgacttcgtccgttcgctgcattcgcgtgccactcaaatcaaattgaaaatgaccaaaaaggacggggtgccgcaccttcgcgtggagctcagtgccaattccctggtcaacgaaattcccattgttttggttgttctacgacaatggcccgacttcaacccaccaaacatgggcatttctcagttggcagttgcacttccaaacgtcaaaacattgacaaaaattgtctcgggtgtgaaggacattggcggaaggcatttgatatttcgcgcaaacaatcgtggagagttcaacatcattggttatgccgaccaggcaaaagtcgctgtctatgct

SEQ ID NO: 89735 - DNA, 448 bp, Heterodera glycines
  SCN-specific regions: Sequence locations=1-448
ttgaatcttttatattttaaatcatttaattgcgctaaatgtttcgtccctttgtcattttggcgttttgcctttttttcctttgcgctgtcgaccgttcaaatgccggcggaatgtttgaggatttgctggagggaataagcgacaaatttagtgaggggctcaagtcaatgcagcagggatatgagaaggcgaaacaggcatttgaagagtcggaggcacgcgcatggctaattgagtcagtgctcccaacgatcaaacagaaatttgaagaagtgaaggaatgggtccatgagaaaacgacgacagtttctgttgagggaccgcaggagaaagagaagtacaaagtgatcgaattggacgaaaaataggaaaacaatcgaaaaatcgcgattattattatccatttggaataaatgctcaaaacttaaaaaaaaaaaaaaacagg

SEQ ID NO: 89736 - DNA, 455 bp, Heterodera glycines
  misc_feature (427)..(427): n is a, c, g, or t
  misc_feature (429)..(430): n is a, c, g, or t
  SCN-specific regions: Sequence locations=1-266,288-289,311-422
ttgagttttaactaaaattttatcgaaaccgttaattcgcaacgacaaaatgccggcccaatcgccattctttctttggatgaatgagaacagggagagattctacgagccgggaatgactcaagcggacgtggcgaaggccgcaggcgaggaatggcgccgtttgcccgagtcagagaaggccaagtggggacagagatcggcggaggaacgaggacgtcaaggggggcaagatgtggaggaagaggagcagtaaaacggagaacaaagggagtgaggggggaaaacaaagagaaaacgaaaggaagaaaaccccctttgatcatttaatttgatggcactccaacacattctcatgggcatttcagcctttcttcttaaagaagaccgaaaaataaagcaataaagtcggaaaaaagtttaaaanannaaaaaaaaaaaaaaaaaaaaaaaaa

SEQ ID NO: 89737 - DNA, 655 bp, Heterodera glycines
  SCN-specific regions: Sequence locations=22-605,629-655
ctcccgccctctccctgctccgtcgcaatttgtcccttcttttgccttacttttcgtcttcatccgtccaattcgaaatgtccaaacatttccttttcctggcccttctgttttttgtcggacaaataagcgctaaatccatccacagcaaaagcgaagaaaaggaagacccattctttggggaagaaacggacggaacggaggaaccgcaagagacggacgagccgaagccgtacggctgggagaacatctacgaaaaatgcatggaccaatttgacgaccacaaaaagtgctgcgaagtgtcgggcggaggcgacgaatgtttgctggaggacacaacgacggaagcgggcgaaacgacgacggaggaaccggaatattcggacgaaacgttcaaaaagtgtatggcgaagctgaaccaaagcaaggacaattgctgcttcatattcgaggacaaaaagttgaaggaatgtgaacattggcaaccgcagacaaccacagaaacggcggaagagccggacaatgcgtacgcgaagtgccttcggcggggatattacgcggaagaatgctgcagaaaatacccattggcaagccaatgcagtgccaccacaacacaagaaaatacgtatggaggtgatatggcggaggaattcga

SEQ ID NO: 89738 - DNA, 680 bp, Heterodera glycines
  misc_feature (665)..(665): n is a, c, g, or t
  SCN-specific regions: Sequence locations=1-658
gtttgagatggattcgcccaaatgccaaactttgaattttgcccggccgtttttcccaaataattttgtgcttttggaggtggaaaagtcggtggctgatgctttttcttcgtccaatatgatcactgatcaatttaatcacgaaagtctttcgcttacaatccgtggccattgctctgaccctttggtcgtgtgcacttcgtcccgaacattcggcgcaaaggacgtcgaagtgtccaacactttgctgttgctcgacgggacgccaaacggcgccggagcaaatcagcaacatatcgtctccatcacaaatcgctttgtggagctttccgaagcttttcttcccgaccaaacgttccgtctgaaggcgcttttggagcaaaatttgctcgatttttacaatgaaaatgcaccggcggcggaggaatcgaaaggaatcaaactgaatgaactgctcgaccatgtgcagatcagtgagcagcaattgcgtgaagaattggccaaatttgccgtcgttgaaccggctgaaggtgttgcgacttttaccaggctcattcttaacttggagatttatttgctctgtatttgttccttgataattgtccgttaattacccattggtttttgtcacaccacgggtaattattttttccaacttaaaaaanaaaaaaaaaaaaaaa

SEQ ID NO: 89739 - DNA, 707 bp, Heterodera glycines
  SCN-specific regions: Sequence locations=1-707
gtctgcaacacatataaacatttttgcatttgccagtaataatggcaacgccgccaaaagcaaatgcgctgatcgaagcggccggcaagttcaacaaactgttcattatgccgcccaatcggccgacacgcatcaaaaaagcgatgaacattttgtttggccgcaccgaggaggaaaaacgagtgaccggcaattttgtgtcacgcattgcggaacgcaacccccgtcgtgaggacatgtcgaccacgcaggactggccaagtgtttggcccaccgcgcagtccttccgttcatcggtggtgccgttgcccgtccgcatgggcttccgccgtaggccggaacggttcgcgccaaaagggccgtacgggaacttggaattgatgaaaattcccaactttttgcatctgacgccggcgcatgtgcagcgccatgggcaggcaatcaaaaaattttgcaccaaatttcccgaggagttgaagcaggccgacgtcaaggagcagtacacgccgttgcggttggtctacagcgactacgttcaccagggcaacaacattcgggacaagcgagcgcgtgaagtgaccgccaaaattcagctgaactcgttcgggctcaaggacactcatgcgcacaacaaatgtcgtcagttggttggcgatcgctatgacgaggagacggacaccgtgaccttcaaggcggacaactgcccc

SEQ ID NO: 89740 - DNA, 907 bp, Heterodera glycines
  SCN-specific regions: Sequence locations=1-631,653-799,821-907
ttgttggctgtgcctcgttcggtgctggcaacaaatacagggactgtgactttccgagactgatttatccgtcggtgggctccgttttcacggactcatactgctggtacgtcaacgtgacgtgcgaagaggcgaattatggcctcccggcgtacattgaattcaatgaaaacccaagcacaattgtcgccgcaccggagccaacacttggcagacgcataacggtcactttgcaatgcgtgggcaattcgtatgggcaaagagtgtggaccaagttcggcgtggacggtgaccccagcgcagtggtccaagtgaaaacggttagatgcgggacaaagtgcgcaacgaatgtaagcacaacgcctgccacgttaacatctccaaattcggaggggctgccgtactgtcgcgacagttgtgccgcgagaattgggcacggcacacgtggccaggactgtgatcaaactctgctaaacaacgctttgattgtttatccaagttatccgtacattctgtacggttgttggtatgttagcgtcacatgcgaggcaaaagccaacggcaacccaatttacatcaaactcaatgacgaagaaaaaacaattgtcacctcaactcagccaccgttcaacaaaataacggtcaatttgcaatgcgcgtggaattcttatgggcaaagagtttggagtaaaaccggcgtcgacggctaccccaaccgagtgatccaagtggaaaaggtaagctgtggaagaaattgcggcaccactgaaacttcgaccattccgaccaccgaataaagacaatgataaaaatatcacaatctgcccataatgaaggtgttatgacgttccttaaaaaccatcaaaattggcgtttttgaaaaagccatcaataaaaatttttgctt

SEQ ID NO: 89741 - DNA, 551 bp, Heterodera glycines
  SCN-specific regions: Sequence locations=1-551
gtacagcgacgccttgttgataattttcatcgcctttttcaccgctttgctcggcgagggactcacttgggtgctcgtctacaggtccgacgagtacaaacggctgaaattctcgatggaacgcaaatcgaagaagttggagcgcaaaaaggacgcaattggcgccggaggggacgcggcaggcggtgcgggtgcggcgaacgcggccagcaaaacgacgaaacggaaaattgagcgggaggaggagagactgaagtcgaccaaccgcgacctgagcatgttccgcatgaagtccatgctcgccattggttttgtgttcgccgctttgctcagcactttctccagcattttcgagggtcgtgtggttgccaaattgccatttgagccgatcacttgggtccagggccttagccatcgcaatttggttggcgacgatttcaccgactgttccttcattttcctttacattctgtgcacaatgagcctccgtcagaatttgcaaaaattgctcggattcgccccgtcgcgttcgttcaatcgtcagacgcaga

SEQ ID NO: 89742 - DNA, 665 bp, Heterodera glycines
  SCN-specific regions: Sequence locations=1-200,222-665
gacacaatgaattttgtcaagagaattgatttttattatgatgttacgacaatatcttcttggataatgttcgagcgtttaaatgtcacgcgaagactctgtccttccattgagtataacttccgacctgtgcattattcgagcttattaacttctgctggaagtttggtccctttctccacggcggcattgagaaaaaatttctttgaacagcagagagaattggcccgagtccatggcattacaattgggaccagacatggcgtaattgatgatttactcgcaaaattatcaaacacagtgctgccccaatgttttatgaatatggttgcgtcggaaagggggcacgaaagcctcattgaactttcaagaagcttttggcgcaaattatggatttcaaatgtacacctggaccatgaggagtttctcgagagtctcagacaattgaatattcaaattccacccgatgaaattattttcaataaccgatgggggaaattgatcgaacaatggcattgtgaacttctgaatcgacaggtggatgatttggttgaggacctttacatggaagttgatgaagccgaatatgaagccaaaaaacgcgagcaccgttcctttgttgaaaatgatggtagtcattattacgatgaggaggatgattctga

SEQ ID NO: 89743 - DNA, 631 bp, Heterodera glycines
  SCN-specific regions: Sequence locations=1-370,392-603,625-631
gttttcccccgcagagtctgtcgacgctcagcctggcactgctgctctcgctcgtctattacccatcctttgaaggccgaaccaacgcgtacaaacagatgctttcaatcttccaaaatgcacaagaagtgtcctcactcgccaacctcgaggccagcttcaagttggacttcacccacctgtacaaccgcctttgtgccacactccattccgaaagaatgccgcttctgctgctctatctgctgctccataacaatgtcggcttccgcaactttgtgctctcccgcattaatcttgaacagctcgtgctccccgtcgtccgggttttatacgacggaatgtgctcagtgcctggccatggatttcaacgtccttcccccacgtcctccccgaaaatgcggcgacagtcccaattcagccacaataactcaacagttcacacccaccaaacttatttggcactgattgttctgctcatactcagcgaagatgacttctttaagaaagtcatccatgaaatgacaatcaaaaacattgactggtacactttggaccgaacaacgcatttggcagaaaccacgttgggcggtctcattgtgctggtgttttcaaagacaattcaaatcaatac

SEQ ID NO: 89744 - DNA, 656 bp, Heterodera glycines
  SCN-specific regions: Sequence locations=1-656
gtttgagcgagtaatttcaagtccaaatggacgccgttaaagcgccaactttggcttcgattcaccacaaaaatcgtctccaatctccgctcaatgcccacggccatcctttgatcattgaaaatggcactgtcgcagaaacattagtggacaaagaagaagaggaattgacggaacaagtcggcacttttttgttcacttccgaatctgtgggcgaaggacacccggacaaaatgtgtgaccagatttctgatgccattttggatgcgcatttggcattggaccccacaacaaaagtcgcctgcgaggttgtcacaaagacaggaatggttttggtctgtggggaaattacttcgagcgcaaccgtcgattaccaatcggtcgtccgcgaaacgatcaaaaagattggttacgatgactccagcaaaggatttgactataaaacgtgcaatgtgttggttgcgttggaaaagcaatcgcccgagatcgccgcacgtgttcacgaagacaacgaaccggaagatgtgggggccggggatcaagggattatgttcggctacgcttccgacgaaagccccgaggcaatgccactgactttggtcctttcacataaattaaatcccaaataccaccaactccgaaaggccgccgctctg

SEQ ID NO: 89745 - DNA, 673 bp, Heterodera glycines
  SCN-specific regions: Sequence locations=31-673
cctcgtgccgaattcggcacgaggagtttgaggacatgaacatgtaaatgtttgatttattcaaccaacaatattccacttctcttcctccaaatgtcctcactttgtcagtccgactttcccatgcgtcccattgattccctcaaattctcacttatgaactgcgcttttttctaccgtccgcctttgtcattgcgtgaaaccaccgaactccttgaacatgacggagacttccttgttcaggattccaatggaaccaaattgttgctttctgtgcgtgtttatggcgttgtgtccgaatttcgcataacaattgttcagaatcactctcgccaagtaatcttcgaatttgctggccaatgtttctcttctttggaacatttggtgctcacattttccaacggccgtggcggcaagcactttctgaagactgttgatggcgatgagtttctgctcgtccgtcccatttttagagcattgcacgccggtcgttttgggtacggcgagcgcatggaagtgagtgacagcgtacggaagggcaaatggctgccgagttttgtgcgaaccttgcgacccgaattcgctgctcgcccacagacggagactgacttggaacgactgatcgaattggaccatcgaaatttggtgcgcgtgtgtgactttttcaagcagt

SEQ ID NO: 89746 - DNA, 583 bp, Heterodera glycines
  SCN-specific regions: Sequence locations=1-37,59-583
cagtcataaaaatgcttttctacccaatttctgtttctttgattttgttcaccttttttgccggaagcgctgaagcgcagaatgatgctggcgttttgggacccgtcgaggaaactgctgggcaaattggccgcaatttaagctgttccgctatacacgcggctgtccgcgccatcattacagcacatccggattggcaccagtggttctacgaggcgagacaaaatcaaagtgatcacattgaaacgtgcgcaaacacggaaagtggcgacgtccacgactatttgtcggaacaagtggacatgctcagatgccccgagtcgcgcagccgtttgatgactgtgtccatcgtgttcattatcgcctttctcattacgcttgcggtggccatcactcttggcattttgctttatcgaaaaaagtaaagaatggagggaaaggacgatggtttgagtctcgcgcgattgatgggacatttgtgcaccatgacaaaatggacgccaaagacgctatttcaaattgaaattcatttttttgttttgcataatttttagtgattaaattttttaatttgggtaaaaaa

SEQ ID NO: 89747 - DNA, 540 bp, Heterodera glycines
  SCN-specific regions: Sequence locations=1-98,120-540
gaagtagccaccggaagacgtcgacaaagcggagtgttttctggcgaaatcaaccgactgaacgtgcaataacaacgttttggagaaagttgcagcgatattggttgccttttatcaggtgcatccaacccatggccggagatgcaatgctgtttatttgtcgtctatgaacatgccgaacagcagaaaaaactacatgtgcagaggcaattcgatggcttggtgaccattgcgcgccaacaagaagttgacgagcagacggcaggcactttttccgcggtcacttcgatcggtcggccaccgacgtttacatcgacttcgcggtacacaccggccgcttccgccccatccggctcgcgcacccaaatgtggtgatgcagggctttgatggtctcaaaaaaaacatgcttccgattaaatgcattacagtatcaccttgtagaattgctcaatgaatgagttaaatgtaaaaatgatgctcgataggccttgagaaaagcaattggaaaataaataaaaaaattttgtgttcaaaaaaaa

SEQ ID NO: 89748 - DNA, 534 bp, Heterodera glycines
  SCN-specific regions: Sequence locations=1-373,396-534
cttaagctatcatagcaatatgataagtaactatttgaagtcccaacttgaacttgtggaagaacattcgactcgtttaaatgagcgcactcaaaattggcggcagaggaaacagacactgagcgcacgcgaaaaggaaattgtcagtgccgatatgtcaattgtggtgccgagtgacattaagccacgactgcgcggcagcaaatttgcccatgccacggaggaagagaggaaggccattgctgcgcaaatggaacagggaagggacgccaatcgcacggcgacgactgaggccaaacgaaacgccgcgcggcttggccaagcagaagccaagctggaccagcagattgaagcggagaaagcctattttgatgcacagttggagaagttggagaccgaactgcaatttgtcgcttcccttttgcccaaatctcagtgacttttttttataatttatttgactcccatcacttatttattagcgtttgcttacataaaaatgatctctcaaattttcttcagttataaaaataa

SEQ ID NO: 89749 - DNA, 682 bp, Heterodera glycines
  SCN-specific regions: Sequence locations=1-8,32-199,223-435,457 -635,658-682
gtccatttaagttgttgttttttattattacttttcttcattttgataatggcatccgcaaagtgtgccagggaagactgtggcaaaacggtgtaccctttggaggaattgaaatgcctggacaaggtatggcacaagacctgctttaaatgcacagactgcggcatgattttgtccatgaaaagctacaaaggctacgacaaaaagccatactgccaagctcattaccccaaaacggttccgtcggccgtggccgcaacgccggagatggaacaagcgaagcgaaacacggcctatcagagtcaggtgaaataccacgaggcgtatgagaagcaaatgaaaggcacgaagatggaagtggccgatgacccggaaacgatgcgacacaaagccaacatggtaaaccaatccttggcccattaccacggcgaactgcagaagaaagagaagcaggactcacagagggacaccactgcaggttcagccccgtctgttggttttgcggtgcacagttcgccctctttggattcgcttggctctgccatttccaccgcctcttccgtcgtccgtccgtccaacggcagcagcagcggaaatattggacacgttcagcagaacatccgccggaattcaccccaacagcaccaccaacagcagacgtactcctacgggcaactgttct

SEQ ID NO: 89750 - DNA, 769 bp, Heterodera glycines
  SCN-specific regions: Sequence locations=1-128,153-769
aaaagcgatggaaagtggccgtagcgacgaagtgctggcccggcttgaggctgttcggcgccgtgtgctcgccgcaccgatgaacgtccacttcggcggagatccgagtcaaattcggctcggcacatgttcatcttccgcttcgtcgccgccaatcacggacattgcctcacaatgggccttcctcgaacagccgatccaccaacttctgcagtgtcccgctgactacggggcctccgaagcacaatttggacaaagccgtgccattgtcgtgggcggtgccgacagtgcgtttttgctgcagaaaactcggtttgacgacgactggaatggacccagcaccatgtccactttgctgcttgctcaatacttgcaacagtctgagggaccgctgtggaatgccgttcgtggcacggggctcgcctacggcgtcagtctgtacgttatgccggatcgcaaagcattgtcgttggacctgtaccggtgctctgagctgaccaaagcatacgaacagacacgagacacaaccctcgctgtgctcaatttggaccgacttgacacgaatttgctggagtctgccaagcgtagtctgatctgcgagctgatctcggggcagaacacggtgaagctgacagtgacttcggccattctggcaaccattcgatctctgggcaccgactttacacttaaattatgctcgccaatttggtatgccaaagcggaggatgtgttggcgattggtggcccgccaatccgacgacttttcgac

SEQ ID NO: 89751 - DNA, 643 bp, Heterodera glycines
  SCN-specific regions: Sequence locations=33-85,107-301,323-643
cctcgtgccgaattcggcacgagggtccaattaagggattattcatttttcctgcttatttgatggcaagaaagaatttatgccgcaaaacatttgctacttttaagcaagaagagaggtatcccattgtccaacgagcaattggagcccgatggggcagaaaaactattcaaacgccgaacatcgaagaagaagcactacaatcagtcgaattgcgaccatcaacatctgccgaagactttgtggaatcaccgccgttaacgccatcaattgcgacaacttcggaggttgacgttctgtctgcggaaactgtggaatttggcgggtcgttctcagcgactgctgcgcaaatggatatcttcgagtcgaccccgtcaacgtctgcagttcaaatggacattgaagagacgactccatcaccatttactgtcaacgaccgctcacagcgaatcgaacaactcgagaatcaattgaacgatcgggacgataaaaatctgtgggaggatgcaattgcatacgattgcgaatttgaagaacagtctcaaaaaagcccagaacgaagtaattacattctcccggcacttcccaacgattgtcttcctctctctgtgccttcagcgagtcgattagtcgatgtgaagag

SEQ ID NO: 89752 - DNA, 708 bp, Heterodera glycines
  SCN-specific regions: Sequence locations=1-686
ggagaaccgaatcaaactgattgttgctgactctaaggaggagagactttgcctggcagaacgtaatggagcagactttgtggtgcattgggacgattcacagtttgaggaatatttaatcatgcggaccaaagacgtcgctaccaatggccttcacattgtgtgcgatttcgtcacttcccctcgtacaggcgcccgttcactcaagtgcctttctgaaggtggtgtccttttcattggcggtatctccggtttggacgttcagctgccaatcaaattagtggccaaaaaccgtttggccattatgggcgttacgcgtggttccattgagcaactgaagaacctggtcacattgctttcagagggacagctcaatgcccccaattatcgcgtttatccggtggaccaggcatcacaagtgttgaagcaattgagcatgtccgaggttgaaggccgagccattttggaggtgtttaatccggacacagaagttaagaaggccgaggaagagcagaaataaacggattgtgataaaccgagtggaggagcctttccctcacctgtgcgcttttatattatttgtgacctttcctttctagtgattcatattggagaaggcacagttctatttaatcccggcggacgaaatttgcacagatgtaattaaggataaattttcaagcgtcaaaaaaaaaaaaaaaaaaaaaa

SEQ ID NO: 89753 - DNA, 1093 bp, Heterodera glycines
  SCN-specific regions: Sequence locations=1-778,804-1093
gccaccgggaatcccgtaaaatccggctgggcaaaaatctggagcgggaatcccgccggtctacattctactaactagtaaacccttgctaatccttcggaattggtgtcccgacggataaagattcgattacaaaaaattttaaaaaaattcaatacctatttttaaaagtgtactttgcttattcaattcatctgcgaattcgacaatgcttttttcctctctaaattcatcccttttcattcgtcaattgttcccccatcgtcgtttcttctgcttttctgcctttccacagcctattccccttgccttcgatgcgtatccatcgactgctgagcccgaaaagaccaatccgctggtaattgttcatggcctttttggtcataaacagaattggcgtggagttgccaaagcattgcaaaaagaacttgggaatcgcgtttttgtactcgatttgcggaatcatggcgaatcgccgcatcttccgcagtgcacttattcgtccatggcttcggatttgaggcaatttctcgagaaggaggtgttcactgtgtccgtctacaaaaccgcctttctgttagggcattcaatgggcggaaaagtcgtctccgaatttgctttcacaaaagtgaatgaaagcttaattgagaagttgattgtcgaagacattgcgccgcagaggaactcccattcaagtttagcccaattccgcgcttacatccaagcgttgcgttctgtcgacttgcgattgagcagaagcgaaattagccgatcgttggagtcaaaaattccagaagaaaccattcgagcatttcttctcacaaatttatataagccaagaggcggtcccttcaaatggcgttgcaatttggacgcattgtctgacaatttggaacatattttcgaccctttgatttcccgcgagagagttaccatgccgactttgtttcttcacggcgcaaattctacatattttctggaggacgacaaaattgcgttaagaaaaatattctcccacgcgaactttgaagaaatccccgaggcgggccattggctgcacgcggagcaaccgaaaatgttcatagattcggtc

SEQ ID NO: 89754 - DNA, 322 bp, Heterodera glycines
  SCN-specific regions: Sequence locations=1-249,275-290
gtgtacactgacctgaaaatgggcgttgcgccgtcactgcacgacgcgttgttttggtacaatttgcaccgggacggaaacggagacctgcgcacgagacacgctgcttgtcctgtgttgaccggcgttaaatgggtgtcaaacaaatggatccacgaacggggccaggaattcatacggccatgcccgctgaagaaagaatataacgaaaaatatgtgggcgacgttagaccattttgagactcataaattttgtaaaaaattgaataaataaacatttttttatcgttaaaaaaaaaaaaaaaaaaaaaaaaaaaaaaaa

SEQ ID NO: 89755 - DNA, 636 bp, Heterodera glycines
  SCN-specific regions: Sequence locations=1-190,212-306,328-636
aatttattctcttacaacatttaaatccgcagaaaatgctctcattgatagtcatcgtttgcttctttgggattgtgccgaatttgtcaaaaccgatcaaactcagaaaccattctccaatgaatgttttgtttatggcctggcccgaggcgcgttatccactggaattgccttttcaccgcgtggattgctttagtgagatggagaggcgacacatcgtgccacaagtcatcacttaccggctggaaaatatcaaaaaactccgtaacgggatatgtttggtacgaatccctacccggagccgagtgactgtcacacagatgaacacaaacaatgttaaaagttatgtgaaattcatcgctggttccacgcagctaagcatgccactgcatactgatcatattcattccggccaacacgaaaaatttgggccatggcatatgccgtgccgttacgcctacattgtgttccgctcccgaagtgatcagcttgaatgggtggagttccggcttgagcccgaactgaaagtggactcggccgatgatcagcgcaatgactgcgcatcggaggaacacaattttgccgaatcgctgttgaagcattgaactgactactgattggagtgtgacatttgaa

SEQ ID NO: 89756 - DNA, 726 bp, Heterodera glycines
  SCN-specific regions: Sequence locations=1-726
gtccatttaagactagacgagcaaatgcttaaaatgcgttccgtcgtgccacatttcccaccgttgcctgctcttcgtgactttatctacatgtaccggatggacgcggacaaaacgctgagccaaaattacttgatggatatgaacttgactcggaagatggttaggagagccggagacttaacgaatgcgtttgttgtggaggtcggaccgggtccaggtggaattacccgagcaattcttgagcagccgtgcaaacgattggacgtggtcgaaattgacaaacaatttttgatgcctttgcagcatttgagcaatcattccatggagcggatgaatgtccatcgggcggacgtgctcaaatttgactttgaacaagtgtggacggatgcgggggcggccaaatgttcatgggttgaggagcatccgaattttcacatcattggtaatttgccctttcacatttcaacgccgttggtcataaagatgatgagacaaatgtctattcgccgtggaccgttcgtgtttggccgggttccgctcacctttaccttccagtccgaagttgccaggcgtgtagtcggcgaaccgggcaccgactgtcgctctcgcatcggagtgacgggccaaaatttgaccgagccgcgcattctcttcaatgtacctggcaaatgttttactcctccgcctgaccatgacgtgtgcgttgtgcagtttctgcctcga

SEQ ID NO: 89757 - DNA, 490 bp, Heterodera glycines
  SCN-specific regions: Sequence locations=50-197,219-220,242-390,414 -490
cctcgtgccgaattcggcacgaggaatataaatttgttccaaatgtgctgcatcaattcaaaaatgttgctgctcgtggcggcatttgttgttctgttgtgcctgctcaatcagaacgtcggagctgagaaaatcattgtactgtataatgggaaaaagtacgatctgaccgagttccacaaaagccatccgggaggtgaagaggtgttgaaaaaagtgaacggaaaggacgtgaaggagtatttggagggcaaaaagggagtgaaaacggaccatttggtgcagcacaaacacagcaaacatacaatcaacgaattcttgccaacgttcgagatcaaacactaaattacaacacttcgccaactgcagaatgttagctgaatttaaatgaatgaatatttaataaaaatgaatgcttacatatattgacgcttgtgtattgttacataaatgttaattgaaataattagaataaatatttgccttaaaa

SEQ ID NO: 89758 - DNA, 402 bp, Heterodera glycines
  SCN-specific regions: Sequence locations=1-72,99-242,264-402
gattagacaaaaaggaactgtcgacccaaagaacgcaacaatttttccacaaagagcgaacagcacaaaccgtggtgggggtggtggaggcgggaaaatgctgagagggcgtgccgctgcggttggccacggcccccaacatcgtttgccccacgcgcattcgcacgcccatcttccgccacagcgacccaagcaaaaaggtcatcagcttcagcaacaacagcaagttcaaacaggtgcagcacaaattgtagcagcattgccaccttcggtgccccaaccgccgcagcaacagccccaagcgaccaatgccgtggcagcagcgagttctttggcggatttcccaaactgtgccaatgatgtcctttcaaagattggcgattttgtccgacaatggggtgc

SEQ ID NO: 89759 - DNA, 574 bp, Heterodera glycines
  SCN-specific regions: Sequence locations=1-14,37-317,391-489,512-574
gaccaattaagctttgctcttaaaattctttctaattgctctgcgttaataatttggcacaatggtttgtgtttctaaaacgccgcgttctctccccaaaaaacgacggcaatcgactgagcaaaacaccgacactcctccaaatgaccatcccgaagtaaaaaaggccaaaatcgaggatctgctaaaaaagttctccaatggagggttcgatcagttttggaatgaaggattccaaccggaagaggaaccatcgcccgacttttgcaattgggatttcggcaaagagccaagaaaatgcgttttttgcattgcgaaagaagaggaagaagagtgggaagaagaagaggaagaggacaaagaatgagtggaagagagagaatgagaagacggggggagccgcgaaacaaaaagcaaaactttagagcacatcgaacatctattattaattcttaatatcaaatacacgaaaaaacaaaaacttaaaagaataataataattaatttaattgtgaattatcataattaagtttgtaattttttttgttctctctaaaataaaacgatttattcc

SEQ ID NO: 89760 - DNA, 782 bp, Heterodera glycines
  SCN-specific regions: Sequence locations=1-104,126-225,247-440,462-782
gagaagtccaatcactcggcccaattaaattagccatccctttaattggccttaattaagagaatttcatatctctgaattaacctcggcaatgcattctctcgcctttatttccttcgctttttgcctttcactaacggacgcttttcgtactcaatcgtccggcgtccgggggacacttctctgtggaggtaaaagacgaacaaaaggccctctctctggcctaggttttagccttaggcttaggcctaagctttaggctaggcttaggcttgcccaaaaaaagacgagaagggcaattccccgccggtctccactgatcggcactctctcattaatttttgttttgtttttcttttgtctgaaggaaaagcactcgcggacacaaaagtgaccaattcctttgatttgtttattgttcggtaagaaagaaacaaaattggaatgaaggtgaaactttacgaccacgacaaagggccggacgcggacgatttgatggggacgacgacaacggacgagcagggacgattccaagtcagcggaaagaccaccgaactgaccaccatcgacgtccaactccgcatttaccacgactgcgatgatggcatgatgccttgccaacgcaaggtgaccttcaacatccccgattcgtacgtcacgtcgggtgcggtgccggcgaaattctttgacattggcacagtgaacatgcaaatcatattcgaccacgaagagcgatcatgcattcattaattgacagatctttatttttttattgaacaatg

SEQ ID NO: 89761 - DNA, 806 bp, Heterodera glycines
  SCN-specific regions: Sequence locations=1-242,264-296,318-388,410 -418,444-531,556-806
aaacatcgcttgaggacagagaggaaaagcgtaagaaactgctcaaagcacagcttaagtcggcgaaaatggtcgtgccaccggcgcctcaaattccgaaaaaaatcgccgaagagcacaaaaagaatggcacccaaccacaaaaggaagagtcgaagaaggacattgggaagaagaagcagccgcagatggcagagcgaagagagtcaagtggcgagagtggcaagaggggaagaggcagtgggatgagcagagagagcagcaagagagcccaagggaacagccgaaagaggggcagagagaggagcagagaaagcagcggcgacaaaggcagaaagacaatgcgacgttcgtcgcgaagtcgctcagtgaaacggcgcaggcgcgactcttcctcctcctcctactcgtccacttctcgctcccgttctcgctcccgctcctatcgccgcagtccaaagcgatcgcccgccagggatcgccgccgcgacagaacaaggcgttcaacttcgaattcctctcgctcgtcttcatcctcttccgcctcgtcctcttcacagtattcttcgtccgaacggtcacactctcagtcgcgttctttcaccagcgaccgggacgaggaggaggagcgcattcgcgatcgaatcatcgcacgaacgctttccacaagtgtgacggcggcacccgcaaaacagcctcaatcgaaggatgacggcgttgcaatggatgaagcgatggaatacgggccaaagccacccgaatcgcttgaagtttcaattctcaattcggacatggaaatgtcggag

SEQ ID NO: 89762 - DNA, 543 bp, Heterodera glycines
  SCN-specific regions: Sequence locations=1-13,37-521
gtcctaatttgtgcattttaatttattttatttcaccgctatttctttcctaactctccgccaatgatttttcttcttttttgttttatggtgttgtttgccttttgcggccactcaaatggccaaatgactgctgccaaccaaacttggcttgcctcccaacaggcattggcaagaaacacgggcagatgcggctcgttttttgtccgttttggcgacttttgctacttgcgctgccgacaacgcttcggcgatgacggagccaacggcgactgtcccttgggtggaggaccgtgccttatggtgaacagaaacgtgaacatttgtttgcgagttgctttcagcctcagacagcagtgaaagaggcaaagaaagaacgaaaaacattggggaggaagtgatcggcagagcaaatgataagaaaaatggaaatgattgtgattttgtgaattgaattgatcaaaaatgaaaagccaagacttttgtgagtagtcccaacttgaaaatacacgtaaataattaaaaaaaaaaaaaaaaaaaaaa

SEQ ID NO: 89763 - DNA, 902 bp, Heterodera glycines
  SCN-specific regions: Sequence locations=1-295,318-420,442-514,536 -542,570-810,833-902
ccaagtttgagtgaacaattacaacaatctttcatcgtcaaacataaacaacaaaattcaatcctttttaatattaaatggttgttctgcccattttcgccgccgtcgccggcgccgtcggcgaagataagaaaaggcaacggacgggggaggccgaggagcaattggacggagacggagtgataacatcggcggagcagccgacgacgacggcgaacagcgaatgttcatcaattgtcggcgaagcgaccgacggcggcgggaaaacgccgacggggggagagacagtgacaaacgagtaccagcagcagtgccatcggaacaacatcattaacagcggcggcagctgccctttggcactttcgtcgtccgagcgaatggtcagcgaactgatcgcagcggtcattgagcagagcagacaaaggcaacagctgcagaaacaccagcaacagttgctgatcagtacgaacaaagtagaggagaccaataacagcggaggaagcgaaaatgaggcggagggggaagaaagaggggacgaaatggcaccggaggaggcgcaggcggcggggacattctgtccacgctgttcaacgcggtcaaaggcggtgacattggcagtcttttgggcgctttggccggcggcgcagatgtgaacgccaaggacacatcgagcggcaacactctgctgcaaatggccataatgacggggatcaccgaaattgtgaagcttctgctgaaccgcggtgcgaatgttaacgcgacaaacgctgagggcaaagacgcggtgcgaattgcgcaagagcaggcggaacaagcgccggacgaggacagcaaagagaaatatgagcagatggtacaactgttgcaggagaagcaatgatgagaaaaggaggggagaaaga

SEQ ID NO: 89764 - DNA, 659 bp, Heterodera glycines
  SCN-specific regions: Sequence locations=1-604,626-659
cttttccattattgttctttctcttcgcgattccttcccattttaaattgatggtccaaaggcttcactgtaccaatcccgaaagtgtgcagtcggcacaaaaggcactgatcaatgccatcggtcgtcagttgatcactgactttcatccagctgtcaaaaacgtcgcttctgccagtcaaaatttgctccgttccttccaaagcctaagtcatcacttttacgaatacaccgccgctttatacgctttgggcttttcgggcataaattcggatgagttcgaagtgagggaacagtcgaaaactctgcagacggtgaccgaagtgctgaagaaagtccattcggaacagatcgattggatggattacttcacggcgatggcactgacaatcaatcaaaacagcaaaacggagaaggaacggctgaaagcattgattagcggcttttccgagagagagaggcaattgagcaaagcaatccatcggggcaagcaaatgccggacacgcggagtaacttttacgagacggagttggaggcgatgcgggaccaacaaagccaacgttaccgtttctttgcggataaacacttggaactgttgcgacgatatcacgaatggatgaaggattcgttgcttctactggagaaagaattgaatttg

SEQ ID NO: 89765 - DNA, 1063 bp, Heterodera glycines
  SCN-specific regions: Sequence locations=1-204,226-289,316-436,458 -996,1028-1030,1061-1063
taccacagaaaaaaagcaaacaaagaaatggcagggaaaatttttgtggtcactggcgcaaacaagggcattggttacggcattgcgcgtgggttggcccaacaagtgaatggtgccaccatttacatgacggcacgaacgccttcactaggcgaaaaggcattggatgacttggagaaggaattgggcataaaacgcatttcaaaattggcatttcatcagttggacatcactgatgagaaaagttgtgccgattttgcggcatttttgaagaaaacccacggcggattggacgtgctcatcaacaatgccggctttgcatacaaacataatgcgacagagtcggccgcaatccaagccgatgttacgattggtgtcaattattatggtaccaaattgatcagtgatcagctgggcccactgatcagagacgggggaagaattgtgaatgtgtgcagtcaaatgggcgtaatgggcagtcagattggtgtgatgggcaacctgtacaaacaggcactgattgatcagttcaaacgtgccgatgtcacttcggacgatatcaacacatttgtggaggaatacaaaaagcttgcccatgcggacaagcgcaaggagggcggctaccccgaatcggcctattgcgtgtctaaagcggccgaaattgcgctgtctgtgctgcaggcacgcgaattggccaagcggaacattgttgtgaatgcctgttgtcccggctacgtggacacggacatgacaagtcacaagggccatctgaccattgaccagggcgcggacacgccaattttcttggccattgaccaaagtgtgcagaaaggaggactgttctattatcagaggaagccgatcacatggcttcaagagtgaaaatgggaattgatcagtggctgatcaactgatcagaaaagaattggtgatttgcttgggcttcttgggagtacattttgatgaattttccatcactttattcgtggatattccaaaaaaaattttaagttaaatatttaataatgtgaaagctttttcaaataaatgtatgtgtttggct

SEQ ID NO: 89766 - DNA, 556 bp, Heterodera glycines
  SCN-specific regions: Sequence locations=1-556
gtcttccgctctccaatcaacaaatgcctcccccggtgtcacaaaaaaatccgatcacagttcaactcaaattgaccaacagcacggacacatgcagcgattactcgttggaatttacgaacacttgctttaagctggtggaccaagtcaaattccatgtgaaagtgccgaaaacgtcaaaattggcaaatcattggggcatcgttccgcttgccactgacaatggcactgctgatcagcaacagttgttcacattgcccaacaatgtgcacctttacccgggcaaatcattcgcttctgccggcatttcagtgaacggtgctgaccgtccggaaattgttattttggatgtgcaatcggttctttgcacggaaaagcatgacgatgcagccacaaattgagcagaatgaaaactgattgggaccaaagggaaagtgccgaaaatgtcgtatgaaaacgatcgaacaaaaacaaattcgtatattgattttaccatttgtgcatttattagcagtaacaatcaacttaatcaacaatattaataatttttgtggtc

SEQ ID NO: 89767 - DNA, 496 bp, Heterodera glycines
  SCN-specific regions: Sequence locations=1-109,131-387,417-439,470-496
caagtttgagcagtaaaatgaaactttttattttgttctgttcgattatttttgcgttaatgcaattgattttgacagaaaccgaagaaaagcaaatcgaagtgtttggagaagagcgcacaaaaagaggagacgaagggaaatgtgtcgacatcaaagaccaaatcgaagaagtgacaatcgaaggacagagaagggaagtggcgcttttggagggcccatgtttttcggaatgtcggctgaaattcgcccaaggcgcaaataaaagcatttggcaaagaatcaaaggcatttttggcggcggttcgaacaacgaaaagaaacggacggaggaggccaaatgctttgtccaatgcttttgtcgatgaatttccaaaagaaaatcgcttaattaattaattacccaattaattaatggatgactcacttaaaatgtcccattaaaatttttaatattaatacaaaatttctcaataaactcaaattatctccaaaa

SEQ ID NO: 89768 - DNA, 182 bp, Heterodera glycines
  SCN-specific regions: Sequence locations=1-2,48-71,93-97,120-150
actaaaaaatactaataaataaaattcattttttaaataaatttaaagcgtaaaccacccaaaagggacaacaacacagcagcactaagcttaataatcagcaacaacaacaaaatgaaattgctaattgtgttgttgtgtgtcagcgcaatttacgcgagaagcttgcaaaagcgcggaca

SEQ ID NO: 89769 - DNA, 246 bp, Heterodera glycines
  SCN-specific regions: Sequence locations=1-224
atgagaaaacagagttttcgatgtatttaacctcctcctcctcccccccctggcatggaattatttttaacacaaattttgcacatttagtttttttccttttgggtagggtacaccaggcatacactgtagttgggcattacggtaagagaatttgtattattttcgagggtgctatatgatgatactgtatttgttcattgtactataaatattttaagaataaaaaaaaaaaaaaaaaaaaaa

SEQ ID NO: 89770 - DNA, 637 bp, Heterodera glycines
  SCN-specific regions: Sequence locations=1-637
gaggatttgtccagcaaagagttggccaagtgcgaactttacttggactttgtgaagatccacgacaacaccacagtttacaggcacattaatcgcattctcaatttgaacgcgaaggacgtcctcttggagatttcgaccgaactgcgcgacattgtcaccaccgttaccgaatatcacttcccagtcattgctgaccgcacttccaaattggtgttcgcctacacaattgacgttatcaacccggaacgcgactgcgcctttcacttccctaccaatgaattcgtcgcacttttatgttacatcgccgcttgttgtcccaatttggacactttttcgttgtcctttttgttgcaaggcgagttctctgacgaagacttcaagcagctctcttcatggctgtaccgcaccatccaaagtgttctttcgcttcgctgctccattctctgcatcgattgcaatttgaccatcgaattccgtgcttttttccctgaggctacacttatggaggccaataagacgggacacggtttggcaacgatgggcgagcaacggcgcacggatgacagcgaaacgacggaaatggacgacacgccggacacttattcaatttcgagaaagattcaaatgcgcgacg

SEQ ID NO: 89771 - DNA, 826 bp, Heterodera glycines
  SCN-specific regions: Sequence locations=1-734,765-801
tgaagattcaatggctatgatacctttcaatttgtttctgctcagcgcccttttcttcacagcgaatgcatatgacttaatattaaagaatatttccgtgccagacgaattgaaggacaaatttgaatgcacttttgaagtgaaaaaagggaatggggagaacgaatgcggattgggagagttggaaacggacggacgacgaaacggcgaattgaaatgggcggaggacaaactgtgcatcaaagtgaaatgtgaagagaaaggaaacgataccaaatttgcattccgtctccagcagtgtgagctggtggacttaaaaaagtccgacaaaccgatgaaaaggcccatccatctgatcgactcgaacggatgtttggcctcaaatgccaaaggacaatggccaaaactcaatcctccactgaactattctttcgaagagagaacggtggaaatgcgcggatggacttttggcaacgaaacggacattggccaattccccgacgaagcgacactttcttgtgcggtcgaaatctgtgcggatccgtgtgaacagagctgtttggacaaaatttctcttgacaagtgcagcctcaatgattttatcggtgacaaaaatgccacggatatttgccacgaaggaaatgccgccgctgttcagggcacaatcagtttttgtttgatgacgcttctgatgttcctctgttcttccactgttttgatgtttcagtgataccaaaaaataattttattttgtttttataattctaattcgttaaagaatcaaataaatttttatttgtcaaaaaaaaaaaaaaaaaaaaaaaaa

SEQ ID NO: 89772 - DNA, 1026 bp, Heterodera glycines
  SCN-specific regions: Sequence locations=1-475,498-578,600-778,800 -1026
gtccaattaagccacctggtttttgtgctaattacatatattttgtcaattttaatgtcagccaccacccattcgttgagcaagcaagaaattgcaaggttcagccggcaattgatgctgaaagggattggcccttcaggacaagaacgcattcgagaaacaaaggtgctaattattggcgccggaggattaggctgtcccgtttcaatgtatttagttgcggcaggcattggacgccttggaattgttgaccatgatgtcgtttccattgacaatttgcaccggcagacaatgcacgaccaaaaacgggtgggccagtccaaagccgattcattgaaagaatcattgtccagaattaacaatgaagcgaatgttgtggcttataacgtgttgctcaccagcaaaaatgttcttcaattgtttcgtgattatgatattgttgccgactgttcagacaatgttgccactcgatatttgatcaatgatgcttgtgtgttgagtggaaaaccgttggtatatggaagtgcgcttggttgggagggccaatttactgtctacaacaatggaacgaattgtccttgcttccgctgcatttttcctgatcccccaagtcctgaacatgtgatgagttgctcagaggcgggtgtgcttggccccgttgttggcgttattggaagtttgcaggccttagaaatcatcaaaattgctgtcagcggaaaatcatcatttgccggaaatttgtggatgtttgacgggtttgaaggcatatcaaaaagaatttctttgagagagaaaatgtcgaattgtgcgatttgcagtgaaaatccaaggattacagaattacaagattatcaaaagttctgcaggtcggatccctcaaataaggttcgctcattatgtttactttcggctgaacaaccagtgtcgccaacggatattcaaatttgcagaaccaaaaaatcacgcgcgtccttcattttgttagacgttcgacctcccacttcatttgaaatttgccattttgcc

SEQ ID NO: 89773 - DNA, 740 bp, Heterodera glycines
  SCN-specific regions: Sequence locations=1-740
ggcgctttctccgcctcacatttcagctattccacttcagtcactgctgcttcttctgccaactcgaaaactccaacaaattgttcaactatttctgacccgaagactcaaagaccacaaagttcgcctgccggcacaatggccgaggggtggcagaacaggctggagaaccttgagtttatcgatgacgacattatttccggcgaggagtgtccattgattaggccgaattcgtctgggaaagtgccgacggcaaatgttccgtccaattttttgtcgaacacgacaatgcctcacaaactgcagacaacttcaaccagaaaagactcaaattgttccgtcacttctctgcttcccaatgctgaaaaagaatccgacaaatctttcgctggcgttgctttgtcgtgcggtggtggcaaaaaagcacaccaattgaatgacattaaggcagttgtggaaaagctgtcccggttggctttcgaactgtccgccactcgtcaccactcctcaacaattcattcgactctttctcatgtccgactgaaaccgagtgcaaaatttgaactgctcgacattgacctggagaagtttcaaacactgcagaacagtcgctcttccgcgtcgccatcctccgctggcactccctctgaccaattgccgtcaaaaacacggcttcagaatgtagcggcactgcgggcaaaagtgcgcggaattgcgcgacaagtggcacaatttgaaga

SEQ ID NO: 89774 - DNA, 635 bp, Heterodera glycines
  SCN-specific regions: Sequence locations=1-276,298-635
attaagcgccattagtgatgatgtcaaacgcagcgacaccaaagttggctaaaaaagtgcttcgcaagaaaataggggaaattattgcgcagcaaatggcgggagaaaatggacgaaatatccgcgagagggaaactgcgacggtggcacaaaagctgttggtcaacgaatggttcccaaattcgacgcgactgtccatttacctaagcaatgagcaggaaatttgcacggacgacattgtgcgaactgcgctcagagagggcaaagaagtgttcatccccagattcaaaaagggggccgaacgaatggaaatgctccgattggaatcggagaacgaattcgattcgttggagggcactctttggggaatacgccaacactccgccagtctcagtcccccctcatttgaagaaacatccgccaaagcacctctcgatttggtcgtaatgcccggcgtggcatttaacacaagcggaaaacgacccggccatgggcgtgaattttacgaccgatttctgaatgaatacgcacaaaaataccgaacagtgccgagaacaattgcattggcattgaaagtgcaattggtggacgatttgccaatcgaaagcaaagaccgaatgctggacgaagtgatc

SEQ ID NO: 89775 - DNA, 645 bp, Heterodera glycines
  SCN-specific regions: Sequence locations=1-32,54-288,318-519,541-645
cttttttttcgaccgaataaaatgttaccttcaatgtcaaaaaagcaaagaaagccagaacagaataaccggcaactacgcataattgaagtccaattgttcactccaactgcccgacgctacccacactttgattacgaagaaatgtgcaaggaattgggactcgaaatttcgaagcaaaagaaaactgcggagagcaattcttttcacgaccaagacgcagaagaaattgtgcgaagattggaggcgaaatatggctctcaaaccgttgtgtcacttccgtctacttggaagaaaccaagaaagaaaaccaaaaaagccatcaaatttgcgcctgaagatgtgatggacaaagggttaggctacgatttggaggacgatttcattgacgacgaacaagcgtacgatgaatgggtgcctacgacaatggacacggccaagcgaggtcattacgtgaacaaaggaccgttggagttccgacaaatcgactttgaccagacgacctcggaggaagacgaagagaaggacggggaggaggagagcaatgggacgagacgagagacgagcattttggaagcagacgaagaggaagcgatgaatatggaatgatcaaatttctataatttacatcattaatttattctg

SEQ ID NO: 89776 - DNA, 659 bp, Heterodera glycines
  SCN-specific regions: Sequence locations=1-132,155-189,212-659
catttaagaagtgactaataatgtcgtcgtttggcactagcagtggaggtcgaattcgacagcgtggtactgttggaggtcgtggccaattcaacttgtccggcatggtggaaccacagcaagcttttcaaccaccaacgacacacccagccgactttagcgttagccgcggtcgagggcaccgttatctgcaaaatccattggaaagtctgacccacccgtgcaaacttgaagtggccatggccacccccgctgaagttgacttgtcgccggccattcgtgaaatcaagaaggatacgttttccgttggtgtcactccgaccacccttacatccgttggaaagggtccgtgcgtttcgtgtcagcaaagcgaagaagtcaaccgccagttgatggccgcgcttctgaaggaccttggaacttcgctcgtcaatttcgccgcgaaattggagcagccgtcgaaatgattggacaaatcgaaggacgaaaaagtgacgaagcgaaagacggaccgactaaagacccatttttaactgtgttcagttcctatctaaagtccttatcaattttatcataatacgtatgtttcacctaacttctcataatgacttaaataagaaaactaagaataaatccctatcataaaaaaaaaaaaaaaa

SEQ ID NO: 89777 - DNA, 360 bp, Heterodera glycines
  SCN-specific regions: Sequence locations=1-177,201-336
gtttgagcttgtcatataactattatggagcatgttcaggcagtggttgaccctggcaaaaagtttgccaaagactcaattcgattggtgaaaaagtgcacaaagccggaccggaaagagtatcagaagatcgcctttgcaactgcgattggattcgccattatgggcttcatcggattcttcgtcaaactcatccacattcccatcaacaatattatcgtcggcggaggataagaaaaaggagaaaatgaacaaaaaaaagtccaccgttttttcacctgtgaattgttttcttcacctttgatttgttattgcacataaacaattcgcaattccaaaaaaaaaaaaaaaaaaaaaaaa

SEQ ID NO: 89778 - DNA, 562 bp, Heterodera glycines
  SCN-specific regions: Sequence locations=1-562
ccgccaaatacttcttctacgacccggacttcgccttcctctccctgggcacatattcggcacttcgtgaaattgcgttcacccaacagttggcccaacatcgacccgacctccacttctattacatgggcttctacctgttcgactgtccgaaaatgcgttacaaaaatcggtttcggcccagcgaattgttgtgcgaccactgctttaattgggtccccgagacggaatgcgaccgaattctcgaggcgaacggcggccgtttcagcactttccatccgtccgctgagcccactcgtgccgagttggacagtgcccaaatggaccaaattctgtgccttcacggcgaccccccgcggccgctgactttcgccagcctttgcaactcattggaaacggccgctgctcatccatcatcttccacagacagtcaacgacagaacggacggggcgaggggccggagatggggcagcatgacgcctttttgaccgtcgatggcattggccccggcgctttgctgcgccaactgacggacaaagtgcgcacgtacgtccgccacgt

SEQ ID NO: 89779 - DNA, 616 bp, Heterodera glycines
  SCN-specific regions: Sequence locations=1-541,568-616
gaatgaggtgcggagcgtttgtcaatagcgagcatgcgaatattgagcaattagtggctgctggccgccgtaatcgatcgagtgtgagcaaagcgaaatacctatttaactgaactaaaccgcatcacaatgtctgaagtctacggttttctcgacaggttcacaaaaagaataacgcgacgcagaggcaccactcccgcagcttcgggatttggagcggacagttcgatggatggtggcggtgtttcgaaggtgtgcatcggcctgtgcgtctgcattctgatccttttgattgtgttcgctgctctccttttgactgctgcgctatcgcctaaaagtttcgaaggcgttgctgtgctggggggcctcgcgagtcttttcgcagaataaatcgaaatgcgatgttcttcggtctttctgttgttgtcccataaggcataagccttaactactagtacttcattttcgagttgtgccctctattgaataccgtacatttgcttgtttatttgtactattgtcgttaaataataaatgcgtgcatgattttacacattattttaaaaagaattgtctttgataaattgttcgaatttgctaaaaaaaaaaaaaaaaa

SEQ ID NO: 89780 - DNA, 351 bp, Heterodera glycines
  SCN-specific regions: Sequence locations=1-351
gtttgaggacaatttcccattttcgctctgctaaaatgcgcttttcccttctgttttctgtcctttcactgctctttttgatcttcgcttccgtcgacgcttttccccgtgccgattttgagcgaatttcgaagcgccaagtcgtcgtcaaagacaccaacgatttgccgaaatggtacggaaaataagccgacaaaagaaaagaaattggaggacggacaaatgaacgacagacaaatcggcgaaaacgatggaaattgttccttagaatagagaaaatctctaagtcgtaaaatatattttttctctgaataaaattatttgcgtttaaaataacaaaagaaaaaatgt

SEQ ID NO: 89781 - DNA, 633 bp, Heterodera glycines
  SCN-specific regions: Sequence locations=1-141,175-633
ttttggcttaatcgcctgattctttttttatttttgccttttcttttattttttgcacttcatacaattgaaaatggctggcaaattcatcggcggaagaatgccttttcgtcaatcacttttggctccttcctttctcacagtttctcccctttggccttttcccttccgtcccaattccgcttcttcccatgcgcgtgtcttcgattccgaattcccttcttctcattctccgaaattgcgctgtgttttgtcggctaataataagacaaattcgcgggcccggcgttaccaccacccgcggcctcagctggtcatcttcgacaaggacggcactctgatctgttttcattctctgtgggtcccgtgggtgcgaagctttgccgaaaaagttgaggaggcgggcatcgatggcattgccccgaaggtgttccatgctctcggcttttgtccggttctcaaaaaggtaaagcgtggtcttctcgctgagggaacgatgcgccaaattcgggaccgagttgtccacctattggttcaaaacggtctcgaaaggcgcgagtcactgaacgtcgtggaaaaggccatccacggaacttcggaaggtccattcgcagaaagaacggtgcgtcaatt

SEQ ID NO: 89782 - DNA, 474 bp, Heterodera glycines
  SCN-specific regions: Sequence locations=1-442
acaccattcaatcaaaaccaaccaaatccccactcattagctcattatgaaatttgcccctctggctttgcttgtgatccttttggtgtctttggtcgctgccgtctctgctaattccaacaacccttttgatgcggacgcggccgacaacggtggcatgaagcgcgtcaaacggcagcaacagcaatggcgttggagtccgcaacagcagcgctgggtgccaataaacattgcgaatgtgaacattgctcagaatggataagcgcactgagaaggagccgaaccgaccgaccgatggacggacggagacgaagacaaaatgccaagaatatgtgtgatcagtgacaaattcaaacccaatgccgcgccctttcgatttatttccgatggaatgacaattccaaacttttttttaatttgttaaaattaaagagtgcatggtaaaaaaaaaaaaaaaaaaaaaaaaaaaaaaaa

SEQ ID NO: 89783 - DNA, 829 bp, Heterodera glycines
  SCN-specific regions: Sequence locations=1-331,354-509,532-572,594 -754,818-829
agtttgagcaaacttacaaaaatacattttgaaatgccatttataaatctttggaccaaccttcccgaactcaaattggacaacgaattcagacgaacattcctcgcgacagtggccaattcaatgcaaaagccagtggaatcgacagcactaattgtccagtcgggaccaaactgttgccaaatcggaagtgaccctgccgaaccagcgatgattctgcaaatcaaatcaattggctgtgtcagcgcagatgaaaatgtaattcactgtaagaacatcagcgaattcgtccaaagtcgccttgggattccgcccgaccgcgtgatgattcactttcagtctttggagaagcacgaagtcgggaaaggaggaacgacggtggaaaagatgtgccagtaaattaaagaaggaaatggatggcatgttcaatcaccgacttggcaatgttaagaaatggaattaaaagcaaaacatttataattggaaattgaaacaagcaacaatgaattttgtttggatgctttccgtcagtaaattctcaagaaaagggaaagattaattcaagagaacatccaaaaagagaacacggcaacaaaggaaatgaatcaagaaaatgatggatcattcgttaaacttcttccgcttagaaagtcctccggccgcgggtgtgccttcgaatggtctcttgaacccaccaccaccgccccgttggccacggaaattacccccatggccccctgaagcgcctctgaagcctcctcctccacgtcctccgcctctaaatcctcctccacctctccctccgctgcctgcgcctgaagcgttaaag

SEQ ID NO: 89784 - DNA, 475 bp, Heterodera glycines
  SCN-specific regions: Sequence locations=1-179,201-342,371-475
gtgccaagtgccgatttcttcggcggcattggccaccgcctttcaggcgacgagaacgttgcgatggtgttcatgctgttgatgatcaccattttggcaacgaatacggccattctgatcatgcaaattgtcatgttttggacagttatctcacggccaagggcagcagcaggtgaacagcagacggagaagaaaaagacggacaactacaagaaaatgatgagcaacaccaatggaaaagtccatttggtgtcatcgcctcgcaattcggccgaattgctattgtttgaccgcaaagggaatgccgtcgtctgaacgctgtgcctttcggcaatttgctagaaaaaaaaaaaataataattcattttttgttttcctaaatttccccattttacagtaacctcacccgtttttttgtactgctattatcagtaatttcattaattgacaagaaaaataaaagaatgaccattta

SEQ ID NO: 89785 - DNA, 654 bp, Heterodera glycines
  SCN-specific regions: Sequence locations=36-495,517-654
cctcgtgccgaattcggcacgaggccaaaattcacaacaatgagcatcattcgacgacaattcttcgccaccaaactgttctctccccaattggctagcaacaaaatggctgtgctcccagtgcgccattgcgtaagcgtcgccacgccaacacaaaatgatgtgccatacaatccgtcgcccaccaccgcgcaaactttggacaccttaggcattggcacgacggtgcagccaccggagccaaaatggcaaaaggccggactccgaattgagctaaactgtgccgacgagcaaatcttccagagcattgtccaagagatcgtcgatcggttcggctgggacaactccgcctatgactacgccatgtggcgaaaagcgtttgggcccaacaatttcggcatgttcttcgccctggacgaagaccgattgccgatggcgtccacaagcatggcggtgtacccaaaaattgcacattggagcatgtattacgtgaaggaacgctaccggggacaccaattgggccgtgcgctcactcgacgagccatggaaatggctggggacagacacattttcggttacggagttgctgaaatgtgggccaaatacgcggaggagtacggcatgtgccatttcttggactggcagctgtggtca

SEQ ID NO: 89786 - DNA, 733 bp, Heterodera glycines
  SCN-specific regions: Sequence locations=1-527,549-733
ttaagatataaaaaagtccccctaattggtaatgtcttccgaaaatcctccgtcaccgatgcaacgccaacagtcatcggtgcagcttcaacagtcatcagtgtcggatatgggcgacccggacgattgcttctcaatgttcctggttttcatgagctatgtgctgctgttcttcacctttccgtgcactatcttctcttgcattaagattgtccagcaatacgaacgagcggtcatttttcgactgggacgtattcgtcgtaaagcgcaaggacctggattgttcttcatccttccatgcgttgatgaatatcgctgcgtggacttgcgcaccgtgacttgtgatgtgccgcctcagcaagtgctttccaaagattcggtcactgtcaccgttgacgcggtggtcttttaccgtgtgttcaacgcaactcaggctgttatgatggggaacatttcgtcgtccaccactctgctggcacagacaactcttcgccatgtgttcggcacaaagactctgagcgaaatactcggcaacttcaacaagatcaaccgtgaaatgaagttgtccatggataagccaagcgatgtgtggggcgtggaagtggagctggtcgagctgaagaatgtgcgtttgccgcacgacatgcaacggtcgatggctgctgaagcggaggcgggacgcgaagcacgggcaaagatggtggcggctgagggcgaccacaagcggccaagg

SEQ ID NO: 89787 - DNA, 631 bp, Heterodera glycines
  SCN-specific regions: Sequence locations=1-15,37-631
aaaaagtggaaatacaatttattttattatttgtaatggaagaacaagggcctttcttaattgattggaggacattgttcggaaaggcaccatttgagcttcggaaacaatgcattcgaggacatttgcgaaattcacatctgagatccattgtttggaggcttctcttaggagttttgcccatggaggacaggacacaatgggtcgaagtcattggtcaagaacgtagaaattataccgaattgagacatcggattgagtcaaacccaagaattaataattcgccagaaggaaagaattttgatggtaacaatccaatttcgctcaatgcagaaagtccgtggtgcagacattttgagaatcaatcaacgaggaaaaacatcgagaaagacgttgacagaacgtgtctgaaaagttcgaaacaatgccttcgtcagcttcacattaccgtccaatccgcggaggaggcaaaagcctccgccccctccacgccttcgaacgtcgccaattcgtacgccgttcaaattcgctggctcagttccgaatttctcaccggtttggcctacacacttaccgtactgtgcaacattcagtacagtaactttgagagagctcaccgctattttggcac

SEQ ID NO: 89788 - DNA, 630 bp, Heterodera glycines
  SCN-specific regions: Sequence locations=1-117,139-605
atttcgagcttttaccaaaaaaatggcatcggagaacgaaattccggataaattcttagggaaattcaaattggaaaagaatgagaagttcgacgagtatttggccagcaaaggagtttcgtggattttaagaaaaatgatttgttttacgacggtcacaaaaattttcgaaaaatcagaagcggaaaagagcaaatacaacgcgtacaaccaaagttcgaaacataacacaaattgggagggatggaaaatcggagaaactttcgaaggcattgggttggacggcaaacagcacaaaataaccttcgatttgagcgacaacggcgacacactgacggagaagcatttgcgcatggacaatccttcggacgtgggcgaagtgtaccgttactcggtggacacagacagcggacatttgattctgactctctccaacgaatcactcactgcccgccgtttcttcaaacgaatccaatagaatttgacttgttttcttttgttttactttgagacgtgcttttttaactttcattttatttaaacacaaaaaatgttttgcctttttttgtttcttaatccaattatccataaaatattcggacattaaaaaaaaaaaaaaaaaaaaaaaaa

SEQ ID NO: 89789 - DNA, 631 bp, Heterodera glycines
  SCN-specific regions: Sequence locations=1-610
gagatgtttgtgaagactttttctcgttcggttcgtaattcaactcgctttttctactcaacaaacaccaaattggatccctcaaaatggcgtattgaagtcgcattgctcatttaccgtcctccagttgttgctccaccaatgacggaagttgaagaacaattttataggatgtctgaatttgccaatcagaagtcgtcttacaaatgtgactttgaacttcagttagaaaaagatgaaaagctattggagaagcgacgacaacttgaaaacgaaggaagggaccttagcgcacttgacgaagaaattaatgtctcttctactcaacttagagatgattggttcgagaaaagtgaacagcttaccaagcagtacaaactggattcgccacaaacaacgacggatgaggacaaaaatctaaagacttttggaaggatgcagcaaaaaaagctggctttgcttgtgaagcaacggttccctgatgctcttaattctgattatgtatcgccatggattttaccacagttaatacgaactggcgatgatacattgcgacagactgcagaaaaatgtattgctcatatgtttccaaattttgatcaaatgccaattggatttcaaattcttggta

SEQ ID NO: 89790 - DNA, 627 bp, Heterodera glycines
  SCN-specific regions: Sequence locations=33-105,128-627
cctcgtgccgaattcggcacgagggtttgagtaacaacaatgaaaagcttacaatagttctgctatatatataacttacctattctttcgcacatttttcacaaggatttattgaaaaacaaagaaatgaacgtgtcaggccccgcgattgatcaaagtgaaaaaaatcggaaactacttcaggatttgcaaaagaccaaacaacaaatgatgatgaggggtgccagtgctgtgagtcgttccgcccaatcgccacttttgccttccgcttcatcgagcagtttgtcctccctacaacaagcatcgactgatagtacgcagggaacattcgccaccagtgggcaacaacagcacggcactttagcgaataaatccaacacaatgctcgccatggaaatgatccaaaaatccagtataatcttttacccgaccaactccaattatggcaaccaacttctgcccgggtttccccgttttttggctgactgataaaacattttacggaaaaaaaaatagtatgactggggtttccgcgttgtgtacgggcggtggctgattgacggatatccgaaatattacttttttgttaaatttaaaaaaaatagggaattttgagtccgacgttgc

SEQ ID NO: 89791 - DNA, 646 bp, Heterodera glycines
  SCN-specific regions: Sequence locations=1-646
gtccaattaagaatgtcacccaaacaattcaaactgacccattcgctgttttcgttccaacgcatttcgcaagcggacggagtcaaacggaaacaaatgaaagccgacgaaagcatttgcccaccacaaaggaaaaaaccaagcacttctctgaaagaagcggacggaagcgacggcgccgttgagaatgtccaaacgaaggaaaatatgcggccaattttggaagcggagagacaccaacagaacgacgatggcacaggggaaatccgttcgcctccgtcgtcttctcccactccgtggcatccttcgcatgcgctcgctgaaccgacgtggcagaaactgttgaggaaggaattccaaatgaaatacatgacgaacatttgttgctttttggaggaacaagccaaacagggtgtctccgtttttccgcctcgtcatctcatcttcaacgcgttcaatctgacaccctttaacacaatccgagttgtggtcatcggtcaagacccctaccacaacttgggacaggcacatggtctctgtttttctgtgccaaatggtcagccaattccgccgtctctcaaaaacattttcaaggaactctcgtcggaattccctgattttgtactgcccaaacatggcactctcg

SEQ ID NO: 89792 - DNA, 616 bp, Heterodera glycines
  SCN-specific regions: Sequence locations=1-588
caagtttgagaataatttaaatggcaaactttccgcctaattctgacgaagagttcgaccgtggcaatttttcatcattgtcgggaatggtcggcatgaaccaacgacacttggactggttaatgaaaaacatatcccgcgaagacatggccgaactccaacaaaggacggggcaatgcgcccgaaagtgtgctgtgacgtatggaggtccgatcgtcgtcgttaccatcggtttcctcgagtttttgcgccgtaaacagaaccttccgatcacagcgccgcgctttttgatcggctaccccattatgtgtctcacttcggtggcccttggctcttccatcggcttcaaaaggtcgggttgcggtgcggaaatgcgactttttctcgacaagctctacgccaaatacgactcccaaatgaatgccgctagcgctcagatggcgccaggcgttggcggtggcacttcgccaacaaaaacctacgcccaattgcgcgaggccaaccgcgccggtcgtccaattgaattgggacagttgaagcaacagcaaacgcgacaacagcagaagaaaatggacggcagcaaagcgacgacggaagggactgagggcagcggcgg

SEQ ID NO: 89793 - DNA, 388 bp, Heterodera glycines
  SCN-specific regions: Sequence locations=1-359
ccaagtttgaggcattaattccattgcttcaaatgtggtacgagagattgcccatgattatcgcggccgttagtatccccgcattttgtaccagcgactattacccactgcattggtatgggacgaatggctgcaaacatcatcgagttctgaaaggacatgagcagtcggctctccttatccgtgacagagagttgaccggctacgaatacaatttgatgggcatcgactcaattccggaggaggattaactgaccaacgagtgggattttagaacattagacgatgacgaattcctcgattatccattatgctgtctaattgtggatataatgtttaaatgaaacaatgttatgtgcaaaaaaaaaaaaaaaaaaaaaaaaaaaaa

SEQ ID NO: 89794 - DNA, 674 bp, Heterodera glycines
  SCN-specific regions: Sequence locations=1-643,665-674
gtaatttacaaataaatttcgcaaatatttgaagtcaagtcccgttttctgtttttttcccgtcgatctcgaggcattattttgtgccaatgcttccgtcgccgtcattttccattcaattggtgtctcgtcttttttcccagttttttaatcgacccttatgttcgtccgcacatttattgtcaaaggacccttcaaattctcgcaattccggtcgcgatcacaactttttcgaaggcctctattttgagggagagataccacgagatcggatcaaacagaagtacactttgtccagcggaccgggcggttcgaacgtaaacagtcaccccacaaaggcggaaattcgtttcactgtcgacgaggccgattggattccgcggagagtgcgcgaacggctggtggaacgatacccacgctacatgaacaacaggggcgagttcgcattcacttcgcagaagacgcgctaccagattcaaaacatgaatgactgttttgatcggctccataacatgctgctgaactgctccgaggagttggtcaaggaagagcaccgaacgcatgtttcaccacaacacatcagcataatggaagaacggaaaaaacgctccgaagaatttcggttagcatcaaaaaattctcattcgcggaaaaaacaaaaccgacgttcgggc

SEQ ID NO: 89795 - DNA, 716 bp, Heterodera glycines
  SCN-specific regions: Sequence locations=1-460,482-664,690-716
caattattgaagtgccactgaatccgacaaatcccagccaaccgaacatggaatttgtttacgaggctattgccactttattcaccactcatttcaaaaatttgacagagccgcaaattcgagtcacagtcaaagggttcttcagctttaaccgcacagttacaaagatgcgtgaacacatccgagacttcctcgtccagatcagggaagaagccggcgacgacactgcggaccttttcttggaagagaaagaggctgagatccagcgcattcaatcgttaaaacaagcgattcccggggttagaaatccgaacgaattgttggaggaggacatggtctgacaatgcgtccgtcgggtgggctcggccctgccttccccgtttttgttttttccatttgtccatcctgacattaaacgatcgttcgtattttttctctgtgcccatttgaattcctttcgtctgtttttgctctccttttcatgttttgtgtccgttctgctgagctttcccctgcttcttctaatggagtttgtttctttgcttctgattgtctctactcgtctgttttggtgagagatttgattgtttctgagtgtgttcctccatccgttttgctttatgaattcgaccattgtcgaccctccattattcttagtctgtcatctcttttttaaatattttttgtctgaaaaaaaaaaaaaaaaaaggaaggag

SEQ ID NO: 89796 - DNA, 1217 bp, Heterodera glycines
  SCN-specific regions: Sequence locations=1-332,355-1217
agcagtcgctggttaccataaattatttcatgaaaacgctttcctcgagttgtgaagctgttatattcgtcttcctcggtctttctgcagtttctaaaaatcacgatttggacttcatcttcattttggtcactttggcttcttgtctcgtctatcgcttcatcggcgtcggtgtgctcacttatttggtcaataaacgtcgcgtggaacgcattggccttgttgatcagttcatcatgggttacggagggattcgtggtgccgtttgctacggtttagtgatgtctttggaccccgaattggtcgaatgccgcaatatgttggcaactaccacaattatcgtcatccttttcacagtttttgtgcagggcggttccattgaaaagttggtcacttacttgaaggtcaagcaattcgaagcacacaaaaagaccgtttttgagatgatcgccgataatgtcagcagtcacatggtcggagggatggaaagtatcgccggactgcgcggggattattggtttcgaatgaagcttgaacgctacaacaaaaagtacataaagccgttcattatgctcaatccgaatgacaaggacatgaaaattgtccgacacaatgaggagattcaggtcaaagaagcggtcatttacttgaaaaagcacgggtcattcgccggaatgcctacggtacaaagcagcagggatttgtattcgcaacagcagccgtccaacggaattggcgcgccgagaatgagcttctcgcggctgacagtaccgcaacggactccccaggagagcattccgaggaatgaatccgtgggaacctttgtgaggaacaaatttgcggagcttcaatctagtgggcatcgctacagtcgccattacaacgaccaggacctccgccccgttcagcacagttttagcatgggcgacgatgaagagccactggacgatgaccaacactacaaaacgtttccgtacaacaaagcgactcaacgtgaagccgtccgactaatcaatgaagccaggcgtaaatcaagcagccaagtgaggaaaagtagcaaaccgacggccaacaaaatggacacattactcgagagcaacaaattcattgttgacgaagaaaatgaggaaaaggaagaatgatgtcagttcccatgcatttaagttatgggcccttttgttttcatctggcagagctttgtacacaattaaattttt

SEQ ID NO: 89797 - DNA, 805 bp, Heterodera glycines
  SCN-specific regions: Sequence locations=1-678,700-805
ctgaagaatgcctgtcgtaaaaccacaaacggacagcgaatttacaaaatttcttttaaacgttgggactgctccgtgtattgttgatttttttgctacttggtgccaaccatgcagtgcgatcgctccggtttttgacgaattatccaacaattatcttaatttgaaatttgttaaagtggatgtcgacaaatgcaaagaaacaaagaacacatacggcgtcagtgcaatgccaacattcattgttctccttaatggtcagcgcgtggaccttttgcgtggtgccgacaaaactgcacttcagaatttggcccacaaatggtccaaaaattgtccaactcaaatggtctcaccgattcctggccaatgcgaattgtcaccgcttttcaacaaaatccaatgcgaatgtttgaacgaggacgattccaacaatttgaacaatttgctgaacggagttggtcccctgatcagtgattgtgacgagcaactgctgatcagcgtgtcgttcatccaaccggtcaaagtgcactccgtccttttcaacggccccaaagagaaggcgccgaaaactgtgaaaatttttgcgaacatcaccaacactcttgggttcgaccaggcacagtccaccgagccaattcagtgcatcgacttgtccgaagaaaaactcgtcgcgctcaaatacgtcaagttccagaatgtgttcaatctgcagtttttcgtggaggacaatgttggagggggcgacaaaaccgttgtcgatgagtttcgaatttacggcacgccaattgcgaagactacgaacatg

SEQ ID NO: 89798 - DNA, 423 bp, Heterodera glycines
  SCN-specific regions: Sequence locations=1-398
aaagggggacgacgcctttgcacaaggcagcatcgcagggccatcaacgcattgtcaatttgctgttaggctgtcgaaaaaacttgcaaattgatttgccaaatagggagggcgacacggcactgcatttggcatgcgaagaccaacagatggatgttgcgttgcttttggcacgttccggggccagcatcgaaaagaagaatcgccagaacaaaacgccgattgatttggtcgacggcaaagaacagaaactgaaactgatcaaagcgagtgaatcggtgaagccaactgccggaacatagccgaattcctttgttaaatcaattctattgtttttcaatgtaattgtaatgaatcttttgatttcacttgaccaattaaaaattctgaattattagaaaaaaaaaaaagaaaaaaaaaaaa

SEQ ID NO: 89799 - DNA, 622 bp, Heterodera glycines
  SCN-specific regions: Sequence locations=32-456,480-622
cctcgtgccgaattcggcacgaggattccgcttgccaatccgatgaacaaatggcgcttggacctttgtgggtccgccgggtcgcggacgttgatgctgagaagtgcagcagctgaccagagtctgaacccgcccggttataatcccggactgagcactacacaacaaaatgaatcggccaacagagccgagcaacagcagcagcatttgttgagcaaaagggcgtgggatttggccctgcagccggtgaaatccttgccgatgaatatgtttatgatgtacatggcgggcaacacaatctccattttcccaattatgatggtcgtaatgatggcgtggagaccgatgaaaactttgatgtcagtcaatgctgcttttaaaccgctggagcaagagcatgtcggctcactttggatccacaaaattgtttttgccttggggaatttatgcgcaattgcattggccgtgtacaaatgtcacacgatgggtcttctcccaaaccatgcttccgactggctcgattttgttcctcccctcgaaagagctcaatatgcactgtttaatgacatctaataaaaccctttgattgtttttaaatcgatttttctccataaatatttta

SEQ ID NO: 89800 - DNA, 546 bp, Heterodera glycines
  SCN-specific regions: Sequence locations=1-223,256-445,498-507
gtttgagataatataaaacaaataaaacaatatggaacgcacattcatctgtttgaggcccacaaatccgtcgccggttggacgagtgattgcccgctttgagtctaatggactcaaattgatcgccatgaaaatgattaacgctacacgaaatcaagcgactgagcattacaaagagtacagagacagaccgtttttcaacaaactgatcaactacatcacgtcagggccagttgtggccatggtctgggaaggaattgactcagtcaagaaaagtctgcatctgctggagtcggcatgtttctacaatttgaggaatatggatgagtgccgtgacattgtgcgccatggttcgtgcaatgtgcaggacgcacaacgcaaaatcaacatttggttctcaccaaatgagttgcgcattaattccacaagcagataatcccaagcgaaattattatttttttcatttttattttaatttatattaaattgaataaaatcatcatttagaaaaaaaaaaaaaaaaaaaaaaaaaaaaaaaaaaaaaaa

SEQ ID NO: 89801 - DNA, 401 bp, Heterodera glycines
  SCN-specific regions: Sequence locations=1-372
caagtttgagagtgatgcaaaattctatctacatcaaccccgatatcgaaaacaactacaaccgggctgtgccaccggctccgaacaacgcggttgctgtgccaccggctccgaacaacgcggttgctgtgccaccgcctccgaacaacccggttgctgtgccaccgcctccgaacgatccgaatcgaggcggctttgacgacacggtgtcgttgcttgggactcacccggtgccgcgtcattagaaaggagatgcgccggtgattcgtgtaatttcatcgtgtggatgaattgatgggcccacgtttgattattggatcatcataaatgattgtaaatcttgtgtttaaaaaaaataaatcgaagtaggccaaaaaaaaaaaaaaaaaaaaaaaaaaaaa

SEQ ID NO: 89802 - DNA, 620 bp, Heterodera glycines
  SCN-specific regions: Sequence locations=1-620
agaaaaggaaacatagtaaaaagattaattcttgttggagacctgacatttcactatgtttcccagaccatccacgtctttcccaaagatattgaacaggaccaaattgtgccaagcttctgtggtcggctcgaaccggacaatgtcgtccagcgacaaactgcagcagcaaaaggtgctcaccgtggacacgatcaaccccaacgttatcaccatggaatacgcagtccgtggcccaattgttatccgtgcggttgaattggagaagcagttggcgaaagagtcgttgccgttccccagcgtgatcagagcgaacattggcgacgcacatgccatgggacagacgccgatcactttcattcgccaagtgattgccggcattacggagcccgcactgatcaagcaacagcccaacctgttcccggaggacgtgcagcgcaaggtggcctcactgttgcgcgcctgcggtggcggcagtgccggcgcgtacacacagagcaccggcattgacctgatccggcagcatgtggcccaatttgtggaaagacgtgacggtttcccctgtgatccggaaagtgtgtgcatctccggcggtgcgtccgagtccattcgcaacgtgc

SEQ ID NO: 89803 - DNA, 637 bp, Heterodera glycines
  SCN-specific regions: Sequence locations=1-267,289-637
ataaagcatattttgagaaagcattgcatcgaattgcttgcatacaaatcaaaaatgacttcaagaagtgccaaaagaagtttgaagaaaagtgatggcttgtccggaaaagtgtccgtctcaaaagcacagcaaattgagcaattttttggcattgacgaggcaaaatgtgaaactgccgagcgaacgtcgaagtcgccgagtgccaagcgaagccgaaactcaacaaacacggcagtgcaattgctgaaaaagatggcgaagcacaaaaaggaattgaacagcagcaaagaaacgcgacgagaagaggacgagagggaaatggagaacattccggacacattggacgaattgaacagtcgggggacggaggacgaaaggggcaaaggaactgaaagtgtgcagacggtgaacgaattggacgaattgctcgactcagagacggccaaacgcattcaatcggaaagcgaagtgaccatccgattttgctgtccgctgctcgccaatgtcggctccgttgggcaattgttttccatcgacgacttttcccccctcaaaactctctcgtcgtcttccaatctttccgtccctccctttctctgtccgttcgttttccttttcctctctcgccctcact

SEQ ID NO: 89804 - DNA, 627 bp, Heterodera glycines
  SCN-specific regions: Sequence locations=1-527,549-627
gtttgaggcaaggtcgaaaatattgttttattatggcaaatgaattaatttctcccacacctccggacattgagaacatttttaaaagactacgagcgaatccatccaacaaagtctgttttgactgtggtgctcgaaacccaacgtggtcttcagtcacatacggtgttttcatttgcatcgattgctcttctgtccaccgtaacctcggagtccatttgtccttcgtccgttccaccaatttggacacaaattggtcatggattcagcttcgtgccatgcaaatcggaggaaatgcaaatgcggtggctttcttcaagcagcacggatgcgagtcgaatgatgcgcaagtgaaatatcacagcaaagctgctgcgatgtataaaggtcgcatcatcgacttggcaacgaaggcgcagcaacaagcgggtagcaatatatttttcgatgctttgaaggaacaacaatcgccacaatcaaaaggtccgaatgaatccgaattttttggatcacatgaaactgaagagcataccaaagaaatgaaagaggcgtcgctttccgaaattccacacgcgcccatccaaaaaacgaagaaaataacgcttggccaaaagaaaggcggcagtt

SEQ ID NO: 89805 - DNA, 881 bp, Heterodera glycines
  SCN-specific regions: Sequence locations=1-13,67-250,272-272,295 -310,332-455,479-513,535-881
caagtttgagccttttttaaaaactagcaatgaaatgaaaaagaatgacttttgattttgaaaagagaggtgacaacgccgacgatgaggacagctctgccgatgaatgttcttcaagcactggtagcagtacaccaaacagcgaatattcggtggatgagataatcgggcacagaattgaaaatgggacggacaaatggagggtccgatggaaagggtgggcgccgaagtacgacacgtgggagccgcgtgagaatttctccaattctatgcatcttctggacaaatttgatgccaaacgacttgccggacaatgcaaagagaatgaggctgttgcaacccatccaatgtccaataataataatcagtcggattatgtcaaaaagttgcgtccccatcgttcgctgtgccttcctccgacttccgccgctgtgccatcggccggcagaaaaggaccaaagaagaaaggaagtgccaaacgaacgacggcggcaaaaactcccgtttcaattccacttttggaggccaaggcgatgctgcacacgtcgagaatgcccaaggacatgtcggagcgtgcgaaggagtgcaaagaaattcggaaattccttttgaattgcgtcaaacggacgaatgcatcggcgaccgccgccgcgcctcgcgtgctgtacatcagcggcgtcccgggcactggcaaaaccgcagcagtgctgaaggtgcaaaaagaattgtgttcggaaaagaagacacccaagttcgactttttgaacatcaacgcgttggaactgtccgacccgcggcaattgttcaccaaagtttatggacaagtacaaaacaattgcacagggacgaggaagaaaatatcggcaagaaatgcacagcaa

SEQ ID NO: 89806 - DNA, 402 bp, Heterodera glycines
  SCN-specific regions: Sequence locations=1-372
ggaagttaaacataaatttgtgcttttttgctgtttggataattactacaaaatttgttgatgttatcattttggtaattttcaatgatttttgccccttttctcttcgttttgttcctttttggctccaatgaattaaacttattattggtggacagcagcagaaacattggaccaccagaagcaggcgaaagttgcgggtgcgcagataaacagcccgggactcttctgttggtgtgcattatcaaatgccgggacgaattggtgaaaaatgtcgaaaaaaagaacaatggatgattaaagtgaagacggataaataaagtatttaattagccaagttattaattatgcatttcaattaatttaatacgcaatttaataaataaaaattcattttaaaaa

SEQ ID NO: 89807 - DNA, 547 bp, Heterodera glycines
  SCN-specific regions: Sequence locations=1-446,468-522,545-547
gccgaattcagccctaaaagcatccttttatattaaatcagcaaataaattaggaaaatggtgtcagtgaatggacgaaaggtgaaaattgtgaagaagcggacgaaccgtttcactcgtcacgagtcggaccggtacctccgcgtcaaacccaactggcgtaaaccgaagggcattgacaaccgtgttcgacgccgcttcaagggccaacgacggatgccgaagattggctacggtaatgctcgacagacccggcacatgttgcccaacggattgaggaaggtgttggtgcacaatgtcaaggacctggacgtgttgttgatgcagaacaaacgctattgcggtgagattggccacgcggtgtccagcaaaaagcgcaagcaaattgtggagcgtgcccaacagttgcgcattgtgctcaccaacggaaatgcccgactgcgcaccgaagaaaatgaatagacggcgacgaacagacggaacaaaaagaactgttgaaatttttggaaagtttcaattgaattgttttgttattttatttgttgaa

SEQ ID NO: 89808 - DNA, 783 bp, Heterodera glycines
  SCN-specific regions: Sequence locations=1-745
caaccgaccaatttcgcctttcaaaaatcggaattgctcagaatgaaggagcaagcagaacaaagcggcgatgtcgcgagggtgcgcgacttgcagcagcaagtcaacgaattggaagagaaggccaagaaaattgaacaccaaagaacgaagaacttaagtgccatcagtgccatcaaccagcggaatagggaccatatgaaacaaacattccttggtgccggaatggtgcgggaagagcaggagaaggacgacgacccattcacacggaagtcggcgcggatgaaagtggtctcgggatccgtgaagtccaaaaccgccggcgaaggaagtggcgccaatgccgagttatccgttatggacacgatggtttcttcgttgggttcgttgtcgtcttcgtcggagtcctctccaaacaaaaaagtgcaacttccctcaactcacgatttattcaacgcacatggaatcgacataaatattgacataaaaatgcccgccgtcgtcggcggttcgttgagagcgccgccaattaccgactcacaggcaccacgaacacaacagaagacgagcagctcgcggacactcacattggaagaatacaaaaagaagagaggacttgtgtgagaatggacaaaagggggagcgacccactgtaaacaattcttacgtcattttgtttcacatgaaattcatacttttcgtatttgtgtgatcgaattttctataccataaaagataccaagacaaaaaaaaaaaaaaaaaaaaaaaaaaaaaaaaaaaaaa

SEQ ID NO: 89809 - DNA, 475 bp, Heterodera glycines
  misc_feature (411)..(412): n is a, c, g, or t
  misc_feature (415)..(415): n is a, c, g, or t
  misc_feature (417)..(417): n is a, c, g, or t
  misc_feature (420)..(420): n is a, c, g, or t
  misc_feature (433)..(433): n is a, c, g, or t
  misc_feature (464)..(464): n is a, c, g, or t
  misc_feature (469)..(469): n is a, c, g, or t
  SCN-specific regions: Sequence locations=1-90,135-174,347-430,454-475
gtttgagggcacaatgcaccgcttctcttccacctgttgatgaggcaacacacttcattctcccggcttccggccgccgacagcatttcccaacaaaaccaacaccaacaacagcaggacatcaacaacaacaatgccgtagtcgatgataatgatgttgaagccgaagatgaagcggcagcagcggaaatgccgggggcgccggcggcgacggcacagcagcgctgggaggactcaaccggcggcggcgacgatggcatggaggaacagcgacgggacggaaatggcggggacgaagaggaggtcgccggcgatgaacaacaacagttacaacaacgacgacaacagatgttcaagcggaagttgttgttggcgcaggacaacgatggacggggcccggggcaagcggtnnccncnacngcgggcgaaacgncgccgcgggcgggggcccgctcgcctggggngctgntcccgc

SEQ ID NO: 89810 - DNA, 635 bp, Heterodera glycines
  SCN-specific regions: Sequence locations=1-384,406-635
gttctttcccgtgttttgagctgttcaaagtaatgctcgaccaaactccgtccacttcgtcgacggcagtcacttacgccaatctgagcatcgatgaccgagacactctgatgaaaaatctgcagaaattgttcaaaacgcatcaccaagaacaaaatgtgacaaatgatcaacagcccgggagcagtacatccaaagggaccgactcgaggacaatgaaaaccgccgcgaggggacaaaccgagtttccgtttttcactccacgagacagcagatattccacgctgaagtcgacggttgtggatggaaaggccttaggctgttttatcattggcggagaatgtcgcttgagcttcccacaaatgcgggcgttgtgtcttggtgaaattccaacccaaaaaattgacgaatcaatgaaattgttggccattgtaaacgcattggccaccgaagaccaactcactgtgctgaagagggccgggttggcccaaccatcactgtcaaagtgcgaattgatcaccaaaaccaatgcagaaagactcatttccctgttgaattccactggcacttctccaattgacgaggttcagcggtcgcaattgcattcgtttagggtagttcacgactgttttggc

SEQ ID NO: 89811 - DNA, 330 bp, Heterodera glycines
  SCN-specific regions: Sequence locations=1-231,256-308
gagcgggatatgcccgagccaaatttgccacttcctcgcaaaagagtcggcttcaaagagccgcacacggggcttgtgaaaaatgatttcttcgggtattggtacttacaatattgccttgtgaccggtctttacatgttggagccgtgggagaggaaaatgttcaatgtttttgtcacgggtttcattgccgttttatgcagtgccttttatgccttgtggaatgcgttgattaattaatttaattttttaaaagcgtaaatttatttatactgccaattttatttatttaataaagagtcaaaagcaaaaaaaaaaaaaaaaaaaaaa

SEQ ID NO: 89812 - DNA, 797 bp, Heterodera glycines
  SCN-specific regions: Sequence locations=1-24,46-449,472-526,548 -566,588-734,756-797
attcccttttctccatgcttcctcctctccatgccttcctttgcctcattttcttcgtgtcttcgtcaatttcgccccattcatccgcttcttctgtccattcatcagaggatgagttgtctcagatgttgtcctccttatggcacatagactcagaacatcggaaactcttccacaacgaatttcggatttcgtcaactgatgacaggggccgtttggtcgctgtccttccccgtccctccgtactcagtcgacccatcgtaacggcatttggccagttgtgtaatgttctccaatccgtcaacccaaatcagtctaacaacaattccctgcgacaaaaggtcgacttatttttagccgaaatggacaaaagcccaattttcaaaaaagcctccgaattttattctgcccatcgtttgtccaattcgaagtctttcaaacagaaattccattctctttggttttttccttcgtcctccattccatttggctctttgatgtgccgcttttcggctttttccggcaattggctttccttcatttcggcacaaaaacgaatgaacgtgaaacgattggtggtggaaagggaaagtgaggacatggcacttgtagagtttgggggaagtgacgccggaggggcaaacgttgcggacatgcgaggcaatgcgcagccgcagaaacggcactttgcgctgggggacagcgtcgaatttgaactgtccgccctcactttgtgtgcccttttgagaagagaaaggcatcaacaaaagaagcgatgttcatttaaaacggatgaa

SEQ ID NO: 89813 - DNA, 747 bp, Heterodera glycines
  SCN-specific regions: Sequence locations=28-249,278-288,319-681,704 -720
tttttttttttttttttttttttttttacggataagttttatgctttattgactgtagagagatcaggagtgaacgaggcaataatggtgatatcgggataagaagtgggggaatactacatacattctatgtcggttcacttcctgagattttcaatattgtctacgctttccaacatatagaccatccgtttgtcgcgctcctctaatttctcaataacagccttgtgtttcagggtttcttaaataatctggatttttgtttttaataaatattgttgaccttcgaaaaaaaaaaaaaaaaaaaaaaaaaaaaaactcgaggcgccgtttgactcccacgaaaaaatgcgatggcattgcattttttgtgcatctttccacctcaaattcaacccctaaatctggtcgatgagtttcattttcctttggctttttctgaatttgttcctccccaatggcgttgaagccatgccctattattacaattctcccaatttgcagcagcaaaagccctttttggccggcacgcgtttcaacatgggcatcgacccatggagcggcagccccgaaaggggaaacatcggattcggaaacaatttggctgcctttttttacgtttgccacacatgcagcagaggaagaagataaaaggagcgatcggtagaaaaacggcgttaatttttaaaaatttcatttgtttacaataaataaaagttgaaaaaaaaaaaaaaaaaaaaaaaaaaa

SEQ ID NO: 89814 - DNA, 626 bp, Heterodera glycines
  SCN-specific regions: Sequence locations=1-167,191-626
caattcctcaatttgttatgcctttcctcggccctttctttgttttcgtcgtttctccgttctttgtttttgggtccgcttactctgaagatgaaccggtcacttgtggttccgtcctcaaattacaaagtgtcgccgacaatgtcaggctccattcccatgaggttaaatacggttcgggctccggccaacagtccgtgactggcaattccaacagcgacgacgtcaattcccattggcaaattattggcccaaattctgagccttgtcagagaggtcagccggtcaaatgcgactcgtccattcggtttatgcatctccaaacgcgctgtttcctccattcccacgaattctctgctccgctctctcgtggaatgcaagaggtttcttgttttggcaaggaggggcaacagagtgattctggcgaccattacaaagtcgtgtgttctggcgatgtttggactcaggacgagcagatcaaattgaagcacgagaatacgggaaattatctttcaatcagtggccaacagtttggcagaccaatttctggtcagcgagaagtgattgcggcgccgtccgacggccacaaatcgctgtggattgcagcggaaggcattttcatcaag

SEQ ID NO: 89815 - DNA, 481 bp, Heterodera glycines
  SCN-specific regions: Sequence locations=1-33,61-326,349-389,412 -430,452-481
aaaatttctcccaaaatgcgcacgtcccttttgatccccctcagccttttctctttgatcactttgctgttcattgtcagctttagtgaagcggacatcgaaatggacagtttgatgccacgaacgaaaagacaatgctgtggaggatgtggctatagtggcggatacggtggctatggaaacgacggtggtggacaatgctgtgatgcttgcggccagtgcggcagcggggggtacggtagcggggcgattataatcactaccggaggcggtggatacggatatggtggttacggtgacggatactgttacagttgcggtggtggaggatgctacggatgctgtggttgagaatgactcgaaggcacatcaattatataatgttcttttgtgcttttattttatttcacaattacatataaaaagagctcccgcgggtttgcgggtcgctttgatcactttcgccagctggacataataa

SEQ ID NO: 89816 - DNA, 640 bp, Heterodera glycines
  SCN-specific regions: Sequence locations=1-640
gtccaattaagccttgaaacctctttttttctttgccaaccatcgcttctctcacttctctaaatgtctcatcacactcaaatccaacaatacttttgccctccttcggcccctgctgtgacctattacaattacggcaacatcaccaacattgacctctcgccgcaacaagccgttccacagggctttcaacagcaagttcagctaactgcgccggcttatacggtggctcagtattggcacaacgtcccttcacaaaatggcggttatcaaatgccacaaaacaatggacaccacgcggctgcctattcgtcgggggatcacccgaaaatgggaaagcacaaaggcattgggaaacgttttcatccacaaaagcatcagcagcgcgcgtcagctccccacggaattcgacgcaacggaaagtactccgcgggtgccaccaccaaacagcagcaggcaaatgccgacgacactgaccatcagccatcagcggcccaagccgcccaaatcattgaccttttgtccgagctgttggccgaatttaccaatttctcggccgaattcgcgcaatttgcttctttgatgcaagagaattgggcacaaacgcaacggccaatcaaacgaacgaattaattgggaa

SEQ ID NO: 89817 - DNA, 930 bp, Heterodera glycines
  SCN-specific regions: Sequence locations=1-426,449-930
tacacattgaaacgcactcaaacggaggcgcgagtgttttgcgctgcgattggcgtcgcttgaaacacgacctgagctctcaagaactcaacgaatttgctgaggaatttattgatttgggcctttctgaactcagcaaagtgccgttgttcgtcatgtgtgttgttgaacatggcattgaatatttggaagatcttctcgaataccttggcacaaaacattcaaatatgcccgtaaagatgggttctttgcacaataaacagttggtggaaactattcaaattggacattactacgagaaagtgatctcatcctataagcagggaacatatcgttgtggtccgttgaaggaaattactttggtcggcaaaaagcaagaagaatgtggcgcctatttcgagcacttaattgaacgattagaggaatgcccatttctgaggattttgctgccatggagtgaacggactatctgttctgataaaaggccatccgaatccgatgatggaccaatttattggtgtcgtcctggtgagcaactgatccgaacggacgaatcgaaattcgacgaaataaagtcaaaacagcacaggaggggaagtgctggcactaaacaaactaaaagtgccggaattccgttgaaggcgttggagcggagggaaattctctttgaagatcgcactccttgccatgccgaccatgtgacagacgaaaacaaagcacacacaactgcagcagttggccttctgcaggcagtcagaagccccacggaaaaaggcaaaatcggcgaccgattagtgaaagatgtgatttgcttccatgctgcagacttcaaaagggtgacagatattttgaagttggatttgtatgagccgccaatgtcccagtgcacccaatgggttgaggaggccaaattaaacactttacgccgtg

SEQ ID NO: 89818 - DNA, 741 bp, Heterodera glycines
  misc_feature (714)..(716): n is a, c, g, or t
  SCN-specific regions: Sequence locations=1-491,513-528,587-673,695-716
agttgtcgaagtgcattgtcctcgtggactacgccaggcagcgccaggaatggacgttcaacaaagtgagccaattgtcgacatcggtcgttgagttgcgcaacaaaatcgaaacggaggcaacgcgaacgcgaaagaacccgggggaagtgctgctgaagatcatccgcttctattcctccaagctgaacgttcttatgagcaaactgcgcgaccgcagttcggaggtgttgctttcttcttcgatgcagaaacaaattctgacattgactgcgtacgttcagcaattggatgacaattttgtgaaggcaaaggacatcgacgaggtcaaacaggaggtgctcgaagaagccaagcagaagctgttcgacatcgctcgttggtcggcttcgctgagccttcgcggtccaccgaagacttcgacggctgacgacggggaaaatgaaaacctaagcagtaacatcgaaacggagccgaagcaggaggagaccaaaggggaagaggaggagacgctgcagcagtcgatgaaggaagatgaggaagaaaagggcgaagaggaggaggacgaggaagaagaagaggaggactaagcaaattaacacagtgacagcgaaaaagaacacttcgcctaatttgacatcctgagttaacgtataagacagttttgatgtcgtttttataatttaaattaattgaataaagggaatcggcccnnnaaaataaaaaaaaaaaaaaaaaaaa

SEQ ID NO: 89819 - DNA, 1045 bp, Heterodera glycines
  SCN-specific regions: Sequence locations=1-55,77-1045
atcagttgattattggtctgctcccttccccccgcctcccttcaattgcgccgtgtaatccatctgtttgttagagtaccgtcccctttttgcattacagaagccccctgtaccgtatcccctcgcttttcccactgaacgttcagttaattgcccagcattggatggccttggccaaaaagcattcttattgactgagtgctaatgcgaattgccaattcccctgagcccaaatcgcccgccaatttcgacgcccgcgccgtcaacgcccgacgcgactcgcttatctttctcaacgattggacttctctgtcggtgatttgtttcggcgtttgtgagttggaaattcgctgttcgtacgccgagaaaagccagtgaaaggcgcccgagcagagcccacggaacccccggcacagattgaaaacagaagtctcttctcctccgctgcttctcctctcccgccgatgtccgcttttcctcccgcgtgcaatccctcccacgcgcgtgccatcggcgaacgcgtgctcgccaaaatgggaaatatgccgcaaacggacgaaggcgcaaaaaggcacgcccaaacgacgacaaattttgagacgccgacggaggccaaagaaacgtcttcgtcttttgcgcttttccgtccctccgattgtcccccgtcggccgattgtccgtcgcttaagccatcggtcggccaattgtccgtttcatggccaccggccggcgtctccgctcgcaatgctttggccgatgcgtttcgcggccttttgcccgcctctgtagccgctgccgtcgctccggtgagaacaccgacagccaattgaccaatactttgaggccaaccaagtgaaaatggtctattttcatccaacaaagagagtaacgaccaatcgatgattacagtaatcaaccacattacagtgaagggttcattacagtacagcattatacagtatacgcattaattcccttccctcgtgacaaacatttgtaatttggtactttatttaggaccaataaatcacaatcacttgtcaaa

SEQ ID NO: 89820 - DNA, 660 bp, Heterodera glycines
  SCN-specific regions: Sequence locations=1-660
ctgatgttttctgcccgttcgtctttcacttttttgcgcattttccaatgctttgcccgtcggtgtcggccttcgcttgcagggaatgcaactgcagcagcacaagcacagccgtccaatgcaaatcaaatgcgagcatgggcagtgaacgcattcaatgcaccgcttgttcacagcaatgttccaatgccaaccatccaaaatgacaaccaagtgatcatccgtgttaaggctgcttcagtaaatccaattgacgtgcgaatgagcgaaggttatggaaatgaagtgctaagcaaaatcaaatgtttgactgaattcgttgaccgaggtctaccaaaaaggatggatttcttacaaacgcagcaaacaatcggagaaactttttcgagaatgggagaagccgatcaattccctcttattttgggccgcgattgtagcggagaagtggtggagaaaggacgggcggtaaaggatttggatgtcggagatcaagtcatcgctgtcgtccctccccattgccaaggatgtcactccgaattcgctctctcattcacaaacgctgtcgcccccaaaccggcgtcactcagccacacagagtctgccgctttgccgtacgtcgcatgtactgcttgggctgcactcgtcacgacaggcagaata

SEQ ID NO: 89821 - DNA, 467 bp, Heterodera glycines
  SCN-specific regions: Sequence locations=1-8,40-440
cttaagaaatttattgaattcacttttttatttggtttcgtccgacaacaagaaatggcaaagcgcacaaaaaaggtcggcattgtcgggaagtacggcactcggtacggcgcctcgttgcggaagacagtcaaaaagatggaggtgtctcaacatgccaaatacacatgtgcattctgcggcaaggaggccatgaagcgagtgtgtgtcgggatttggaattgttccaagtgtcacaagaaagtggccggcggcgcctacgtgtacgccaccaccaccgcggcaacagtgcgaagcaccatccgccgtctgcgcgagaccaaagagtgatttgccgaatcccaacggcggagaacaatggtggtgacgacgacttttgcaccccactgccactgttttttgttgttatgtgttgtttttgaatgaaaatgggaattgttaaaaaaaaaaaaaaaaaaaaaaaaaaa

SEQ ID NO: 89822 - DNA, 471 bp, Heterodera glycines
  SCN-specific regions: Sequence locations=1-388,410-414
ggcggctatttgttggcatgttacaacaacgactcagagcagtacgaatcaattgcaaagattggcactgggttcaaagacgaagacttgaaaagtcagtttaaagaattccaagagcttcggattgacaagccccgttcgtacttcgccttcgacccttcgttggcgcccgaccattggtttgaaccgtcggtggtgtgggaagtgaaggcggccgacatgtccatttcgccacgtcatttggctgcgcggggattggtcgacgctgagaagggcatttcacttcgctttccgcgtttcattcgaaaccgagcggacaaaaaacccgaaaatgcaacatcatcagaacaaattgcagagatgtaccgaaatcaggaccacattaagaaccaaaaggactgaaaagtggattttgatgaagaggaagagggggaggagaaaaaggaagaagcggacgatgagaaggaggaa

SEQ ID NO: 89823 - DNA, 1054 bp, Heterodera glycines
  SCN-specific regions: Sequence locations=1-1054
tagataactcatttgttaattattgctttttcacattggaaaaccttctttctgctctgtaccaaaatgccgggcatcaaaaggctcttcgacggcattctccgtttccgcaaaactcttcgtcccagcatggtcaaagaattcgagaaggtccgcgaccaccccgacccgagtgcgatgctgttcacctgcatggactcaaggttacaaccgtccaaatttatgggtgctcagatcggcgaattgtttgtcgtccgcaattccgccaatatggtgccggtggcaaaaagttttggcgattccggcggagaagtgtccgtcaccactgaaccagcagcactcgaattggcgattaggcgtggaaatgtccgacgagtggtcatttgtggacattccgattgcaaggcgatcaacacactttacgacctttaccatgggcgtccgtttgacgccgagtcgccgatggaccattggctgcgacggaacggacaccaaagtgtgcacaaattgacccaactgctgatggcggggcccggaacagagttggaattcgcatcggagaacggactgatggcattctgcgctcacattgaccgaacggaccaactgaacgcggtggacaaactgtcgcaaattaacacacttcagcagctgaccaacattgcgtcccacgagtttctgcgggaatacatcgtgaccaaaaaggtcggacttgatgcgatgtggctcgacattttcaatggcaaaatttacattttttcgcgaatgcaaaaactgtttttgcccatcgatgagaaaacgtcggccgatttattgcgggaggcgatcgggcaaattgaggaggaaaatgaaaacggaggcgaaaagcggagagagtgcagaaaggaacggcacggacgaacatgaggaaaagagagagaaattcattctttgcacataaaaccattattaattaattaatcgtagggtctgtgccgtggccaaacaccgagggccaaattacaaaaaggctgttataaataaatatagatcgaaaatgcaaaaaaaaaaaaaa

SEQ ID NO: 89824 - DNA, 643 bp, Heterodera glycines
  SCN-specific regions: Sequence locations=1-643
gttaaacatgggttagtggaggtgggataacaacacttaagcgggggagtcgccatcgaaatgggaaaatgattttggtttgaatggtaacgaatttcgagaaacacttttgatgaagactctcacgctttaaaataattaatcgtatttaacggtaatttttatttcattgacaatttaaatccccgggttcctttgataattgaaggaaaatggcatcgaccgatcgcaccagcggagcggcaagtcgggaagtctcgagccggagcagttccgaaaactgttcattggcggtctgtcactaaatacaaccgacgagtcactgcatgctttctattcccaattcggaatgctcgtcgattgcattgtgatgcgtgacgcacaaacaaagcggtcgcgcggctttggttttgtttcgtttcaaacagccgacgaggttgatgcggcgatgtccgcgcgtccacacacaatcgacggcaaagtcgttgacccgaaacgagcggttcctcgtgaacaatcagcaaaagccgagtccaatgtgtccactaaacggctttacgtttcgggtgtccgagatgaacacgacgaagaatcgttcatgcattattttactgagtttggccccgtcgcaaaggtggagata

SEQ ID NO: 89825 - DNA, 660 bp, Heterodera glycines
  SCN-specific regions: Sequence locations=1-91,114-660
ctatggtccgtatttccgttgatgttgtcaatgatgcgtaccagtttataaatccgtgtaagcagcgcgaaatttcccttcggaatctgcaaattcctaccattgaaaatctcggagttaccagggatcaatttgatgtcattgatttgactgacaataatattcgaaaattggacaatttgccgagattgaaacgtttggaaactctgcttttgcacaacaatcgtgtcgactttatttcaaaggaaatcggagatcaattgacgaaattgtccacccttgtgttgactaacaataacctggcacaacttggtgatattgacgttttggcctcctgccctcgtttggaatatttgagtctccaagggaaccctttgacccatttgcccaaatatcgtcagtacgtcatttataaactgaagaatgttcgggtcctcgattataaacgcattcgccttgcggaacgccaagcagcgaagaaactctttaaaggtgaaagcggtgcgcggctgaagagcgaattggtaaagcgttcgcagcaaatttcggaaggaggcgaagagacggaacagccgccgaaaaagcgcgcgacggaagagcagaaaaaaatcagagaactgatctccggtgctaaaacacttgtggacgttgaacgagtcc

SEQ ID NO: 89826 - DNA, 938 bp, Heterodera glycines
  SCN-specific regions: Sequence locations=1-866,889-938
caaaacgagatttggcacgcaaagatcacttttttccacatacatttccgattttttgtggcgtaggcaatttggaggaccggacattttttttaatttgtggacccaaatcgcggaattgtatccaataagcacataaagctcctttatttgatatttaaagcaattgtgacaataaaaaagtaaaaaaaattgaaaaatgcgaaaaaaaaaatgtggatacaaagtccatgagtaccagggattcggtataccagggattcttgtgaaaaacccaggaatccgttcacgtttcccgtcttttttaacgggaaaaaaagcgggaaacccttctcgctttttttttgttttcccgtccggaaaattttttccggccttaagtaaatattgcctattacattttaagatgcttcctctgttcgtgacaaataaattgctgacaacgcaaattgttagaacaaatctctctcttcgactgccgtctcgtcaaaagaattttgggcccaattattacacagaaaaacaatggtggatcacgagaaaaataaagaagttattcatgcgatttcctatcttggaaaggacccttattttgggtattctgttcagcactttggccattccttttattactcagaggaaaaaactcctcaatatgcgcaacaatctttcggacgacgagtgggccgactttacgcaaaagcacaaagccacgatccttgcaagactcaaattcggccaaaatttgcacctcccattttacaacaaagacaaagcgttggaacaggacgagcaaacgcagaagacattcatggacagctgaacagaacggacgaaaattggcggaatgaaatttaaaagtcaaagcaatttttgttttattattttgtgttataattttggcccttttgagtaaaatgagataaaaaaaaaaaaaa

SEQ ID NO: 89827 - DNA, 621 bp, Heterodera glycines
  SCN-specific regions: Sequence locations=1-189,211-364,394-462,510-621
acaagccgaaactatgcttcaaacactgaattatctgacgacgcatcagccggtgaaatggaacgcgagaatcggcgagtgcgatcaaacagactcagccagcaaagataccgcgagaagggtaatgaagcacgcaatttgttgcctcagctgtacagtcgaattgctgagttggaacgggaaaacaatttgttgaaggatttgttgtggagagaacgcgaccccaacagtttcgcggtggcacaacagcagaaaatggaatggaatcgtgcgaatggacaaacaatggacatggaaaatgcattcccacaacgcgcgatgagcgaaacttcggtcaattaatgctaattgataaaataattaattggcaaaagaaaaacatttacacataataaaaccggaaatacttttctatttttagattccttcaatgtttaattgccaaacagttcggtcaaataatttaattttcaactttactgaatcggaataaaaaatcaaacagaaaactgaactgaatttaaaaacgattaaaggcaatgccgccgggcaatgaaatgttggcacccgattggcaaatgcagttaataatgccgcacttgggggagcagtgggaattgg

SEQ ID NO: 89828 - DNA, 975 bp, Heterodera glycines
  SCN-specific regions: Sequence locations=1-80,102-327,382-509,536 -680,738-832,855-975
gtgccattcgacagaccatttgtctctgccgccgatggcattgcctttggcggtggcgaaattggaggcgcaggcaccgatttttcagccaccactttgctgttgttgaagaagttcagcggagagccgttgaagaaactcaagcgcaacgcagaagaagaagactttttaggggacgtgacacctctaccatttgtcaaaggcgcattatttgagggcgatagattttcggttggcattacaaccgggcgtcggatgaatggtggcggcggcggtaaaggaggcggtggcattggcactttggcgctcggtgaggtggaaaatgtggacgatgacgacaattgttgttgatgatgaagattgtggtggtgatgatggtgaaagttgttgctgctttgttgctgcaacatttggggttgaatcttcggaattggagacgtaggcggcaacggagtaggcgaagaggcagatgtgcggtcagcaaaatcgacatttaaggaaagacgattttgcggcggcggtggtggtggaacgggctgacgaaatgagttaaaagatgataaagaagttggaccaactcctccattctgtcgttgttgtacagaaacaacatcgccaccattggtcaggttcatgtccatggcattcccatcaccaacctgaaaatatttggataaatcaaaaatttttttttctcataaatattatttttactttctaaatcaaatttattaattgctgttgctaaccaaccgtttcatactcattcccgatggttgaataatatgcgtcatcatggtcctgttgttccaactgttgaccccttaaaaaatgcaccaaaataatttatatgtccgttgattgaggctttagcccgttaaatgattcggaacaaattttaattaccccttatgccttaaaaaattctcgtgttttgattggtcgaagaggatgaggagggtccggcgctaccaa

SEQ ID NO: 89829 - DNA, 639 bp, Heterodera glycines
  SCN-specific regions: Sequence locations=1-5,37-302,324-461,484-639
cttgaccgacgcgggccaactcgtggcactgacgggtgccagtggggtggacagaaccacgctgttcaacactttgctgaacaggaacttgaagagtctgagcgtggagggtcaattgctgatcaacgcgcactctttgggccaattcatcaattacgccagcggggtgtttggttcgtcatttgtagtcagcaacattctccgtgttctgtctggattcccgattgtttttcgtattcagaaggctgatcgcaggcgttatacacccactgagcgcatgcgggacatgcaacaaaacattaatgagctcattcgcatcaaccgagtgaatgctgagacaattcagagccaagctgagacgattcgaattctcatggggttgcctggagtccgccaaatgtatgatgaacatcaagccaatgccaaccaaaacgcgaatcaaaacgcgaaccaaaacgcgcccatccaaaacatccagtatgcgcaacctcttcaaattgcccaagccggcaattttcaaaacctcaatcagctcccaaatttgcaacaaaatcaacagcaatatggtcagtatccgtttgttcctactcctcttgggtatccgccggcgcctcagggaaatccgtaatttgttcgtcg

SEQ ID NO: 89830 - DNA, 650 bp, Heterodera glycines
  SCN-specific regions: Sequence locations=1-96,119-650
gtttgagataaatttattaagaacaatgcgttcagtaaaacatggaggaaaaaaaggaatgcgattcagatacaaattgtcagcagttaagaggcaaaacaaaaagcagaagaaaaagcaaaggaacatagctggatgctctttgatcaaaaaagcatggcaaacccaactatcatcgcggcaaaatttaagtgcaatgggactggtctatgatccaaatgaggcattgaaaaagaatcctgaattcgccatggaaatggaccaaagcgaaattgaagtaattggattgccagaagccaaagctttgggaagcgtgaaggaacaaaaaaaggcgaccaaatcaaagaaagcatgcccaaagttgaacaaatctgaggccgagtcgtcgaaagttgtgttggaacttcagcaaatcgcattggaaggagcccagcaaatggccgagcaaaagcaaaggaaaagagaacgggcgaagctgcagcaaagcgacatcgaattttgccagaaaatgttgcaaaggcacggagagaattatgagggcatgtctcgtgatcctttgaatatttggcaaaacactccaagacaaattgagcgaaagattggcgtatacaaacgaagcatcgccagtgactgaatgtgaaaagcgaaaa

SEQ ID NO: 89831 - DNA, 887 bp, Heterodera glycines
  SCN-specific regions: Sequence locations=1-597,619-887
gtttgagataaataccgtaaacagtgactaattactgtaattatggccgccacaattgcgtcccatgcgccccaaatgaaacaacaaaatgtgcaggttgctgaagaagaaacattcggaaagacaaacggcggaatgccaaacggagcacagaagcagcagaatggccaagcgaaggagaagcaaaaagtgggccaaacggcgccggtggcacgtccgctgacagtgaaagattgggactacgacgagaggggccaatgcggaccaaagcattggctgcgcattgccaaatgcgaacatttgggcgatcaccaatcgcccattgacttccaactgtccaaaatgcgcgtccatccgctgaacattcacccgctgtgtttggtcaattttaaaaagcctttggctggccagctgatcaacacgggctgtggaatccaattccaacccgacccacagattgaaccgcccgaaatttacggtggcttattggaccaaaactatcgcttcgtccaataccatttccactgggcacagaatgacaatgaagggtctgagcacacaatcggtgggctgcgttacccagccgaacttcacttggtccaccagggtgtcaagaatccgtccaaattggccgttttgggcattttcctgaaattggacaacgaatcggagaacggcgaaaagaagaaatttgtgttctccgccgaagaaatggaagcgctgaagaaagtgatcgaatttgagcagaatgccgccattgacactgaacattcgctgtcctcaaaattgccgcccaattgttgccaggaaatggcttcttccgcggaacattttgtgtcttcgtttgtccgttacgagggctccctgaccacaccgccatgctccga

SEQ ID NO: 89832 - DNA, 688 bp, Heterodera glycines
  SCN-specific regions: Sequence locations=1-230,253-643,666-688
aaagattcagtggatgtcggctcagtgatcatcaccaagctggacggtcatgccaagggcggaggcgcactttcagctgtcgccgccactcgttctccaatcatttttatcggcacgggtgaacacattgacgactttgagcagttcagagtgaaaccattcctgcaaaaattgcttggcatgggcgacatcgaaggccttgttgaaaaggtcactgaaatggggctggaggacaacgaggagctgatcaagcggcttaaacagggtcaatttacgctccgtgacatgtatgaacagttccaaaacattctcaagatgggcccgtttggtcaaattatgagtatgatccccggatttggcaccgattttctgtcaaagggcaacgaacaggagtccatgtccagactgaagaagttgatgaccatcatggactcaatggctgacaacgagttggaccacccaaaagccaacgatttgttcaacaaagagccaacacggctcgtccgagtggccaagggcagcggcacggcgccgcaggatgtcaaggagttgctttcacaatacaaaaaatttgcggacatggtcaaaaagatgggcagcatcaaaggcttgttcaagggaaatgaagtgaacccgaggaacatcaaccagaaccaaatggcccgcctcaaccagcaaatggccaaaa

SEQ ID NO: 89833 - DNA, 578 bp, Heterodera glycines
  SCN-specific regions: Sequence locations=1-578
cctaaacgaggcttttgaaatcgtataatggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggttaacctgttagggactctaattggctaagctaaccaatgtttctgctccctccatttcgatgtatacacttattcgcaaatcttttattttaggacggggggacggttaacccactcgtattcttttcgtttaataggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcaccaccaccagtgaaaagggaacgtactccgggaacaccgccacgcc

SEQ ID NO: 89834 - DNA, 605 bp, Heterodera glycines
  SCN-specific regions: Sequence locations=1-53,92-126,148-572,598-605
ctaatctggacatgtaaatcaacgacctttttccgctctttttttgttgcgcgcttttcaaaaaattttgggggacagatggtgtgggggcatgccgacaggcgccacagtggaaatttttaagtattttgttaagaaattattattaatttcattccaactttctgatcattgacgactctcttactacaatacttaattcagatgcaaagattcgtcttatatttaggtgaagctgaagcctccgccatggacacttcaatggttcaaatatgacgtcaaaggaatagaggacacttggacattggccactccatggttcaagaggaaattcattgcgtcaaaggatttgttggagctgagaaagtacgacgtcatccgccattatagggaggctggtcaagaattggagcatgatctgaaagtacagaaacggatgcttgagttcattgaagaataccgcagaaaacggggggagcccaagaggaaattgctgaaatctgccggaggaaaattaagggaaatttctttattcgtcacttcggaagatgttaaaagcaaatgattagtgttaaggataaaactctttgatttttcactaaaaa

SEQ ID NO: 89835 - DNA, 842 bp, Heterodera glycines
  SCN-specific regions: Sequence locations=1-842
tcccagcccagaaggtgtttctggcccagaagatgatgatcgcaaagtgcaacatggccgggaagccggtgataactgcaacgcaaatgctcgaatcgatggtgaacaagccgagaccgactcgtgccgaggtcagtgacgtggccaacgcagtgctggacggctcggactgtgtgatgttgtctttttagtcggccaagggcgattatccggtggaatctctcaaaaccatgcacgacatttgtctggaggccgaaaccgcctttttccactcgaggtacttcgaggagttgttgcagaacacgcccagccccaccgggccgggcgaaaccatcgcaagcgctgccgccaacgccgcgaggagatgccgggcaagcgcaatcattgtgctgaccaccaccggaaagtcggcccaggagtgttcccgcttccgcgtgccaatccccgtgttggccatcacccgctatgagcaggtggcgcgtcagctgcagttgtgccgtggtctgttcccgctgtactacccgcacatggaacgcgacacggagtggacggaggacgtgaacaagcgcatcgcgtacggcatcggagtgggcaaggagcgcgggttcatccacaacggcgactttgtggtcattgtcaccggatggcaagcgggtgccggctccacaaacacaatccgtttgcagaaagtcgaataacagagggacgtgtccaatgagcttttgaagacttcgcgtgaccgatgaaaactttttttaggaatttacgcttttgtgacttttgttttcatatttttgttgactcggtgtttattctcaaataaagaaccttaggctttaaaa

SEQ ID NO: 89836 - DNA, 491 bp, Heterodera glycines
  SCN-specific regions: Sequence locations=1-307,334-491
caagtttgagccaaagcatttcattgactttctgtttaaaaaaatgtcgcttcttgttttctctcgtctccgtactcttcctcgtcttgcgccgcttctgacgaacagtccttgtgcactcagcaccagtgccgttcgcaaagacattgacagtgccgcgaaatacgtcggagccggggctgcaactgtcggagtggccggttccggtgccggcattggcaacgtgttcggctcgttggtcatcggttatgcgcgcaatccgtccttgaagcagcagttgttccagtacgcgattctcggctttgcactgtctgaagccatgggactgttctgcctcaccatgggcttcttgatccttttcgctttctgaacattacgaagacgagcacagaggaatggataggaaatctttttttgttttttctcgcttccaataatagtatgtttttctatttttgtgttgtcagataaagttggactgattagaaaaa

SEQ ID NO: 89837 - DNA, 640 bp, Heterodera glycines
  SCN-specific regions: Sequence locations=1-640
tgttgtcctttgtggaacggactgtccaatcgttactcgacaaaaagatgattgttcgacaagaaattgacatgttcgaagccacacaaatcggctcggccactttcaacgcgaattttaacccccaaatggcacttgacatgtgcaacgacctcggcgccaatttgggcaaaggcatcgtgctaatttcgcacttccatttgctttacaattgtgtgccgttggacgtcgccgttcaagtggactggaatttgttctacaacgaagtcatatttggggctgagcagcgaggagcggcagctaattcattcgatgggtttgcttaatccccaaatggattcattttgcgcctttattgtcggattgctgactttttcatttttgtttggtttttaggtctttctgaggctgttcttatccgtcacattcactcgcaccaccaacaaaaggacccgagcaaagggatgcgaatttacgttgtaattgttttgggtgttataattccgccattttttccacaaatctgttctttcaggtgtttatgcttcgtcaaatttggaatcagaagcccttgtgggaggtggcgcgttatttcggcgtcccccggggttggcttcagtccgttttgcagtccgccgtc

SEQ ID NO: 89838 - DNA, 808 bp, Heterodera glycines
  SCN-specific regions: Sequence locations=1-61,83-379,402-729,751-808
gcaatttgaaaacagaacataattcacttcttcttctgctaaaccctccgcaacagaagtcaaatttcagaaaagaaaatgcacgaagcgaaaattatagtcggaattgcttccctttgttcgctggccgcgattttggccactctcgtggtgatcccgcaactgtacactcaaatcaacgaaatgaacaaccgcgtgatggacggtgttcaggctttccgcgtgaacacggattccgcgtggactgagctgatggaggtgcagatcagtgtcactccgccgacccgtccgcgagagaatcccttcaactccattttcctacgccaaaagcgccagggattgcctccccaatgcgtttgccaactgcagcagccaagctgtcctcctggtcctcctggcccgcctgggccccccggaacacccggcgagcccggcggcgccgggcagccgggaagcccaggacagcccggacaacaagcaccgccatgccctccgcccgtgtcgacgtgtcagaaatgcccagctgggccgtccggtcagccaggaagccaaggaccgcctgggccacccggaaacgatggacagcccgggcagcctggacagggcggcggacaaggcccgcctggcccaccgggtcctcagggacagcctggccaacccggacaaccaggaggacctggccagcccggtcaacccggacaaccaggaatcaaaagcacgacaattcccggcccacctggacctcccggaaacccaggagcaccgggccagcccggcagccccggacagcccggaaaccccggaggac

SEQ ID NO: 89839 - DNA, 619 bp, Heterodera glycines
  SCN-specific regions: Sequence locations=1-619
attaagtttactttctgctttcctcttacaaatgaatatttgtgcatcaaagtgttgtttggcatcaccaattgcccatcgttctcattcggttgcgtttccgccatttgtccgtcgctttgcatcccatggacatgacgacaacaagccgcaccccattgatgacccggacattccgcgtcagcccgacatgtaccgccctggttccgattcgtttgcttatgaaaatccatggccaatgctgaacaagggccgtcttgattggcttttcaacgacggttggcgtcgaccactcgcggctgaccaaggcgctcacatgcgtcgccaatggatctatttcaaatgcatccctcgcgacgagcacaaagactggaagaagtggcacggcacaatgcccatcttcggcaccggatgttttgtcatgttgacctttgtgtggcaatactgcaattccgactggcccagcgcgaaagagtgggcactgcgcgaggcgcactttgaactcgtccgccgggagcgtgccggactgccgctgatcagcccggatctgatcgaacgcagccgggtggaggcggctctgccggccgaagaagagctgcgcgactttgagattctcatc

SEQ ID NO: 89840 - DNA, 451 bp, Heterodera glycines
  misc_feature (158)..(159): n is a, c, g, or t
  SCN-specific regions: Sequence locations=1-42,64-125,149-451
tattgaagccggaacaagtaactgtgcagaatttgctgattgaaaatggacaactcattgaaactgtggcggaatatcagcggatgggcaaaatcgttgaagcgactaaataccaagagcgactgcacagaaatctcatttatttggcaaaactggcnntgattcgacatgttcttctcaccttttactggaaatcggtggagcgatacccccaacgaatgagtcgccaccgccagccgaacctctgttaaccgttaccaattccgctaatcctccgaacattgttgctacaatagctaacgcgggtttgcctcaccagcagcaatgccaacccgcggtgtctgtggccattgtcagccaaacatcgccgcccagtgggcatgcccaacagcgcggaatttcgactacgccacctgcccatggtgtgcagtaccaattcccctccccgcct

SEQ ID NO: 89841 - DNA, 671 bp, Heterodera glycines
  SCN-specific regions: Sequence locations=1-105,127-150,172-671
gcttatttatgtttttacctgtattaatggatgtccatgacgacgaagttgaaattattgggactaagccaaatgagaggcaaataggaccgggctcatcgacaagaacaacagcaggaaaaattttactcccaacaacaaatgtctgaggaaagtgaagaagcattgttttgcatttctaagcatgacgttaaagaaataagccaagtggtcaaagcaatggcattccgagaccattgcacattaaatgtaagcaatgagggcattcgcttggcagttgacgaccaacacaatcagcaaggcagtgcctacttcagatccgagcacttccaagacttcaactttcgtacccaaacatgcagcattaaaataccgatgaggcctcttatggaagcactgaatatgttttccggtacgatgacaatggtgcaaatttcgtggaatggcgaaggctttccattgctcgtcattttggaagacgaaggcaggagttgttgtccacaccgaaattcgaactttgatagcgcccgagattctcgaattcgatttcgacaatgaaaatgtgacggccaaggcaattctgaactctctaccaattcgggagattatgcgcgacttggacgactccgccgaaacggtggtgctcactttcactcccggttatctgcaat

SEQ ID NO: 89842 - DNA, 669 bp, Heterodera glycines
  SCN-specific regions: Sequence locations=1-16,38-669
aaaaatcaaaatgccgacattgagcatctgtccactcattacgaattggaccaaaaccttttcaaaaacaaaacattgcgcgagttttgtgccgcgattcacagtttctacggaaaatgctccaccaacattctcgatcacttcaaaaagcgattcaacattttgcaatttgcgaggcatttgccccatttctttgtcggcctcaattcaacatggatttacgaattcgttgtgctgctcgaaactaccggattaaatggccatattttggacaacgatttcgaaatggacgacaacgatcgattcattgtgaacacgcaactgcaacttttgttgcaggaggcgttccgcgtcagttggcttcagaacagcccattccatgacaaaatttgcgtctcactgatgcgtctttctcccacgagtgacgaccgactggcggaacacgagaaaagacttgaacaccgacttaagaacccaccgaagctggagctgaacatcgtcgtccccaaggataatgcgtcgaacaagaacaaggatttggcactgagtttggcatttcccccagtcgtcgtttggtcgtaccgccaaatgttttaccatttgttgttgctgaaccgggccaaacattggatgtaccgaaaatattttgcgctgaaagggacgaattgc

SEQ ID NO: 89843 - DNA, 490 bp, Heterodera glycines
  SCN-specific regions: Sequence locations=1-370,392-411,433-490
gaggtaatttaattttctgtgctttcatttttatttgttgtcaatctgatcagtttcttttttctcacaaacaatttgtgttgtgtcatcgaacaaatgtcgactgtcagcaacggcaaagctgaatcgtccatgcgccgatacatctacatcttaccctaccttcccactggcattgcttcttattatttttacaaagcggcacagttggcgcgaaaatgggccactgtccacaagttcgggccgttcaaagtgtcggcagcgcatggatttgcccttctcattcccatgccgcacttggtgatattggcctttcaaattgcgtacacgcgaatgacacgtcgtaccgatgagaagatcaaaatgaaacaaaatgtttccaaatagttgcctattttcatttcctctgcgctgtttccattttgtccttgatttttgtggggcaatttaaattcgttttgtttttcggcaattaaatgcgcgcttcttc

SEQ ID NO: 89844 - DNA, 603 bp, Heterodera glycines
  SCN-specific regions: Sequence locations=1-603
gtggcggtcgatttggcggcgataattgtcgagaaaaatgtcaactcttttctgtcggttgtggacattcccaagccgtctctttacgattatttcgcttttcttttcgcgttggccacaattttgtgggcaaatttattgtgcaaatcggacagcaacaacattttcaaagtgcatcgtctcatgttggtgctcgtcttcctcaaatcgctcactttgcttttccacggcgtcaacttttactttgtctctgtttatggccacgaacgtgagctttgggccatcatttactacgtcacgcatttgcttaaaggtgcgcttctcttcggcacaattattctgattggctccggttacactttttttcaaacaatttttgagtgacagagacaggcgactgttcattttcgtgttgcccctgcaaattttggccaacatcgcaatgataattctggaaaaatcggagttcagcgaccaacgctatctgttctggctggagatgttcaccttcctggacattgtctgctgcatgagcattcttttgcccattttgtggtctattgcctttctgacggagtgtgccgcaaaaacgacggatgggaa

SEQ ID NO: 89845 - DNA, 614 bp, Heterodera glycines
  SCN-specific regions: Sequence locations=1-354,376-417,439-614
ggtgcgacttttggtcgtgaatcgggctcaaattttgatggttttagttccaactttgttggcttctgaggctctctctttgcggtaggacgcgatggtggtggttcaatttttgctttcgcacgaggcgggagcggaagccggggaggtgaaggtgggtaataaaccctgtattttttatgttccgaatcatcatcatatgcttcgtccttttttaattttcttctgatggcaatcctctgctgatcagtgtccatctgttcaatttcacgttgagcattgtagggcagcacaggcaagtcgccatagtattgtgttggcgctggcagcgctaacccactctccaacatataatcatcatctgtatcactttccggtaagggggcagcagctgcttccgcaagaaggtcccgcacaactggttgccgtcgttgtatatcatttcgccttttctcccactgctccaaacgaccatctctccgcgatgccctagtcgatctgggaggacgttgtgggcgaggcggaggacttcctggcggggatggagcgcgacccggaggacttggtgggcgccgatgacctctcttaggcggcggtggtggatgtggtggagg

SEQ ID NO: 89846 - DNA, 593 bp, Heterodera glycines
  SCN-specific regions: Sequence locations=1-593
gcacattccaaagttgcaacaagaaactgcggaacaatgtgatgtttatgcatcacatttgggcccatgtggcccaacaaaagcacaccgactcggaagaacagtttatcaacatgcaggccgagcaacataacgccaacagcatcatcactaacggcacgaacaacggcaccgacacggccaccggcgacgagcatctcagcgatgtcagccgacttcacatgtgcccagagtgtctgttggaacagcccacaccgcaccgggcgcacctccattaccaccgcgtccataaacgcggcaaacgacatctgttggacaaaaaacccgggttgttgcacgtgtgcaacatctgtgagcaggtgttcgacgccaaggccatcgcttcgcactgtgccgtccaccatttgccggacaaaggcgctcagttggcactgccctacgggtgccggttcagcgccggcgtcaaatgccaattcagggcgtccaaccgcagtgcgttgctccggcacttttacgtccgccatgttggcactcacgtggtgctgtgtccgttctgtctgctcactttccccgtgccgcccgccaacaaacgc

SEQ ID NO: 89847 - DNA, 636 bp, Heterodera glycines
  SCN-specific regions: Sequence locations=1-608,630-636
atgtccaatttccatttgtcctcaaaagtgttaaattacatcgacacacgtccaaaggaaaacgaagtcaaaggggcaataaaattggacgtcaatttacggatttttattaaaaacgaacgttctgttgaaaaggaaaaaagccgaaaggaaatggcaacgaatatttacgcaactttggacaaaaaagaacctttggccgcatttattgcgcggattggcgacactttggcactgaccgaagagccggaaaattacgctttaatgttcgaagagaaacgacgatttgtgacggaatataacaaacccagcgtggcacagggctttttcctcttgctgaccgcttctccgtccaatttcgctaaacactttctggcccaacttggccaaggttcgtgctccgcttggccccatttgcctttgttcgtttctctctgtgccgaccccgcctttgccgaagcatttaccgctcttaacggtgtccattgtttggccgaagtcatcgaagggttttccgacgaatggcacccattcgaaccaaatgcacctccgctgttctcgcttatgcgttcccttctcacatttatgcagcaattccccgtcctttgcccttgggccgacttttccccgcaattt

SEQ ID NO: 89848 - DNA, 545 bp, Heterodera glycines
  SCN-specific regions: Sequence locations=1-54,78-78,114-185,210-545
cacattctcaatcaacacaaatgcttaactaataaaaaataaatcttctttttggtccattgccatagccaacgcttcatctcccaaattccatcggcggtgccattctccgtccgtctcccccccccccctccggtgctgcttttcctctgctcttccgctgatctcactccctccccaccgtttggtcctcaattatttctcattagtgccattttatgcttattccttcttctctccgcttcatcatccgctgtcattcttcagctgctgctgagtgttttttgccttcgttttcgtcccttttacaattgtataattctttcaattgagcaactttggcattatttcctcctccttgtttgttagcatttgaattagccgaggttcactcggttctcagccagcagaatggccaactccagtggccatgaccatccggcgcgcgggggctcactcggctaaagcctcgttcgcgcatcgctttggtcattttcggcgctgtgatgatccacctcagcatcggcacttaccacaccttcggt

SEQ ID NO: 89849 - DNA, 542 bp, Heterodera glycines
  SCN-specific regions: Sequence locations=1-263,286-542
gagtttcataatattttcttcctccgtcctcccttttcgcctccttttaaatggctcgtcagcaattgaatattcgccgccgttccgttgtctcttacgttggcatcagtgagcatggccaatgcggctactgcaaattcacaaaacgcgcccatgacaaggccaagttcgcagcttcaaccagtgaatgcaatgcctccgtcgatgcgtcgacggtggcgagcagtacaaataatgatgggcaacaacaagcgaatccgcccaatgcacatgatgaaaatgccaacgatgatacaaatggagggggcgactcggccgtgttcggcctctgggcccaccggctcactgtccaccattaccaatggttggccaatcgcggctggcgacgttcgggtcgctttctgtacaagccgttgatgggccgcacgtgctgtccccagtacaccatcacgttggacgtgcacaaatttcgcctctctcacacccaaaagcgcgtgctgcgcacaatgcgcgactttttgcgcacggaccaaaggccgaaa

SEQ ID NO: 89850 - DNA, 655 bp, Heterodera glycines
  SCN-specific regions: Sequence locations=1-655
ttttccgatggataagcaaacttttggtggagattcttctgccaattcggcagcggaagacaaaatgagcggttgctgttcagaacacattgtggaaattgagtggaaacatttcgactatctctccgccctcagtggcctttacacggcatcggtcgaacgtcgaaaatgcaatttgcttgtgctcgtgcagggcaatttggacaatttggaagggaaaatggtcattttaactatccacgacgtgggcaaaaaccacctgagttttgtcgacttcgtcaacagtctttcgatggcacccctccgcggccgttcccttttcctccatatttgtgtgcctggccaagagcccgaggcgccgattttcgccggaagcagtttcccgtcgatggatcagctcggccatgccatggtgcaagtgctgcgccatttcaaaatctctcattgttttgcaatgggcgaaggcgccggcgcggacatttgttgtcgattcgctttggattttccgtcgatggtccgggggttggtgttgatccattgcacttcgacaacccacggaattgtcgaaaacatcaaagagattttcgccgggttgcgtctcgaagacggcgaaatgactcattcggcgtggaattatttgctgactcaccgtttt

SEQ ID NO: 89851 - DNA, 651 bp, Heterodera glycines
  SCN-specific regions: Sequence locations=1-480,502-651
ctctgaagtttgaaaatgttagaacggcttccgtctcagttagtgtcacgaagcgcgagctttgtccaaactcggatgacggcaaacaccgtcaattttttcatgcgtcgaaccggcgacactttgtggaagacggtgacgaacgtgtccatgggagggatgaagcgggggagggcgcggacgcggcagcccatccgaccgttgccccaattttaccgagtcggcatgctcaagtcgagtccgatgcgcatccgttaccctgggttaaatgcgcccattgtcccgcaaagtgttgccgaattggcctcgagaccgttttttgttgaggaacagtcggagcaggaaagggaggaggtgctgcactttgtgaggacccaagtggccaacaagagcagtcagaagcgccatttgtgcaaagagcgcctcactccgctggagcggggcttcagcggcagcactttcatgggccaacgcatgggaccgcccccagacatggacggggcgaacatggacgacttcgagtgcatttgtctttttaccgaccgaataacggaaatgcattccatcagaggacgtgttttcagcacgagggcactcgtttttgtcggcaatgggaacaaagttggcggttttgcattggcaagggcttcc

SEQ ID NO: 89852 - DNA, 907 bp, Heterodera glycines
  SCN-specific regions: Sequence locations=1-253,281-379,401-847,896-907
caagtttgaggaaaatacttttaactgatttccaccattaaaatgcactttgttctcattgccttctgcattgtttggcaactggttgtcgccaataacgtggagcagccggccaaccgtgccaagcggttcacctccttcggctcattgtccaccattgggggccgcgttggatgtgttgtgtcgaagaataagctgttcgtcaacggacacttcaccaaggacctgagcgaggatgagcaggaggaattgaagcagtaccaggagcagctggatcagttcaagtccgaagtcaagacctacttggaggagcgccagaaacagttccgcaaccaggtggcgcgccagggcggcgccgaggccaaggagggcggaactcagctgaagaagccggagccgccaaagaagcccagcttctgctcggacaaagccaccacacagtacgtgttcgacggctgcagcgttcaaggcgacaacgtgtacattggggatacttttgtgcgcaagctgagcccggacgagcagaaggaattggcccagtttgaccagaaattcaccgcctaccagaaggcagtgacggccggcttccgcaagcaagttgaggagatgtttggccaacattttggcgccctgttcggcgcctccaatctaagcccatccactgctgaggacaaacaacaggcggtgccctcctccggcgctgagctagcgccggctggcgcagagaacggcacggcgccggaggcgccaaaaacgccgagcttctgcactttgttggtttgagatggcgagagagagaaaaagaaagaaaagcgaaagggcagacagagaaaccaaaggacaaagaaatcaataaaatcgatcaaacaatcgatgaattaatcgataatcaaccctattttaccgt

SEQ ID NO: 89853 - DNA, 957 bp, Heterodera glycines
  SCN-specific regions: Sequence locations=1-908,930-957
gcagactctcgttttgccgttcttcttttttacggctaagataggcgctgcccaatgactgaaatcgattggcttaattgcgccaatttgaagaaggcgatccaattcggcattcacagcttccatggcgccatgtggaattgggcgagctcggcaaaatacacgctttgcatcagaccgcaaaatgagatgcgcctttgcctttgagcagtgtcccagtccttcttcaaagacttcagggaaatctttttggagtaccgctttaagcgttgacacattattgatcgatttgtttggcggcttcactgccgaaaaattttcaatcattgtcgcctgatcagccgatttgctggacggaaataaaatttggcggggaatgatctccaaagcttcgatccacggcaatcccaataaattgtgtccgacttctccgctcacataagcgatcagaatttgcggtggtttgtcggcaaattggacagtgcattggaatttgccaagtaaggcgaatggctggtcattgcaatttttggcatcgatgtcggatggagtcagttccggttctcccaactctcgccatgtttgcaatgaaataattgtggcctgagcgccggtgtcgccattcatggaagtttgccttccattaatcaaaatgcacaatttccaccatcgcccttgagtcgtgccgacatgcaggcaatttgcgtcgactttgacactgtgaaatgaccggtggctgttcggtggtgccattttcttctttgaccggcaaattgttgaaatgtgcccttttttgttgcacttaaagcaagtggcgtccttgaatgagcaatcggagcgccagtggtcaattttgccacatgatccacacggaagtgttggacgaccacgtgttggctttccacttgaattggcatttttatgttgccgttgatttgtgccgctttgtctttgtgc

SEQ ID NO: 89854 - DNA, 1242 bp, Heterodera glycines
  SCN-specific regions: Sequence locations=1-878,901-1242
atcagaaacgaggaggaaatgccattgaaaagcattaatgccctccaaaacggttaatgtctttgagtggcgtcccgaaacaattaaatttgccaaatgtctgccagaattcagcacgaggctttttttgaacattttggcattgtgttggacaacgccgagggcgtttacttttccggacaggaaattgccggaaaggtggtcattgagtgccgggaaccgcgccgaatcagcgaacttttgctggaagtgaagggacgggcgcggacgcattggacaaagtcacgcaaaatgtgcagcgaaaacgaaacgtacttttgcgagcagttcaacacggaatacacgcgaaagttgccaaaaacggaggccgaaaacgacgcggggggagaaacaccacgggaaggggggaggacagtggcggaacggagaagggaaagcatcaaaatgatgggccgtcttctccacgtcggcacccacgagattcccttctcctacgcactgccgaagagtttgccgagttcgttcgagggcgagttcggcttcgtccgctacacgtgccgtgccatctgcgaaagtccgtgggacttcgacacggtgtgctttttgcccttcactgtcattggcatcgaagatttgaaccacgaggccgaggttccgtcagcgccgaatttcgactcgccaagggtggccttacgccgggcgaaaatgtgccgatgaacgcgaaagttcgaaaccaaagcggacgaacgctgcgcgggttggagctcagactgagcaaagacgtggtgtacaagtgggccattcattcattcctttgcccaaaaagttaaattcaacactttttaagggacgacggcatataaaagcgaatttcatattattattttgaattttactgcaactttttgatatttaattcgttcatttcacagatcgaaaacatttgcgggtgccgaacagcgacggaccaccaaaaatgtggtggagagagtgcggctgaaaaaggtgcccagcgggagcgaattcgaaagtggcgcattgcctttggcggtgccttcggttccgccgcgactcgccccaaagtgtcgcctaatcgacatttcgtattctgttgagctgagttgtcagtcgccccctttttgcgtgtcccttcccgtggtcatcggaacgatccctttgttgcctcccaatctccgatcaaacgaccaaaatgtggcacagaacaacggcactaatggagtc

SEQ ID NO: 89855 - DNA, 726 bp, Heterodera glycines
  SCN-specific regions: Sequence locations=1-726
acgaagcgcatcttcaaactctaaacagaaacactgttgtcagacattgtctttcaatggatttgagtcggcttttggtctttttgagtttggtggatgcgaaaattaatgagcatttgatgagtcgtttcaatctcgtcctgtctcaccgacataatcttcagtcttcgtcttattctgctcgcttaatgaattgtttctcgtccgccgtctcgaggattcaacacgcacgagcgcacatttaccattcgatcagtgacattggagttcatgtggatgacaacggatttaatcgactctttccccaacttttacattacgaaagggcaacggaaccaccccaagcggacattacactgactttcattcgtcctggagcaactccttcacattcccaaatcccgagtgttgtctcccagccgccttcgcgtgattctccgcctcattccgattcgacgccgaatcccccttctcatagtcagcagaataatccgactgctcttaattcgttgctttccggctttatgtcttttgcacatcaattgcttggcggtgttcctgatcaaaatcatccacgacaccccaccatttcgccgcgtatgtcttctcgctccgtttccttcgccccgcggtcgtccgcttcgtccagatcaactaattccacgggtttgactggacaattccctcgaccctttcgtcacgtgcaagggtcccaaagacgttttc

SEQ ID NO: 89856 - DNA, 639 bp, Heterodera glycines
  SCN-specific regions: Sequence locations=1-28,51-257,279-639
cacaatttgggcattggttttttggtaaataatttttattagaggatgtggacatttttaggaaaatggaagaataataatacaaagaactaaaaattttgcattttatacctttcaatgtttatttaacccataaaataaatttggctcattcgaaatcattataaatagcatttatacttgcttaattttttcattttgttgtcttcatctcattaatattgcatttttcctctataaattgcactcttcctttcgttaatttttccaaaattgtagcttccaaattctcaaaatggtgcttcttacggaaaaaatcgccaaaattttaaactgccgtgtcagcgagctccgtgatcggcttaatcatccttccgattgtgaaacggtggtgaaagcgctgacaggacaccgtgttaaaacaacatacaaagacagaaatggatacaccaaaagctttgcttttgggggaattacagcacaaggagctgcaataactatggcttatggacgtctgggtcgtcctttcaatgttaatgtggccgcacatttctacgtccgtcaccgcattaaactccgacatcctttcctccactgtgctgttgagagctttccggaaggacaagaggatcgcttcta

SEQ ID NO: 89857 - DNA, 1093 bp, Heterodera glycines
  SCN-specific regions: Sequence locations=1-46,73-113,156-170,193-1093
caagtttgaggattttaggaaaaggtacacttactttctacaaaatgacctcacaacccattcgcgtattggtcactggtgcggctggacaaattggctattctctggttctgcaaatcgccaaaggggatgtttttggcaaagatcagcccattgtcctcgtccttctcgacatccctccgcttactgaagtgctcaccggcgtccattacgaattggttgactgtgcgcttcccaacctcttcggcgtcgaggcagtgaccacggaagaagcggccttcaaagacattgactacgcttttctggtcggagcgatgccccgcaaagaagggatggagcgaaaggaccttctcgcggccaatgtccgaattttcaaatcgcagggcgaagctttggccaaattttccaagccaacagtcaaagtgctcgtggtgggaaatccggccaacacaaacgcattaatttgcgccaaatacgcggccagcaaaattccggctaagaattttagtgccatgactcgtcttgaccacaaccgtgccatggcacaagtggcacaaaagtgcgcagatggaaccaccgttgggatggtgaaaaatgtgatcatttggggcaatcactcgagcactcagttcccggatattcgacatgccaaaattgccaaaggtggttccgaaactttggcctatgatgcggtcaaagacaccgcgtggattcaggaccaattcatcaagaccgtacaaaagcgtggcgctgtgatcatcgaaaagcgcaaattgtccagcgcaatgtccgcatcaaaagccgcgtgtgacccacatgcgcgattggtttttcggcactccgtccgacggtcgttgggtgtccatggctgtgccatcggacggctcttacggcatccccgagggattggtgttttccttccccgtcaccatcgatgcacagaaagagtggaaaattgtgcagggtctcgacctcgacgactttgccaaacagaagattgacatcactaagaaggaattgttggccgagcgcgacgaagcactcgcggcatgcaagtaatggaaaaggagagacaaacgtagaggaaatgaca

SEQ ID NO: 89858 - DNA, 1077 bp, Heterodera glycines
  SCN-specific regions: Sequence locations=1-282,330-751,773-850,872 -1077
gagagcaccaaggaaagtctgtcgaacgtggcggaggggacgaaggaatggctgacgagtgccaaggacaaagtggccgattcgctgacttctacgaaggacactgtgaccggcaagtcggcggagatgcgcgacagggcgtccgacagttacgaggatgctaagcagggggcgcaggaccgttacgagcgtgccgtctcttccctccctccctcttactctttgcccatgaactctctctcgcccttctcttcctccgtcccccatttgccaatgccattctcttcctcttcctctccctcttcggcttcttcttcttcttcttcttcatccgctgcccctagcgactcccttctgctcgattatcttttctccggctacgacaagcgcatccgtccgttctccgatggccatgtccccgtgttggtcgaattgaccatcgttttggccattctcactgagttgcgagagaatcagcaggcggcctccttcgtcatttcgcacgttcaaaagtggacggacccgcgcctttcgtgggaccccgcggcgttcagcggactccgacagattgtcctcccgcgggcggacgtttggctgcccaaacttttcatttacaattccatggataccaaagaaatgctggcggataattacttcgacgtccgcctcacgcaccagggcaaactgaagataaacattccgcattacgtcacttgcatttgccgattggatattgcgcttttccccttcgacacccaattctgtgccattgcccaggcttcgccactgctcggagtcgaagagatggacgtcaacgtgacaatgccgcccaaagattcttacttttcgggaaatgccgaatgggaactgttcaatgtcagcgtaagggacaccaaattttgggaggatggcgagcggagggtcgaagtgcattatgtgatgcacatgcggaggaggcccgtctattacttgacggtcatcgtcgcccccacttttctcatctctttcctcagtattctcggcattttcgcgcccggcacaaatgaggggccccgaagtgagaaggtgtccttggga

SEQ ID NO: 89859 - DNA, 742 bp, Heterodera glycines
  SCN-specific regions: Sequence locations=1-16,38-742
gtcgccctcacaaccattgcaatttctttgctcttttttcttataccgggtaaatggaatttaataatcccatgtaacactaacattccgtttttgtttagtcacaattggtcgctttttgctttccacgttggctttgacaaatcagcccatccacgacttgtacaccatcgccgttgggctttacgcctgttggatttgtgtccgtttgggccttctttctcgggaatgggctcgcagagggtggacttacgtgaaaaaggttggcacgggtcttttgccttttgaatgtccggttggttccttttcagctgttcaatgccacggggtttctgctggctcatgtctttgccgccgcttttcctttgtaggccgttcattccctttatgcctcagcctttacttccaaatgctcgtcatttctcctcttcgcgtggccattttccaatcgccgcttttcttcccctggaaagaatgggccatgggggttggtccacttcaaaattgtttgtgcttccggtttgatgggccccgactgtgggctgaaaacggcttttgaacaggtccaaacgacgacatgtgatgggttgtcactgtttgtttttaagatgtacgccgatgtgatttgggacatccgtttgcgagacctttacacgaacctggtgttcccaattgagaatacactcacttttatgatcgcgtttccttacgttctcagcaattttctcctcttttttgtcgg

SEQ ID NO: 89860 - DNA, 979 bp, Heterodera glycines
  SCN-specific regions: Sequence locations=1-62,84-786,808-979
agtccaattggtccattctgaattccctcctccgtccgttgccctaagccatcaatttgaccattgggacgccctcaggggacggaagggaattgacaaattcgaacatttttctgccgcttcctccacaaaatccaatcgttttttggtttgcactgcttttggcgcttttttggcaacgaatttcgaaaattgcgccgttttggagagaatttgcgattcgcgcctcgggaaaaatccgaaggaagtgaaacgattcgaattgccatttcgaataggaaaaatcagtgccggaagggatcacctaatcattttggactctttgaacggagagatttggagtttcgggacggggacgaggggcgaattgggcacggggcgagtggaggcggacaattgggcggaggggccgagacggattccgagtttttccgaggcggacattcgctgcgtggacatcgaaagcggcgcatggcattctttggcactgaccgcggaaggcgatgtgtacggatggggatggaatggacacggccaaattgggcatccgtccacagaattttccatccaaccgacgccctttccttttgatttgggcgatggaagggccaccatgatacgttgcgctggcaataattcatttttgttgcttagcgatggaagtgaaatggaatttggagaaatttgcaccgaaaagccaatggacgaacaaatggcggaaaaaatgccagaaaatgggtccaaaaatggcaccgaaaaagacgaaaagaagggacaaagccaagaaaaggacggaaaggagaagagacaaagtccatcggcaaaaaggcaaaggcaccaacggacactgaaagtggcggtggtcggctgcagtcatggccaattagaagccatttacgaaagaatggtccaaatggaaagccaacagaacgccaaattcgacttgctcatttgctgcggggattttcagtccttaaaa

SEQ ID NO: 89861 - DNA, 1081 bp, Heterodera glycines
  SCN-specific regions: Sequence locations=1-183,237-248,272-995,1018 -1081
atcagttccatcatttccccattttcctttgatcaaattggccaagtcttccccaatcgcctttgaacgaccccattaatccgggatttttcactttaccaattcttcttttattttggtctcttctatttctgttcaacaccatccctcatttctggtcaacccatctctttcatttctggtcaaccccctttccccatttccctctcatctctcaaaatatttccttttaattaccgatcagttccattttccccatttattttggtcaacttgccccaatcatttcgatcagtgccattcccccatttattgatcaaatggcacaaatttagtttgggtcaatgccattcatcatttttctcaaattgcgcgcaattcttctgatcagcgtatcccttcctctttgatcagtgccattctctcccccattttcttttgatcaattgtccctcattgatcaatttcatttattttgatcaattccaccccattttatttgaccaattagtcccaattaatttgatcaggcccctccctctaattttcaattgattaaattgtgcaaatttcttttaatcagcgccacctcctccgtttttgtggtcgaattgcgcttttccttttgatcaattcccacatttttttgatcttagtgcgaacatttcttttggtcaatgccattctccattttattgtttgatcaaaattgcgcgcaatccttctaattatttacatcctttcccaaatttatttttgatcagtcccactctgaggggctcacaaatggcacctttcagtcaatcagtgccatccctttttctgatcaaatgcgcacattctcttttgatcagtgccatttccccattcttctcttcatcaaattgccccaatttattttggtcaatcgtcttttggctatttcttttgatcagtgtcacccctctccatttatattgatcaattgacgcatatttcggctgatcagtcccatcgccatctttgatcaaattgtgcaaatttatttgatctgtcccattttccccatttccatttgatcatttgtaccatttttcattgt

SEQ ID NO: 89862 - DNA, 632 bp, Heterodera glycines
  SCN-specific regions: Sequence locations=1-89,111-347,376-632
gtccatttgatttcatcgccgtcatccaccacaattcccctcccactcaatcgacggcactcaaatggcgaggacggcactttcgggttcggcgacgaggcagaggagcatcaccgacaattccaacagcaattggtttgccggcgatgctgcaatactacgaacagaacaacagtgttccgctcgacagcggatgaatgcctcggcgatggcaaaaattagcttgcaaaagcaatgctccccgccggagtgctgctacacacaatgctccactgatgctccacaaaaatgtcatgatgataatgatgcccagaaagcttttgatgctgttcatctccgttccctcaactgcttcttctcctctttctgtcctccatttcggcactttcttccccccaaagtgctcctccgtctctgtctgctgttcctttttgctgtcggcggctgtccaattgtgcctggcggcgtctcggcaacggcacgttcacggcggacactcgttccgctcggcatggacaaacagatgttcccgcctcagatctttgacgaaaatgcgcccatttgcactgcggaaagggaaccgtgcggcttttacagtttttcgctggacggaaaagcgcccctcaaatgga

SEQ ID NO: 89863 - DNA, 594 bp, Heterodera glycines
  SCN-specific regions: Sequence locations=1-242,265-561,583-594
cctttatgagtttgggacttttcccttcttcaaccgctgtgtattcgtcaaacagtgacaacgaaaacgaccaaaacaacaaattccgtggtagtactgttttgcgtgcttcgtcagaaaactctgcgacatcgaacaactctagtggatttgctttgtccaaccagcagaaagccccattttcggtcgccgaaggggccgcaactgcggcaaaacgcccgcaccggcgtggaatttcgccgtttaaacaacagcagcagcaaccgtatatatcgggcacaggtggcgccaaacggaaattgtcgaacactgggagtgagcaaagaatgcaccagcaaaacaaccaaaccatcggaacatcaaggtcagccagcagtgatgacgacgaatttttcctgttggacgtcgagccgagagcgaagcagcgacgatatgaggaacggatgagcacaaaattgagcggaattcggctgaaggatgagcacgggaaagcggtggggggaaggaccaatgaacggaatattacaacgattgcttctgctcaaatggcatggggagaccaatggaaacagcagaggaagggaccgatcatcg

SEQ ID NO: 89864 - DNA, 1013 bp, Heterodera glycines
  SCN-specific regions: Sequence locations=1-302,324-353,375-456,478 -748,770-1013
cgaacattaaaatagggctaaacgagcacaaatgaacagtgagtgatttgaaattgtccaatcgaataaacaataagtcaagacattgaaaaaatcgatcactgctcattttgttccttgtttaatcaatcgatcattcgtccaacaaaaacccaattagggaagtgataatagcaaattgattgggcttcactcaattccctccctactgctgatccatcctaaaaatttggacggattgtcgggcttgaaacggccaacagtcaatttggcctttcactctttcggtctgttcattcgaattccccctccctcccctctttgtctgatgggattatccgatcccttccctaattgccttcccttttccttaattgccttttcgcttcgcttcgtccactttattttccttcctttgtttgccattgaatgattcgccttcctccccattttgttggatcatttttccgtttttattctgtgtgatctccgatgaaacatcgccgtcgcttggggggttttgccgggttaaaaagtgcgacaggaagtgcctacggggagaggcaacggaggcggtgggctgacccattggtgacggtggcgtcgaaaaatgatttgacggtggcgcccgagggaatggccgacgatggcaaatccaagtgggcttagagaaaaggcattgattttggcattacaacaaatcagtggcatttcgtgtcgacagacgcttttgccagccgacccggaggaaacggcagagagcaaagaggagacattggcacaacttctgaagagacatctgcgaaatttggtcggccggtcgttggcctacgcattatgacaaaaactgattgtcttcggcaatttcccttctcaggtgcatttcttcgttgaggattggttcatctccggcatgctcggcttcatcaccgccgctctttccatctccgtggacgttggctatgaatatttgaatcactgtatgccttttgcgccttctctttgttctctct

SEQ ID NO: 89865 - DNA, 654 bp, Heterodera glycines
  misc_feature (46)..(46): n is a, c, g, or t
  misc_feature (167)..(168): n is a, c, g, or t
  SCN-specific regions: Sequence locations=1-654
gaaagaatttgatcactcagaagaagtggttacaaaaataactttnggagacaattcttttcaactttggtaatctgtcggtgcatacgacccgagcaaataatttggatacgaaacattctgctggacgggacactgaaaaaatgctgcaaagtgactgccatctnngccgaaagtgccgttgcgttacttcccctacaaagtgccgcgcaggtttttgctcgccaaacaacgccaaaagctgcgcaacagtcaaagcgattccgccggttcgacattttcttatgagaattctctgctgaatgcgcgtctcgacgggtgtgaatttgacggacgatcgctaacatcggacaccaaagaattcgctgacgtacagcagagcaaacaaacagcggagaagcgtcctcgctgtccgtcctcctccgccacttcggccttttccgcgtatcgtaccgccccaccaccgcctcgtccgtgttggcttcagcacttccacgcgtccgcggaatatgcaccgaaaacagcgcaaatttcaacgaatatcaacacaacaaaatgtgacggaagcggagggagaagcgaacgcgtgcaaccgcaacagcagcagacacgagaccttggcctggcggaactgaccgattacttccaacactt

SEQ ID NO: 89866 - DNA, 710 bp, Heterodera glycines
  SCN-specific regions: Sequence locations=1-80,102-330,353-710
gtttgaggcattttggctgatcaccgctttttccttacattattatgcgctgcttcttcccccgtgtcgtccgaagtgttttcccctcgcccctttccttcgtccgttcctctctctccactttttatcccatcgatgaccaattgttcggtttggacgaggaacaacgacagcttcgtcaattggtctttcgactcgctcaaaaggaattggccccttttgctgatgaaattgaccgtcaaaatgaattcacaaaacttcgcgatttttggcgattgcttggtcaacaaggccttttgggggtcacagtgccagcggagtatggcgggtcggatcgcacttatttggaccattgcattgtgatggaggaattgtctcgtgcaagcggatcaatcgctctcagttatggggcccattccaatctttgcgtcaatcaaatccgtcggcatggcacacccgtgcaaaaagccaaatacttgcccaagctgtgctccggcgaagccattggcgcattggcaatgagcgaaacgaatgcgggttctgatgttgtttcgatgaaattgagtgcacgaaaaactggcgacaggcgttccttcgtgttgaacggctcaaaattttggataaccaatggacccgacgcggacattttggtggtttatgccaaaacaagccctgccaagcatcaacacggaattacggcatttatagtg

SEQ ID NO: 89867 - DNA, 542 bp, Heterodera glycines
  SCN-specific regions: Sequence locations=1-7,29-37,59-111,133-451,475- 542
ttgaggcattaatattacttttgttgcaatgctgccatccaatcttttcttcttgctgatgaccatgctcagcagttccctcctccatcagacattggcaaataaattttcagcagagaccgacgcagtaaatccgacgcgattaatccagagacggcatttgattcgaagccgcgcaactcacaaagaaaaaatgcactcgaacgtaaatgaaggctatttacagtgggaaaaggataaattccacgaagcactgggagaaaagattttgccgaagagttcccgatctctgatggaccccaagtttttgggatcggtggaaccgcggcttttgaaaacatcggcggatgggacgcggacaaaaagcgattcggaagaggaaaagtggcggaattggctgcgcaggcatttcccagctgcgagaacaatttctgatcagtgatcactgatcacttttcattttatcaaatgcaaatgatcgctcatctcacctttttgaattggatcggattttcaatcttcaataaactttatttattagc

SEQ ID NO: 89868 - DNA, 138 bp, Heterodera glycines
  SCN-specific regions: Sequence locations=1-138
cactttcggctcgcttggcagagggcgtcagggcatttgatgacaccgacggaagagagaaagacgaaatttataaccattttttgaatttgttttgttgtgtcttctctatttttctttttgcttaaaacacacacg

SEQ ID NO: 89869 - DNA, 622 bp, Heterodera glycines
  SCN-specific regions: Sequence locations=1-517,539-622
attcgaataaaaatttctgtccgattctctctgaaatgactacctccgatgagaaacaacttcaagtggttgtggcagccaacgagaagaaacaaattaagaaatcggaagttgactttcccgtggtattgaagcgtggggtgcagggacgtgtgaaatggtactcgcccgaggatgcctatgggttcatccatcgttacgacgtcgacgaagacattttcgtccacggctcctccatcgtccgcttcaacattcgcaacaaaaaccagcatcccgtccttagcattcagcaagaggtggaattcgatgtgatcaaagtccgcaagggtctcgaggcgcgttgtgtctctggcccgggtggccgacttgtcggacgcttcttcaatattcctcgtcgaagtgtctcgggtgctaagaatcagaaacatgccgtcaacggtggtttgcgttcgattcgccgacgcagcgacggcgaagccatcagaagaaggagaagggacgcgtggactccaacaaaaaggcagcggttgagaagaacactgaagacacaacggcagacttggccaatatgcgccttagtgaggacaaaaatgacagtggcaccgtggcggacacggaggag

SEQ ID NO: 89870 - DNA, 676 bp, Heterodera glycines
  SCN-specific regions: Sequence locations=1-676
caagtttgagcaaaatgcgattggcttcgttattttctgttctgctgtttttattgttcatccatcgaacaattccctcaccttcgccaaaatttgatgaagccataaaagacaatggcattttcgcattcgattcgtccgaggacagtgccgaggaagtccctccttcgcctgcttttgccgattctttgcggtcgcctcactcctccgaggccgaggaggacggtccatctgctgaagaggaagaacagtttgtggacaatgtggccggatggcggccacgtccatctttcctgccgccttttgctgttcaaaatcgatgcctaaaagccaaattcttcgattcgaaatcggacgaatgccgcccttgttccatttgtgggcccgacctttatgagcgggaaaagtgccgtacggacagtgacaccgtctgcgagtggtgcctgaccaatttgcgagtgattgtccgcaacagcgactttcgcgtcaaatgtgaacagctcattgccctccgtgaccaattccgcgcggcattggttcaacattccgttgttgagggaaaagcgaagccaacgatttattcggtttcgatgttcgaaaatgcctccaaactgtggaagatcgagttgtttgtggagatggctttttacatcactctgattgccctcgtgttggc

SEQ ID NO: 89871 - DNA, 276 bp, Heterodera glycines
  SCN-specific regions: Sequence locations=1-276
gcggatggttcaattatgagcttcaaggaagctcgtgatgcgggaatccttcagcttcaattcgacgggctggaaaccagactgaacgaggcatcggcgctgggagagatcaatccgggactcgccgaaattctcgtcgctccatgcggcttgtcagacaatggtctgccattgtcattggtccgcgcgtttctcaaataccagtcagtcaagggtcgcgtggacgatgtcaatggagaagtcattgatccggccaccgggcttggaaagtccatt

SEQ ID NO: 89872 - DNA, 550 bp, Heterodera glycines
  SCN-specific regions: Sequence locations=1-141,163-231,253-550
tgaatccgtctgtcaacaaaattcacttctccaaagatgaattggacaagattttgagggatgctgacgagcagagggattttcccgcgttgctccgttcgcttggccaattggcttttcgtcccaccgatggcttttccctcccttcgtccgctctctcccaaatggcttcccattttgcttcgcttagccctttctccgcttttcactgggccaatggactcttcgctttgctcccatcagcagaaaaccatgccaattccgaagtgctcattgtttcgcttcttcgctcgttggttgacaatgtgccccttctgaatgccaacaaattgcgtgcctttgtcaaaactgaaatttcgcggcaatgcgtctcattttggcaaattgggaaagcgcatttggcatccgcactcactttatgtgtgctacgaatcttgctgatggaattgtcctatttggaggcaattcaaaacggagtctgtcgtgccgatttaatcgccgaagcgcagaacatttggtcgcaaatgctttctgctgatgaacttttgaa

SEQ ID NO: 89873 - DNA, 908 bp, Heterodera glycines
  SCN-specific regions: Sequence locations=1-358,380-671,695-908
cactgattcaccccgaaaagatgcgattagtaactgctctgctaaaattcattgagcaaaggaaatccatccaatcggacgaacactttgactctgccgaaagggaaaaacagttcgacgaattgcgcgttgaaatgggtgaagccaaaataacagttgaagatttgtccctaactttcgcggttaatgctcccgctcgatgtttcccctacgaatgcgttgaattaattccaaacggcgcttcggttgaggtgaatggttccaatgtcgaattgtacgtgaaaaggcttgtcgactttcatttgaatgaaggaatccgtgagcagcttttcatgttccgcttcggcttcgacttggtttttcctctttcatctttgacttgctactcgaccagcgaacttcagactttgatctcgggagaacagagtccaagatggacacgagaagatttgttacggtattcggaaccaaaacttggttacactcgcgactcagtcggttttctgaacttcgtcgaagtgctcatgggtttcaattcggcggagcgtaaggccttccttcagtttacgaccgggtgctcttctttgcctcccggtggcctcgccaacctccaccctcgtctaactgtcgtacgcaaagtcggttctggagatgggtcttatccgtccgtcaacacgtgtgtgcattacttgaaactgcccgagtacagcagtgccggaatactcagagatcgtcttttggcggcaacagcagaaaagggattccatttgaattgaacgaattggcggggagaagcggggacgagtcagaagccattcattttcatcaatattttccattattatgtgaccacatgactgtataatatgattcttgatcggtgatcaattaaacagataatttgaaaa

SEQ ID NO: 89874 - DNA, 1100 bp, Heterodera glycines
  SCN-specific regions: Sequence locations=1-221,244-275,297-681,703 -892,921-1100
ctcgactctctattgaaacgcgcgccacggcaccgtcgaagcaaaaagcaccgacggagcagaggacatcaccacgccgaacaccagcatcaacggggggatgtgttcggaggggaagccgaccaaaatggacaatttgcttcatctggaccccacgcgaagtcatttctgacgcgactcgattctgcgcattcgccgggctctccaaattcgcggaattctttcatgcaaatgatggtgttggaccgaagcagacagccttcggccgatgtcattgagactgtgtgccttcagaacggtgtgtgcacttgtgccgaaacgacctgcactttgcgctgctcttcgtgtgcgcgactcactttccgagagatttgcctgaatatttattcacctcatggtcaaatgcaaaagtttgcacttacctttcggcttaatccaaactctgtgcctcaaactgtgaaaatctctcagtcctcagctgagtacaccgttttggagaatgtgagagtcgtcgaatggcaaagttcgtcgttggatcgaccagaattgttgactgttgggtcagaaagtgcaatttcgcctgtttgaatctgctgaaagagaccaacggaaagtcgccccgttttatgctaatcggaaatccgcaaggactttttgacgagggcgaactcagcgcagatttggaagaacgaggcgaaggcacagtttcggaaaacagtggcagagcagcggacagaatggtccggacgcattatgtgatgtatgacaacgaccgactgctgagaagcaccgattgtcacgagcttttcgggagggtggcagacgaatcatgcgaaaatgagaaggaaacggacggaaaaggaagaacggaccaccgatttgaagaattttcttaaaattataaatattttcaaaaatttccatgccttcggcgccactcactgagagatggacgaactttgacattggtagcatggactttcgaataatcacatatttttaacttttcctctttatctcaattcaatgatcttgtttttctaaattgtttttttccgttcactttcgcatttttaacacataaataaatgtcaaaattt

SEQ ID NO: 89875 - DNA, 861 bp, Heterodera glycines
  SCN-specific regions: Sequence locations=1-646,674-725,747-861
ttgagaccctccgcttccgtgaataattatacaggaatgaatgtcaatgacctggtaaatcagtttaaaagtgccgcacttagtgtgggtgaatatttgacgccggttttgcgcgagtccaaattccgtgagactggagtgcttactcctgaggaatttatcgcagctggcgatcactttgtccacctttgcccgacttggctttggtcaaaggccagtgattcaagcagagcgcgcgattatttaccaattgacaagcaatttctgatcagcaaaaaagtgccatgccatcatagatgttcagaaatgaactacaacgattcattggagaagatcatcaaggaggagggcgacgaatgggtggacacgcaccatttcgacacccaaaccaatttggcaccaaaagaattggacgatttggacacgattaacacagaagagaatgaaaaagcaacgacgggtgaaagcgaagaaagcggggaggagggagaagcattcgaccttgatgaatacatcggaagaggcggattggaggacgaggacccaaacaggtatatagcaaacactgtagcaaaagtgccgaaagaggctgctcagaatgagtcggatgatattggcattttacggactcgtacctatgacttacacatcacttatgacaaatactatcaggttccacgctcttggttgattggctatgatgagaatggcacgcctttgacggtggcacagatgaaggaggacttctcacctgaccactaggaccgcacaattacgctcgagtcgcacccccacgtgggcgacctttgcctggccaccatccacccgtgccaccatgcctctgtgatgaagcatctcatc

SEQ ID NO: 89876 - DNA, 612 bp, Heterodera glycines
  SCN-specific regions: Sequence locations=1-237,261-476,498-612
agaatatgcaacaaaagtgcactttttcgttgattactcaagacaaaacggaagttgttgtcccttctgactttgtggatcagtccgatatgttgtcggattacgcaaaaatgcaacgtcagaacaacggagacgcggaggaattgcaagcgaaatttgaaatgaccaacgaaatgccattgatcagcaaattccacttggaaatgatcttcgaattcctcggcacttatcgagaggagaaacaaaaggaaaacgaaggggcggcggacgaaaagcaaacgacgaaaagcggcgaaagagcggccgaagcgacggcggaagaaagtgccgagttgtcgaccatgccgaagtgggcgttcgatttgttcgacaaactgccgaaaaatgaccttttcctggcaatgaatgccgccaattacttcggcatcgcccctttcgtttcgcttagtgccgcgttcgtttgcttccaaattttgcagaaaaaggggaagagggaagtcgcggaatatttgaacatggacgagaacgacaataacaacaacggcaaatgattgaacattcgcaatgtttcagtctctctattcacgattttttcaataaaacaaaataatt

SEQ ID NO: 89877 - DNA, 609 bp, Heterodera glycines
  SCN-specific regions: Sequence locations=1-117,139-200,223-455,479-609
ccaacacgaacatgaaacccgcaattattactgcccttttaattgcgtttattctgcaccaaattaccgccgtaattgaaaatgaatgtggacaatgcaaacattgtctggataaaaatgattgttttctcaacatgatcactgcttgggctcagaatggcgaaatcgaatggccacgggtgttgggagagaacccaaatttgtggggaaaggaacaaaaagtgttggccgatgcgaaggcaaccgaagacaaacagttccaagacccgaaatttgaacaaaattttaaggcaatgaatgccattggtatggctcatcgcggtgcctaccattacttcagaggagagccgggaagtgccggtgccttggagcaagtgcggcattttctaaacacaagcataagggcgggattcaatgtgcacaaagactttgctgtggtcaatgttgaaatatataagaatgaaggtgcagacaaggaccaattcacgggaaagctgctcaattttgtcaagttactaaagagcaaagtgccgaaccttttcatccacaccagtgtcgatcattggtcggcactgatcaacaacgatcatgacgagttcttcgctctgt

SEQ ID NO: 89878 - DNA, 874 bp, Heterodera glycines
  SCN-specific regions: Sequence locations=1-12,34-60,82-874
gagatctcggcaatttattttttaaatctgtatgtcttcagtaccgcaattatctgcttccgaacacaaagaacgaggaaatcgttattaccaagcaggaaaatatgaggaggccctttctcactacacccgcgctattataaagaacccgaatgatccgacttactttacaaatagagcactttgcaatttaaatcttaaaaaatgggactccgcagcggacgactgcagaaaagcgcttgacatggacagaaagaatgtgaaggcgaattactacctggggaaggtgtacgtacaccagggacagtttgatgaggctatcaaagtgctgtcgcgggctcatgaaggcgttctcaatcttaagcaaacatatggcgacgaaataacccaattgttacggttagcgcgcagagaaaagttccgtcaagaagaagacaaacgcataactcaggagattgaacttcaaagttacttaaaccaattaattgacgacgacatcgccaaaaaagtgaaccaattggaggacaaaaaggaaaatgacgttgaagaaaaggcggaagaactgaagacacagggggacaccttcaaaaaacagctgaacaatctctttgctcaggttgacgatcgtagacggaagcgcgacctcccggactatttgtgtggcaaaatcagtttcgagctgctcaaagaccctgtaatcactccttccgggatcacttacgaccgacaggacattctcacccatttgcaccgagtcggacatttcgaccccgtcacccgggttcctctcactgccgaccaactaatcccaaatttttccatgaaagaggttgttgaccattttgttcaggaaaacgaatgggctatagatttt

SEQ ID NO: 89879 - DNA, 1000 bp, Heterodera glycines
  SCN-specific regions: Sequence locations=1-121,143-356,378-398,420 -883,920-1000
gagaaataatacataatcaattaataatgtgtcgatttcaatgcgatcaacaatgttgtcccagcaaacaaacatacacagcaaaggataagctgaaaacggaggagcagcaattctcacggaacaaaaatgtgaaatttttctcgcccgactcttctgatgaaagtgaggatgacgagcatcataatcatcatcatgacaatcatcatctgctgcggaccaaaacgaacctttcgaattacaactttttacaatcatgcgaagacaattttttccgatcattcgatgccacaaaaattgccgacaatttttgccatgacagtgactcatcgctgtcattatcatcagcagcaactgaggaggaggactcggaggagtacaacagccagcagagtgacagtgaggaggacagcagcaaaacaacctcatcatccattgacgggtcaacgacgacgttcaaactgaaatccattttgtcaacaagtgccaagaggagtccaacagctgagaagcatgcttacgagaggcgtgtcagttttgcggaccgctggggcatgcaattgacatcgtttcgcacaattccgaaccgttttgctgatcggttttatgacgaattggagctggacttcaatgaagttaatttctccgacaacacatcatatttttggtgccaatcgcttcagcagcagagaaacaatttgcaaaactggtcattagatgaacaaggagaggtagcctgctgagaattgcttaaattcggctggtagatgaacagaaaacagatgggctatgacggacgggcaacactttaattaattaaccctgcgcaacattctacacaaattttcattgattttgaagattttacctacgttcatttagcatttttttatctatttttttattagtataaaaaaatctttttaccgtagatcttacagtatcttttccattgcaattactgggagtaccgtcttttctaaaggatttgttgtcaacg

SEQ ID NO: 89880 - DNA, 595 bp, Heterodera glycines
  SCN-specific regions: Sequence locations=1-595
gtttgagagccaattcaactccaaaagccgaaaatgtctcctgttattgcccctttcgtcctcgccatcattggcatcatcgccttgcccaccatcgaaggcgcagtcgggcgtcagcaagtcaagctgggcgagcagtacaaatacgagaatgtgcccggcaaattgatggtcaagcgacaaactgcggccagcaaggagccccagtatttgttcgccggtcaaacggcatggaccacggacggaaaagaccgctttggccatgccgagttggacttcgccactggcacaatgaccatccccaacttctccgagaacgacttgggctcctacaccttcccgcttgagcagcccaacttcagcgcagtgaatgggcccaacggatgcgagctgcagggtgtcggcgggacgatgttggatctgatcaaaaaagaatgagcgaagaacagcgactgatcggagggaagagaagaatggtgctaacgccggaatgacactcttttcaattgcattttaagcatttagcattaattaacactttggcatttgataatccagggataaagaacggacaaatcaaaaaaaaaaaaaaaaa

SEQ ID NO: 89881 - DNA, 480 bp, Heterodera glycines
  SCN-specific regions: Sequence locations=1-480
cgaactgttatttattgagacaggccaggctgctctgcgtcgaaatatgtctcacaaaaacgcccaccgaggaccggttcctctctgttatctaaatataacgaaacacggcgtgtaatcctcaaatatacgagccgactaccgcctgtcctaatagaatggacgattgctactaatgaacgatctcctttgaaaggttttacggattcgatggacaacagacaggattgacacttgacaggagacaagagagagtgagccgcatagtaaaattattcgcgctttgcgtagtattgtgaacaatcgtaatttattgatttttttttaggtttgctgcgaacgcacaagtaaaacgtaacagaaaaatctttttgcaccgacttggaactttttgttgacactgttggaaaaagtttctctgaagacagttcaactctagtagggctggagggtgctttattaaaatttgctttaaaggaa

SEQ ID NO: 89882 - DNA, 744 bp, Heterodera glycines
  SCN-specific regions: Sequence locations=1-2,38-44,67-95,119-148,170 -221,254-521,548-628,650-677,699-744
agtccaattaagcttttcttttcccattcattctcttcgcctgtatatttaaaatgatttccatgatcaacaaattgctcgattggatccgttctctgttctggaaggaggaaatggaactgactttggtggggctgcaaagttctggcaaaacaacctttgtcaatgtcattgcgagcggacagttcactgaagacatgatcccaaccgttgggtttaatatgcgcaaaatcaccaagggaaacgtcaccatcaaactttgggacattggcggtcagccgcgcttccgttccatgtgggagcgttactgtcgcggtgtgaatgccattgtttttatggtcgatgctgctgacaaatccaaactcgagccggccaaaagtgagctgatgcaattgctgagcaagccccaattggaggccatccccgtgctggtgcttggcaacaaaaaagaccttcccgacgctctcgacgagggccaactaatcgacgcgatgaatctcgagtccatccaaaaccgggaaatctgctgctattccatctcctgcaaggaaaagtcgaacattgatatcactctgcaatggctgatccaacactcaaagacggcacgttgaagaattttggcaccgatcttcgtcaatttccttaaatattttgcactttttcatctccccatttcattttcctaaaattacttttttcttatttgattttggactaaaccaaaaaatattacggaaacattta

SEQ ID NO: 89883 - DNA, 628 bp, Heterodera glycines
  SCN-specific regions: Sequence locations=1-4,27-394,416-628
gtccaattaagaaaagtcctttcacagtgctcatcgtcatcaaatgttttgtcagtggagaattaaagttaaaagcaacaacttcttgaattcgttttctttttactgccaaaagcagtgtctcttttcctctcaagaaaagtgcaacaacaaaaacaaatatttgcccgacgaggatggaatcgtccgttctgaatttcaatcagtgccgattcagtccgaaccttttaccgaaacacttctgaatcgaattcgacaattttccgctgaacaaccaaaacgagccatttttgtcgatgccgaaaacccttccaacattacaacgtttggccaatttctgtccaagactcactccgccgctcactttctcaattccattggcttctcctccggcgatgtcgcctgtgtcattcttccaaactgttggcattttttcgccatttttttggccgcttccatgcaaaaggcgtgcatttccccggtgagcacacttctcaatgaagtcgaactggcccgcatctttaatgaaacaaagtgcaaaggggtgttctgtgccgattctctgctcgaacgaattttggcgactcgtccgctttgtccccatttaaagtacgttgtgctcatttcc

SEQ ID NO: 89884 - DNA, 312 bp, Heterodera glycines
  SCN-specific regions: Sequence locations=1-24,50-169,191-289
tatacacaatgtctttaattaccataattaattaatcaattaattaatttttcataatttgttccttccattgttcgcttctcttctcaggttgattgatcaccgccaccacacatacacactttccgatcacattttgctatatgaattccttcgcttatttaccatcaaacaaaatatgcaattttttggaccaccaatttaaagcacatttattttcatgatttaaataaattttccaccaataaacaattttgctttgcttttttctaaagaattataaatctttaaaaaaaaaaaaaaaaaaaaaaa

SEQ ID NO: 89885 - DNA, 599 bp, Heterodera glycines
  SCN-specific regions: Sequence locations=1-449,471-502,528-599
cactgttgtggatgttgcagaagaaactgttgcacaatcaatggaccaattagaagaaggcattgaagtggggacggtcgtcaacgaagaaatggcacagaatgtgccggaagagcccatggcatcagtgcaattggcgaagcggtcgaagccgttcaatcagaggattgtcgagaacatcggatggcgaaaggaatttgggcgggttccaccgaaggaaagggactctttgggactgatcgaatgcattgatggcgcaacggtcggatgcaaccaacggcttctcgcttctctgaagagttcaaacccttcattgtttttgagaactgataagtttcgctcgagaaatgcgtgtggcaataaaaaaagcgaagtgagtctacaaattgatgaatttgacgaattctacaaacgatggatttcaaattatgagcaagagggagcggggaagagccacggagaggagaacagtgaacacgatgggaaggaggaaagtgaaagtggagacgaagaggaggagccaccacaaaacagccgaggacccgtgatcaaatgcccacggatgccaaagataagaatcaatttgaagcgacgtattt

SEQ ID NO: 89886 - DNA, 704 bp, Heterodera glycines
  SCN-specific regions: Sequence locations=1-61,83-552,596-704
catgaaaaagcaacccagcgcattgcttccacaacgtcaacaattccgccaactcaacccgccactgacccacaccatgacctcgcttgccaacttacacaatgccaccgacgatgaccatttcggccgcctactcgaatccagtgtccagtccaatgtggtcgtgctcaacttccacgccgactgggccccgcaatgcaagcaaatgaacgaagtgtttggcgagctggcaaagttgcacccggccgtcgacttcatttcgattgaagccgaagagcttgtcgacacctctgaactctttgacattgctgccgtcccctcgtttgtcgtgctcaaggccggcaaacccgtcgaccgtgtcaacggcgccaacgccatcgaactgaccaacattgttgaaaagcacgccaaggcggccaaatcgcgctcggcgggcgccaacgccgacttttccgacacggcctcgacggccgctggcggcgccggcgccgatgcatccatggccgccgccccactggcgccggcggccctcgaggcgcgcctcaagcagctcatcaacatggcgcccatggtgctgttcatgaagggtaccccacaacaaccgcgggtgcgggttttcgcggcagaccattgagttggtgtcaaagtacaatgcccggtactcgacgttcaatatcttgggcgacgatcaggtcaggcagggc

SEQ ID NO: 89887 - DNA, 521 bp, Heterodera glycines
  SCN-specific regions: Sequence locations=1-178,200-314,337-467,489-521
gcctttgttttgtctttgccgagcacaaatggctctctgcgtggcgatttatgataagcatgatgccctcctctatttacgcctcaaagatcgaatgtccgcttctcccttggaagtccaacgattcctgcacagttcgagtgacattgttgcggacaaaatgaactcccctggtaacaaggccacccaacaagaaaattttctcggtgcacttcttttgagtgatcgctttcggtcattagcttatctgacaaacaccggtacgaagttccttttggtcatcgatgcggaggagggcactctcaaagatcacgaaattcagctctttttcaaaaacattcacacaaaatattgcagcgccatttcaaatccgttttattcgtttggaagtactttgcaatccagtaaaattgatgccgtcgttaacgaactgcttacatccttttgactgttcagaaaagcagtaattgatcacagaaaagagaactattgcaaataaatataaattattttcttttgaa

SEQ ID NO: 89888 - DNA, 592 bp, Heterodera glycines
  SCN-specific regions: Sequence locations=1-88,116-164,194-432,455-592
gtttgaggaattaaaaaaaaacaacaaaaattgttgagccatggaaaatgcggacgaaaagccgccgccggtgacaagcagcggcggcaccaatgccgccgccgccaccgctgcgttagcaatgcaaaaaattgtccaacaacacgcagcaaccatcgcgaaccaagtgcagcaacagcagcagcaacaaacagtttcttcttccgctgtcgtcgccccttccgtgggcatcgcttcattaccccaataccatgtgagcgcgccgcaccagaacatgccgggcagcaagtaccagcaactgttgctgttcatcgatgaattggggcgtgtcatccgccccacatacaacgcgaatcgcaacgcgcaggaacgcctgaagcgtgacattgtgcaggcgcggctgttggtgcgcgagtgcatggccgagttggagcagcagcgcaagcagcagcagacgtgacaggacggagatagagagaaagacgacagacaaattaccgattgattttttaatgtattgattgaccagttttgtaccaaaaatcttctcttttttctggattgatgcacaacgatgggaattgttcaaaaa

SEQ ID NO: 89889 - DNA, 884 bp, Heterodera glycines
  SCN-specific regions: Sequence locations=1-884
aaggtttcccacattttcaaccgcaaaagaaatatcattgaattggagttgcgtcagacagttccgcttcaaaaaggatgtcagaattacaccggccctctcacaatcgttgatcaagagcttgaaggtcattttgctcacactatccaaatagacgccgccgtttctcgccacgacatccaatgccattcgaaggggcgtaaactaaagaagaaacggataatgctcgggaccggagaagaggtcgacgtcgacctaaactcgatggacttcgattcgccagtgctttggattagagtcgatcccaatttattactttatcgtcaaatgtcaatcaaccaaccgttttatcaatgggaacttatgcttctccatgaaagggatgttctagctcaacaacaagccattgaaacactttgccgtttttccgaacacaaaacaaagatacttttggaagagacagtccgaaacgacaaattcttctaccgaattcgacgagaggctgcccactgtcttgtccaaatttacaacagtctccccgaaagccgtcttggcgagtctcccccactcatcgattactttcgccagaattttgggagtaaaacttcgcctgacattccattaccaaataattacgcggccacttcctccaaccttcagaacaatttgcttggacaagctttgcccgctgctattggcttaattcgaggccaagacggaagagagtgtccggaatacgtgttggaattcatcatcaacctgattaggctcaatgacaacagcactaaccgttattctgacgattactacagaggagcactgatccacgcacttggcaaaactttgacaatgtctgaacggactgttgaacaacccgattgttt

SEQ ID NO: 89890 - DNA, 769 bp, Heterodera glycines
  SCN-specific regions: Sequence locations=1-31,58-127,151-268,290 -520,543-769
aggaaatgcactctaaataattaagtgaacctgtaaactttttaaaaatttctttatccttttttgcccaaaaatgactgccgcccgtcttctaaaaatggttccatccgaaagtgccttgttggtctgtgacatgcaggagaagttcagggagcacatcaaattctttccgcagattctgcaggtcacttgccgcctcattgaagctgctaaactgctcgacatgaagattttggccactgagcaaaacccgaatggacttggccacactgtgccagaaattgtcctcaaaaagcatgacattcccgtctttgagaagaccaagttttccatgtgcgtccccgacctccaacgcgaactcggcctctccccggccgttcggtcgctgcttctctgtggcattgaggcgcatgtttgcgtttaccagtccgccattgatttccaacagcaagggttcaacgtccacgtggtggtcgacgcaagttcaagccgttcaatggtggacaggatttatgcctacaaacagttggagaaagtgggcatcaatctgattaccagcgaatgtgccattctcggcttggttggcgacagtgcgcacccaaaattccgtgaagtccaaaaactgatcagagagagtgcgcccgacacgggactgatcagcaacacttcgcatgtctgatcagcagatgatagatctttccaaggactgtgatgagacacaaataaattttaatatgaaattcgtatttattttctttttattaataga

SEQ ID NO: 89891 - DNA, 863 bp, Heterodera glycines
  SCN-specific regions: Sequence locations=1-73,95-390,413-564,588-863
attctctcctaactaattaatcttcaattttcctgctgtgtttattgttatgtttcaatattcgccttgcttaatttagtaattaattaattcattcgtgtaaatgtatcgccgtgtcttttgttattcttcggctcctttggccggtgcccttggcgcatacgctggtgtgacgatggcaaaccaaaattctccatcgacagaaaaaaacacaagcgaagttcagcagaaagtcgcaaagcaagcagtcgtaaaaagtggaactcacaattctcagcctaaagatgttcaatcgcttggcaccggtgaaataacgcgatgggactataattgggacaaaagagaccctttttctatggttattggaaaggaatacgaagcggcggacgaagaaaagaaaaaggaaattcttgccaagtttgttccgaccgcaacacggaacattttcctgatcagacacggacaatacgaattggattcaaagacgaaggagcttaccgctctcggacgtgaacaggccgacctcttgggaaagcgattggcggagttcgaagttggcaagggaaagaaaatcaacaaatgttttgtgtccacaatgaaaagagccgaagaaacagccgatattgccttgaagcatttgccacacgccgcacaaatccaaaaacattcggatttgctgagggaaggggcgccttgcgaaccggaaccgcctttaagttcatggagaccgcagtattacttccacgaggacggtgctcggattgaggctgccttccgcaaatatatccatcgcgcctcgccttcccaaaaggaggactcttttgagctgttcttttgccatgccaatgtgattcgttactttg

SEQ ID NO: 89892 - DNA, 605 bp, Heterodera glycines
  SCN-specific regions: Sequence locations=1-582
actttccgttgccctttttgacccccccccctagggctttttctgcttcccttttctccctcaaatcacttcccccaatgatttgccccaacttcgttcttttgtcccttttatccgtctctctgttcagttccctttcattagctgataatcagaccataacagtgcatgggcaaacgatttgtcatcgtcgaagtgtgaagggactgcacgttgaactgagagagcacgacacatttgatcccgatgattcgttgggctcgacaacgacaggcttggatggctcgtttaaggtgcgcggattggaaaatgaaatcggctccatccgtccctatttgagaatcacccacaaatgcgacgtgaaggacgaattgaaatgccgtcgtgtaacggagatcgacatccccaaggagaaggtgaacaacgacgtgtacgagatgcattttgtgaatttaaatgtgcatggccatagggacacagagaattgcgatgagtgaccaaaagggaagaaggaaaagcgaaatttgaacagatcaattgtaaatcaaattcaaaatgaactgatcaagggaaatacacatcatttaaaaaaaaaaaaaaaaaaa

SEQ ID NO: 89893 - DNA, 628 bp, Heterodera glycines
  SCN-specific regions: Sequence locations=1-230,252-628
atttccaatggatttgctgctgttcccattccctgggtcaatgatgtcgacaattttgaacttgcaaaattcgattattcgcctctccctaaatttgctgaaaatctgccaaatcgggtgttttgcaattgtaagggcaccggcggatgctcggctcagaaaggctgcgcatgtgtcgaaatgagtaccatcgaactctcagaaccaggtcgtgtgcacaatgcccatttgctcagtgagaatgcatttgagtcgcgcttcttcgagtgttcctcactctgttcgtgtgccggcacttgtgccaatcgattggcgccgcaaaacgacgcgcagcggaatcatttgcaaattttcaagacgctcaaggccgggtttggatgccgtgcactgaagccgattcggaaaggcagtttcatttgtttcctcggcggcgaaatctttcccttcgattatccgtccaaaaaagcggaggaattcaaacaaattgtcgatgctgacaaagtctgcttcgccttcagtgacaaagtgcgtcaattcgcctttttcgtgcgatttgaccgattcgcaaatgaatcgcgcttttttaacagcgcctgctgtcccaacaatcgtttggtccatctcttcc

SEQ ID NO: 89894 - DNA, 687 bp, Heterodera glycines
  SCN-specific regions: Sequence locations=1-687
aataaagttttgccattgacactttcagcaaacaaacaaaaaaatgggcagcagtgcctccgaatcgccgccaccgccaaaacttgtcgccatccaagacttgcccatttacaaggccgagtccgtcccggccgtacgtgctgcacggcccgtcgacaccattggcaggccggccacttttggtgaggaagttttcggcaatttccgcttggttgcgctccaattgagggacttcgtttcggaaaagttgggcgttgtcaacagttcccttgcacccataagagacgcggccaacgccactgaacagttcatccttgacgagcagcgcaaagtgttgccccgtgccgtcgccatttccatgggcggcatggccggctttgtggcggccatgcgaaagggcggacggatgcgccgcacattttatcctttgattggactgctgacaatgaccgccttttgctacccaaatgagacggtgcactccgtccgcgttggcattgcccactcgcagagcgcatggcacaacttcaagcaggcgcctgaaccgaagagcagttgactgatgaacaattcaaatttgtgcatcgtttttggccattgtcaaggggtgacgaacacacacattttaatgttgtaggatttaaattttaaattctgtttttcggtctgataaataatttcaattaa

SEQ ID NO: 89895 - DNA, 625 bp, Heterodera glycines
  SCN-specific regions: Sequence locations=1-177,214-339,364-388,411-625
ctttccgccatttcccttaattttcccgcggctcttccaaatgaaagccggcgccgaatgataaaagccgaagtgtcgctctgttatttgtactcatcgacaaatgccgccgacttcttggccaaatgcctttgtaagcaccgcaaacgaaagaaatgaacggcgaattgtgccaacccaaagcagcagcaccagcagcagaaacagaggcaggcacagaagggttgcatcgtcaccagcagcaccgatcatttcgtccggcgcttctccatcgtcttcggcccctctctttggccatcgtcgtcctcccccgtcgccttggccatcgtccccatcgtcgtccccccgatttccccccttttctcgggtctctgctcataatcgcctcctccccctcccgcttctccttctgctaattcttccgatggccttctcctcccttctcattcattctgcaaatgccctccaccatcggcacgaacacccgcaaaaatgttcaattgagggcgaaatttgcacaacaattaatgctcatgtgtgccgaaatgggacctgtgtgtccgcttgcactcttcgcggcatgaaagagtgccattgcgacgtggaggaggacaacttttgcttt

SEQ ID NO: 89896 - DNA, 611 bp, Heterodera glycines
  SCN-specific regions: Sequence locations=1-68,90-611
gtttgagtaaaattttctatatattttgtaatgtcttggcctgatcttgtcaacaacaatttgatcggcactggtcatgtttctaaggctgcaatttgtggcttggacggttccatttggggaaaatcggacaattttaatttggatgccacggaagtaacggcagcgatgaacggactgaagcagccggatgctgtgctcgcctctggacttcgtttcgaaggagaaaaattttttgttctgcaagcggacacggatcggatcatcggcaaaaagatggccaccgggttcttcatttacaaaacgggcaaagctttcatcatttcaatctatgagggtggtgttcagcccgaaatgtgttcaaaaacgactggtgccttggctgactatttccgaagcattaactactgatcgatcgggaccgaaccaattgtgacccaaatccatgtttttgtagtgcctgatattcataaagcacatcgaatagccttccccgtccctaattgtccctaattggtttgatgctattaaagacaattaactgattaatgataatctaattgacaataattaatgcctttaaatgccatccccatccaccgttgttaata

SEQ ID NO: 89897 - DNA, 641 bp, Heterodera glycines
  SCN-specific regions: Sequence locations=1-233,258-586,608-641
ttcgcaatgagtgccgctgcgacccaacgtcttcaagcgaagcggcaaactttggacgaggcttatgctcccccagccaattttttggagatcgaagtggtcaatcccatcactcacggggtcgggaagaaccgatacacggactacgaagttcgactgaggaccaacttgccggtgttcaaacacaaagagtcgagcgtccgtcgacgttactcggacttcgaatggctgaggaatgagttggagcgagacagcaaaataattgtgccgcctcttcccggaaaagccttcaagcgccaattgcctttccgttcggacgacggcattttcgaggagggcttcatcgaagaacgccgcaagggactggaacagtttctgaacaaagttgccggacatccgttggctcaaaatgaaaaatcgcttcatatctttttgcaaatgaacgagcttgacaaaaattacgtcccgggacgcattcgtacggcctgaccaactgacaaactctgcgaatttgccgtttgcccattctcgaccgattaatgtcatcgggttttccttcgtctttttttgttggctcccgccctcatattattattttattgacttatctccaacgtcactttctgaacattacttacgtc

SEQ ID NO: 89898 - DNA, 555 bp, Heterodera glycines
  SCN-specific regions: Sequence locations=1-114,137-201,223-430,453-533
ccaagtttgaggtaaatatcggtttatttaatccaacccattaaataacccccacgtaagaattgaaagaaatggcgcccaaacaaaggatgagtgtggccaaccaacacttcagcaaaaatgtggtggcccgcggtcaggtggccaagtcattgaagcccaaggaaaatcagtacccggccgcgccatggctgatcggcattttcgtgttcgttgtttgtggctcagcagtgtttgagatcatccgatacgtgaagttgggcttctgatcacagtgtgattatatgtgtgtgtttggcattttgactgacggacggacgagtgtttctttttttcttggtgttgtcattggcgcattgtttggcgggaaatttggactggacacacatttaaatgaacaaatgatgatgatgaccgataattggttgacttccctttaacttctactctttcgttctctctgtccattcatttccatccatttgtttcacaatttcctaacaaatcgccaacagaaatttaattatttctttaaaaaaaaaaaaaaaaaaaaaa

SEQ ID NO: 89899 - DNA, 830 bp, Heterodera glycines
  SCN-specific regions: Sequence locations=1-104,126-511,535-582,606 -757,781-830
cgaatggaacagtcccattgggttcgttcctccgttcaccgatccattcatcagttgctgctgttgactgtgctggtgatggttttgcccgttgttttgccattggtggtggtgcttctcctgttgctgctgtttcgtcgcgctgtccaccgaatccaaaaatgccatgccgtaaaattgggcccgctctttcaaatttgagtacagtccatccagcagcgatgcccgagtgcgttccgccaatttggcaaatttttccgccttataagccgcgttttccgcattgatcagtttggtgagcaaaaagtcgcgcagttggcacttccaaattatggaagagcgcggaagcgtcgggccaaagaacggcacgtcgtctcgcgctgtcatcgacacgcggtaacgcgtgcggtcagtgcccggctcaatgggatgaaccaccaaataggcgtggagaaagttgctcgcgatcatgtccggacagaagggtgtgttctgctcttggaaaacaatggccacgatgtcgttgccaatgtgccgcttgcgctgcaattgttgcgcgtcgccaatgcaaacggtaccgtatgcccgccccactctgccccaccgaacctcggtgcccgactgtccatgaacggtgtccagtccgccacgataaccgtcaaaatgacgcaactgaactcggtggccgatgatggagagaaattcgtctaaggccgcgcagttggaggagtcgttgctgaacagctcctcctcggtggtctgcccaaacttttggtaaattgcacctgtgaaaggggggcaattaattgatcagtgattctattttgagt

SEQ ID NO: 89900 - DNA, 678 bp, Heterodera glycines
  SCN-specific regions: Sequence locations=1-170,193-678
cagaacatacgtttttgcaaggtgctggtcagccggactgctcacacacttcggatgagtattgtcagctcccttattacaccgctatccacgaactattccctccagagcgttctcggtgggtgccgctgcccacccaaccgcccatcgccagccctctgtcagtgcgactcgtccagcggcaacatctacctggaaaccaactgaacctaaccatcgccatccaaggtggcactgacaagttgtcattgcatatcactccgctaaatggcttccaattgcgacattggtcattgacgccttttgatcctgccacttttgggatacgcaaaacgtactttgtgtttatgacttatggatttgaatcgcccggagaacgtctcgtttggattctgcttgagaataatgaacgcagtgttagcgcgacggacgaagtgccgagtttggaattggcagttgccaccaaatatgtgcatggaaaaaatcaaaactcggacaccttgttgcagttgcgttcgcttattgccaacagacggcggacgcctcacgcgggcgttggtttttggcgttgggccatcacaatgattgcgggtgtgtctgagattgtcatacatttcttctaattgccaattgtcttgccaaatactgatgcgcattactggatctaattcgcgactt

SEQ ID NO: 89901 - DNA, 1024 bp, Heterodera glycines
  SCN-specific regions: Sequence locations=78-1024
gacaaatttgtcaagcgttgggagcgttctcccgtcggcacttccttggccattcctcacattcctatggcggtgccttccatttcgcccctcgggcgtccccatcctccgccccctccccgctctccaagtcggccatcgtccaaacattcctttgcaggcgaccacggttcattattacaaacttctccgatcaaccgaattgtggacgaggagggccaagagtgggaggtggaggaagtgcagctggacgtgtccaagacgggactcggattctcaattagcgggggttgcgaccgcgagcctgacttgatgtataacgaccgatacattcgcgtgactgacatttcgaaagggggcgccgtggagacggaccgacgcattcgcatcggtgacgtgattctgttcgtcaacgattgggagacggccaacagagagcacgacttcgcagtgcaagcactgaagaacgcgggcacttttgttcgactgttagtcaaacgcctcaaatatccgccgctgcaaaaatcgctgagtcaaagccatttgagtgagcccatcgccagcggcaccttccaacggtcgttgagcggaggcgcggccgacagccgaacattgcctctgcagccccccgtccgttcccaatcattgcaccatttgccgatgaatgccgtcgcaacttcgccaaatgttgtcactgcgatgggcactttgccaaggcgggcgaatgtacagcagcaatttgcaacgccactaaatgacccgggcagacagccgagatgggttgtcatccgaaaaggcgaaatgggcttcggttttaacattgtgggcggcgaagatggcgagcccgtgtacatcactcgcgttgcacccggtggagcggcggaccagaccggcaacattcggatgggagacgtattgctgcgtgtcaacgatgttgacctgtcaatggctacccatggagaagcagcggtcgccctgaaggcgattccgcagggggcccaagtgaaactgctattgcaattca

SEQ ID NO: 89902 - DNA, 864 bp, Heterodera glycines
  SCN-specific regions: Sequence locations=1-249,271-471,495-618,640-864
agcaaatcgcaaggcaacttttcatacataatttgcatatagaattagccatgatcttcaggttaggcaattttcgacattttcccgtcaatttttgcaagttgtgtattgctcgtttcaccgtggccttttctcgccgtattttccgtgaccatttttcgctgtttttgcgcagcaaacgaagtttgctctttggcgcttctttggtcggcgtttcgttcggttcaaatgtgactttggaagacgaatacaaaaggataaaaactgagtgcaaagaatgcgaccctttttcgcctcccccaactgacgaaggttggacactcttttggtgcaacaaaagtttggcggtgtaccggcggagatttgtggccaatgggggaaattgcgtgtttgaataccgatgcattggcacttacgaagacatttcacccaacgattttgtaactgtgcaggaggacatttcctgtcgactcaaatgggataaaaatgtgaacagcttggacgagttggattttgattacaacacggggacacaagtgattcggtgggagagcaaatatcccttccccctttggccacgcctttacattttcgctcgtcgccaattcgttgatcggccaaggaaacaaatttatatcttaagcagagcacttagcagcgacaatttcccggacccttcgcaaacgaccgtccgagtggaatgctatgaatccattttgatagtgcgcgcacacgacagtttagacaaaaaaggtttggactttgtgctctcttattacgacgacacgcggtcttccatcccacagaaaatctaccaatacggcattaatgttattggcccaagctttatcgaagatgtgcaca

SEQ ID NO: 89903 - DNA, 680 bp, Heterodera glycines
  SCN-specific regions: Sequence locations=1-98,120-680
ccaagtttgagatgatcgtgataaatggtgcagcgcaatgttctttttcagcttcaaatttacccagtatttctgagtcaaaaaatctaaaggccgttgcgaaaaatggggcgaaacaaacaataagcagttttactgagttgtttgatgagctggccgagtgccaatggtattggggtggcatttccgctggcactgcttctcgcctgctacagcggcgatcccccggcacttttctggtgcgcgactcgcggtcggacagatcgatcttctctttttcttacgccaccgcctccggcgtttaccattcgcgcatttaccgattcaacggctatttttgtcttggcggtccaaatgctttgatccgttcgccatctttgcgcgactttgtcctccaaaccgtcgctcgttcttcggttgacagcggagaaacaaactgcaaaaaaacaggtctatcagcaacgacagcaagtcgtaacgcggagctgccacttcgaattttgatgcacccatcgtccgccgaaccgacagcgcaaccggtggacattcgtgttccattgtgtcgcaacaacttcgtgcccactctgagaggcgcttgccgtttggccattcgtcgctccatctccgactgttcacgaatcgaagaattgccaatccccaaaaagctcaaaaagtttctt

SEQ ID NO: 89904 - DNA, 654 bp, Heterodera glycines
  SCN-specific regions: Sequence locations=1-11,33-519,541-632
gtttgagatgcttttgtctcctccactgctcttcgtgctcagtctgtgttcattgtgcgtctttggccataaaacgccgaatgcgtcggatggcccggcaatgccggaactgccgaaagcgctgcaaaagctgagcgacgcggagaggaactgtttgttcaccatttacacaatgtccaaactgttcgagaacaaaaaggtgcagaaaacgctggccaaacagttaaagtcatgcgacagcaaagacacttctgagccggacatttggaagagtcgggagaagagcaacggatggtgtgaggtgaacttggaaaggatcgacagcgaatatggccccgtaattatgcacgcccatggctcaatcgcctctatcaacggcgcccgtctatttgtgaagtcgacctcggggggcatttggatagcgatttatcagccggaatgcctaaaagagaaggatgagtcgaaaaaatcggaggaaggtgttgtgagcaacactttggaccgagtccgacgttgggttttgttaaaatgagaagaaaaggaagtgaaagccgacggaccaacaattataaattaacagacaactgctaatgatcaatgattgattttaagtgtaaatttgtttcaattggttttttaaataaaaattatttt

SEQ ID NO: 89905 - DNA, 825 bp, Heterodera glycines
  SCN-specific regions: Sequence locations=1-9,31-154,176-742,764-825
cttcatttcaatatttttattttttattttggaatttcctctatcaaattgcccaataatctgtggcttttcctatggcttctcagcccataaaggcggttttgttcgatttgggcggagttgtggtggaatacagtgaccgaaatgcgtatttaaaccgactcaaaatcatccaatcaaatgccaaatttgtcgacctatttgaacagttcgagtgtggccttctgaccatttacgaaattgagcccgaatttcttaaaacagtaatgggaaataaaagcggagatgacctaattaaggcggctaatccgactaatttgatgaaaacgaaaaatcctttcgttgaaaatgccattcgctcacttcgttcctcgggcaaatatttggttggccttttgaccaacaatggattttgggtgcgcgacagatcggagtcgaagttgaccattgacacttccgacttcgattttgtcatcgaatcgtgcaaaatcggcgcgagaaagccaaatgcggatttctacgagatggctctgcttaaaatgggactgtccgcggcagagtgcgttttcatcgacgacctcgaagaaaattgcaaaggtgccgaagcggtcggaatacgaagcatttggctaaaggacgacgactacaaaacggccatcgaacaattggaagaaattatcggcgagaaattactttaaattgccattcttttgtggcaacattttgtagttaaatggtcaattttttaaactaatttgtggcttcctaagcttgtctgttgaacattcctttgttaattcatctaaatcatattaacttttataa

SEQ ID NO: 89906 - DNA, 1048 bp, Heterodera glycines
  misc_feature (206)..(206): n is a, c, g, or t
  misc_feature (220)..(220): n is a, c, g, or t
  SCN-specific regions: Sequence locations=1-1048
caactcgccgtccatctgcttgttcagtacagcacaatgttggacatcaccgccagggcttttcagcgtcctttcgccattgcttttctgatgccttctcaacccactgcaaaaaatgtcgaagcgttccaacaagcggcggctgaactgcttatgccaatcatcgcctgcaacaaacgttacgtccattcgattttgcgtcaagncgatgctaatgctnttcggaacgggaccagcagaatgtgcagtcatactattccacttcagggaacgcacagcaaattgtgatcgtgtcgaacaaactcaagtccgtggttcaaaagacaaatgcgtggtttgagcgtgtttcagaccaattgtgtgaaagtgacgggtcggcggacgaatgcttttgcgaatgcgctggccccgaagagtttcgccagttcgttgttttgcttgcgcaaaaacactcgtcctgtgcgcttctgaatctcatggaattggcgccttgcaaagacgtcaaattaaaacactcaatccaagaggcgtaccttcgtttgacagacacagaagtagccaaaggtctgctgttctgtggacagacggctgtggtgcggagcacttttggggcaaattctgaacttccaaggcatgaaactgaggaccccaacagaacagaggaagaatgtattcctcttgtcgtggccagagaaagcactctcaaaacactttcatatcgtctattacggtgtgtctatcctttgctgactggtgaacgaatagtaattttggcgtcaaaacagcgcgtttcaaccggggttgaccttctcaacaagttgaactcaatgcgaatttgtcgaaggccagagggcgtaaaatggaatttcgattctgacatcgacactgaatcaaataccatgtccgacaacaacacacactgtcaattgtttggtatttctcgtgaggcgaacgcgacttcgcagtggattaatggcgagaagtgcgaacattgtactgtcgttgacttgggcaaccaaaaaatgcgggcccatgaatactcgggccg

SEQ ID NO: 89907 - DNA, 532 bp, Heterodera glycines
  misc_feature (486)..(486): n is a, c, g, or t
  SCN-specific regions: Sequence locations=1-68,90-144,166-469
gaaagacaaaacccatcatttaattatttccactggcacaaatgtgccgcaattcgtcgcccccatttgttcttttcgttgttttgctggcactcgtcccctttttgtccaccggtggaatgccacgtcatcgacggcaccaacaaaaggaagcaatggaaaatgccggcggcgaaatggctgacgacagcggcgacacttcggcaaattgcagctacacggacccgtactgctacaactcggaggcgttcatcgacgcggtgccaataaaagaagaaaaagggacgaaatgaaagggagagagaaggcaaatgactcaattttgacgataaaaggcattcgaagtgttcttctgtatcatcaaaattaattgatatgccaattgattagctaatttgtgtcttcttaatgacttaagccatggcatttccatttttgtcgcgtttctttccaattcccccccccccgcaaaaaaaaagcaattanaaaaaaaaaaaaaaaaaaaaacccaaaaaaaaaaaaaaaaaaaaaa

SEQ ID NO: 89908 - DNA, 611 bp, Heterodera glycines
  SCN-specific regions: Sequence locations=1-361,383-440,462-611
gaaaaacaaattatttcgtttttttttaaattttctatttcaaaaagaaaagacaataattccaatgaaagatgaaaacgctcattttactccacagcaaatttcaaagctgttaaatctacacatcaaaagtcacaaatgcctagatgttaagtgccaaactgaacgacaacagttgcttagcaccatagagaagctggcaagaaatttttacgacatttacaaaatgtttgaaaaacagaaacgtgagatgagcagaattagcaatttatacaaggatttctgtatacaatttggtctgccggtgaaaattgacttggtgaaacaacaggaaatcagtcagatcgacaaagtcgctaatatgatttaccaacattttataaaaataagagaggtcaacaagaaaagtaaagtgcatccaaatttcgatgagaacttgcaatcctctggattgacttccatcaatggacaatgcaaaaaggacttttctggtctgagcaatcgcaagaagagtgggtcttcttccagttcaatagtggctattgacaatgagaacagtgcacaaaaaaatggttgcgaaacatcgttacgggagacagacaatgggaaaa

SEQ ID NO: 89909 - DNA, 636 bp, Heterodera glycines
  SCN-specific regions: Sequence locations=1-121,144-355,377-476,498-636
gaaataaatgcgtaattaaaaacggaaattaaaaaatggatgaagaaaagctgaaaaacgaagtggccaattgcatccgctccttccctgactttcctacaaaagatgttgtgtttagggacatttttccattgttttcaaatccgtcgctgatccgatcaatctgtgcccacattgtgacactttatcgacaaaaaattgatgtggttgtggcgctagaagcccgaggatttttgtttggcccaattgtggcgcttgagatggacgtgccatttgttcctgttcgcaagcgtggaaaactgcccgggtccgttttctcggcgacttatgtgaaggaatatgggcaggatgtttttgaaatccaaaagaatgcattgtcagagggacaacgtgtgctgttgttggacgacttattggctaccggtggctctttgaacgcggcttcccaactcataagccaatccaacgccaaaacgcaggctgtgtttgtcatcatcgagttggaaggacttaatggacgccgaaagatggattttgatgcggaaatcacttccttagttaaatacgcttaaaattgacacaattttttttttatcagatatcattttttgtttttatgtttggcatacatttttt

SEQ ID NO: 89910 - DNA, 599 bp, Heterodera glycines
  SCN-specific regions: Sequence locations=1-560,598-599
tgatcaaaaatgcgttccatttgtttctgccatttttcggcattccccttttctcgtcaattcttcggtggatgccatcgctctttttcatcaccgatgacgcccttatttttgagcttttctcttctgctaatttattcccagtttgcttctcctacaaatgcatttattctgcaggaattgccattgtaccgtaacgttcgcaatcagcgacatgccactcccccgattggtccgtcaaaaccctccattgactatggaattcgtcgttcgactgtctctatgcctttggtgatcagaattgaggacggaatgccaaccatttttgtgcgtccctcgcgggcatttaatttccacagattgaatcgcttgcaagaattctggcaccgaaatgaagcactgagaagattgacccaaacggggaacagaccatgaaatgatcagcagagaaagaaaaagaaaagaaatcggatgatcagacaaattgaaaaggaaggacggaagacaaacggacaaaattgaccacacacatttaatttgatctctttcatgcaatttggaatatttaataataatgttaattaaacattaaaatttgt

SEQ ID NO: 89911 - DNA, 601 bp, Heterodera glycines
  SCN-specific regions: Sequence locations=1-308,332-578
atctcaccaaaatcagtcgtctgtgccacttcaacgggctgttgcgtctgtttacaatgctaattcaatttcaacttcgtccagttcaactaaacatgcagtggatttgataaacgaatatctgacaatgctttccgtctgtctctcccatgatgaattgaacaaattcgccattttaatgcgccgttggcgcgcacgtgaaatgccaattttggagttcgcccaaaagctgctcgagctgtatgggccggagaggcggcaccttcttgcacgaatgcgcactttgcttcgcggcgacccttctgacttggaagcactgactgattttcttcgtgccaacggagtggtggagaacgcagcggcaatggccgcgtcgccacttttgaccgcggaaataagtttgggagaggggacggacagtgccaaaagcacggccagttccttgccttcggcaccgcttcatttttcgtcttcgcatggttttccatccgccgattttcaccgacctaattcatcataacctttcctgaataatttacagctgtcaattaatagttaacaataaattttaacattccaaaaaaaaaaaaaaaaaaaaaaa

SEQ ID NO: 89912 - DNA, 663 bp, Heterodera glycines
  SCN-specific regions: Sequence locations=33-472,547-547,652-663
cctcgtgccgaattcggcacgagggtccaattaagcgtccctacccaaatgaatattgtgtgtccgtctcaccctgaagcggatttggtcgaagatgccagggccggcgatttgatttgtactcgctgcggtttggttgttggagaaagactaattgatgttgggactgaatggcgttcgtttagcaatgaaagttcgggaaaggacccctctcgcgtcggtgcccctgagaatccgcttctttctggctccgacttatcgacttcaattgccgtttctttcggatcggacagtgatagagctttggcaaatgcacagaggaagcttttgagcagcaccgatcgacaaatgacacaggctatgatggttattcgtgaaatgagcgagaaaatcaacttgacccggacaatccaagacagagcggctaaactgtacaaggaggtcctcgagtcgaaagccctccgcggaaagaacaacgaggcacaggcggccgcttgcctttacatcgcatgtcgtcaagagggggttcccagaacgttcaaggaaatttgtgcggtgtcaaaagtgtcgaagaaggaaattggacgctgtttcaagctcatccagaagaccatggagaccaacttggaccacataaccagtgccgatttcctgtcccggttt

SEQ ID NO: 89913 - DNA, 1280 bp, Heterodera glycines
  SCN-specific regions: Sequence locations=1-334,363-384,413-814,840 -1039,1089-1217,1240-1280
atctttttgcatccccgtcctgacatcatggacgatttgtgccgtcgtgggctgctgaccacggaacaaaccccgcacgagccgtcctccgcagacaaatttgacggagcggatgaagcggtgttggccctggtggacaaataccgacgcacttgcggactgccgaccgccaagcgcagtgcgccctcaccgctcaattcgctgctgtcgccaggcaaactgccgcccgccggaaagccgccgacgccgtacatcccaacgccaggcggttccgctgggtacgcgccggccgcgttgctcaagcaacaacagcgcaacgcctcctttgggtatcactcgaacagcagcagcagcaaccaggacgactggcaggcacttcttcaaccaccgcctccaccaccgccgccgatgccttcgttgtcgtcagtgcagactgcgcttagcggtgggacaccgcgcggtattctgagccacgcgtcttcggctgctgctgcggcgcataaacgtgacactttgcgctcacccgggacagaggcgcgacgaccaaagaatcagacactgttcaaaaatgcgctggagcaaatccgtaaaatcaatgaggagtcaaagtcgggcagtggcactgtgccgtcagcgacttctgtttcggatccgtttccatcatcatccattcctccacttaaaacgccgtctccacttcgtccattgatctcaaccatttctgcaacttcaactgaacaacaacatttgccagcacctcctgtgcctcccaatcttccgcgtgacccacgactgctcaaacatggcaatgccaccgctgccgccgtcgttgttgttgtagacaagccaaaccaacaacaacaagttcgatgtgccacaattcctgtcgatgctcgccccaattctgtcctatcgccgccttgcgacccacgtctgaagcgcatcagtgctgaagcagtgcctgtttcgtcgccctccgtccttccgccactaccaaagttcaaggcaacggtgcccgtgttgaatgtcaggccggtgtcctctgctgccgccgttgttgtaccaccgccgccgccgtcaccaccgccaaatgtgtctgttttcaagcaattggtgccatctgctgcttctgtttcgacgacggcgccggcaccaccaaatttgggtttcaaacgcgcatatggccttgtcggaatggtatcttccggcattgatataccgccaccaccacctccgccagaacttgcaccgccggaggagaaaaagatgatgttgcagcc

SEQ ID NO: 89914 - DNA, 779 bp, Heterodera glycines
  SCN-specific regions: Sequence locations=1-223,249-668,690-779
cataatttaagctatttgccttttttaacattattgggccaaaataatggccagacagcaacaatccacggcttcttcttcttgttcgtcatcatcgatgtgctgctgcaatgcgttggccaaaatgcatgaaagttttgtggccaaatttcgtgtcatccgaccgcaggccaatctgatcactttggacggggacaacaacaacgacatcattctccatgaagaagcagacgaagatgaagcaatagctcagccctgtacttcttccgccggacaacagccgaggccgattggtggtggtactgctgacgaactgcaacaggaggcggaggacaacgaaagtgttttgctgaacggcgccgaatcgccgacccccggcgccggcactttgggctacgaaattttggcggaggactccaaaacgccggccccattctatgaaatgatgagcgaaagtgagctgaatgccgaacttgccaaatatggccatggtccgatgggaaaacgtgcggctatccgacttttgaaccgaatttatgaggcaacacacccagtgatttcaagcgacacgccaatcccgcggaaagttcggcgcgcattggcgacggacgacggctgcggcgacaaaaatggggcggctgaacggcaacgggaacggaggaccaagcagaaaattggccaaatgttgcggttggccaacaaaaatgccgagacggagacgacagggaattatgccaagcaaaacgatgacggtggcggcgatggatttgccaacaatg

SEQ ID NO: 89915 - DNA, 282 bp, Heterodera glycines
  SCN-specific regions: Sequence locations=1-255
atttggaactgtccgaatgcattcccttcgatttgtttcatcaacaactcattttcatgctccgttcctctctttcaaaacagcaacgaaacattttcaacgcattgaaaagttcagcggcggtgagaaatttcctcgtcgatttttatttgaataatgtcgactgattggattgtccttttcgacctcacaatcagccttaacattgcacttcacgttaatatttttcttattaattaatacacgtttacgttgaaaaaaaaaaaaaaaaaaaaaaaaaaa

SEQ ID NO: 89916 - DNA, 730 bp, Heterodera glycines
  SCN-specific regions: Sequence locations=1-268,290-730
caagtttgagttaaaaattatggaaaaaagtgccaacaatttttcgaaaatattgtggacacaaaatgagcatcgtttccaacaaatttgtgctctcccatttattcgtgaacaaaaagatgggacacttgctgaggaacgctatcgccactacataatacaagacacactgttcctggagggattaagcagtgccatcgctgtggccgcttcaaaggccactgatcacccaaaagggcacgagcgtgccatgcttttgctgtcccatggcattgccattttggacaccgagttggacttgcacgatggcattctgcgcaagttgggcctggtcagtcgtagtgaagtgcacatgaactacgaccaatcgccagtgtgtcatcattatgtgtcctttctggcagcaacagcatcacaacaatctttgccggtgattgtcgcgtcaatgttgccctgctattggctctaccgcgaagtgcccaaatggatgttggcagaacgccaaaaagccggcggcacaaacaccgtaactcagtaccacgaatggattgacatgtactgtagtgaagagtatgccgaggcggtggacgaaatgttggcacatgcggatgaattatcgcaagaagcggatcagcggacgctcgcgaaaatggccaccgtttttgagcgcagcttccaactggaatggatgttctggaagtccgcctatcaaatgtgccaatggggaatt

SEQ ID NO: 89917 - DNA, 728 bp, Heterodera glycines
  SCN-specific regions: Sequence locations=1-529,552-728
ctttaatttaatcctttcttccgcttcgaattagcaaaatgatttcgtccaccgccgtgcctcgcccccttcgctcttcgaatcaacaaaaacagcagccaaacgcactgaccaaacagaacggtgctcatcagcagaagacgcctatcaaagccagggaagacagcagaaacaggaacgacgcattgggcgcacagaaaccaaacggtcattcgccgcgtacgccgagcgttccgccggtgaataagcgatacgctcacgtaaaaagcaaagtcgggtcaatcactgagtacactccgtcgcccagtcgcgtgaagattttccacgagtctgtccgagtcagcgccactcccaaagtcggctcactgcaaaatgcgtcccatgtgcccgccggtggaaatgtgacgatcgagaacagaaaactcaacttccgggaggcagcaaagccacgggtggaggacaaatcggaagtgccaattccaaagagtgagaaaaagattgcgactcaaaagttggaatggaaagcccagcccaaagtcggttcgttggacaatgtgaagcacaaacccgcggggggcaacctcaaaatattccacgagtcggtgcgggtgaaatgcgagtccaaagttgggtcccttgacaacatcggacacgtgcccggcgggggcaatgttaagatttcggattacgcacgcagtgtttcccgcagcggtgatggctgcagacgt

SEQ ID NO: 89918 - DNA, 810 bp, Heterodera glycines
  SCN-specific regions: Sequence locations=1-267,291-440,462-810
ttgagtttttttattttattcttttcttgccaaaaatggtcgacgttccggctgattttgctgttctgctaaactccgcgccgccaattagccgaattgagtcaaacaaaatgcattggctgcgaaaacggcaacagacaaatgcgacggcattgcaacgcggcatcgatcagattggccaactcgcgacggagagtcgaggtttgaagcgtccggtgaccagttttgcgcgttttgcggattctcccgacgaacaggcgctgtatttgctgtgggaaccactcacttcggaccaaccgacggcaaacggagggccgtcctcacggatttatggatatttaaaagtcgtccgggaccgacgattgtatttggtggacggagaagggcgacagttcgtcacgacgcccctttgtgttttggactttttcattcaccaatccgtccaacatcagggcaaaggcgcccaattgttcagagcaatgctaaaggctgagggcgatttgggggcccatcgctgtgcctttgataagccatccgacgtatttctccactttttggctcggcattttggcctcgaaaggcccctttggcagccaaattcttttgttgttttcccctcattttttgagggcattaagccagaaaaagtgtcttctgctggggacgaccgactgcggtcgatgaccgcgctggagagacaccgccggtcggtaaacgaacagtacaatgggcagccgccgatgagcagccgactgtcgccgctccctgctgcccaacgtgaccaggcgggcgcactgatccatcagcagc

SEQ ID NO: 89919 - DNA, 580 bp, Heterodera glycines
  SCN-specific regions: Sequence locations=1-558
caagtttgagcattatgacagtaatccgtgattttttgtgccgttcgtcgtaccaatcgttggctcatttgtgccgtaatcaaattcgcgtttattctgtagaaagggagggggcgggcacggcttcgggcattgaacacgcgctcaaattcaacaaagcgggagcagtgcacaaaaaagagttgaaggattacaaatgcgtcgaatatcttcaccaaaataattattccttttatgacaaggaggtgggaaaattacaaaaaatataacggtcaaaatatactaacttaagccttcattgaaaaaaaatacatattcgggttcgaaataatttaatgccatattcatgatcagcgctctctaaaacccttaaagcatcacaaaactgctcaaaaccccctttttgtctctttttgtgggaagtaaagccgatgattaccaaaatgacataaattcctttttaagtgtgagctgcagcaatttcgcgtggtgcaaccgacgaacaaattgcctgacaccgaaccgaagttcaaatcatcttaaaccgattgatttcatgaaaaattttgttttttaatta

SEQ ID NO: 89920 - DNA, 646 bp, Heterodera glycines
  SCN-specific regions: Sequence locations=1-17,39-646
aaaaccacttttccaagaaatggcttcttctgctgctggatttgccattgtcaccggtgccaacaccggcctcggcttgcattttgttaaatcactatatgcttccggcacttattccgccattgtgttggcctgtcgaagtgaacagcgcgcgaagagcgcaattgaacaaatttgctgtggccaatcatcgccggcggaaaatggcaacggcacacaaacaaaattagaatttgcgaagttggatttgacctgcaatgattcggtccgcactttcgtctcccaactcgacgagcgtccctatcaaaagggcagtttgcgattgctcgtcaacaatgccggcattatgggccatccctttcaattggtcgacggcgttgaggtgcatttcgcctccaaccatttgggtcattttctgctcacaaatttgctgatcaaacacaattggttggcttccgacgcgcgcattttgctggtcacttccggcctctacgaaaagtgccattccatgctgactgctgccgagttgaccaacaatgcagtcgctaaaaagcgttcgcccgccgaatattacgcgttcagcaagttggccaactgtttgcatgccgttgggttggccaatcggctcgcctcccccgccgtcgcg

SEQ ID NO: 89921 - DNA, 624 bp, Heterodera glycines
  SCN-specific regions: Sequence locations=1-624
ctttgctcactccttccgtggcttcttcttcggggtgttcttccttcacaattaacagcttcacccaaaatttggcctctgttctctctgacaccaaacggtcaaaggccgaagtcgcggctttctttactcgccattggggcgagcaattcgtgccacagaaaaccctttgctcagcaccgaccattcccaaaatttccttggagcatttccggcattatttggacaacacagcgaagaaacaccgccaatatttgcgagtgcgaaaaacacttcagcggagcaatggccatctcatcggtgagcaaatcgcaccggatgaaatcccttcgattttcttctcctccgccttttcataccgtgactcggctacttttgaagcagttttccttgagccccgtcaaggggaggccgacaaaatcatttccggggccgagcaaagacggggggccgtgggtattggttcactttatcgtcccgcgagttgtggctcgttgagttcgatgcaaagtgtgcaaatgagcattgctcctgctgccgaggcttgtcacgggcgaatgttccgcggatgccatcggctccaaatgcgcctcgagcactttgatgatacggtcggaatgctgc

SEQ ID NO: 89922 - DNA, 740 bp, Heterodera glycines
  SCN-specific regions: Sequence locations=1-42,64-111,133-315,337 -402,424-740
gtttgagacactcgaaaaaactctctaagccttttaactccttccacttcttcttcttctgctgattttgaattaaaaccttttctctctcaatcgtttgtcctttgccaatccttccaaaagggcttttccaaatcccttttcaattcttttaaatctccaaatttccaccgattaaccacttctcactttcctctcctaaaccatccaaaaatgtcgcgcatggaaaagatttgcgaagacgtgaacagaaatgccgccctgctgaacatcttcggcaactccgattccgtgctgctgagctgctccgatttgtgctctgaaaatggctgtggtgcgatgtcgcgtgcccaaatgatttgcgaagatgtgaattatgaagcgatggccaattcggacggcgggggagggacggacgacgaagcgtatgcgctgatggaatttggcggctctcttttctgcgtgccggcctccatcttcgccaccgcggtccgcgtgccacttcagtcgtcggtttggcccaatcagccggccaatttcaccgtcggaaacccgtcgtcccaaccacaacaaggagatgtgtcggtcggacctcgcttgccggccgttcgtcacggcgtcggcggcctcaggcagtgggaaactgtcgccgaagatgtcgaaggctgctgctccacgacgtttgcggacgggccgaagtgtctttttaagttcgtcgcctcaacccccgacgcgtccat

SEQ ID NO: 89923 - DNA, 567 bp, Heterodera glycines
  SCN-specific regions: Sequence locations=1-3,25-58,80-284,306-567
aaagcttttaaatttttcttcactgctttcttagtcagtttgttatcagttgctctccatttttattttgacaacaaaacaatttttcccgctaaatttggcgaacgatggcttcttctcattgcgcacccggatgatgaaacgatgttttttggaccaactctgttgttcctttcatctatcggtgttcaattgcatttgttgtgcattacgtcggggaattctgagggacttggaacgattaggcgaaatgaattgtattcgtctgcttctgtttatggcatccaacccaaatacatctcttttgtggatccagaagagcgaagattcccggatggttttcgcgattggaatatcaccagcctttctgcgctgatttactcttacattcgacggctgaaacccgatggactgatcacttttgacgaatggggcatcagtggacatccaaaccacagagacagcttcaaagctattttgaacttgaatactgaaggcaaacttaaagaactcggcctaaaaaaggcattggcactgaagagcagtgcagttttaaggaaatatgtc

SEQ ID NO: 89924 - DNA, 1001 bp, Heterodera glycines
  SCN-specific regions: Sequence locations=1-1,30-240,262-1001
ggtactttaaaattgcactttttaaaaacccaatgccttcaacaaatgcaaatgatggcatcacttccgccgatgatgcgactcgattgagaatggttgacccggtcgatcgttattcagcattaatagttcgtgggctgatagttggaacgggtgcgcttggattaggacttttcattcgaaattcaaaattgtttgcagcttttaaccacgtgaagcaaataccgcaagattattatcagaaaggaataattatgaaaggaattgtgcgcgatttggagtcaaatggcataatcaaagtggaacatcgaccagcaattcgtattcctagactttttggtaccaaaaaatcgaaagtgggtggaaatttgaatcttcgcttggctggaattgaattatcccctgttggaattgaatatttgcagaaggaaatgcaattgaaaggacgatttgtgaaattttctgtgataaaattagcacaaacggaaccggacattgtggaagcggacgttaccgcaaaaaaagccatccgtcacgttaacctcaacaccgaactcatccgcaagggtttcgctcgtacgccaactctcgacaaccattggcacagagagtcgctccaattcaacacgaattattcccgactgatcaccaggctgttgacctgtgagaaggttgccgaacgtcgcggacttggcctttgggaacgcgccacttgggttgagcgtgttcagtcgtacccatcgacggcagtgcaaattttcaaacactccgtgcccgccaaacttgcggtattcagtttcgagttgctcagagatctgtccatggttctgtactccatcgcccagaacatttattttatttgcgtggaactgttcaaatactgtgcatttggttaccgaaaattgtccatcggtatatctaaggcatttttgatctacacaaatgccaaaagacatctgatccaaattggctcaaaaatcggcgcgcgacagtcaccggcg

SEQ ID NO: 89925 - DNA, 868 bp, Heterodera glycines
  SCN-specific regions: Sequence locations=1-503,525-868
atttgatatgcaatgacaacgacaaatagcgcctccaataattacactggtgaggtgagcaaaatcgagaaaaggcagcaaacgatgcggaacgaccctttcggacaacgctatctgagggacgaatgtgctgtgtttgactacaatgcgtgggacgacgttgactggccagaggagaaggaagcagaaattctccaaaccatccaagcgcaaatggccgacgccgttcccgagagtgtgtcgttaagtcttctcgagaacccgaaggatcgatgggaggccttctttgagactcacaacaataagtttttcatggaccggaaatggctgtcacgggaattctcggaactgttcgttcggccaaaggacagtgccaaaatcaatgtgctcgatgtcggctgtgggatgggcaatacgacaattcctctgctgcaaagtgctgaacacctcttcatgtacagctgcgatttttcgaagaaagccatcgaaacgctgcgaaatgaccaaagaatttcatctgaacggtgtcgtccattcgtttgggacattactgagaatgctcatcaaactcaagtggctgacggcactttggactttgtcctttgcattttcgttctctccgccgttcggcccgatcggttgcgtgccgccgtttcgaatttagtcgcactgttacggcccggcggaatgctgttgctgaaggactatggccgtcatgaccttacccaactgcgcttcaagtcaggcagactcatccaacacaatttgtaccgccgcggggacgacactctcgtctatttcttcaccaccgaggaaatggacgaattatttcgcgaagcgggcctcgagaagattcaaaatttcatgg

SEQ ID NO: 89926 - DNA, 575 bp, Heterodera glycines
  SCN-specific regions: Sequence locations=1-50,73-150,172-457,479-575
gtttgagtcgcttttcaatttcaattttccaaaattccaacttttgaatgctttcttcgccacacaattttaaagttgcaattgtcggcgctgggcccagcggtctcacagccgcaagacaagctctgctctacggctacaaagtgcgcatttttgaaaaggaacaaaatttcggcggcgtttggcgcctcgccatctcagaaaatgcgcaaagacggcccgtgcctttgcaaagtgtgatggactgctcaaaacagctgtgtgcctttagtgaactcgccgttgctgaacattttcccacttttcttcgcccttctgacgctgtcgcttatttggagtcgtacgtgcgaacattcgaattggcacggcacatgaaacttggcacggaagttaaaacgattcgccgatcggagtgttggcaaaagacagataattagcgggggattggcaattaaaccaatggattaattaattaatcccttttcaagccgatggattgtccaatgggcggacagtgaacagccgaacaacggcccatcggaaggacagcgactggtcgaggaactgttcgatgc

SEQ ID NO: 89927 - DNA, 461 bp, Heterodera glycines
  SCN-specific regions: Sequence locations=1-461
gtccaataaagcatataaaatttgccaatttgtttcccattttggaagaaatgtcccaagatttgttcggccacagcaaaagtgaggaatggaaggattcggacgagacgggcaacgactcggacaaactcagccaaatgtatgtcggcattcgcccggtggacaaatgcctgcgaattgcctatgccaaagcgatggacatgaagcatcagaaagtgattgtgatggtggagaacgacaacgattttcgcacctacgacacgaaggaagtgcccgtgggtgaaatcatcaaatattgaacattgttggctggtcgaaactgaaaaggtgtcgaaattgatggctttccggcggcggatgatttgaaaatttaaataatgctttttttccctctctttcactttgtcatttttgatcgtttgccttttttcacatacggttttaaattattgttttcaaaa

SEQ ID NO: 89928 - DNA, 584 bp, Heterodera glycines
  SCN-specific regions: Sequence locations=1-494,516-584
gtttagatcagtttttaaaatttcatccatttgacatctatttttgaaaatcagcagtttcttctttctgtttaataatgaaaagcgaaagaaaaggtggcctcgttccatcgttgtcgtccaagcgccaacagcaaagtgtccccagccattcggttccatccacggagccttcgcctttagcttctccgtcgttatttttggcatcgcaaaatgtcggagacaagggacatcaaccgccacaaaagcacgtctacagcgaattagccttgcgcaacaattaccaaatgttggaacagagcaggacatgtcaagcggctgtcagcggaatcgccagtggcattttggggctgaccggcactttgggctttctgttctatttcctttgtgttttcttacaggcttttgtctggcaatacaagacgggctttcgatggagtgcgtttttcacgagtcgttcgcttttcctcacccattcggtcgttagtggccttttcacttatgtccttttttgggtgtttgtctacggacttgtccatgtttattagctggtttgtaccaacagtatttaattttctttattc

SEQ ID NO: 89929 - DNA, 1021 bp, Heterodera glycines
  SCN-specific regions: Sequence locations=1-4,27-423,453-777,799-1021
atttacatattttcccttttattttccatcataagaaaatgaacagtaagatgcacagatctttctttcattggacatcactactcatgcaaggcggtattttgtgtgcgccaataattgtcaatttacagagaaataaattgaaccatgacttcaaacttcgcaaaatgatgtccgctgaccttcccaatatgcctgatgaaaatctgctcgatttggttgaagctgaaatgttagccaaatctaatgatcggctttatccatttgaaaagcaccatttcggcatcaaagttaaggacgacattgaatcgaacacttacggctttttctattgtcaaaacggagtcactttccgattcagttcgagattggccttaaatgatgtcgagaccatccgacgccattatccaaattttctcggactttttaaagaaaatctcaaaagcaaatgggcgaaagacttggaaagtgtcaaggaaaatttacggtcggcaaaaacactgtgggattaccttaccattttcagagaaaaggacttgagccagcttcgcattgacacttcgaccctttccgacgacgaactcaaaagagtacttttgactccaaatgctaagagatttgtcatttcgcgagaggttctgcttgcggacagtttttaccatggcatgcccgccctgcacagttttgttgcctttggcacttcgtggggccttttctctctgctgaagaagcgaatgcccgagaaattggcaatagcaattgcgtttcctcttgctgtgattacttttgttcttctggacagagttgaccaaatcaacgaactcgccacttatgacaaggaagccgtggaagaggatgcagcatgcctttctggcgcaaaagaatatctccagtccagcattgaactcggcaaattgctttatcggttaaccgacggaaaagcgccttttgatgcgaatggaaattgcaaaagacacaaaatgaaatacaccgaccgaatgaaagcgatcgaaagcattga

SEQ ID NO: 89930 - DNA, 743 bp, Heterodera glycines
  SCN-specific regions: Sequence locations=1-12,34-481,503-743
acgagggtccaattaagtaaacttttctattttcctcgccttttccaatgtctcggcatttttccttattttccacgaccggcagaatttgtgaactacggctgcagccaaagtgttctcgtcgtttgttttgcagcatttcgccttcaacaagttcgggtgctcatttggacagcggcagaaaatgtcaaaataaacctttatgcgcactgagtgcattctcacgggagcaactcggcacttccatcctccacccggaggcgaatcggtcgacgcaaaggattgtcctaatctcgaaaatttgttccctcggaagttcagctttcggtctcgtcatggttccgctggtcacttccgccctttgggagcccatcgccgaacggccggccatcgctgtgttcgccggcgtggccaacgtttttctgttgctcttcgctttcacgccaattctgctccatttcctgaccaaacgttttgtccaaaatgtgttcttcaacgaaagggagcagatgttcaccaccgtccactacaatttcttcctacaaaaacgcgctcttcgctttaccgccgatcaattggtcgatgcgtctgagctaccaaaggacaggcgcttttggctgccgttggccacttgcttggcccactcctacccaatgcttctcccattggacgccaattgctacagcgaccaaacggcgttcaaattgctcacaaaaaacataaaattgccgacgaaagaggag

SEQ ID NO: 89931 - DNA, 873 bp, Heterodera glycines
  SCN-specific regions: Sequence locations=1-540,562-721,743-849,872-873
cacgtgtcaccggcgctcgaattgtccacgacaccgctgatttgcgtgagtcggacattggcacgcaggcggacctttacgagatcaacaaagtgggcgatgagtactttgcttggatcacatccgaaaagaccaccgccgtgacggtggtgttgcgtggaccgagcaaggacatcatcaacgaggtggagcgcaacattcaggacgcgttgcactgtgtgcgcaatgtgttgactaacccgcgtgttgtgcccggggctggtgcgctggaaatggcactttcgcatgctttgttggagaaggccaagtccatcccgggcgtccgtgccggcccgtacaaggcggtggcacacgcgttggaaattgtgccgcgcacactcatccaaaactgcggcggctcctccaccatacgtcagctgaccgcactgcgtgccaagcacgcccaacagccggacaccaactggacatggggcatcaacgggcgggacgcgggcggcgagttggtcgacatggcgcagcccgcgggcgtttgggactcactcactgtgcgactgcaggccatcaaaacagccattgagacgtccattatgattttgcgcatcgatgacattgtcagtggaacgaagaagcgcgacaaagacgagaacggaggcggcggtgcaatgccgggtcccggagggtttgaataatagcgaagaaaggcgaaggagaggaaaggaacttcccaattcaacatatttaaagaagtggccattttgttggattgaacaaatttcgaaactccaaaatgctgttgaccgtttcatgctttacttatccattcaatcacaaattgaatttgctttgttttgcctaataaaatttgtttttgtt

SEQ ID NO: 89932 - DNA, 641 bp, Heterodera glycines
  SCN-specific regions: Sequence locations=1-346,369-641
cttttaaatcgcacaaaattcctttggctattgttggcaaaggggcttgtcggtcagtaaacgaattcgacaagattcgacagctcggcgaaggcacttatggcgtcgtgtacgaaggtcgtgacaaaaaatcagggcaaacggtcgcacttaagcaaattcgccttaacttgaagaaagagggcgtttccgtgtccgtaatgcgtgagattcaatctctgatggacattgagcatgaaaatgttgtgcgacttttcgacgttgtcgtggggcgaagaattgaccaaattttcttagtgatggaatattgtgaccaggaccttgcctctttactcgacaatatgaattctccatttaccgaatcacagattaaatgccttttgctacaacttttccgtggtctccgtcatttgcacagtcgtttcattgtccaccgggacattaaggtttcaaaccttttactcactgaatttggtgctctaaaaatcgctgattttggtctcgcaagattatgcggtgttccgccaactgaaatgactccgcgagtcgtcactctttggtatcgttcgcccgaattattattcggcagtaaattccaatctccggcaattgacatgtgggcctgtggctgcataatgggc

SEQ ID NO: 89933 - DNA, 716 bp, Heterodera glycines
  SCN-specific regions: Sequence locations=23-198,220-326,348-716
acaaaatgaaaatgggtcaacaatttatcccagcaacttcttcaatggctttcttcgcacgaaacgtccaattaagtggatcttcaaatttatcggctaaattcgacataattgacagacgtattgcaagtttagagcagagttggcgtaatgccatgcccatctcatcaaattctgcaactgccggcacctcggccatgtcttttgattatgcagagaaccgatttttgctgtgtggcaatgctcgggggaatgtgtcggtcgtcgatttcgagtcattttccaactctctgtcaaatgccgaagtttacccgaggcattacgtcgtaattaacaccaataggaaaagtcatcacgaatttatggtcaatggatgtcaatggtatcccgtcgattcaagcatttttgcaacgtcaggaagagacaaattgctaaagatctgggatgctgatcagctcaagtcggtggaaaaatttgcattcgagcagcccatttccagctttcattggttcgttccgtgcgattgcaactcttcgcttattcccattgccacttcctcgtcaaatgtcgttttgttggacccgcgattgggtaacactgcacaacaaattcgctgtttgcagcaacgcatttggtcagtccgctgggaccgtttccgtgactatgttttggtgactgggagcgacagtggcgaaatcgctttgtgggacattaga

SEQ ID NO: 89934 - DNA, 659 bp, Heterodera glycines
  SCN-specific regions: Sequence locations=1-12,34-182,205-255,288-659
acgagggtttgagaaagtgctttactaataaattattcataatgaaaaggccttcttcggttgtcgcttttggtagtcatttatttgtcggctttatcctgttgtcgcttttcattggcactttgggcactgagaaaaaagagacgaaacctgccgctgctcattctcccgccgatgccaaacatccgccgccagtcgccgcccacgcggccgctggcgccggccacgcctccgatccgaaacacgcttctccttctcccgctggggctgctgctgctgcttcccacgctcatccgcccaatggcggcgccgcccacgcggccgaaccaaaacatgctgcggctcccgctatcaaaataactgatgaggccaacaatgtttactcggtgtgtgtggagagagacgttctgccggcgccggaaaatgcgtcaaaggacaaattgaaggcaatcgctgcgaaatgcgacgaatgcggggcggcaaaatgcaaagcgaaatgcgggggcaaagaagtgaacgacgcatgccgaacatgcattatgcaaaactgtccaccggcaaaataaaaaatagcagaaatgaggagggaaagaaaggcaaaaacggcacggaaggaggacaaaatgatggcacgacgagaaggaatggatgaatgaatg

SEQ ID NO: 89935 - DNA, 514 bp, Heterodera glycines
  SCN-specific regions: Sequence locations=1-123,148-240,263-364,386 -399,421-462,484-514
caagtttgagctattcagttctgatttgcaatttgttttattaccattctcaacaatgccgaaagcttcgaaaaacaaggaccccaacatgccaaagcgtgcccaatctgcctacttcatctggatgttggccaacagggagaagatcaaaaagccggggatgagtgtggctgaagtggctaaagccgcaggtgtcgagtggggacgcatgtcagcagcggacaagacactttgggaacagaaggcggcagacgacaagaagcgctacgagcaggaaatgactcagtacagagctcgccagaagtagacgattgggcagtgaatgacgttttatctttgacttccttttccgctgttctctcctatatttaaaagtcaacaaaaatcgaccttccatttgtcgtccttttcgacattctgatttatttctctcagtttaacttttattctgatcatgtacgtatacattgcatctggaaaatgatgatcaaataaatggaaatcatcaaaaaaa

SEQ ID NO: 89936 - DNA, 616 bp, Heterodera glycines
  SCN-specific regions: Sequence locations=1-495,517-616
gagaaacttaccaatttgaaaaaattttgatatgaattcatttatttttcgtcgattaccttcattacgatttcctacggcttctatgaattttcggaaaatgttttcaactgctgcttcgtcttctcagcagttcaatgtcgaaaaaccggtcatcaacaaaagcgatatcatggagcccgaggattatgatctcactgatcggaggaaatgggttatcgaaaatatttcgaactcaattggtgatttgactaagatgatttttgcggttatttacatccaagggaaacagcacaaagtgacccaggatgacataattcacgtcgaacataacattccgctcgatgttggagaggaaattgccctggaaaaggtcctaatgatcggaaatgatgaatttacattaatcgggcgtccgttactcgacccaaaatttgtgcatgttcgggccacggttattgagaagacgaccacctctcctgaagtgcaatacgattttcgcaaaaagaatattttaaaccccgtttggctgagtcatgagctgaccgtcttacggataaacaacattcatttggataaaatgttgcttggagagacttgaacaatgagaatgtct

SEQ ID NO: 89937 - DNA, 679 bp, Heterodera glycines
  SCN-specific regions: Sequence locations=1-679
gtccaattaagttgacaattttcgaacttttgttgacgcattatgcacgagcgagttcaacaggatttccgttccagcaagttttcaacacgagccaatcaaaatgggcagcacggaaatcggagtcgcgaagttcgtttcgacaacacaaatggacgggcgtacacacgtcgcaacggcagttattcgtcggaaccgtcgtcgggtcgacgaagctccttttcccgtcatcaagatggtgctcgtacatacgtaccctccactgcagtacagcgaccgatcagcccgaatgggtgtgacagtggcggcatgtttctaatggtcgaccccttcaacattccaaacacattgggcgcccaaattcaagtatttgatctccaagagaacgcgaatttaggcatccgacatattattggttactgcattccattgcgttgctgtgtgggtctgttcaagcacattcagccatgccgtgccatcaagtcgatggaaagtcaatctatggatgaacagttcgcgcacaagtacaaattccaccccaaccttccattgagcgttgtcccgcttcacgacacggaattccatcggatgatgggctcaccggtgatgccgttgcgcgacggttatcagcaacgtaacagattctttgtgcgtccctcttccccgcggttggctcaac

SEQ ID NO: 89938 - DNA, 566 bp, Heterodera glycines
  SCN-specific regions: Sequence locations=1-364,395-566
gttaaataaacgaagtttctttaaagttgcaataaaggtgaagtcgtcataatacggggttagtcctgaaatagacattcctatgagcagaaaagaaccatattacatcgaccatcgccaagtttcatcggataatttattttttttttcggtagaacggtagtgtagattttttttgaaaatttcaggaggtttcctctgtgacgtaaagcgaaatctccaaaattttcaagagaatccgcacaaacgcactccctcaaagaataaattgttcgagaatttggcaatgcctcctgcgacttggttccctcttgctcggttcagtctaaatatggcgcagtttcttggacccagggatgcagaaacttccaagggttcccccaaaataaatttaggttcccccattttaagttttcgcagtattttgcccgacacatcaagtaacgcggtcgacagttgggttcccttaaaacagcgcggtcaatagtttggttcccccaaaaacagtgcgcttgacagttaggttccctcaaagtagtgcactcaacagtcaagtttccctaaga

SEQ ID NO: 89939 - DNA, 613 bp, Heterodera glycines
  SCN-specific regions: Sequence locations=1-369,391-613
tttgagggaatggccaaatcaactgaggaggaaagaattgcaaatgtccattttgaccttgaactggtcaattcggattttattcgaccgatgcgaatgaactttcgccggagggggcgcgacttatactgggacatggcgcttgggcacgacagtgtcgccgcactcattttccacaccgaaaggaagcagttgctgttcgtcaagcagttcagaccacctgttttcgttaacgtcgtccggtcactgcccgaaaacaaaaacaaatctctcgccgaagtccgctgggagaattatccgattgaaaatggatgcaccgtcgaattgtgcgccggacttatggacgaaccgggcaaaacgccgttagagcatatgaaaaaggaaatactggaagaatgcggttatcgagtggacgagtcgaacatccgcccgattcggcgttatgtgacgggcatttcgctgtcgggcgcaattcaacatttgttttacgttgagttggacgagtcgatgtgggaaccgaaggctggcggagggaatgagcacgagggcgaattcatccaaaatgttttcatggacatcggagaagccgaagcacttttggagaaggaaaatt

SEQ ID NO: 89940 - DNA, 560 bp, Heterodera glycines
  SCN-specific regions: Sequence locations=1-70,144-281,317-560
ttgagcactgtgtttaaataatttgaaaaaaaagttcgcatcaactaaaaaaccaaaaaataaaaaagtatttgtaacaatggcaatggctgatgttaagcccaaccatactttgtacatcaacaaatgaaaaagtgaagaaagaagagctaaagaaggcactgtacgcaattttctcacagtttggacaaatcatcgacattttggccttcaaacacttaaaaatgcgtggacagtcccatgtcattttcaaggagataaattcggccgccactgccctccgttccatgcagggcttccccttctacgacaagccgatgcgcatccaattctccagggaggactctgatgtgatctccaaagcgaaaggcacttttgtcgaacgtcccaagaagaacatcgccgtgccgaaaaagaagaaaaaacttgccgagggtccgaccaaaaagagcaaaacgtccggcaaagagggacaacagcgttcgaccgcaccgcccaacaaaattttgttcatcaccaatttaccaccggaatgtacggaggaaatgttacgcgttgtt

SEQ ID NO: 89941 - DNA, 641 bp, Heterodera glycines
  SCN-specific regions: Sequence locations=39-433,455-641
acgaggcctcgtgccgaattcggcacgagggtccaattaagatcattttctaatgacttattcgtacattgtatgtgagaaaaacaacacacaacggagcgacaatggccaatgtatcgacaatagaacgaaaatgggatatggcgctggaagttgcagaatcattcccatcggcgaactcgaccagctggaggaggaactagacccttgcctttccgcagcagtgcgacagaaaaaggagccgtcggagggattgccggcgcgtttgaagtattgcctctgctgcgtcgttgtgttccttcttctcgctctcctcgctgtgtctctcttacttttgtttggcagtgattgtcccaccaattcgcatcaactcacgactcaatttgaacaaccaaaagacgctttgctttatcaggaggaaacgcacattcgtaaagagaataatcagccaaagaatggcagcaaataccaccacgaacaattcacaaaagaagcatcccggggaaagaccgttcagccacaattcaagaaagacgaagtgttcaacaatgcaactgaacaacaacagaatgaggaggacgagcagtacagcaacacaactgtacaacaacggaacttgaacttggagtataataattctt

SEQ ID NO: 89942 - DNA, 563 bp, Heterodera glycines
  SCN-specific regions: Sequence locations=1-132,155-563
gtccaattaagatgttggaaaaacctattttgcaccgaaattatctttcttcaatctcttccgctctgctaatgagcttccaacgagcacaactacaaaaggttgctgtgcattgtgaagggacaattagaagttgtagcaacagcagcagcagttcatctgatgacactcatccaacgtcgaagaaaatgccgccatggcaaaaaaactgcgaattttgtagacagcgcacagactttcgactattggacacgatgtgaagacagtgtgatcgaaaaggaatttcaacgtggaaaaatgatactgatggtcaacaaacagccggccgtccattccgattcgttcatttacaatccgaccaccagtaaataccaaatgcaaagtgcgccacgccttcgattgttcgattgccatgaaattcgtcaagttctcagcccctacggacttgaaattggtacattgaattcggcattgttggattattatcatgacgataacgatgtcatcgacatagatttgcgcgcacttttcggcacaaacataatgttgaacgaaccgcccaa

SEQ ID NO: 89943 - DNA, 575 bp, Heterodera glycines
  SCN-specific regions: Sequence locations=1-159,184-575
gtccatttaagccatgaatgagtgccattcaccagtttttggaatggagtgcactttctgccgagttaacgttcaaatttgaaaatttgcgcaggctcctttatttgttcgtcgattcgctgtttgggctgatcattttgacttttgccacttcgcaatggacaaacatttccaccaatttttgggccgcaattcatttgtacatcgaacagttggaaacgctgatcacttggctgaccaacaaccccgcggggctgaaactgaacgacgcgctgaacacctttctggccaactttttcttctaccatatccatttgtggaaaacttatgtcaccgtttttgaacactcattgactaattggttgctaattgtcgccttcggcgcattgggcttttcggtgctcgtcgcttttctgtctgactttcttcgcgtgcttaccgtgcacattttctgcttccacatttacacgcacaggttggccaaagtctcctgcaccgcctttgtgggcctcggccgcgcctttcgcagcaaaaaatggaatccgttgagacggcgtgtggacagcgtcccgttt

SEQ ID NO: 89944 - DNA, 667 bp, Heterodera glycines
  SCN-specific regions: Sequence locations=1-546,568-667
gagattctttttttatatcattgaatcccacgtttgttcttattaatttgccagccttttcgaatatttaatggcaacgcaaaatggcgccgcaatggcaacggatcttctccaacgaaaggcttttaagattggcatcatcggcggcactgggctcgaggacccgcacataatggagcgcagcggcgaagtgcgcgtcgaaacgccgtacggacgcccttccgacgcactcattgagggaaatgtggcgggtgttccgtgtgtgctgttgtcacgccatggtcgtcgtcatcagcagtctcccaccaacataaattatcgggcaaacatttgggcgctgaaaaaggccggcgtcaatgtcatcgtcgccgcgtgcgcttgcggctctctgcgggaggaattggagcccggcaaattggtgctgatcgactcgttcatcgaccggacgacgaagcgcgagcagaccttttacgatggactgccgggtcatccgccgggcatttgccatatgccaatgcatcccgcactcaacgaacgcctgcgacgggcgctgctcgccacggcgacgcgtttgggcgctgcacacagcgaccgcggcgtgttggtgtgcgtggagggaccacgcttctccacgcgggcggagagcgagctgttccgcgtttggggc

SEQ ID NO: 89945 - DNA, 551 bp, Heterodera glycines
  SCN-specific regions: Sequence locations=1-12,34-551
atcaaatcggacaatatttttgttgcatttgcattttcgcctttatcaatggcctttcaacaacatttaggtcaacaaattctctccacttctgatttccgtgttttcgcctctccgcaactgtgccaacttcgctgcaacaacgcaaaaagcggcgcattctccgctgcccttttcgctgaaaacgatggacgaattcgacgaggacgcggcgatggcacagcgaccgatgcccaaatggaaaaaggccggacttcgaattgagcgtaactgtgccgaaaaccaaatttttctgagcattgtccaagagattgtcgacaaatttggctgggacaattccgcccacgactatgacatgtggaagaaggcatttgggcccaacttcagcatgttcttcgtcctcgaccaaaacagagtgccgatgggttgcattagcatggcattgtacccgcaggtggcacattggagcatgttctacgtgaaggacccctatcatggccaccaacttggccgtgcgctcgctcgcagagcgctggaatttgcaggggaca

SEQ ID NO: 89946 - DNA, 758 bp, Heterodera glycines
  SCN-specific regions: Sequence locations=1-447,469-758
ctccattcttcttcaaccatgcctggtgcttggcacacatcctttccaagtggccactcttcttgcactttcggcaaacggttgtttcatgtcgacaattcctcgacgaatggctcaaaccgcatcgccaacatacgcgttgcgatcgattgctgctgcgtgttcctgtcgaaatgctgctctcattcgacgaatgatccgagttcgttcgtttcttttttgccttcaatttggtcgccatcaagtttcgtgagcccatcggttgttgttcgaggacctttgcttcagcgatggtcgactggtacatttggaggtcttcgacgactccatcatactcgaccaggtcaccatccgctgcaagcttcgaaaggattcgctttctcagctcggcatccttcggtgatttcagtgccgtcaaaagcatgaggcaagaaaattgctcttcgttgagcttttcaaactgaaaatcacgcaagagtcgcttatgtctgttgataaaaggacgaaagctttcatcttcgcttttcgaggctctcagacattcatagcgatcaatccaaatggattgtggccggctgaaggcaatctttaggcgctcctctgtttggctgtagtcaaaatcgatgactttcttcggcagacatgacttgctgtactggctgaaagccacttcactcagcttcgtcatgagcagcttgacctttgcttcgtctgccagttgcggtgccgcacagtcgagggcaaaattgaagcgctcc

SEQ ID NO: 89947 - DNA, 580 bp, Heterodera glycines
  SCN-specific regions: Sequence locations=1-580
cttatctccaaggccgaccgcaagcaaatctacgagtaccttttccgcgagggtgtgctcgtcgcccgcaaggacttcgagttgccccgccacaaggacatccccgtgtccaacttggccgtcctcaaggcgtgccagtcgctcgagtcgcgcggtttcgtcaagtcccagttctcgtggcagtggttctactacaccttgaccgatgccggtatcgagtacctccgcgagtacctccacatccccgccgagatcgttcccgccaccttcaagaaggtccgcgccgctgcctcgcgtcccgaccgtcccgagcgtgatgcccgccgtccccgccaagagggcgagcgcgagtcttaccgccgcgccgacaagaaggagggcgcccccgctggcgagtacaacccgcagttccgtggcggtattggccgtggccgtcccgctgcccccgctcagcagtaaggacaacccttgcctgatgaagaaaagccttccttggacatgggttgtcgcgcgcgcgcaaggcttgtggtcgatttggtgtgatttctctctaggtggcacccgtcgtcgcttgtctttg

SEQ ID NO: 89948 - DNA, 552 bp, Heterodera glycines
  SCN-specific regions: Sequence locations=1-11,38-492,514-552
gtccaattaacattcattttgcttttttgtttcttcctacatatattccatgtaatgtgtttctctactaaaaaaaaaatgacaagttttctcgcaaaaacgaagacaatgtttgccaattctttccattgtttttctgcgtccgaaattggcgcgtttgaggcggagcattgctgtgcatgcgagaacaacgcatctttgggccgacaaattttggaaggttgcatgttccgtggactctgaaaagttggcatttcgcggacaggcgacgacagccatcggcgccgcctattggcatccgatgttctttacggaaactcgtcgttcacgcagtgcggtccaagcacatttaaaatgtgcctcttgcgggaaggaagtaaacaaagtttacgaagggacggacgacgccggcggggggtcgcgcaacgcttttggtcattacaccgacacggaaaagcggacggagctcagcggtttgggtggcgtcgcttatgcggacattgagcgggcatttgccgtcggcggcatgcggtcggggcacaggcggaatgc

SEQ ID NO: 89949 - DNA, 773 bp, Heterodera glycines
  SCN-specific regions: Sequence locations=1-9,32-86,116-195,230 -305,329-530,554-564,591-773
acgagggttatccatctaaaaatacaatgtccgccattcgtaaaaagttggttattgtcggggacggcgcttgtggtaagacatgtttgctgattgtgttcagcaaagaccagttcccagatgtttatgtgccaacggtttttgaaaattatgtcgcggacatcgaagtggatgggaaacaggtcgaacttgcgttgtgggacacggccgggcaggaggactacgaccgactccgaccgctcagctacccggatactgacgtgattttgatgtgctttagcattgactcgcccgactcgttggataacattccagaaaagtggacacccgaagtgcgccatttttgtccaaatgtgcctatcattttggttggaaacaagaaagacttgcgcaatgaccagcagaccattcgcgacctttcacggaacaaacaggaaccggtgaagtcggagcagggaaaggcaattgcagaacaaattggtgcatatgcttatttggagtgcagtgcgaagaccaaggagggaatccgagaagtatttgagaaggcaactcaggcagcacttcagcagaagaaaaagaagaagaagggctgcaacgtgctttgattgggcttcgcttctgatggagggaatcgcacttaaaatgaaaaacagaatttccttttttctttggtcgttttgtcgccattttccatcaaatgctttttgtgctaatattctgttcatgagtggcgtcattcaacttgaactttcaattaaatttgactttatttt

SEQ ID NO: 89950 - DNA, 1005 bp, Heterodera glycines
  SCN-specific regions: Sequence locations=1-125,148-611,633-742,764 -1005
gaggcaatcatttgcattcctacaaatcaatcactgatcagaaacactcgagcccaacaatgcgctgcaacttgatgttcatgactttgatgtccgtcatgttggccatggctttggctgggcttgccaacgcacaggacaatgccaatgctgaaacaggtttgcgaacagcacggtccgatcgtgttgcccttcgcaaacgtcgcttcatcggtgatctgatcgacattggcaaatttgcatttgatactggctgcaaactgttccacaccgccatttgcgacttgggcaaaaaacggaagcgtgaggccgtctacggcaaaaatgagccggcgccaaacccggcagcggtgaacgagttcaaagtcctgcagagcacccctattgacgagcttgtggaaaaggtgaagaagcagctgagagaagtggcggagaagcctggcttcaaggatctgagcccggtggaccaggaagacacacttttggatgcaatcagcgcagacgatcagtttatgaaggacctcgtaagagaatctatcgacgattcagtggtacagctgcggaaagtgacggacgactttgtcacgtactctcatgcaaatttggaggggaggaaggccatgaagaaagtgttcgacgcctacgagaacacctacaagacgccgaagcagaagctggacaaagtgaagcagctgcaggcggaaatgtcggatgagctgcgcaacagcctgaagatgaccacggaccctgaggtgctgaaggaggcgtcgttcgccttcggcgatgtgccgaccttcaccggaatcaccaagagagtgtcggtgttgccgcccaaatacttgagcatcaaaggccatgaacaatgcgtggacaagtaccccactggaagcatgtacaaagtgtgcttgccggcaaagaagaagtacgaatgcgcggaagacgcgtggaaggcactcaatgccttggagggcaaagataagctcgagacgtgcccttcttactgat

SEQ ID NO: 89951 - DNA, 940 bp, Heterodera glycines
  SCN-specific regions: Sequence locations=1-61,84-196,218-687,709-940
ccaatacactcgtgaagagttgcaactctttttggagacaatgcgtcgcttcaagtccagcggcctttacaggcgtttcggaatgatccatcgccggtcgggcgtccattcggggcccgccttcttagtatggcaccgcgaatttttgaaacggctggaactcgtctttcgcgctttgcatccggagaattcggagcccattttgggcctgccctattgggactcgactttggaccacgacttaccatcgcccgaggattcggttatgttcagcgaatatttactcggagaaccggacgaagcgggctttgtgaccaacggattatttgccaattggacgacgatggatggtcggcactccttccaacgaatgttcggtgaccaggacgacggcgaattcattaacgacgcacgcattgattgggtgatgacgcaagacatcgtggaaagcgtgatggcattcactctgccgacacagaattgcatcaattacgaagtggacgaccgctttttggagtattcgcatgattatgtgcactatttcatcagtggcgacatgcaggagaggttcagctccagcaacgaccccatcttcttcatgcaccacggctttatcgactcaatttgggagcattggaggcaaaacaaacagagtcggctccaacgcgagacggactttccgcgcaatgacgccgcgtgtgcgccgcggtggcacttctcagaagagttcatgccgatgctgcagccgttgtggaacatcgacgtgctctccaacaactacacggacaacatgtacgagtttatgccgaggccgagctgtgcgcgaaccggcaagtcggaggaatgcgggagcagcgattatttgtggtgcgactcgcgaacaaatggtggtcacgcggtttgtacgtcaaagattaagcccgggggggatttgtgccgg

SEQ ID NO: 89952 - DNA, 667 bp, Heterodera glycines
  SCN-specific regions: Sequence locations=1-389,411-459,481-667
agcagttgcccctcaggccatcagcagcagatgaacgcatgccaaaaactcaagcgtccgactccgccaatcacgacttactcatccgtcgggccggagagggactgtccgctgcgcaaagaccgcgctgaaccgaactggaccgagacggatgaggcgatttgcgacgatagcgacctcattggcattatgcagcgccagtatgtcaatttgccgcacagcacacaaaaggcggcacgtcgcacgaacgcagttcgccagcgaatggttgcggacgcgacggagtcgtccgactgctcctccgacgtcacaacacccaacggtgccattatggaggaatgggcatcgctggcgacggagggcgacggcgcggcgatggcacgcgaaaatggcagtgagaaaagcacaagcagcagcagaacaggcgttgactctctgtccgccttgctcaatcggcgcgtctctcctcctcaccaccactctctgtcgccctccgccgctctttccgggggtgccgcgtccattcagttgcgccgtgccacatgcggtgaactggacaagtcaaagcgcggcgaacttggccacagcattttctatgtggatgagcccgactcgccgtccgcggatggaccgaacgcgtcgcattcgttagccgcgactccttcct

SEQ ID NO: 89953 - DNA, 835 bp, Heterodera glycines
  SCN-specific regions: Sequence locations=1-248,270-329,359-455,479 -560,587-727,750-835
ggcacaccttttagtcgcctttatcaattatcacaatggctcccaagggtaagaagatcgccgccgctcccttcaagacggccgccaaggctggcgccgtcaaggaccctcgtttcgagaaggccacccgcaacttcggcattggaaacgctgtccagcccaagcgcgacctcacccgctacaccaagtggcccgagtacgtgcgcctccagcgccagcgcgccatcctcaagcgccgcctgaaggttccccccgcgatcaaccagttctcgcgcgttgtcgacaagaacgttgcctcgcagctcttcaagctcctcaacaagatccgccccgagaccaagcaggagaagaagcagcgtctcaaggccattgccgaggccaaggccgccggcaagactgtcgaggctggcaagaagcccgttgttgtcaagtacggcatcaaccacgtgactgccctcattgaggccaagaaggccaagctcgttgtcattgcgcacgatgtcgaccccattgagctcgttgtcttcctccccgccttgtgccgcaagatgaacgtgccctacgtcattgtcaagggcaaggcccgcattggtaccgttgtgcacaagaagaccgccacggcccttgccattgttgatgtccagcccgagaacgccaaggagctcgctgcccttgtgtcggttgcccaggccaacttcaacgacaagtccgatgagatccgcaagacctggggtggcggtatcatgggcaagaagtccaacgacatgatgctcaagcgcgagaaggcccgtgccaaggaggtgtccaccgctcaccttgcctaagctcattcttg

SEQ ID NO: 89954 - DNA, 829 bp, Heterodera glycines
  SCN-specific regions: Sequence locations=1-134,156-722,744-829
gataaactttgttttatgaaaataagccggtagactttttttgtaggccgggaatacctcaaaaaattgatttccgaacctgagtccttggaaaaccaaacaagaaccctgtttccgatcccgtaccactaacaacaatagatatgaattcagcagaaatggccagcccctccattgacattggtctgcttgtcctgcgcggaaatgaggaattaatacggcaaaaattgaaacgccttttggcaataacaatgccaaaagtacgtcaaaagttgtacgtgcatttggagcaaatggacgtcatccgggcacttcttcccgccatttacattaatgcggcatccattgcgccgaaaattgatctccgagtccttctgaaccgaacgaccagcgtcccagttgaccgggttttctatgacgaggtcaaagacccaagccatccgatttttccgatgcttcgcgaagagaatgggccaactttcaagatggattcttttgccacctcccatcacaaacttccggaaaagccgtatgaccatgtcgtgttgggcgggacgttcgaccgattgcacaacgggcacaaattgctgctctccgaggcggcaatgatggcacggacaagaatcacttgcggagtgacggacggaaaaatgaatgaaaaaaaaattctttacgaactgatggagccggtcgaaactcgttgccgctccgtcaccgaattcattggcgacatttccgaaggcatcgaatgccaaacagtgcccatttatgatgcgtatggtccggccattgttggtgaccattaccaagcgattgttgtcagtgacga

SEQ ID NO: 89955 - DNA, 1039 bp, Heterodera glycines
  misc_feature (1022)..(1022): n is a, c, g, or t
  SCN-specific regions: Sequence locations=1-33,56-70,105-105,146 -146,191-191,231-267,296-862,884-1039
gtttgagattccaaccattttatcataaataatagaattaactttaaattcatccgacttttgaatatgcgcattttggtgggcgttaaacgggtaattgacttcgctgtcaaagtgcgcgtaaaaaaggacggcaccggcgttgtgaaggatggcgtaaaccattcgatgaacccattctgcgaaattgcgttagaagaggcggtgcgaatcaaagagcgtaaagagaaggagggcggtgggcccgttgaagtcgtcgccttttcatttggcacacaaaaagcacaggaaacactgaggacggcacttgcaaaaggcgctgacaaagcattgctcgtcgaggtcgacaacgccacagaggagaagttggagcctatccatgtggcacgggcattggccaaattggcgaaggaagacaaatacgacttgctgttgttgggaaaacaggcaatcgacgatgatgcaaaccaaacaggacaaatggtcgccggatatttgaattggccacaggcgactttcgccagcaaaattgaagaggatggcgcttatataaaagtaacgcgagaaatcgacggcggattagacactgtgaaattgaaattgccagccgttgtcaccgccgatcttcgactcaatgaagttcggtcttgtttcaacaaacattgattgtttttgttttttagcctcgttacgccaccctcccaaacattatgaaagccaagaaaaagccattggaaaaaaagacagcgcaagaatttggcattgacatgactaatcagacagaaactttggaagtctccgatcctccagttcgacaggcgggcggttttgtggacgatgtgcctggattagtttcgaagctcaaggagaagggagtgatttgaccgacaaatgagttatatggccagaagatatatactatatatatttttacactttgtctattgagaagtcgttttttctctctaatttgcccgctttatcctgccaaatagctgtttaaattctaaattttgcttaanaaaaaaaaaaaaaaaaa

SEQ ID NO: 89956 - DNA, 592 bp, Heterodera glycines
  SCN-specific regions: Sequence locations=1-199,222-362,385-553,575-592
gtccaattaagccgttttactgacattggcaacaagaatggaccgcttggagttcagggatttcccttcctctggtggcggtgcttcgtccgaatttttcaattccgactccgtcaataataaacctcctcctgacccggcctttccttctggcaatcttttggatgtttcttcgtccagcgaatcgcaaagggatgactcctcaaaagtgcattttctttctctgagtttttaccgtcgcttctttgatatagacgaagaacaggtttttgcccgtttgttgaacagtgcgatgcctcgccggacgggcaatttcatctccgattttgtgcacccgaaccccgatttgaggggaccattttgggttagtgtttcgctcgtattttctattgcgattgttggcaatctgtcgcgttttttgcataccttcggctccgacgaattgtttatcagcgacttcagctttgtcactggtgccacttccctcgtgttcgggtacgtgctgacaatgccttctttggtctatgcctttctgtggtaccatcgtccgctcaatctccaatattcctttcttcaatttgctgtgtgcctt

SEQ ID NO: 89957 - DNA, 573 bp, Heterodera glycines
  SCN-specific regions: Sequence locations=1-17,40-259,281-573
atcaatttgtataactcacctcaacagaacaaaaatgggaaaagttagcaaaacaaaatccgcaaagaaatccgccggaggcagcggaaataaaacggtgatttgggcggtggaagacattgtggacggaccgaaatacgaaacaattgggacgaagagacagaaactctacaaagtgcgatggggagagacgtacgaattggccagcaacattcccccgggactcatcgatttgtacgaaaagcgggaaaagaagcaaatcaaaatcctcggccccattggtcaccagcgaatcttcgaccagcgaagggtcgctaagcccgaaggagagaattccgctccatcagacgaaattcgccattgaaatcggtgacaaagtgaagtgcctcagttacagcgaagtgcgcaacacttacaaagaggaattgttgcagtatttcgaggaaagggccaaaatcgacgaagagtaaagcggaaggaaaagccacgcaaaagcattcacaaataaattagcatcgctcaactcaactcgaattgaccctcactatcccccgatgtttccgttctctctca

SEQ ID NO: 89958 - DNA, 742 bp, Heterodera glycines
  SCN-specific regions: Sequence locations=1-9,35-742
tgcaagtagcgccaaaatttttgtttttccaaattatgtatctccataaataacatatgtctttttcctgtaatttaaagcaatgtttttgggagctcgttcagctcttttcattgatcgtaaagatgccggccaaaaattggctaaggctttagcccatattttgcctcaacgtgataacattgtggttttggcacttccgcgtggcggagttccagtggcttgtgaagtcgctgatgcctttcaggctcctctcgatcttctgatggtaagaaagataggtgctcctggccatgaagaatatggaattggtgctgttgtggaaggaaatccgcccgagctcgttatgaatgaggaggctgtcagaattacacgaccatctgaagcatatgtgcaacagcaaatgcagaagcaactcaaagaaatggagagacagcgaaaaacatatttgggcgacaaaccgccggtgtcgctggaagggcgaattgccattgtcgtggacgacggaattgcaacgggtggcactgctcgagttgcgctcaaagctttgcgtcagaaaaatgttagtcgtgcaattttggcctctccgatggcgccttccgacactttggccgaattacgcgctgaaggaaatgaagtgctctgtttggagacaccgccgaatttcagtgcagttggactccattaccaacgcttcgatcaaaccagcgacgaagaggtcatccgctgcatggaaaaagca

SEQ ID NO: 89959 - DNA, 607 bp, Heterodera glycines
  SCN-specific regions: Sequence locations=1-607
ctccacgccaattttgaagtcggtgaggagcagcggcggaggatcgccatgttcaaccaatttgagcgttgctgagggctcaaaaaacggtggaggcagcagcgggagcgcaaacgcacaacaggggacaaatggaagcggaaacaaccttttcattgctttgttcgactacaatgcacgaacggatgacgacctgaactttaagaagggggaagcgttggaaattctgaacgatttccaaggcgattggtggtacgcgaagagtttgatcagtggcaagtgcggctttatcccgtccaattacgtcgcccgcgagtcttccatcgatgcacaaccatggtatttcggcaaattgcgcagaatcgatgcggaaaagttgctgatgttgggcgtcaatgagcacggggcgttcctcgtccgcgactcggagtcgcgtcacaacgaattttcactgtccgtcagggacggtgaagtggtgaagcactaccgaattcgtcagttggacaacggcggctttttcatcgcccgtcgcgtcactttcggcactttgcaagaattagtccaacattacagcgaggaagccgacggactttgtgtgactttgaca

SEQ ID NO: 89960 - DNA, 633 bp, Heterodera glycines
  SCN-specific regions: Sequence locations=22-633
atttatttattaattaattttcgaaacaacgacaaatgccagaaatgtttccgccgtcccaatttttgccgttttccgtagccatcaccaattttttcccatttgccgaatgccttctgtccgttctgctctttgcgttaagcgttggaatggtgcgcgggatgaacgccattattcgggtgttgtacatcacattgatcagccggcccggcgctgaaccaccggcgtctccgcgtcttgccgaattggacgagcaaatcggtgacattcgtcgacgaatgtccgcactgtcaccgaccgacgaatttgcccaatatttcaaattggaacggttggccaacaaattggaggaggaacgcaagaaaatttgtgtaccgtcccgcaaaattgtgcctgctttttcccagaaatttgcgcttggcatgagggcggtggcacttttcatttcgcttgcattggcattgcattcgtccacagaaacgcgtctcttcaccatttgtgccgaccatttttatccgttcaattttttgttggattttccgttttcaatcgccgcctttcagtggactaatcaaaatgatgatgttgctgacttgcagcagccggtcggccttttctccttttcaatccttt

SEQ ID NO: 89961 - DNA, 754 bp, Heterodera glycines
  SCN-specific regions: Sequence locations=1-314,338-754
gcaatatttagccagaaatgttcaagaaattcgattcggcagaggatgtggtcgggtcccagcagctcaaaggatctgtgcagaagtcaatccgggccaagctggttgagcagtatccgagcattgagccgtacatggacgccattctgccgaagaaggagaacttcaagttggtcaagtgcaaggaccacctgcagctgatcgcggacgccaacggcactgtccacttcgttaaaagccgtgatttggcaaattatttcccaactctgagactgctgcacaaatacccgttcatgcttccacaccaacaggtagacaaaggtgccatcaaatttgtgttaaacggttcgcatataatgtgccctgggctgaccagcgcgggtggccgacttttggacgattgcaacgaaggggcattggttgccattatggcggaaggaaagcagcacgcaatgggaattggacaaatgaagctttcgtcggcgaatgtgcggtcacaaaatgttggcattgccattgacaatgtccacttcatgaacgacgggctgtggcgattaaccactgttcaatgagcacagaacaatttttttttaaattattgtttaattgactctataattaatcgctttttcaattttaaattgttgatgtatgaggaatcatattttttcgtgctttatttgcaaaatgaaatacacaaaattttcattcgaatgtttacattaataaatgtgaggtgattaaaaaaaaaaaa

SEQ ID NO: 89962 - DNA, 906 bp, Heterodera glycines
  SCN-specific regions: Sequence locations=1-11,51-78,102-906
ctagtctcgagtttttttttttttttttttttttttttttttttttttttaaaaaattcattttatttgcgtcaatataaaatttgttttaaaaattttgactaaaatattccttgtcaattgtctggcaaaaagcgatcaaatttgggtatttgctcaatgtctccacaattgctttgtttggcatttccgtggtcagaagagtgtacaaatggccaaaagcgagtgcatcaagttcggtcggttggtcgcccacaaagaattgctgctggcccaatttgatggaaagcgcgtggaaacatttgtcgcatcgctccgccactttggctattggaaggtccgcccagccgatgtccgccaaataattgtgcatttcgcgccgtttgagcgtcggcagcagccaattcaaaggccacaagtaaacgctgccgtacctttttttggtcaccaattcgtaggattcgtcgtcaagccatgacaaatatttttcggcgtttcgaagcgtttcctcaatcagtgagcaaaatgcctgaatgtccgcctgttcagcagcgcttagcgtatttgacggacgaattccttttttgccgaccaaatcaacaatagggaagaattcagcgaccagagtgttctgaagacgcagaaagggcacttctcccgtcggggacataaattccgcgtttggcctctgctccaaaacgaaggacagatcggccatcataagaaaggcacggacagccaacgtgtcggcatattggtacatcagcgcttgctccttttggtacggcgcgtaaagcaccgcgtccttccattcttcagtcattgtgggcagtgtttgtgcaacaaaattgctgaggaacataccaaaaataatagcaaatcaaaaggatgcaaagtttcaggact

SEQ ID NO: 89963 - DNA, 640 bp, Heterodera glycines
  SCN-specific regions: Sequence locations=1-533,555-614,636-640
cttaaaaatgcacaagcagaaagtaatatgaaactaccaatctcaagcaacaaattcaacaagtacgaactctacaaatttcgacatgcgactatggccatcgttgaaaatatcggattttctacttctaacagctccgcagtcagttccttgtcttttctgcttagaacttattttgagcaattgtgtcgcgactcgcttaactcggccattaattctggtcgtgcagaagttggcttggaagatgtttcttatgttttcggagccaatggaattaatataactgaacttcatgattatatccagcaagttcaaccatatgcggctgatgagcatcctttgtttcccgtcactgaaccattaaatgtgccgccgccttcctctgaaattgcggacacatccgagcaaaaaaatggcgagagagaatcagcagggaatgacggggctgaagttgacgaggaagggaatagggagcaaaacaacaaacactccttgaactcattcaactcgaggtccaatgttcgaaatgcaatttctcaaaagatttttccaaattttgtcggtgcgtttgccccgaatctcggcttttccgtccgaaaggtcgaacttccgacggagaatgtctctgtggaccaacatt

SEQ ID NO: 89964 - DNA, 571 bp, Heterodera glycines
  SCN-specific regions: Sequence locations=1-571
cgcctccaattttcggcaatggaaaatgttgttgctgctgccgatgttgcggtcgacaattttgaggagcgcactcgccaattcttcgccttcgtcaacgagggaaacatcggacaattgcgtgcgctggtcgactcgctgaacgcggacgaactgagcaatttgctgcggatgaaccaaccgaatgtccaaccgcctcgagccgctctcattaacgcaattgtaaagcagcacacggaaatgttggagaagggcgcagatccgcatcagactgtgcttggccgactgaacaatttggacatgaatgtgacgccgctttggactgctgtcaatatggccaatttggacatgtgccgtgcgctgatcgcccatggtgccaacatcgaattggggacggactctggcgaatcgacgctgctctgcgcatgtttcgaaggcagttttgagattgtcactcttctcgtcgagaatggcgccaacgttaatctcgcggacagcgacggaatgacgccactaattgtcacttgttactttaccggaaagattgacattgtgctcctgctgcttttac

SEQ ID NO: 89965 - DNA, 647 bp, Heterodera glycines
  SCN-specific regions: Sequence locations=1-647
attagttatatacattatatttaaacggctcttcaattatgacgtcaacctcgccacctttgaccaacggtgtcgccaatcatttatccgagaacggttcagcgacaagccctgaactgatcgtgttccgcagcattgtgcaagatttggttagctatgtggaccgcttccccaacccgggcaaatccgttcgtggccacacattcaaaacattttgcggcggcaaacgagcaaatcaggcagtgatggcctcacggatgggcactcatgtgacaatggtcagcatggacggcgacgatttgtttgcagccgaaaatgtgcgatcaattgcccaaaatgatgttgatgtgtcgctagtgaagcaattgtcgggccaaacaacgggcaccaccacaattaccgtatccagagacggtgagaattgtattgtggttacattgggcgccaacacttcattgggcgctgaatgcgcacttgccattgagcatacggtggcacgcgcacgcctcgtgttgtgccagcaggagattgaccagcagggcacgttgaccgtttttcggatagccaaacggcacagcgttaccacctttttcaacccggcgcccggccgtgccgacattgaccggacgattttgccactttgcgac

SEQ ID NO: 89966 - DNA, 593 bp, Heterodera glycines
  SCN-specific regions: Sequence locations=1-52,74-593
tccgcccaatttgcgatgccaaaacaggcaactatcagcctcagcagtgtcgggatgagaaacattgcttctgcgttaattacctaactggagtacggcaaaacaaaaaggaagtgccaaccaacgaaattttgcattgtgaaggcggccaagtcgatttttccatcgatgatagccatatcattaaatcggagaaaggtgagggagaaaaaggcgacgaggagctgatcccgatcggatcgccggtctgcaagaagccgagagatgcgggccacagatgccatggccgagctggcggaccaatcgcggccaaaaaccttaagtggtattttgacacggagacttttgattgtttggcattttcgtacaacggctgtggcggcaacggaaatcatttcgactcgcccgcagattgttgggacaaatgcaaacttgtggacctcgccggttgtgcggggatgcgcctgccggcaacggataagcagggtcacacaatcatttgcgccggggctggctacccatcgcctaccgcggcatgtccgtccggctatcggtgcacaatgttggcgcacatgggagtttgctgtcattca

SEQ ID NO: 89967 - DNA, 782 bp, Heterodera glycines
  SCN-specific regions: Sequence locations=1-389,411-466,488-782
cacacattccgacgcaattacttcattattttgggattagtacccaacgcttttcttttgcagcttttgaacaatgagcggtggcatttatggcggagatgacgtcggtgcattggtgttcgaccccggctcgcacagtttccgcgtcggttacggtggcgaggagttcccccgctttgacattccggcacgggtcggcgtctgtcctcggccttccgccggcactgacgcgtcccaaaccgctgacgccacaattgaagaggtggcctcaggacggggggccaacgccagcaacaaattcgaccattacattggcacaacaaagctgaatgtgccccgggccggcatggaggtgaagccgtacatgcgggagggcatggtggaggactgggaactttttgagaagatgctcgactacatctacgggccgtgtcttggagcagaaagccgtgagcatggcgtactgttcacagagccaccatggaacccaaaggaaaagcggcaacggttgaccgagttggtgttcgagaagtacggcgtgccggcctattatttggccaaaaatgccgtgctggccgcatttgcaagcggtcgtacagccgggttggtcatcgacagcggctcctcccacacctccgctgtgccggtgtacgacggatattgcatcacaaattctgttgtcaaatcgccggtcggcggtgactttgtcgtggaccaatgccgcaaaatgttggtcaaagagggcgtggatattgtgccctattacaaagtggcatccaaaa

SEQ ID NO: 89968 - DNA, 643 bp, Heterodera glycines
  SCN-specific regions: Sequence locations=1-229,251-451,475-529,551-643
cccgattgtccatcttctttctgtgcattatcacattccgactaccatccaaagcatttcgtggcccgtcgcactcagtggacgcgatttgatctcaattgctaagacaggctcaggcaaaacccttggatttattctacctgccatcgttcacactatggcccagcctccacgtcgaccaaatgatgggcctggagtgcttgtgctgcttcctactcgcgaattggctgtgcaggtggagcaagtggcacgagaatactgcaagctgatgaaattggatgtgacttgttgttacggtggagcaccgaaagcaggacaggcaaacgatttgcgaagaggcgtcgatatttgcgttgccactccggggcgcattctcgactttatggaggccaataccaccaatatgcgtcgctgcacttttttggttttggacgaagctgaccgtatgctcgatatgggatttgaacctcaaattcgcaagattgttggccaaattcggccggatcgtcagtctctgatgttctcggccacttggccaaaagaggtgcgctctctcgctgccgatttccaagtgaatccggtccatttgaacgtcggttcgttagagttggcggccaaccacaacatccaacaacacgtggaa

SEQ ID NO: 89969 - DNA, 862 bp, Heterodera glycines
  SCN-specific regions: Sequence locations=1-63,85-297,319-429,453 -564,588-862
gtccaattaagcaattttttctatttttataaaatgcttccgccgggcgaatggcgcatgaccgacctgttgctggacccggccatccgcacatgggtgttcgtgcccattgtgttaatcacttttttggttggcattgtccggcactacgtgttcctgttgctggtcaccaagaagagtgctgacctgcagtcagtgcgggacagccattggctgctgaaggcgcgtctgttgcgtgagaatgggcgctttttgcccgccgattcgtttgcccagcggcgctggctgctgtgtgacgagcagcatggccagctggtcaagcggcaggacaaacagaacacgcagccgaacccgatgctggacccgtccacgatgacggagatggtcaagggcaacatgctgaacatggtgcccatgctggtcatcggcggttggatcaactggaccttttccggcttcgtcaccacgcgggtgcccttcccgttgacacttcgcttcaaaccgatgcttcagcggggcgtcgatttgcagtctttggacgcttcatgggtttcctccgcttcatggtacttcctgaacgtgttcggcctccgctcggtgtacgcgctggtgttgggcggcgagaatgcggccgagatgatggacgagcaggcaatgctcggcatggcacagccacagatggtcgcgccgggccaagacccgaagggggcgttcaaatccgaatgggaggcgctgcagctgtacacgcacacgttcaacccgagatagaaaaacggaaagaaaaccgtcgataaaaatacacaatttttttttgtcatttcgctaaacatattcattcgtaaagtaaactttagcgattttt

SEQ ID NO: 89970 - DNA, 693 bp, Heterodera glycines
  SCN-specific regions: Sequence locations=1-410,432-581,605-638,689-693
ccatttaaggtgcattaattatgtcacaatcaccgcaaatggcgactttcagcggtctgacagcaaatatttaccacgaaaaacagaagaggcaactttgcttgctccacacactgaacaaccttttccaacgtgaagaatttgtacgggatgaattggacgaaatttgtgaaagactcgacgacagcaaatggttcaacacccaccgttcatggcttggacttggcaattatgatgcaaacattttactctgcgcgttaaaaacacgtggactggtcggacgatggttcgacaaacgaatgccagcttcttggatccggaaggaagtgatagtcgcatacatcttcaacatcccatccaccgggttcatgccattgccatttcttaacggacgccattggttcaccatcaaacaatttgggcccacttattacaatttggactccaaattggccgccccaacactgatcagcacagccaatggcattgtccactacatcaactcacttttggcccaaggcaacgaactgttgctggttgtccgccccgaaaatgaggccaattgtttgctggccaatggcgaagaagaacacggaggaggagaatgattaaatgataaatgaatgcctcaacaaatgtgtcttaaatatttaaatttctttccacatttcaagtcatatatatttatatttc

SEQ ID NO: 89971 - DNA, 622 bp, Heterodera glycines
  SCN-specific regions: Sequence locations=1-460,484-622
tgagatttttcggacgaatgcgcacttcgaattcgcagcggcgaggaaaagccgcagagggaaacgcacgcgacggccattccgttgccatgcggcggccaatttattccttttggtgaagaaaatcatcaccgaatcaaccaaattgttcgctgacccaaatgcggtgctcagcaaattggtggagctgttccgtcagtgccttcgtcagttcgcccacgggtgcctttccgcctttttgccccaagcccttcccggcgtttcgccgggggcgggcggaataatcggcgcctccacctccattctgcagaatttgatgcgcgacgacagcgtcgtccgactcgacgccgaccaaaccttttttacgtgttgtgtcctcgccaccgccgattggagtgcggagacgaccatgcaattgcaggacaaactgaggcaaaagatagcggacggcgacttcggtcaggagacggatcttttccacagcatttgcaacagtgcgttgatgcttttggtgcaggacgccgaaacgatgtgcgagccgtcattgcaggcgatgaacaaaatagattggtcaaatgtcgaccaagtgggcgatgagtcaccgtatgtttcgacgatccga

SEQ ID NO: 89972 - DNA, 625 bp, Heterodera glycines
  SCN-specific regions: Sequence locations=1-42,82-461,483-539,561-625
ggaacccctcgccaattgagtgcgttttttggcattgccatggcttttcccctcctccccttcttttttctgtttccgcttgccctcgtccctctccaaaggacagctgcggttcatccaccgctgttcaaccgaattgtccccaccagcgaacggacagtgaatctgactttgacgcgggattttggcgaggcaaaagcggggaacgatgaaagcgcaaataattcaaatttgaccgcatcaccggtggaggcgaaaattcatcgactgaaagagctgagaaacgaaatgcgtgcattgacggcgatgatcaaagaagaacgacgacgaagcaaatccaaagacattcggcaccggcaccgatcaatcgcggagaaaatgcgcaccgaaatcagcagacaatttcgaaaatggcgcaaaaaagtgctaagcaaaattcacttggttatgcaacgattggaccaattggagggcgaaatgcacaggacaaaggataatttgcaaaaagtgatgcacgacaacggccgggaggaagggggcaaatggggcgggggcagcaaaaagcggcggccaccgccttcgcattccgccgaatcattgtcagcagtgcgccgcgtgcaaatga

SEQ ID NO: 89973 - DNA, 556 bp, Heterodera glycines
  SCN-specific regions: Sequence locations=1-556
gttttccatactctctccatttggttgtctctttcttctcctttctctttctctatgttttccatactctctcctctccttccatctgttttaatttaccgttcgattcgttcactttgcgcagtttcccctggttcagatgcaacttcggtgcgtaaatgatgtccttcaccaagttggccatgtcttctcccaattgtccgctgtgcgtccattcgtccaccagcaaatcgcataagcggatgatacgaattggcaccgctttccagcagtacgacgccacggcggaagcagtgtttgagttgcagcaaagggtaaatgctcagcagagagatgtacggcttggaaaggcgcgtgccggcgccctcaacgcactgctccaacttaatccatctgaccgtgccatattagagtgcttttccatgctggataatgccgaccggtgcgtctgttgccaaaagagcgtttgctgaacatttgccagtgccattggactggccgccgtttcggcacttccttcgccactttcgacgactcgttcagccaattccgtgtt

SEQ ID NO: 89974 - DNA, 379 bp, Heterodera glycines
  SCN-specific regions: Sequence locations=1-379
gcgattggtcggcggggaaagacggcacagccaaagacaatgtcaacaattccaataggtgggcaatcagttggaactgctgctcgacttccgcaccaactcgtggctgtccctgggctggcgtcccctcaacatccctccttcgtgtcgactctttccccaaatgcacggcacggcagccgaaggtcggcacggggaggacggagtgcagacgagcggatttggttggtggtgacatggcgaacaaatggccattcattggctgccaattcagcaaagtccgcgctgagtttgcctttgcatccaatggactgcaccgacgtaataatggcctcggtgctggagggcaccgaccttttgcacattgccgacatgtact

SEQ ID NO: 89975 - DNA, 515 bp, Heterodera glycines
  SCN-specific regions: Sequence locations=1-261,283-515
caaggcgcttcgccgtcagttgcccgtcactcgctccaagctgaactggatagagacttccactccttccgcatcactcaacaggacatgaaacagccgccgacgcccaccgtcgctgtccaacaacagtcccagtgaaaaacaacaaatgaacggactgacggacggatgaatgacaccgcaactaattggagagagacactttcgcgtcctcaccactcattttaattggtgtactaaatcataatctgcttgtgtctgtttcatctccttcttcatttgtccgtgtgctttttcgttttgtgcccttcgtgaacattcgccatccaaaaattaagaatttggcgctatctcacaccacctctccgactgatcagtgatcagctttgtcattccctgctgctcgtattgactcatctccgccgtttgcgattgatttttgatggattttccctttcttttctgtttgtaaaacataccctcccccactcttcagcataaattatttaaactga

SEQ ID NO: 89976 - DNA, 673 bp, Heterodera glycines
  SCN-specific regions: Sequence locations=1-178,201-673
tttgagttttaattgttaatttttaccgaattcctgaaaaatggctgatccgaaaaaggctgtctgcgtgctcgtcggtgatgcggacccatccgtgaaagggatgattactttcactcaagacaaggaaggttcacccgtgtcagttcagggcgaaatcagtggtcttgagcctggtcttcacggcttccatgtccatgcctacggcgatttgtccaacgggtgcacttccgccggcccgcatttcaatccaacaaacaaaacgcacggcggaccgcaggatcaaatccgacatgtcggtgatttgggcaatgtccatgctgggtcggacggaattgccaagctgacattttctgaccatttgatttcgctgtgcggtgccaacaacattgtcggtcgtgcgcttgtcgtgcacaaatccgaagacgatttgggccgtggtctgggtgaaaaggaagatgagagtaagaaaaccggaaacgcaggggctcggctggcgtgtggaatcattggacttgcaaaaccatgactcgccagcgacggagacgaacagtcgaaatgacgacaccatggaaggaagagaaaaggaaaccgacttaggacactccatttataattgtttaatcagaccaatcttccgttttttgctttgataaatgtttcacctaaaaaa

SEQ ID NO: 89977 - DNA, 1106 bp, Heterodera glycines
  SCN-specific regions: Sequence locations=1-638,660-922,967-1106
gggctgcaggcttccgcgagcggctgacccaccacttttacgcgcagtatttggacgggttcaccttctacaaaatgaccaatttggacaatcgaattgccaacgcggaccaactgctgacgcaggacgtggaccgcttctgcgagggcattgtcgagctgtactccaacctgtccaaacccttcgtcgatgttttgctttacgtcagtcgcatcggcgcttccatcggttggcaggcgcccattcagctgttcgtctatttgctcttctccggcacggcactcacttatctgcggaggcccattggccgtatgacagtgatggaacaacaattggagggcgactaccgtttcgtcaactcgcgactgattgtcaacagtgaagagattgcattttatcagggcaatgagcgcgaacgcgtttctgtgctgaacgccttccaacggatgatttcccatctccgttcgctgattttgttccgcttttccatcgctttcatggacaatattgtggccaaatatgtggcaactgttgtcggctggtcaaccctgtccaggccctacttcaacgaacaaaatgagggaatgatgcgcaaggacaaaacggaactgatgcaggcttattacaccaccggccgtatgatggtgaagctggcggatgcgctgggccgcctggcgttggccgggcgcgagatgacgcggttggccggcttcttcttccgagttgaccaactgatgcacgtcctggccgaccttgagcagggcaaataccaaaggacaatgctctcaattaacgcggattcaaagaatgtggccaatggaaacggaggcctcgtcgtcattgaacagcagcagaaactgaacaatgatgaccagcacagcaacagcacaaccgcaccgtcgtcccctccggcactgttgttctcctcctcctccaactcgtcctcctcctgctccctgtcctccttccgccccggctccggccatgtccttgtccaagacaatttgatccgtttccaacaagttccgctggtgacgcccaacggcgacgtgctcatccgctcgttggactttgaggtgccatccggcaccaatgtgctcgtctgc

SEQ ID NO: 89978 - DNA, 648 bp, Heterodera glycines
  SCN-specific regions: Sequence locations=1-166,188-648
cgaacattaattggcaattaattaagtcgttttgtttttaaatgacattagaaggcgaaagaggtggattacatgcacttttgactgctcggttggatgaggatgagcaattcattgcgacaataaattacctgaacgacaatttgcgtttggatgccgaaacgacggagcaaaaactcagaatggtattggaggaccgggagctggagctgaaccaacagtacttggaacagcttgaaaagatgaatgaccgcgtgcagggatttgtacagcaaattcggtcgatgaattcgatttgctgcgaactcactgaacgcattcaaacgaacaaggaaaagacacgcgagttgctgaagagaacagccgttctgcagacggaaaagcgcgaattgggtgccaagaatgcatttttggacgaatttttcgccaaatattccctaaacgaagaggaggagacggcattggcactacccaatcagcaggggtcgccttccgacgcatttttctcggccttacgacgtttgttagaagtggagaaaaatgtgacggaacaattggcattggagccgaacagtttggcattgatggaactttcgcatttactcggcgacaaattgcgccaaacttacgccactctttacgcgtgtg

SEQ ID NO: 89979 - DNA, 611 bp, Heterodera glycines
  SCN-specific regions: Sequence locations=1-611
gtccagttaagccagcaccttctctcaacgatttaataagttttctctatttgctgcacagaatgccttttgcgaatttcagtgtggacagtatcctttccaccggagaagggaacagcggcacttccaaatgccacaattcctttcgtccctccgtcgttttcgcttcgtcatgccatggctgtctcactgacgagggaagttcctgtttcgaaatgcgtccattcgattccgttgacaccgaattctgtccccgggcgggcgacgacgacacttcgctggtcatttcccgctgggctttgcagtgcattcggatgattgcgggcgacgatgccaaaatgacgacgatgaaaacggtgaatgccgattcgccggagcaaatttcgccaacggatgctgcgaattccatctttctgaatccgtcgattgctcttggcaatggcaatgccttcccactttttcaacaaatgcaaaaggccaaacgaattcgcactgcgttcagtccgtctcaactcgtcaaactcgagcaggcattcaatggaagtcaatatttggtgggaagtgagcggaaagtgttggccaaacaattggcactgtccgaaacgcaggtg

SEQ ID NO: 89980 - DNA, 1104 bp, Heterodera glycines
  SCN-specific regions: Sequence locations=1-946,968-1104
ccaataaagaaaaccttacaaatatacgtttttaatattatggcattgcctaacaggcctccgtatcttccggataattgggataatgatgttgagatgagcggcttaatgtcttttttaaaggctcgacatgtcaactcgacaaattatgatagggtcattgagttttggaagagagtgatttcagattattgtcgtcaccaaaagaattgcattttttcgttggatgaactcaaattgaaattcaaacgaggaacgcaacttccgagtccgttgccaaccgtcgtaatggaaatgcaaaatgccggactcgttcaatcgaaggaggaactcgaaaagcagaatcagggctggctacagtggagcatctctttgctgaagccgaacagttggcttccgggcctcgcgaatccaacggacgccggcaaaaggcacccattcgaattggtgcacatccccacactcaaacaacaggccaaggagttgctccgtttctatcgaaatcactttgaaatgttcgctgactgttccgacgtggtcgactacaacgacttgcgagaacagacggcccatctgatggacgagcgctgcttcgacttggtgatcaatgagttggccagaatgggcgaagtgagcatgggaagcagcaaaagcggcgacagagtgctcaaatttaaggaccaatcatcgaagggacccgcccgtttcacagagactgacgcaaatgtccatgacctgaagcgcacaatgcaacgcctggacttggacataaaaaatgcagaaaaacgagagcaaagtttgaaagaggaggcgcgcgtggcactcggacgaaaggataaaaagggggcgttgaacattatgcggaaggttgcccgagtgcgcaaggacatccaggacaaagacgtgcaataccaaagactgttggcaatgctcgagcagttggcggcctccaaacagaccaaggaaatcatcgacgtgtacaagcagggctctaacgcattccgagagaccatggctagacagggactgacaccggacaaagtggacctcacaatggacggcgtgttggagacgatgcaggactaccaagacgtggaagaggcg

SEQ ID NO: 89981 - DNA, 792 bp, Heterodera glycines
  SCN-specific regions: Sequence locations=1-251,274-792
ttgagatgcatttgttccatgccttccttcaccgttcgctgctgatgaatttgccgccttcgtcctcttcttcccccgtcctgtttaatcggctgaccaatcgtcaaactttggctttttctgccattgtccgtcgtgtaactcgcggtttttctactcgtcaacgcaatctgtacaaagtgttgggcgtttctccttccgcctcacaaagcgacatcaaaaaagcgtattatacactgtccaaaaagtatcatccggatgtcacaggttccaacgaatcgtgcgcaaagaaatatttggaaatcaaagaggcttatgacgtattgcgtgatgaaaagcaacgagaagaacacgaccgatggttagcggccgaagaagttcagcggcaacgtccaattaacggacgacagccgtatgtacgcagacagaaagtgtacgacgatttgtggccaaacaatggaaccttttcggatgaggaaatacgaaggatttggcgcagtatgagtggcaacagcgaatttggacggtcgaattgggaatttgaaacggaggtgaagcgtaaacgacagatggcatatgaggaacagacgaggagaagaaatgagtgggcgaagaacgggttcggccaaaacaatggtcgaagtgattggactgaccaggaccaatacaaaatcattggcaaaattctcctctgttatgtgctcatcacttttttcatcgaaattttcagcgcttcccttggacttttccgagacccatttctgccgccatataacagagaagaagacatca

SEQ ID NO: 89982 - DNA, 543 bp, Heterodera glycines
  SCN-specific regions: Sequence locations=1-71,93-180,202-543
gctaatgctcgttggtcttgaccatttgcttcccgtccgtccggttgccctttgtctcattgaatattcgtccactctttcgccctccttcctttttgtacatttcattagcaatttctccaaaagttcctcttccgccggcacttccgatcatcacatcactttcgtttccctccatacgactttgggtcttttgagaatggtcatgggcaaaatggcccaacgattgaatttggacacctttcatttcgtttccgtctcggatttcctcggcgattcgcttctgttcgactgtgatcgacttttctcatggatcacgaaggaagtccttcgctccgttctccccgaccgcccccaactcgtcgtcctggacgaccttttcctttctcacccgtccattcgtcctgccaaactgctccaatttctgctcgctctctttgtccgtcttcccgaccgttccttcttcataatggccaccgcaaatgccactccattgtccgcatatatttccaatttcttcaattttcacattcgactgactcc

SEQ ID NO: 89983 - DNA, 916 bp, Heterodera glycines
  SCN-specific regions: Sequence locations=1-449,473-730,752-916
gcaatttgcgcgttaattgaaagagcccagaattatgctggacactcgacgtcaatcgggcgcaattgaccaggctgaaatcctcataatttacggactgcgcattgaacatttgtattataagtattcttcgaatgaggtggaagatgaacagctgatggactcgttgtgcaaaattgtctatgcgataggcaacgcgccactcgcccgacagagggcaatgctttgtcaaatttaccaccacgcgctgcacgaccgatggcataaggcgaagaatttgctgctgatgtcgcatttgcaagcactggtggaccattcggatgccagcactcaagtcaatttccaagaaaagacaccgacccaaaaacaatcgaattaagattttgtacaatcgcacaatttgccaactcggactttgtgcttttcgtcatggatttgttcgtgaagcgcatcagaatttgtctgagatccagaacacccaacgggccaaagacttgcttgctcaaggcattccgccgcgacaatcggaaaaaacggcagaacaggagttgaaggagcgctctctgcaagtgccctaccacatgcacatcaatttggagttgatggagtgcgtttacctcatctgctcaatgatgctcgagatcccaaacatcgcttgctacgagtacgacgtgcgtcgacggcttctctcccgttccttccattaccaactgaaattctccgagaaagcggcgctcatcggtcctccggagaacacccgcgaacacgtggttgccgcctcgagggcaatgctcaggggcgaatggatcaaatgtcgcaattacataattaacgacaaaatgaacgcaaaggtgtggaatttgtttcgcaattctgacgccgtcaaacaaatgctcatccaacgtgtgcaagaaga

SEQ ID NO: 89984 - DNA, 472 bp, Heterodera glycines
  SCN-specific regions: Sequence locations=1-356,378-443
cggaagtgtcgcgctgttcgacactctttcgctctctcctctgtctgttcttcgccaaactcattgctcttttgtcaccgccctttcatttttgcctcaacggtcgtgcgacgtcaaagatttaggccatatcggtgaaactatttcgcacaatttgccttcaaagcgctgttttttgccggggatttgcgccgattttcgttgtgcccttgtctctgtgagcgttgaccgaacaattcaggttcaccaatttcccttccccactcaaagttctttctccgccttccttttccgtctgtcaattctgacttctgttctctacgttcttttgtggactctttttgcataaataaccattggcattgatttgttgtgatctttgaatgtctctaaattttaaattgtgaatctgtgatacatacgaaataataaagttttttgttaaaaaaaaaaaaaaaaaaaaaaaaaaaaa

SEQ ID NO: 89985 - DNA, 650 bp, Heterodera glycines
  SCN-specific regions: Sequence locations=1-249,271-288,310-422,444 -489,512-650
gtccatttaagatttagacaaacaatttcctaaaaatgttgagccgactttctaaaatcactgttcgtggctatgcaaaggatcttaagtttggttcggaagggaggaaagctatgctctccggtgttgacatgttagcggatgctgtcgctgttacgatgggtcccaagggaagaaacgtggtcatcgaacaatcctggggcagtccgaagattaccaaggacggtgtcactgttgcaaaggccattgacttcaaggacaaattccaaaacatgggcgccaaacttgttcaggacgtggcaaacaagacaaatgaggaagctggtgacggaacgacttgtgccactgtgttggcacgtgccatcgcaaaggaaggcttcgagaacatctccaaaggtgctaatccggtggaggtgcgcaagggactgatgaacgcagtggacgaattggtcaaggaactgaaggcaatgagcaaaacagtgacaactcccgaagaaatcgctcaagtggccactattgcagcgaacggagacaaaaccattcgaaaactgatctccgatgccatgaagaacgtcggaaacaaaggtgtcatcacggcgaaggaccgcacgactttgttggaccaattggagtttattgaagggataaag

SEQ ID NO: 89986 - DNA, 967 bp, Heterodera glycines
  SCN-specific regions: Sequence locations=1-945
gtttgaggtgccatatcagatcaattaagcattaattaagtacatcgttcatttccattgcccccatttattaatcgatggctgccaatgcaaatgatggaaccgccaaagggcaaaaaaagcaaaaacaaattgcccaacggactgcgcccgcttttggaggcatttgcacgagaatcactgcgcagtcagccgacagatttggcacaattcggacaaatattcttcgaaacactaattgaacagaaaatgcgaaattcggaaagcactgttgaagcccttctcggagacaaattcaattacgacattttcagaagcgaattgcatgaaaaactgaaaaaattctcttcgccgcaacaaaacggacggcccaaaagtccgatggatatcgcagcaaccaaaatccaagctatttttcgcgggcacatggtccgaactcatcccgaaaaatttgggttggacgccgaaacgatggacggactgaatcagaaaatgcggagaaattccaacgaacgattggagacggtggatttcaaaaaagacttaaaacggcactcaatcggcgggtacagtcacgcggagcaaacgaatgccacgccggaggacagagcagcgaccaaaattcaatcagaaattcgcggatttctggccagaaaacactacgagcaacagaagaaggatagctcggtggcggccaccaaaatccaagcgcaaattcgcggcttcttgacacggaaacggctcgaagagcaaggctttgtgctcagtccgccccgctcgcgtgcttcgacgcgcgcgtcggccggcgatgttaaggcccaatgaatgatcgggttgggtgggctcggctcgtctccccaaatgcttttgtgtgccgggcgctgtttggtgaaaacggcacagatggaaaaaaccaaacgcaacaaaaaccaaaacgcaattatcatttttattattattttatatt

SEQ ID NO: 89987 - DNA, 1356 bp, Heterodera glycines
  SCN-specific regions: Sequence locations=1-163,185-213,236-1256,1278 -1356
tgagaatttggggacgtgctgttattctcatttcccctatgattgcctctgaaaacaatcacttagaagcccaaaatggcaacagtcccgagggagaagaagagtcgaattgcggaggcagtgcttcgccttcgtctcttcgcgactgtcattctcgagcatcgaccaacgaacacaccaacatttctcatcactctcttcacgatgacaatgcaccaccttctccctccttggccaatatctcaacaaacattgaactccatccacacaacaatgcgcttggaggttcctcctctcataaattcatcaaaaggccattgaatgcttatatgatatggacaagacaggaaaggaagcgaattttaacggacgatcccaaaatgaagatgaacgaagtgagcaaagctattcagatgggcgaaaaatggaagaaaatgtcggacaaggaaaagaaaccttacttcgaaatggcaaaaaaattctctgaagaacacaaattggtgcttcaagaacaccctgaactgcaatatgcgccctccaaaaagaaggtggtgaagaaactggccgatggaaagcaattgtccgtggtcgattcttcgtccgtcaagtcgtgcaccataacacccgacgcgtcgagaagcacaacgccgcggggttcttcaaatctgatcacaccacaaccggtgtcacagagtcaaatgttttctccgtttcaatctccaactgtgcaacttgctcaggtccttcagggagtgcgttctgtgaccaaccaggctgccatctcttctaattcgcccatccaaaatccgttgcttggctcggcttcgacctttccgcaagcgttcctccaatcccattcgttacctcagcgtgtcgctaattcctccgtttctttgctcggaggaatgtctcagtcgggtaccacgccagttagtgctgctactcggaccacgcctggtcaaatgttggacctctactacacctcactttgccagcctgccttccccagcataaccgagaaccctgttaatcctcttggaatgtatccttcacactatttgttggagcagtacaaccagcatctttctcagcagcaacaacagcagggaaataacggaggcacatccaatgcatctgcaaatgggggtggacggttttagcaagtggatcaccgatcgatcactcatgcctaatcaacttgatcatcctcaacacatgtcattttgtgctatgctcctcccttcgcatccattcgaatctcctcttttcaatgttcctcttcaccccacccaatgaacttgcagatttatctacctgatcaattttctattttctcgtgcgaattttggcccttcg

SEQ ID NO: 89988 - DNA, 670 bp, Heterodera glycines
  SCN-specific regions: Sequence locations=1-532,554-610,632-634
aggtttttaatcctttaaatggggcgtcgtctgcccaatgttttggttaccggaacgccggggaccggaaaatcgacgttggccaaaaaagttgcacaaaatgttggcatggagcatatcgacaccgcattgattataaaggaacgcgaattttatgcggaatacgacgcccaattggacacccacgtgctcaacgaggacgcactccttgaccatttggaagaacgctttggctctgacgcgggcggcctaattttggactatcactgtgccgaaatgttcccaaagcgatggttcgacctcgtcattgtcctccgttgtgccaccgactcgctgttcgatcggctgaccgaacggggctattcggagaggaaaagacgcgagaatttggaggccgaaattttcggcatcatcgcagaggaggcaaatgccagttatgacgagtcggtcgtgcacgagttggagaacagcacagccgaacaactggaggccaacgttcggacggtcaccaatttggtgggggcgcacaaacagagaaagtgaacgaaaaagagcaaaggcaaagcagcggatttgtgtcataaatttcaaagcattttttgttgcttctaattttattgcaatttttaaatttaaaaaaaaaaaaaaaaaaaaaaaaaaaaaaaaaaaa

SEQ ID NO: 89989 - DNA, 1165 bp, Heterodera glycines
  SCN-specific regions: Sequence locations=1-1165
ccaagtttgagttttccaatggagcgttctttgtgcagtcggaacggtgcgggaaatgacagtgtggtgaatgtgagggatgacgaagtgcaggacgacgacgacgagttcttccacggcacggcatttgaaagtgacgaaggataggacggcatagggaaaaggcaaacgaaatactgtataatttgattaagcggttcgcggagaggacaaggagaaccgagggacgacggacacggcgaaatatggggttgactatgacgagatggacaaagggtctcaacagcggccacctccccacccttcggaccttccccagtcgacttcacttcgctacccgtcaaatctgtccaaaatcagcgaatcgcccgatgaattctctttttcgtttaaacgaggagaaaatgccatccaacagttcaatcgcgaccatgaggagttgcgtcgtcagaatcacctgcgcttgccctccgtttcctttcacacgtcccattattcgatgaaacacagttgggaggaaagcgcacttcgacttcaaaacgcgacgcattgttcatttgcaagacccgagctcgacctgagcacggtggacgtaaccgaaaccaaacagcagctttcgtccattaaaaaccaaactgtcgccaattctttttccgcctttcccaatacttccgcttccaatcaatcggcggcggcatctccccaattcctttctgggagtaggcattgcatttacttcggtttctgccgattggactttgagtcggaacagacgctgattctgcgcaacagacacccgcggggggaacgcgtccaaatcaaatgcgaatggacagttaacacgacgaaccaaccgcactatagaattttgtatccgcgcgaaacgacacagagcagagaacacacgcaaattttgggcagtgaacaagcggccaaagtggtcatcggattcactccgtccgattgcgcctattataagaacttcctgcgcattgagtgcaaatcgcgcgatgaaacgcgcgaatattactttttggtccatggttacggcggacgtgccgtggtggagccgacgatggaggaccgaagcgcgaacttgtgcttctccacgaacggtcaatttcaactgattgtacggtccatttcgaaatttcgtttttggctg

SEQ ID NO: 89990 - DNA, 609 bp, Heterodera glycines
  SCN-specific regions: Sequence locations=1-315,337-609
ctccctcacccgcatcatcatcaccagcacaaatcgcacggcctctgggagctgaccagcttgaacttctcgtccacgcccgccgttgacaacgatgacaagcagcaccttgggggcaacaataatccggcattctattctcgctttacgcacgagaagcgcaatgccaaagcagcaaaagcggtttcggcgccaatgccggctaagcaaaacaacgatgccgagcagggcaaggtcaatgatgatggcattttcgctgtacaacaacaacattccgccgacgacaccaccgacgacggttgggaggaggatggcatttttgctcagtgccaaaaattgccgccgtaccaacagcaaaagtcgtcgttgctgctgacgccggccgccacgtcgtcttcctcggcaatggtggacagtgtgatcagttgccactcctcgttggcatcgacgtccgctttttctacgcagcaaaggtgctcaaacagtgccgaaatgctgacgagtggtgccggcggagtgatgttcgactcggccattgtcagcgacggcggcgcgccgtccaacttgggcttctttggccatgaacatgacgagcagcagcagaaggaa

SEQ ID NO: 89991 - DNA, 1269 bp, Heterodera glycines
  SCN-specific regions: Sequence locations=1-130,152-345,369-1070,1093 -1269
cccagcccaaccccagaagtgaccttcaaagatcgttcagtgcatgagattcacttggagaatggctacacttatgttattgagcagaacttaaagcacttcgcctcggttatcaccgttttggccaagttcagtgagcaaattctgttgcaaccgaccgaagacggtttgatgctgtccgcctcttcctccgcgcggtcggcttacgcaaaagtgaaactgtgccgtcagttttttgaccggctgagggcacgcgaaaatttggggccggacggcgaagtgttctgtcggctggccacgaagagtttgatgcacattttcaaaagcgcggcccaatcgtccgtcggccccgtcccctcgtgctcacttgagttggacccccaatcggactttgcctacgtccatctccaatgtttgtccggcattcggcgctgttttgtgctgtcgttgcgtgagtatgccatggtctgtgacaatgtgttcaacgagcggcaacggctcaagaatcgggtgaccgcccacgccaaaatgctcgccactcttttgagtccgttggactgcagcgatctggaattggttgcgttggccgaccgattcaccgcctgccggtacatccctcgcgaggagtacggaaaagtcagacgaacggaggtgcaaattccggtggaccactgcgagcagtaccgcatcgaagtgcccacccgcgtggtggtcaacctgcgcgagttgcgccccatccttcagtttgccgacctttgtggcatgtccgtctcgctgcactttgaccgtgccggacgcccgctgattgttgcggtggaagagaatgtggactttgccgctgaatttgtgctcggcaccctcgatgaacagttgccgctcaatgagcaacaacaacaaccgacgccgcagcagcaacaagaacagcaacccgtagtccaacaacgcgaagaacaaccgccacaacatcggcacaaccaaatgctgcggcaccattcgccggcccctgcggcagtcgcagaacgggtggaggaggaacacaacgaaacgacgccaaaccgtgaccaaatgttgatggtgcagcaggaggaggacgtccaactgtccatccgctcgacaccgattctcccgattgcagcgctgcggcaggaggaacacaacgaaacagcaccaaaccatggccaaatgtctatcggtcccacgcccattctcgcggtcgccgcaacggtgcagcagcagcaggaggcgcacaatgaaatttcacaaaatgat

SEQ ID NO: 89992 - DNA, 618 bp, Heterodera glycines
  SCN-specific regions: Sequence locations=1-45,91-618
gtccaattaagaatcccaatgaacgatttgctgcctttgcccaattccctctcgtccccctcgttgttgtcctcctcctcctcctccgccgatgctgtcaaggagtaccgattggttctgttgggcacccaacacaaaaagccattgttcgaaaaaatgtgttcagcagcacaaaagtttgaacagcacattcaatacgcggacatttggtatttaacgtttcaattcaaagacagcgaagagccggttgtggtggaaataaccgacccaggcacagagaaaacgggcgaacgccaaatggccatccaacaaaaatcagacgcgatcattctctgctactccgctttcaatcccggctcatttctcgccttggagtccgtcacagaggactttcaaacattcaatggaaaaccgcccgccactctgctgctgtgcaacgaggaccaattggcggaggagggcttcgaggacggacacgaaacggacactgctgacgacggatacggcaccaactcgggcggagggtcgccgtcggacagagaaatgccaccacagacagtgccaaaaaggaggagcacaacgccaacggggagacagcattcgatggagcgaatccga

SEQ ID NO: 89993 - DNA, 657 bp, Heterodera glycines
  SCN-specific regions: Sequence locations=1-303,327-515,537-657
gtccatttaagtcaaggagtcatacatttaatgactcgatctcgaagtggcagtcgttgtggcgatgttgttcgttatgtgcttggacagaatacacatcagcagagttacaaccaacacatttacgatgacattgatgttttcctcgacttttcgcactgccgtccgagtgatcaggagcgtgccctcttctttgagttggaagcggtccttcagtttgcccagcgttccgccgattgtttggccatttacggcgctggtgctagtgccgaagttcgtgcagcactgcaaaattgtgatgatgctgacatacaaaatgcttcttttgccatcgtccgtcaattcgtccgtcgcattcgcaaatattttgaaacggcgcaacgaattgaaaaggtggtccctgagctgttgtgggagctctgttccggccctttgcctcccgttgagcagctcgactcggcccaagccctctgcaaacaactcgcccgactcatcgatttcgtctttcattttgaaaaaatgaaaatgaacacacccggcgatgcaggaacgactttcagttttttcaggcgagtgatttcgcggaagcaagcggcggcgcgcgaagcggagaccgactgttccctcgagttgggccacaccatttccctgttcctc

SEQ ID NO: 89994 - DNA, 534 bp, Heterodera glycines
  SCN-specific regions: Sequence locations=1-168,190-349,372-415,437 -466,506-534
caagtttgaggttttaaataattccgctaatatttgttaattcatttttggcctttctctgctcaaatgcgactcgttcagcttctccatttggcactgcttgttcagcttttgctggcgcctgttcttttggccgttggccaaaccgatgaaaaagtcaaacgaattcaaaagagagaggggccccccgaggcgaatttggtcgacaaaagtgcggtgccggccgaagggaatggcatgaaaatacggagacgacgcggcaccaaactgaaggcaatggcaggcggtgccgcggcaggactcggcgcggcacttctctacaaagcatttaagggcaaaggctaattgaatgagggaggagaagcagcggagaagggagggaatctccgaaggggtgataatccgaaagatattcataaatgaattaaaaataaattaacaaggaaatacgaaataacattcaatgaaataataaaattcacttttatttaaattaaaaataatacttattgcacttaaaaagttattttactt

SEQ ID NO: 89995 - DNA, 209 bp, Heterodera glycines
  SCN-specific regions: Sequence locations=1-78,100-183
ctgaacccggcaataaaaaagagacgcggagaaacggggagaaaaatcggcgcctaagaaaatttgattgactttgtcttttttgacatggaattttgcacttttattatttttgctgttttttttttttgtctcttttgctgcagctgagtgtctaactgtcgcgtaaaaataaatttgcttaaacaaaaaaaaaaaaaaaaaaaaaa

SEQ ID NO: 89996 - DNA, 637 bp, Heterodera glycines
  SCN-specific regions: Sequence locations=1-551,573-577,611-637
gtttgagtcactttctttctaatgttggccaccgttcgctttcactccgtcactaacaatcgcattgattgttgtcaacaaactctgttttcgctggacgatagtgagaatttgccggggacggacttttccgttgggaaagcgaagtcaaaacttttgtcggatgggcggagagagcagcagaaaatggcgaagaaaacgaacggcggaaaaacggagggaattggcaaaacagcggcaggtggcagcagagggtccgactcccttctgacggacgaagtccaattggacggaggcgccgccgacggcgcgtcggacgacgaaagcggcgactttttgcccattgcattgggcacaaaatgtgccgccggtcacgcagaggaaaacggccgggcaaattgggcggccaattggcgactcagcggacgacggtgtctgaagagggcgtccgttgttttgggctgctgtttcccatgggccgttggctttaaacaattcaaatgatcgcaatttgccatttccttttcatttcccttgaatctcaacatttgcttcacagcaatcattaaatgttctcattattattattattattattattattattattgaattttacaaaaataatgtaatttta

SEQ ID NO: 89997 - DNA, 648 bp, Heterodera glycines
  SCN-specific regions: Sequence locations=1-95,117-648
tatttaagttatattttcactacataattttgatttgctggtaaatgtctctgtacgacgacattggaattgaatcatcaacatcagtgcaggtcaaagaagagaatttggagaaaaaagctgatgactttccgacaccaaactctgctcaagaaaccccaaaatgtcaccgtctcagcagtgtcagcggccaacaaaatgaatttgtccctttctcaaattcgcaactcgtaagccaagaaagccattctacagaatgcggccgctgccgcttcacaaaataaatcagcccccggcgttgccttcgcgcagccgttacccgccactcttccgaatatgcctcagctgctgaacaagaagggcggcacgttcaagctgaagccacacaaagcaattccattgcccatcgattcgaccggcgctttcactttggtgccgaaatcactgaaagaagacaaagtatttttgtttggtgaactgatggtggaagacgagtacaacccaaccgcacccactgattattcgtcgtttaaacagaaaagggagcaacaacggttaaaggagaaaattgccaaagaaattgcggatcggctggccaaggaagcggcggatgaggaagacaaacggcggaagggcgccgccatcgca

SEQ ID NO: 89998 - DNA, 651 bp, Heterodera glycines
  SCN-specific regions: Sequence locations=1-533,555-651
ggaacttcgatttaacgatttcctataagcgaagttatacacagaatgagttccgcttcttcacctgtgccttcacttatccttaactcgggcttcccaatgtctcaaattgggtttggcacttggatgtgcaaaccaacagaggtcaacgaaattgttaaaagtgccattcgtaatggatatcggcatttggattgtgcattcatttatcaaaatcaatcggagattggcgcagctctcaaagacatgctccaacacggagagattaagcgcgaggatttgttcatcaccagcaaagtttggaacacttttcacagctttgacgccgcattggcaaatgtccaaaaaagcttagaacagctcgggcttgattatttggacctttgtctgatccattggcccatgggttacaaagaggggacagaactcttcccaaaggacgcggagggacagaaagtgtttttgtcggacgtggactttttggacacgtggcgggcgttggaaaaggcggtggcccttggcagagttcggtccatcggcgtgtccaatttcaactcggcccaaattcaacggatcatcgacaattgcaacatcagaccaagcgttttacagacggaatgtcacgtgttcttccagcagaaaaagttgcgc

SEQ ID NO: 89999 - DNA, 1049 bp, Heterodera glycines
  SCN-specific regions: Sequence locations=1-338,360-406,453-823,846 -1049
tatcagagacgagggtttgagcacttaaaaattattttaaatcacttgaaaagaagcatgggttctttctctaaattggcaatcgaccaactcgaacttaaggggaaacgcgttttaatgcgcgtcgattttaacgtgccaattaaggatggcaaagtgacgagcaatcagcgcattgtggccgctctgtcgacaattaaatatgccattgaccatgaagcaaagtcagttgtgttgatgagtcacttgggacgaccggacggccaagcacaggcaaaatattcgatgaagccggtgcacgaggaattggagcgactgcttggaaagacggttgtctttttgactgactgtgtcgggacagaaattgaaaatgcgaccgccgacccaaagccgggcaccatcattttgctggagaaccttcgttttcatgtggaggaggagggaaaaggcaaaaattcggctggcgaaacagtgaaagcgtccaaagaggcggtgaacgcctttcgtgcatctctctcaaaacatggcgacctttacgtgaacgacgcatttggcacggcgcatcgagcgcatagttcaatggtcggctgtgcgatggagaagagggcgtctggttttctgatgaagaaggagttggagtattttgccaaggcactcgagtcgcccacccgtccattcctggccattctcggcggtgccaaagtggcggacaaaattcagctgatcaacaatttgttggacaaggtggacgagatggtcatctgcggtggcatggcattcactttctacaaagtgctcaccggcaaatccattggcaaatcgttgtttgacgaggagggttccaaaattatcaacgatttgatggcaaaagcgaaggacaaaaatgtgaaaattcaccaaccggttgattttgtggttggcgatgagttcaaagagggcactccattcgccaatgttgacgcaaaggatggaattccgaacggaaaaatgggcttggacattggtcaggaaactctcaaacaatttgccgaagtgattggacgtgcaaa

SEQ ID NO: 90000 - DNA, 618 bp, Heterodera glycines
  SCN-specific regions: Sequence locations=1-531,553-618
gtccaattaagcctttctttttgactttccattgactgtgctttttgtccacctttcgtcttcaattttgttcatccaaaatggcggaggaaaccagcaaaaccagtgaaaacatcgctgaggacaacggcatcaaagcgctcgactctttgtttgccgccgtcgcccacgcctcaaaatgtttggcatccgctgccggcacgcccaacttctgcttggccacgcccgccttcctcgccttcatggtttggtgctgtttcctcatgccgccggtcgctgtgcttttccgcagttaccgccgcgacggcaacgcgttcactgtgcaggcggcgtacaacgtcattctgtgcttcttcctctgggtgcccggcatgttgcacgccctttggttctgtttcggtgagacggtgcgtatgcttcgtcgtcgcgtgccgccatcggacgacgcacagaaaaacgaataagggaaaagcaacgaaggatgacagagagagacacaacggcaccgattagacactaattagacgataatttatatgttttaaatagatttcttaaattcttaagtgtttttattttgaggtgcataaaaaaagacacattcaaaaaaaaaaaaaa

SEQ ID NO: 90001 - DNA, 466 bp, Heterodera glycines
  SCN-specific regions: Sequence locations=1-146,168-440
gccgccgatttcctcccaataaaaagcaccaaattctcattaacaaaaagccttcaaaaaaaaaatgcattttttgttgaacttcaagctttttgcatccatctttcttgtactttgtgtggtttcgtttgtcgtctgccaggacaagccagctgaagcatgccttcatcccaaagacgagggaactggcggcttggcactcacacgatggtggtgggacggtagtgattgcgaggaatttacctacaaagggcagggcggcaacacaaacaatttcccatcaaaggagctttgtgatgacgtgtgcaagccatgaatgagccgtggaaagaagatgcaacatgaagagacaagcaaagaagaaaatcaaagaaattaaattcaaaaaatgaaatgtagcactaatgcctaatgattttgtggaataaacaaaacattgcaaaaaaaaaaaaaaaaaaaaaaaaaa

SEQ ID NO: 90002 - DNA, 703 bp, Heterodera glycines
  SCN-specific regions: Sequence locations=1-507,529-631,654-703
tgacaattttggcaattttttgtttggcatttgttcaccttggcatttctggcaaatacgataagtcggatgagcacgatggcaaatatggtgccggtccacctggtggctactcacatgagaacaacaacaacaacaattatggtggcgattcttcgggcgaaaaatatgagacaatggaacatatgtggtcatgtgccaccaaatggcaatgggaaaagcccggcgtgtcaatgaaatgggaaattaccgacacactcaccgaagcggcggtggacacggattgcccatcacggaaaaatcggatgaacaattgttgctacttgcagactgaatgctacaacaagcaaataggacaaaagagctgtgacaaccaattctgtgaatgtatggagcgagccactgctggcaaaaaacgatgctcaatttgggaggggccaggcttctgtcgtcattaccgcttatacggcgaatcggcataccgcgcagcggcccccccgttttggagcagttgtggcactgtgttgaacagcgaaaaatatttgggatgtccttgcggcacgtacaaaacatgggaacgctgcggttttctgtatatgggctaccgttacctgtgctatgcgtgctaatcaaaaaatatataataatttttagttttgtcactcatgcttattttgtggaagtgataaatttgtttttagaa

SEQ ID NO: 90003 - DNA, 676 bp, Heterodera glycines
  SCN-specific regions: Sequence locations=1-417,440-647,669-676
cggacagtttgcgccggttggccttcttcggcgtggcactgtccaccgtcagtacgctgatctgcgttctctccgtgccgatggtgtatagttacgtgcagcacatcaactcacaaatgatggccgaagttgacttctgcaaaatgcgttccggcaatatttggcgcgaagtgacgcgcactcagggaatgcatgcggctgactcgccaccgcgtggcgcgtaatgctgacgcgtgctgcggctgtggcgaatccccgcgtggtccgcccggccctcccggcccagatggaaatcccggcggcgacggacagcccggcggacctggacagcctggcgcaccggcacaggctccgccgcgtccgaaaccgagcggcacaggatgtcaaacatgtgctccggccgagaacggacatcccggcccccagggcccacccggccaacctggcgcagcgggagagcccggggcacccggctatcccggcaaaaagggcccacgcggtccgcccggtccagcgggtccggacggaaagcccggcgacgccggagcacccggacagccaggcgcaccaggagaactcaagcccggacccgtcaaagtgggaccgcccggcccgcctggctatcccggcaaacccggcggacctggccaacctggccaacctggagagcccggac

SEQ ID NO: 90004 - DNA, 663 bp, Heterodera glycines
  SCN-specific regions: Sequence locations=1-663
cgatcgttcactcgtagctgacaaattcactaattaccaggtgattcttatagcatctacccatttaaaatgtcaaagattcccaaattggcacccgccggcttgaagaatcgggccccaagtccttttatcgcatggcttcgcaatgctttgctcaaagtcaagcgtgatccgactttaacaccaccatcgaacattcctaagccagatgaacagagtcagttcagaccacacaatcgcttccccaacactcagtccagtcgtagcattgagccagcgatggcgcagggcggcgtgcaccacaaattggccgacaattattacttggaacgcgacggacgccgcgaagttcgtccaccgaagcccatttacaaagcgctgggagagacgccgttgtgggaaaagccgagcggtgggcaatcgctgaccactgaacaaatggggaaaaacattggtgccgccatcaacaaaggccctgcccaaaattatggcatttcttttccgactcctggcttcggctatgaatggaaacgcaacgccgaggtggagcagttcacgcagcaaagaaacgcggaatttgccaaactcgagaagtacgacaaatttgtgaaatagagcgtttcatccaatggaatgattgattttaagttacggggcagcaga

SEQ ID NO: 90005 - DNA, 641 bp, Heterodera glycines
  SCN-specific regions: Sequence locations=1-143,165-344,366-641
gtttgagttgtcagtgtataacatgtttctggtataagtgtctttcgtctccacgtttctcaatttttgtccgggcgattgatttgccgctcccttccactgtcgtcactccaaaattcccaactcaactctccccggccaaatctccacgttcggctcttctttcaggggtcatctgagcaacctttttggaagtgttcagcagtggtttaacacttcggccagcgcgagagttgtatcatcggcagacgaagcgttcactccgtccttcgaacaaagtgcacttagcccaccgctcagccaaactcatatgaattcgattagcagccaaggactcgccgaaccatctgtgatgaacaattccaacaccaatctgcaaacatttcgcgaagtgttgttcaatgaaactgtgctgaagttgctgaggcgttacgaatttgttgggtccatagggtcgggggcacaaggattggttatttgctgcaaggatttgctgacgaatcaacgtgtggcaatcaaaaggctgacgaggcctttcacccaatgttatccacgcaaaaagggcttatcgtgagttcgaaatcatgaacctggtgaaccatcgcaacatcatcaaattactttacgcgtacacctcccaa

SEQ ID NO: 90006 - DNA, 809 bp, Heterodera glycines
  SCN-specific regions: Sequence locations=1-809
cccaattcttcctcattagcattaattaattaattcgtttcccttcccaaatgccttttctgtcccttttctcttccgtctccgcttttgcccttctctctctcctttccttttcttcttctgtccatcacttccatcataaccatcactccgattcgtccaaaggacacaacggccatcatcagcagaaggaccatcaaacggcacaagaaattccttccaattcgttcccttgcgcctgcggcggtcattcgtccggcggggaaaatgcgcgatggatgaacggaatgccggcgaatggagttccgttgtttttgtttccggacaatgtcttgcgattggtcggcgtcgttctccgaagtgaaaatgcttttcatagggacaacaacgaattggcgcggcatcttttccatcttttggcccaccagttcccccgaaaatggtttatcgtcggaatcggcacaatgccatcgaatggtgcgaacgaaccgaaaatgtgggcccgcgaaggaatcgacgcactgaacgggactgtacagttgcaaagcccgcccggttacggtagctttccctttttggacggacggcgttttcaacgagaaaacggaagcaaaatttggtatttcgtatatgcggtggagccaatgacggacaaagcaaaggacggattgccaaagcaaagcttggcaaagtgtttgtcggaaggttgcccttctcgcgacaatttcgcctcactttgtgccaacaatcgccgtcagcttggaacggtcgtcgaatttgaccaaagttcggaaatgtccattttcgca

SEQ ID NO: 90007 - DNA, 332 bp, Heterodera glycines
  SCN-specific regions: Sequence locations=1-240,276-308
aattggagattgggggcttaatggagattgggggataattagagcaaatacggtaggccattttgccgtaaattgtctcattttagtgcattttcctccaatctcttacaattagcaaaatctctcctcctacgcttgtaacttttcccatagttctctttgcttcttttctttcactttttatttctttccgtttcaaagccttttccgttttctctctctctctccattcattacgggtttttttgtttaattatttattttcatatattattgttgattatacggcattaaaaaaaattcatgtgaaaaaaaaaaaaaaaaaaaaaaaa

SEQ ID NO: 90008 - DNA, 297 bp, Heterodera glycines
  SCN-specific regions: Sequence locations=1-121,143-276
acagaacgatgtgtgcgtgctgaactgtcgcatcgacttgggcatctgtgtggtcaaaaagtgcagcctgactgtgtgccctcggcccaaggatttcgggtcggtgccatgagaagtgccgaagcaaatgaggaaaatgcagaatgatcagagagagggagagaagagcagaggagagatgaacagcagccaattcaaatcactggtgatcagtgctaattgcctaccaattgaccgatcaattatttgactgatcgaaatttttatttacaaacgaaaaaaaaaaaaaaaaaaaaa

SEQ ID NO: 90009 - DNA, 522 bp, Heterodera glycines
  SCN-specific regions: Sequence locations=1-21,43-500
gtttgaggtgtcccatcggaatgcttttcgcctcttccgtcttccgcttctttctccgtcctcctccaaagcgttattcgtccttcctcctgaacacaatgtggagccctctcttctgtctgctggtcttcgctggtttggccgcgtgttgcgtttcccttccacagattcaatacgtcaatgacaagccgtactatctgatgcagaacatggaatgtcgaggaggcaaaatttacgagatcaatcaggtccaggacatcgacgagtgcaaggcggcatgtgtaactcggaattgccgggcagtcaacctcttccagctgggcgagttccaattcaaatgcgaaattttggcccatgtccacgggtacttccctgcccaaggagccgcttgttacatttcttacgtttgaaagagagagggcaatgtgacagattaatgaaaagcgatgtttttgcatttttatttttttagtttttttccctttgcttttttcccttaataaattttcttttgtgaaaaaa

SEQ ID NO: 90010 - DNA, 772 bp, Heterodera glycines
  SCN-specific regions: Sequence locations=1-772
ttgagttttcttttcgctcaaaagggcacatgtcgccatcagcacaaagggaagtgttcgcgtcgcgcgtctttccctgcgattcattggcgccgctcacaccgaatggcacgacaaatgcaccggcgcccctttcgaaagtgtcgacagagtcctcgacgagtacagagacttgaccagcgaactttcgtccctttgcgatggctccaccgaactttcccccggcgaacattccgtcgcttttcacttcaaactgccgatggattccgtgtcgaccattgccaaagacggacacggcgtggtcaaatacttttgcgttgcgtcgttggatttgcccgacgacgggggagacaacgaaatcgttgcggagaaggaattcgctgtcactgcctatctgaacttagacgcgcctcattttcgagagcccgcccattcctccgaacaaattaccaaaggcggagttttttgcggaagaatacggcgggtgaaggcggagctgtgcgtcgaggaattgggcttaatgacgggagagacatgcgaagtgacactgacagtggagaacacagcgaaaagggggcgccggaaaagccacgccggggaggggcacaaatgcggactgatcagtctgtgccagcaggtcgacttcaaggccaaggccaaaacgggagaatggcagaaacggtctctgacgacggcggtacaaagccagggcatttgcaaagcgaactgtgccaagaagcccgaaaccaggagaacacagttcataatccca

SEQ ID NO: 90011 - DNA, 677 bp, Heterodera glycines
  SCN-specific regions: Sequence locations=1-677
gtccatttaagcaatttgttaaacaactttttgagcaataatatcaaatcatatttgaatggatccgtccgctccagcgaagaagcgtggccgaccaccgaaggcgggcggcgtagcgaaaacaattgccaagaaaccaccagcgaccacaaaagcggcgcccaagtcgccgtccaagtcaccagccaaatcgcctccgagttcaccaccgcagccggcaaagggctcgcccgccgcaaagaacgccgtcaagccggcagcagcgactggacgcggccgtggccgcccaaagggcaccggcacatcggcagcagcgaagaagaaggcggccgcaccggcgggcggaggcacgggcaagcgcggacgcccaccgaagaagacagcgcagaaggccaaggagagcgatacggacgagcacgacgaggggactgaccctgacgaatcggcgagcagcaaatcgccctgacttttgacgtgttgaatgtgtgacttttgctgacccttgcgcggatggatctctgtgtaatgatgataatttcaccacccccattttttgtttgtttgttttttcttttgatttcttccgtttattttgacaccctttttttgtctccctttttcccccttttattttctgtcgcattctcgtaccattaaccaacccacacactgttctt

SEQ ID NO: 90012 - DNA, 1105 bp, Heterodera glycines
  SCN-specific regions: Sequence locations=1-303,325-567,590-738,760 -827,852-1105
atccgctggacgattcgctaagtgaatttgacagagcgcaactgcgcgaattggacatgtttgaggacaacagcaacaaattttgcgaagtcgaagatgaaaatcccgaacgaatgcattacgtcaacttggccaagaaccccgagcggtacaccggttacaaaggcaattcggcggtcaaagtttggaagtgcatttacaacgagaactgtttcaaacccgacccgaaattcgacaaaaagtttctcctccaaccgacgccaacggggatgtgtttggagaagagagtgttctatcggctcatctccggccttcactcggccattaccgtttcgattgcggcccacaattacagaccggcccccggcggtttcggcaccggcacttggtaccgaaatgttgaattttttgaaaatcgcttcggtacgaaatggggcaaagaagggcccgaacggttgaggaatttgtacttcacttacatgctggaactgagggcattggtcaaagcgacgccgtacatccgaaaaagtcaactgttctacacgggcaacgagcaggaagaccgagaaacgcagcaatccttggaacacttcctcgccgtgctcaaagagttccccaaccaattcgacgagactcaacttttctcgaatttccaagagtcccacgcccgtctgctgaaggaggagtttcgcctgcacttttggaacatttcgcgtattatggactgtgtcggctgcgacaagtgccgactttggggcaaattgcaaacgcacggaatgggaacggcactgaaagtgctcttttcggaccttccgcggaacggaaacggagggaaagcgaacggaaggaaagagcaaacggaaaacggagaaagtgcagcgaacggcggacttttcaaattgacaagaaatgatttggtcgctctgttccaaagctttggcagatattcctccagcatttgggagatcgacggattcagaaaagagttccgacacgacgaattgtgaattgtccgctgaatttctttttcgtttcgcaaatgtcccatttttcctcctcctcgtttcctctccttttgtacgatgagtccgattaatttatttct

SEQ ID NO: 90013 - DNA, 622 bp, Heterodera glycines
  SCN-specific regions: Sequence locations=1-153,180-246,268-622
ggaacttggaaatcattcttcaaaatgggtcgcgttcgcaccaagactgtcaagaaggcctcccgggtcatgattgagaagtactacccccgcctcaccttggacttccagtccaacaagaaggtcgcctcggaggttgcttccatctcgtccaagcgtctccgcaacaagattgctggtttcaccacccacttgatgcgccgcattcaaaagggtcccgtccgcggcatctccttcaaactccaagaggaggagcgtgagcgcaaggacaactacgttcccgatgtgtctgctcttgagcagaatgagctcgttgttgacaccgagaccgctgcccttttggcgtccctcgacatcaagcttccccaaatccgcaccgtcgctgtcaccgcccaaggtgagcgtcaaggccggaacgccgttgtgggcgccaacttccgtggcgaccgcggtgaccgcccccgtcgccccaagacccagcagtaagttgcatttgttctcttccgagctgtgcaaacttttcatccaacacgatgtattttgcttgattggtatcgcttgttggcgcgggctgggcatttcgaccgccatcaatacaccaacattggtcaatctaaaaaaa

SEQ ID NO: 90014 - DNA, 217 bp, Heterodera glycines
  SCN-specific regions: Sequence locations=1-217
taaaatctttcccggaatgtctgcggataaaacgggcgcactttttgtgggcgatatcattttagccgtcaatggcgagtcattactcaatgcccggcatgacgacgctgtccgtgcacttaaacaaaacgggaaaatggtcaatttgcaagtgcaatatcgacgcgatttgcacctccgtcgggagaatatgctgcaccggctgaattgggaggag

SEQ ID NO: 90015 - DNA, 911 bp, Heterodera glycines
  SCN-specific regions: Sequence locations=1-389,411-500,522-884,907-911
gaccagcaaaactcatgcatgattcgactgataatcgacgaaccaacccaactctgtgcgactcttttccaacaacatgctcgtaccatgttggaccaagttgacattatgctgctgctccatagacaggacggcgaggctacgcctggtgaattgatttgccggtcatcgcgtcgagttttgccgtgtgtgcgaattgatgacacttttttgcctcgtggagagtatttgctctgtgcccattcattttcaaaatttggagaacaaatggtttcggggactattgtcatacacagttcacgggaaattcaaaccatgaaactgcggaccacaactctcgacgacttgcgtcagtcaatgtgttctttgctgctcaaagaaggcgtcctccaaaattcttctcctgggattgccacacgttatctcaccaatgaatttgctggtttggtgttaatggtggacaattacagctcggacaattgtttgaaggtccattccgattgtcaaaactcaacaaatgttctttccactcgttcttctttgcttgcgttcgattccatccctccgctgcatcgacaggttgtcactcttttgacgcacttcgaaccctcccaatcttttatggtcactcatcgatgggtttaccaccaaacaaaattcccacaactgcgcgactttgtgccctgcactgaatttgcttccgctcagaattttccaccgttacaaacggaaacaatcggttatttgcatggcccttttccggtctataaatgatttgttcacatcttctaatttcgtcaaacatatcttttctatttcttttgtggatttattttttcccatcttcagcatctcatacatatcacttccattgtatattttcctcctttcatcaatgaatttattgactt

SEQ ID NO: 90016 - DNA, 736 bp, Heterodera glycines
  misc_feature (714)..(714): n is a, c, g, or t
  SCN-specific regions: Sequence locations=1-518,540-631,653-714
taatgtttcacattcaccgctatgacaaattgcaatggtgtggactggcgatccatcgtcgcactttgagtttgaccgtcgactattgtcgttatcgccagcgccgtccgtccatttcttttccgtcttccgccgttcgctcatccgaccattttcgcttcatttgcaacaccaccaatcatcgctttttgccattgggggttgggcgtctcaactcaattttgcattcgactgtttgcggagttggcccctctaatttttcagccggttttgcaaatcatttggttcaacatcgctttctttcttcaaagtctgatggtttgaacgtcttcgaaccgaagtggaagaaggcaattctagttgtactccttgtctctgctgttatcgttttgataatactggaggccagatcgaatttggcgaccgacgaagagggggaaggtttggaggagcaccggcggaaggaagaggagaagcggaggggccgccaggagcggatggcagctaatcggctgcctccggcagagccggaggccgaggaagagccggaggttattccatggcaagcgcgtagcgcggatgacgatgatgatcatgatgatccggatgcgcccgacaattggcgaaaccggacaaactgaagaaataagaaattgttgtggacagccattttttgaatgttatgttgatctctcgcataaattgtttttgttnaaaaaaaaaaaaaaaaaaaaaa

SEQ ID NO: 90017 - DNA, 737 bp, Heterodera glycines
  SCN-specific regions: Sequence locations=1-83,105-687,709-737
gccatccggaacatttcaaggcgaaagttctgtggatgctgcgcaagttaaaagccaatcgtgaacgcccgccttcactaatcttcattattcgcgatggactggacgaaggaaaagtggacaatgcgttgtccagtgagattgggctgtttcgcgaaagctgttctcagatcagccaatcgtggaagccgaaatttgtttattgtttggcggacaaacgacacaacagacgctttttcgaggtcgaggaacggctgccggacgcggcccagccgcgcaatgtgtgcaacccgcaaccgggttccgcggtcgatcgcaagttgacccgttcgggtgttctcaacctctacgttcaagcccatcatcccgtacgcgggacagcgaagattcccgagtttattttcccatgtaacgaagtgtgtgctaccaaggaggagttggaggcatttatcaacggactctgtcactcatggcaaattgtgaaggcggcgacgtcactgccggtccccgtttaccaggcccacgaacttgcgaagcgtggaaggtccaattacatggagctgaggagaatggcgcccgaacgaattccacggagtgttgttttttcaagtgatgtgcgaacaattatccgagttgctctcttacaacgacagtcctctcagtgaaacgcgaacaacggcttaatccaaaaatcagataatgacactgatggactaatattataaaagcggaaacaa

SEQ ID NO: 90018 - DNA, 604 bp, Heterodera glycines
  SCN-specific regions: Sequence locations=1-495,518-604
gtttagttttgatggaaggcatcgatcagcctgtgacaaaaacgtgcaccatcgttgaaaaggactacgaccaacacgagctgttcatcttccggcctctcaagttcaacacctgctcagtcgtcaaactttccatcgaacccataaatccgtcagaactgccaaaaatgctcgactcgctgcgtaaagtgaacaaatcctacccactgctgaccacccgagtagaggaaagtggggagcacgtgatgctcggaacgggcgaactttacatggactgtgtgatgcacgacatgagaaaggtgttctccgaaatcgacatcaaagtcgctgacccggtggtgtccttctgcgaaactgtcggcgaaacttcgtccctgaaatgttttgctcaaacacccaaccaaaagaacaaaataacgatgattgccgaacccctcgagaagggattggcggaggatatcgaaggcgaaattgtgaagatcatttggaatagaaagcaacttggtgactttttccaaaccaaatacgaatgggatttgctcgctgcgcgttccatttgggcatttggtcccgagacaaatggtccgaacatttttctggacga

SEQ ID NO: 90019 - DNA, 584 bp, Heterodera glycines
  SCN-specific regions: Sequence locations=1-141,182-195,228-368,405-584
gaaataacaaattcgggcaaatgggactgcatcattcttcacgacgtagatttggtgcctgaacatgatcacaatttgtaccgctgcttcaaggaccatccaacccactttttccggcgttttgacgagaataattacgcgtaatttattttattaatcatatatttatttaaataataaagaaacttacccctaaaaatatgaaaattggaaaaataatttaaaattcaaggctttcaattttcccagaatattcatattatttttgggaagactggcagttctgggtccataacttatgacagaatggtagccacaataagacatgaattcttaactcaatattttggtggatatatatgattacatttaaaaacaaatccaaaaactaattaacgaaataattaattgcattttataattaagtcctcttccggacaacaactttggcgaagtgtccggcttcaccccggaacaatatcagcgggtcaacggctactccaatctgttctggggatggggtgacgaagatgttgacatgttcaacagaattctgagtgttggctacccggacgagcgtaaaa

SEQ ID NO: 90020 - DNA, 626 bp, Heterodera glycines
  SCN-specific regions: Sequence locations=1-569,592-626
gtttgagccgcctttatctgtcccttccgcttcctgcttctcttcctcgcccttgtaattaaattccatcccctgcgctcgttttggccttccctcccacaaatgactgaagtgcctcccaacgcgcgtcaatggacactccattttggtggattggtggaagcggtcaatggcgcacacattgaccccagtggacgcactgatctactcaaagtgttggacagagccaagcgggacggcagtttgcaattggatggtggcgaaataacactgttggaatgcgattgcgatgcagtgagagtgagttcagcgaaggtggacgaaagcagcaaacctttagcattcattccactccatcagctttcttctgttggctttgtccatgaaccaccacaaaacattttggcactgaaagttggtgacgtggatgagaacaagcccgatcagtttgatctgataattctttacacttcaactgaggaaatggccggagaaatttgtcagtatttggccttctgttttcaattcatttaccgagaagcactgtcaacgctggagcaaaatgaacacgaaagggaggaaaggaaaaagacgccgcagcaaggggacatttcggcaaagttcgc

SEQ ID NO: 90021 - DNA, 738 bp, Heterodera glycines
  misc_feature (716)..(717): n is a, c, g, or t
  misc_feature (720)..(720): n is a, c, g, or t
  SCN-specific regions: Sequence locations=1-639,669-682,704-738
tgagagtttcccaaaaaacaattctgcccaatatggtcacttcttcgccagacattcagcttatttttcagtcagttgaccgcgatcggtccggtcaaatcagtgccgatgagcttcaacaggcgctgtccaatggcacatggaagccgttcaacccggagacgtgccgaatgatgatttcaatgttcgactcaaacaacgatgggggcatcaattttcaggaattcggcgcactttgggagtacatcaacgattggacgcgcacttttcgcactttcgaccgcgacaacagcggaaacatcgaccgcgacgaattggtcaatgcgttgacacaattcggttatcgtctgtccggcactttttacgatatgttaatgcgcaaatttgaccgaactcaaagcggtcgcataaacttcgacgacttcatccaactttgcgttgtgctccaaacactgactaccgcttttcgagaaaaggacaccgaccgggacggatggattcgaatttattatgaggaattcctcgccatggttttctcgctgaagatgtaagtcaatgatggctaaacaatgagcaaaagaagggggaattattgactgatgaggatttgctaatacagtaacccacttatttttgtatgttttctgttaaacattatttacatatcactttcaattttacgacatttttgtttgaataaaaatttggaaactttnnaanaaaaaaaaaaaaaaaaaa

SEQ ID NO: 90022 - DNA, 931 bp, Heterodera glycines
  SCN-specific regions: Sequence locations=1-726,748-931
gataatttgccaataagcaatatccacattaaagcaattgaatagtctgataattactaaaatgaacaattacgaattcgccatgaattcgcctcacatggaaatggccaaattcaaggagttcatggacgactctagtgaagaatttgtcgctttgtcaccgatgatacaaaaccagcgagattggagcccatattcgaaccaaggagggaccgtttgtgtgttggttggtgacgattttgtcgtggtcgctaatgacactcgtctgacgggcgatgctgaaattgagattctgtcgcgcaagtgcgagaagacgcacattttgaccaacaaaatcataatgacttcttgcggattttacggcgatgtgctccaattgaggcgcattctcgagctacgtattaaccacttcgagtttatctaccagaggcccatgtctttggaccagtgcggtgaaatgctttcccgtactctttactcgcgtcgttttttcccctatttcacggggaccattatttgtggaattaccagtgatggccgtggtgacctttacagttacgacccggttggttgtattgaaaccaaattattcgaagcaagtggaaatggtggaagcactctgagtacatttttcgagaaccaatgggcttactcgacggtcgcacccgaggagcgtaaaaacatgccaaaacggactttggagcgtgctctttcggttatccgtgatgcttttcgtgggctgtcagagcgcgagacaaccaccggcgactctctcaatgtgtattggttgcaggcgggtgacgaaaaggttcatcaggagacttatcgcctgcgtggagattagccgcttttctgtgctgttgttggaaataatccgatcattttttgtctccgtcggcatatttttttcttataaattctgccatttaaa

SEQ ID NO: 90023 - DNA, 566 bp, Heterodera glycines
  SCN-specific regions: Sequence locations=1-44,66-256,284-407,430 -432,476-497,519-542
ttgcagccaaaactaatctcatagtctcataaactctcaattcataacaactcgagactagttctatcacttcattcccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacatggcggaggaggaggaggaggaggaggaggaaattacggtggtggagccccgggtggaaattacggcggttccagcggctcatacaatggccatcgcgcacgccgattcgcttgataaatgacaaataaagaaagtggatgatgatgaagtgttataaataaaaagtaaacaaaacaatctatttttaattactttattttaaattgtttttttaattttttagctattttagtgaatgttcgatgtttattttaataattttcctttttaataaatttgagttcatttgaaaaaaaaaaaaaaaaaaaaaaaa

SEQ ID NO: 90024 - DNA, 552 bp, Heterodera glycines
  SCN-specific regions: Sequence locations=1-206,228-552
caagtttgaggtattaaaatggaaaaggaacgtgatattttggtttcactcgcatcgaaacacagaacagttccgtatgacgttttgatgaatgctctcaaaattgcaaatgaaagggaatttgaagacttcatcattgaatcgatttatcaggatatcattcagggacggctcaatccaataaaacgccatttggagatttatgattggaaaaatgaaaaagttggcgactttcagtttatggcggagacactaaaccaatgggataaacattgcggcaattttttgaattcaattggcaccgaaatgatccgttctaataacactgccgctgagtttgtggcaaatgagaaagcggtgaacgaagaaatcgaaaacattcggaagactttcagttacgaggacccgaagaagtttcttggcgacaaagacacgttcaaaacttcttcgaagcccgaagcaaagaaattcaaaagcatgaaaaataagaagccaggaaattagcacttttgttttgtgtgcaatttttgcgtaaataatttatgcaaaaaa

SEQ ID NO: 90025 - DNA, 569 bp, Heterodera glycines
  SCN-specific regions: Sequence locations=32-493,516-532
cctcgtgccgaattcggcacgaggtggtcgtattttgtacgctgtgttggagcattcttttcggcaacgcgagggggacgaaaagcgatgctatcttgaacttccgcccctaattgcaccgatcaaatgctcaattttgcccatttcttctaatgagcgacttgacccaataatctttgctgttcgggaccaactgacctctcgagaaatctcttctaaaattgatgacagttctggttccattggtcgtcgctatgctcgaactgacgaaattggcataccatttggcattacggtggactttgagtctgagttgcagccgtggactgtgaccttgcgaaatgcgccaacaatgcaacaaattcgtgtttctgttagtgaaattggtgaagttgtcgggcatttggtgaaaggcaaaatgaattgggagacagcaatggccaaatacccaattttcaatgccaaataaatatttgcatttcatacatattgtattttattgactttctttttgttgggattataagtttataaaaaaaaaaaaaaaaaaaaaaaaaaaaaaaaaaaaa

SEQ ID NO: 90026 - DNA, 648 bp, Heterodera glycines
  SCN-specific regions: Sequence locations=1-648
ttaagattcaataaaaaattttaatgcatttgtcagtttgttcattattgctaaaaaggcttccttctacacgcttggccactacgcttgctaatgttagggcaaaaaatgtgaagcagccgtcgactgagcggataaatgcaatttctctggatgatttcccaattgcttatcctgattttcttcgctccgaagttcttgatcgtagagacccgttgtttgaacaactcgtccaagcagacatgtttgaaagacgtatggtaattgacatccccgaattctatgttggttctgtgttagctgtcacaatgtctgaccctaacaccgtaagtaagcagcacagattcgttggcatatgcattcggcgcgaaaaacagggacttcagcacacttttacacttcgaaatgttattgatggcctcggtattgaaattatgtacgaaatatacaacccaacaattttgcggattgaaactcttttgctcgagaaaagactggacgaggacctcacctaccttgcggatgctttgcccgagtacaccactttcaaattcaacatggaaccagtgagccatacagcaggaaaaccggttcccgtgaaccccttaaaggtgaagctgaagcctccgccatggacacttcaatggt

SEQ ID NO: 90027 - DNA, 650 bp, Heterodera glycines
  SCN-specific regions: Sequence locations=1-650
agtccttaagcttatttcattaattttgatgtcaagcttgctatgagctttcaatggccttggcattttgattttcctccatttttcaccatccaaccaaacctttcaactcgtgacaaacaactaaaagcttggggacgacttttgctcgattattgccaagcaaatcgtatttacaccactgatttggacgaaatttcaaagtcggatttattcaacaatcgtcgactgaatagacatttggatctgtcagggattcgggcagtgttcgactttctcgaacttcaaaaacacgttgagtggaaggataaggacaagacgcgctgcaacatttattggcgtagaccagaagagtggggccaattgctttacgagtgggcaaattcaattggattgttgaacactgtggtcacattgtacgagttgacccaaggcgaagacgtcgcgaaagaatctttttacggtttggacaaagacgtgctgttaaaagggctccaacatttggagaaccaaggcaaagctgtgctgattgacattgacggcgaaaagggcggtgtcaaatttctgtgaacaaagctttgtgttcaccgttctatggccatggaaaagggttcgaattttttgcgcaattccgacattgttgaggaggg

SEQ ID NO: 90028 - DNA, 630 bp, Heterodera glycines
  SCN-specific regions: Sequence locations=49-74,102-487,515-630
cctcgtgccgaattcggcacgaggaagttttcttttcataattgtcaattttttttaatcttcaatgaatgcctaccaacagcagcaacaacagcaacttctccaggcttactacagccaattccaaccccaaggggtggcaggtgctgacggacaagtgccggccaagtacaagagcacactgtgcaacatttggttgatggagggcatttgcacgcgcggaaaacaatgccattacgcacatgggatcaaagagctgaactacagacaagatgacacaatgagtcgcttctacaaaacatctctgtgcactttttaccagcagcgcggcttttgtaacaacggcgaccaatgtcggtgggcccatggcgaagccgaacttcgcaagggggcagacggttcttctaatggactggcgaattattacgctgcgacaatgcaagcgatggccaccggtcagcagaacgccaacggctcgtcagccgaagcggcggcggctgccgctgctgccggttggaattgaattgattctcgatcatttgtataactaaccgattgtcaaaaattgttaagaatgcataacatttgggcaaaaatgtatctttcaatttgaaaaaaaaaaaaaaaaaa

SEQ ID NO: 90029 - DNA, 629 bp, Heterodera glycines
  SCN-specific regions: Sequence locations=1-12,39-278,300-629
ccaagtttgaggtaataattttttaattaattatttttggctaaagtttaattatgatgaatttatttaaattccgagacatcgttttattacggaccattgcctttcctccgaattttgtattaaatcgtggaattaattaccgggaaaacagcaccatcggatcaaagcaaagtattggaaatgcagacgaattcaaattgcgcgaatttggccaaaaatacctcggcaaaaaagaagtgaagttcacagagaaattggaatttcgaagcagtgccaatgaagtgccaatgccaatttaccaatgcattaattcgcgaggagaatttgttgacggaagcgaagagtgtcctctgccgaaggaaatcgcagttaaaatatacaaagaaatggttaaattgaatacaatggacaaaattttgtatgaatcgcaacggcaaggacgaatttcattttatatgaccaattttggcgaggaggccagtcacatgggctcggccgccgcgttggaacttcgagatttggtctacggacagtacagagaagtgggcgtccttctgtggcgcggcttttcgttggaccaatgcatgaaccaatgctatgggaacgaattggacgaaggcaaaggc

SEQ ID NO: 90030 - DNA, 638 bp, Heterodera glycines
  SCN-specific regions: Sequence locations=1-7,29-617
gtcaaatcttacaatttttatattatttgaaagcccttcacaagcaatttcaatggaccatcttatcgcattgatcgacggtgcttgccttcgcatgcaaagtagtgcccttcattgggttagtgacagtatcaagtcgaagtccgagcctaagaagccggagaagttcaaaacgcagctgtgccatcactacagtcagaatggattttgccggttcggttccagttgttggtttgcgcatggggagaacgaacttcgctctgtctctgctggttcgtccttttcttcgcccatcgggagccgtaaaccgcgttcgttgttgccacgcccgcctccgccgctgatgttcggttccagttgttggtttgcgcatggggagaacgaacttcgctctgtttctgctggttcgtccttttcttcgcccatcgggagccgtaaaccgcgttcgttgttgccacgcccgcctccgtcgctgctgttcaacattttccccaaaaatccctgattttcccgagaatgcttttttttccgcactcaccgtttttaatttttgaaatcaaatttacattttttattgtcaaagtttttcaaactttcgaataaatttatgatctgttaaaaaaaaaaaaaaaaaaaaa

SEQ ID NO: 90031 - DNA, 643 bp, Heterodera glycines
  SCN-specific regions: Sequence locations=1-643
ttctttttatttctaaacattatgaagaagtttgactatctcgtcattggcggcggttccggtggcatcgcatcggcacgccgtgccgcggaattcaaagtgaaagtcggactcatcgagtcggagcgccttggtggcacatgcgtcaaccttggatgtgttcccaagaaagtgatgtacaacaccgccatacatgccgagtttctgcgggaccatgctgactacggcttcgactcaatgaacgtaaaattcaattggagcaaaatcaaaaattcccgtgacgaatacatccgccgtctgaattccatgtatcagaccaacttggaaaattccaaggtggaaatagtccgtggacgggccaaattcaacaaagacggctctgtcgaagtctccagaagtgatggctcaaaagagacatgtcagggtacgcacacactgatcgcagtcggcggtgcgccgcggattccgaaggacgtgccgggcgccaagtacggcacgagcagtgatggattttttggctttgagcaaatgcccaataaaacagtcgtggttggtgccggatacattgcagtcgaattggcatcaattttggctgaccttggctctgaacccatctgctgatccgttatgatcgtgttctgcg

SEQ ID NO: 90032 - DNA, 586 bp, Heterodera glycines
  SCN-specific regions: Sequence locations=1-586
gtcggctgccgacggaggacaacggcaccactagcggcgaaaatccgtcgcatcagttggacgatggggacgacgttcaccaattccaattgccgctcgcttttcggtcatcgctggtccatccatctacgacaactgcacaaaatgttcaccaccatcaattgcttcagcagccgcaactcaacatcatcgttccctccatggaatgtgtttccgtcattcatcccaaaagagagcaacaattctccgcctccgttgaccaattcttagacggcgaagacgacctattcaagacggagccgttggatttgtcgctgtcatcggcacgtacaaaggcaaacgaaaacggcacaatggtagggaatggcgcaacagtcgctggcggcatccagcgcagaaaacggacgacaaacaaaagacaaatggtggaggaaatgtgcgaaacggcggcgacggggagaaaagtgacgccaacggaagcggagaaacggacttcgcccccctccgccgttggtatttctttgcccccctccgtcgtccctccgtccggcactctcttcactcccctcgcttctccttccgctgt

SEQ ID NO: 90033 - DNA, 636 bp, Heterodera glycines
  SCN-specific regions: Sequence locations=1-636
ataaggtgcactctttaactatttctattttcgcttttggtgttgctaatgtctcaacgcgaagaacctcgtcctcaaatcaaagcgaagctcaagaactcacttatcgcttttcatttgtttctccttgtttccggtgttgtgctcttcagttttgctttgtggcttcaatttgaccctgcccgtgaatttcttctccgtctcgtccacttctccgagtccactccctttttcgagatcgctgtttacttaatgttgggcacatcgctcttcatttttattgccgtcgggattggattctcgggaatttggaagttggagcggtgtttgcttagcggattctctgtgcttcttctgctgttgatacattgcaaattgctcatccttattcttttggttgcctatcgttttaagttccccgatgacacagtaatgactgagtacctcagtaaaatggcccaacatcactaccatcgcgacaaatgggcgacacctctgatggattccgtccaattctatcacaaatgttgcggaagaaacggtgcgcaagactattcggagtcattttggtacaaagcgaacgcccaaatgggaatgccaacaaacggcgcaggacgcccgggcttggcacttgca

SEQ ID NO: 90034 - DNA, 403 bp, Heterodera glycines
  SCN-specific regions: Sequence locations=1-381
gtttgagacttccatttgacttttgaccattttctccgtctttccctatgcccgccgtcccttccggctaccaagtggtgcagcagggccgtcaaggaccttcgtgcatggacaagctgaagttgggcttcgccatgggtgttctgatcggtggctcgaccggcgttctcatcggcactttcacatcactaaggatgggcctccgtgggcgcgagttgctcagacagacgggcaaaatcgcggcgcaaatgggcggttccttcggcgtttttatgaccgttgcgcaaggcattcgatgctgagggacggccgagagagaacgttttgtgctttttatattttatttagctgttttttgttggcctaataaattatattctcaaaaaaaaaaaaaaaaaaaaaa

SEQ ID NO: 90035 - DNA, 901 bp, Heterodera glycines
  misc_feature (596)..(596): n is a, c, g, or t
  misc_feature (881)..(884): n is a, c, g, or t
  misc_feature (886)..(887): n is a, c, g, or t
  misc_feature (889)..(889): n is a, c, g, or t
  SCN-specific regions: Sequence locations=1-6,31-843,865-901
taatagattattaattaattaaattaatttgttctgtactgaaatgacccgccccttctgatcaccactcattcgcacttttgtcacttcgactcaccacttgcttttctgatggaccctcccgatctatccgagactcagccgaccattccgaaaaggggccaccaccaccggcgtcgcgtggatatctccgcctcgcgtttgccccgcgctgtgctcgtccgcatctttgggcatttgagtgtggctgagttgggtgctgtttctctcgtttgttgcagttggaaattcatcgtcgactcaaatgacttcgatctgtgggctcgccatgctcgtgctcagctgccggagagcgcgctgtccgacccgtatttgtttgtcaacatttcctcccacagggaaatgttgagggcatttaaacacgcctggaatccatcggactgttctcgaaatgcttttgtccgcaccaatggtttcaccgtccatcggcaacccattgcacagagtacggatggaattcggggcaaagttggcgtttcgagcggggcgcactgttgggaattttgctgggaaggcccactcggaactaccgctgntgttggagtggcgacaaaacatgccgcgttgcattgtcccggctatttgccggtaattggcagcgacgaccaaagctggggatggaatttggtgaacaatacaattgcgcacaacggcgaattcgtggaacgatacccgcgtctgaacaagaggaggaacgacgggagcaagcagcggaagacagaacgaacgaagaaagtgatcaagacgccgacatcgatgtcgttgactgatcgaggattgatggtttattttcactacacgtataaataaaaatgttaaannnnannanaaaaaaaaaaaa

SEQ ID NO: 90036 - DNA, 583 bp, Heterodera glycines
  SCN-specific regions: Sequence locations=1-583
cccttctgcttttgttcgcctttctcgtcattcttccgcctgtttgctcccgttatgaagatcggtacaacatgaacatgcttccctgggacctgaagccggtccaagacttcatcggcctttggcaaatggaccgcagcagcggaaacttcaaagaattgccgccaccaaatttaattgacttggccatcaatccaatcccgaaatttggagcacggacaatgaacattacgttggtttatgatttttaaaagccgacaaattcaaaaacccaaggcacacttacttggactcggcccgaaatgtcatccgaagtgattacggctttatgccagtgaaaaatgccacccgaagggacccgcgggtgcacgtggcatatctgacgacgagcagcgaaggatggtcgatgatggagcagggcttcttcaaggacggcaaattgattttccacctcaaacaattcttgaaacgctcattcggtgccgggagcaatttggacatcagagaatttgagcgtcaatttgaactgtccggcttccactcgatgacactcaaagtgcgcgccgaaacatcttttcagacg

SEQ ID NO: 90037 - DNA, 1045 bp, Heterodera glycines
  SCN-specific regions: Sequence locations=54-576,599-1045
cctcgtgccgaattcggcacgaggcaaataagcaaataaaaataagacaaaagctgaattcgaaacaaacgtgatgagcgtcgaagaatcgccacttttaagggaatttaagacatttctgcaggcgactcttgtcgcattcggaagcgatggggcacccttttcgctggtgaatcagagattcagtgaggattgggttggctcgccttctctcaaggaatacgcgaccaaattaggttatgtccatccaaatggcatcttcaaattgttgcagtcaatccctgatcaggtgacaatgatggtaaatccgaccggcgaagtcattttgaagccggtccctatggaggaaacacgcgacaatttggaaaaaatcgacgcaacaaacaaagaactcaaagctgagagaaagcgtcgccagcagtaccaacaggggcctcttccagcgtcggtcattgcgcaattggcggcaggcatctgttggcccccgccggtgcccgcgcaaccgttgtcctcggttttcaacgcgagcatcgagcgtaccgcacccctcgccactccatctatcgctactattagccgaccaccgccgccgccgccgatgacaaagaaattcaacccaaatttgattccgcttggaacgcctcggtttgcgcggtgtgccagtaccagcaacatcgctgcggacagcagcgccgacagtgggcccagtgcttccggtggaccgactccatcgccgatggtattccatccaccacaccagcagccgcaacagcaaccacaacgttcgaaggtattctttgggcagcgtaaaaaaccaccacctcctgtcgccgtgccccgcaacgatttcggcgatttggcgcctcctgtcgccgtgtcccgcaacgatttcggcgatttggcgcctcctgtggccgtgccccgcaacgatttttgcgatatgccgcctcctgccgccgtgtcccgcaacgatgtggcgcaaacgttgtcctcggtcttcaagaggaacgaaggctattatgaagaggactttcatgcgttggcg

SEQ ID NO: 90038 - DNA, 630 bp, Heterodera glycines
  SCN-specific regions: Sequence locations=1-80,102-105,128-594,616-630
gtccaattaagcttttcctcgtttaacttttcctcaaccttttgcctctctttcctcccaatttttcttttaccaatgtattctttccgttttttcctcttcgtctttttgttcatccattttcgtttcattggcacggcacaaattgtgaatggtcagcagctggacagcaattcggagcagcttcagtctaaccaaacgtacagtgtcaccaacgtcgaccgcatgtccaatgcgttccattcgccaacggacaatcagacgacttctcttctcggagacgaaaccctcaaacccagcgacaacgaagcgaactgtacgactacggaaaatggttgcgagttgaacgatggcaaatatttccttcgtttggtgctcattcttttggccgtccccaccgttctgctcattatcattgtgatggtcggtttcatcagccacaaaaagaaacgtcgtaacgaattccatttggacaacggcgccgccaccatttgagaaaagagtgacgatacgataaaccattgaaaatttggtatttgtttttgaaaatttggtattttgtttttcttgcaatcgatcagcatattcccgtgtcttttctttatggataaattgtcgatctgaaaaaaa

SEQ ID NO: 90039 - DNA, 499 bp, Heterodera glycines
  SCN-specific regions: Sequence locations=1-499
gtaaattgttcggttatcgacgcaaaaaagtgacaaaaaaggactcaatcaccggacggaacaattcatttccagtgccgtatttgtccaaattggaaggcaatcagttgcaaccggggcaatccctaattgtacgtggcattatcatttcttccgatgagtttgtcatcaatttaaccaatggtccgcgtgtcgaattggacgacgaagtgcggacactcgacgatcggttgctgtgcatgcgcgtggaaatggggcagaagaggcggaaagtgcatttgaacgcgtgcataaacggcgaatggggccgcgaggcactcatcaaacacaaatggcgaaacggcgacgaatttgacatccgagtccgatgccatgaggacgaattcgagctgttcatcgaccacaaactttgtgcccgttttgctcattatgtgccgttgtccacaatttcgcacatttacataaacggaggcattgagctgtattcggtgtcctggga

SEQ ID NO: 90040 - DNA, 320 bp, Heterodera glycines
  SCN-specific regions: Sequence locations=1-102,124-124,146-320
cctacataccactcgcctgcctcgcactccgagtcgcctatgtaccgcgttccgtttccctttcgcttggttgtgtcagggtgagtcggctctctgtgggccatcatggccacaccgcacggccgctgaactcgcagtgcatgcatgccgcgtttcgtttgtgttgatgtccgtcatctcgcagccgatcgcggtgatctcggtgtctcacggccaagcgaaagcttccagattggctgaatcaatcgtaacaacacaactgctcgccacaactccctcttttgctttcccaatcgtagacgccccacattgccattcga

SEQ ID NO: 90041 - DNA, 612 bp, Heterodera glycines
  SCN-specific regions: Sequence locations=1-612
gttgctttgattttctgtccttttggccgatgagttacaattatccgctaaaaattgtcgttgtcggcgaccacaactgtggcaagtcgtgcattttgttgcgcttttccgagaattccttccgttctgaccacgtgagtacgctcggagtcgatttcaaattgaaaaccatcaaaattggacgggacaaaattcggttggaattgtggtatttcaatgtgttaactctccgtttcatttgcatcaaaatgcttatcgttaggcatggaaaggtatcggaccatttacaattcgtattaccactcggcccacggagtgatgtgtgtgtacgacttgacaaacgaaaagtcatttcaaaatttggaaaattattggctaagacaagtgaaggaacacgcgccacaaaatgccgtcctccttatggtgggcaacaaagccgacttggactccgagcggaaggtggactttgaccgtgccgaaaatttggcaaagaaaatcggcgtgtcaatttacgaagtgagcgcaaaaacgggcataaactgtgacgacgcattcgttgaacttgccactgtcatgagggacagacttttgaactcggcattgaattccgat

SEQ ID NO: 90042 - DNA, 836 bp, Heterodera glycines
  SCN-specific regions: Sequence locations=36-456,479-792,816-836
cctcgtgccgaattcggcacgaggctttaatatataggatgtacatccgagagttagaatccccgggtgagcttcctctggtttggttaaatgcgctctcccgttcttgctttcgtccgactaaagatgaccaacttgtatcgcttgttgagctgagacaggccgcagaacggatcgcggtcgaaaacgcgcagttgaaccgggtcaatgccatgctcctaattttaattcaacgtcccgcaggagttctgcctcatcaggccgtgcccgtcgctggtgcttttggccaacaacaaaaccaacagccggccaatgcttttcccattccaccggttgtacctgttgtgcctgtcaacgcgaacaacagacttcacaccgatgaacttcaattggaaatttctcgccatgcacggaccttgaatgagctgtcggtcgaatacgctcgtttgatgcacaccaacagaacccttgttgaacaactttttgcaggtggtgcaccgccttatgttcatcaacagtttgaaccggtcgatgctttggtcaaccagaacgttttccatgtcaatccaccggcaccgaatgggaacaacaacgaggcggtcgatgctttggtcaaccagaacgttttccatgtcaatccaccggcaccgaatggggacaacgatggcgatgatctgcaaatgttttttgaggacgatgttgttgatgcttatcttcagaatatggacccgaactaaaagaaattcatccgccgatgatctttcactcatttatcgtgtttcattttaaaaatgtttaatgtgtgtctgtctgacaatgagaataaaatcacgact

SEQ ID NO: 90043 - DNA, 642 bp, Heterodera glycines
  SCN-specific regions: Sequence locations=1-642
gctaattacgttttagtaataaaatgccaaaattttcgcggaaaatgctgagacctccacgaaaaaggattgccaagaaaagtgatgacaaaaaatcgacggaagacgaaaaaaagaagaagaagaaacggaggttgcccaaaacactgaaggagtgttttgagtgcgtcgacgtcggttccatcgttttgtgcgcctcctatttggacattccgccggagccgatcagcagcagcagtgacgagaaaagcaacgggaaaagaaagaagcaaaagggacagacgaaaaaagaagggcccaaaattgtgacggatgtccacgaatttgggtgcattccatggcgactttcgcttgtgcaccagcttcgcaaggacgacaacggaggctattccaaacacattctcaagttggcactgcactcggactatcgcaaggacgtcgcatggcgtgccgatgtgtccggcactttgacgatgaaaaaatgggtggacaaaatgccggagggcaccgacccgaggaaattggacgaacattcggagcgttttgccaccatcttcaatcagtgctgccaaacccaggcttttggcaccgaatttccgctaccaattggcaattcgtcggcggagacggcgaacagtgtct

SEQ ID NO: 90044 - DNA, 624 bp, Heterodera glycines
  SCN-specific regions: Sequence locations=1-379,402-598,620-624
cttggttggtccaactctactcaattgaattaagcaatgattgattgccattgccatttggcggatgaaagttttaatgaggacattagtcaggtgattgaccgagcgaagcaaaatggtgtcaaagctgctttagtggtcgcagaatttaaggatgattttgagcgaattttggaattggcccaccaatttcccgattttatctttccatgtcttggaatgcatcctgtgcaacgtggacacatttcatgcagtgaagaaatgtacaaaaatttcgaagtggacaaatggattcgcactcattcagaccaactgatcgcagttggcgaggttggcttggatttcaagcctcaacatttgaagaacggagacgcggacaaggaggaacagcgcaaagtttttcgtgcacaaattgaactagctaaagaattgcagttgcccctaaacgtgcattctcgttcggctggtacgcctgtaattgaatggttggccgcgcatggggcgcaaaatgtgctgttgcacgccttcagtggcaatgtgaaaaatgctcaaaagggcatcgaaaagggcttcttcttttccattcctccatcctttactctctcaaaagaaaagagagcgatt

SEQ ID NO: 90045 - DNA, 1044 bp, Heterodera glycines
  SCN-specific regions: Sequence locations=1-1044
atttgttcaaatgaattctttctgatgtgtttaaacaatgcatggttcttcaccattaacagaggctaatctgtgcatgaaatttgagtcttctttttcatggaaggattgggttaggttacgtgacacttggaatgccgttgttacgtcgcaatcgcagattcacaggcattctgaacagctcgacaaaattgtttcggaggaaagcagttacagaaattatgcatctgacattcaaaatcgacaaattatgatccaaattgtggaaagaaatgtgaacaaagcgagggaattggtacgaacggcgcgatatcagttgaacgctttcaattcggcgctgagtcaaagaagagaacgattcccaaactgagcacggaatattggagctgaacaaccaaaacgccgaaatgcgcttggagttgagccgacttcgcaatgagttggttttccgacgtcgacatatgctcaaaagcctttacgaagtgttttttctgccgaagctgaagcgctcttcgattgcggcaccgctcgtcttcagaaggcaatgcttttgctccaacttcgatgccattcgctccttgcatttcccttctgtgcctgctcgactcgggcacaatgatgccgagttaagttcggccgctggttttatcgttcaacttttactcgcaattagccatattttggacattccgctcaaacatttgctccttttcaatggttctcgttccgcaatatttagtcgttcttctttggaacgctttggacctcttttccacttcctctgcaaagagtcaaaggaatccgctggaccaaacgatgtacctgctcaacgaaggcatcgtcccacatgagggccaagactggcggttgtgtctgagggggaccgaccggaccatgcagcctagtgcgaagagcggggactactctaagcaaccgaatgccagacggtgtcgagcaactcgcgaaaaggctacactacaattaggaagaagaatacacctaatacgcggcgcgggaggaggggcggccaaaagcaaaggaaaa

SEQ ID NO: 90046 - DNA, 552 bp, Heterodera glycines
  SCN-specific regions: Sequence locations=44-192,214-492,514-552
cctcgtgccgaattcggcacgaggcttggctttgctgctgctttcgatgaccattttcagcactttccgtggcttttttcggctctcttcgcttggcttcttctcctttttcttcttttggagctgtttccttccttttcagccaatttatctcttcagttggtaagccctcgccgtgctctgatcgctttattccgtgcccccaacccaaccgaacattatttggcctttctcgacatattccgaatcggtgccatctgttgggtgataagcaatcatctcggcagtgaaggacgtctcgatgtgcttttgggacttccgcacggcgaacatttcaaacagtccgtccattcccttcccatctttggccccatttttggcaattctgctctcggtgtggaagtttttttggttctttccggctttttggccgcccgctcgtggcatcgtcggtggcaatccgaccttggcttttggccaaactctctcaactttctgcttcatcgttgacttcggctcgctccaacaacaaaggcattcgtttttttggct

SEQ ID NO: 90047 - DNA, 618 bp, Heterodera glycines
  SCN-specific regions: Sequence locations=1-618
gagaaatatccggcccgcaacaatctcgagcaccttgcgatgctcaagtgtacggaggaaccgcacattgtgcgcaagacgggaatcatttgcacgatagggcccgtttgtcgttcggtggaaatgttggttcaaatgatcgaaaatgggatggacgtcgcccggatgaacttcagtcacggggaccacgaatatcacggcggtaccatcaaaaatgtgcgtgaagcagctgccaaatgcaccaagaaacgcaacgtggcgattgcactggacacaaaagggcccgagattaggacgggacttttggcagggggcggttcggctgaaattctgttggagaaggacgcgtccattcgcctgaccaccgactcggcatttgagaagtcgggcaccgccatcaacctctacgtcgactacaagaacataacgaaggttgtgaccaaaggatcgcgcgtgtacatcgatgacggattgctgtcgcttattgtggaagaaattttcgacgacgccatactgtgcaaagttgaaaatggagggaaattgggcagtcgcaaaggggtgaatttgcccggaacaccggtcgatttgccagccgtttccgagaaggacatcaaggac

SEQ ID NO: 90048 - DNA, 446 bp, Heterodera glycines
  misc_feature (421)..(423): n is a, c, g, or t
  misc_feature (426)..(426): n is a, c, g, or t
  misc_feature (430)..(433): n is a, c, g, or t
  SCN-specific regions: Sequence locations=1-41,64-409
ctcggaggaaaatgtgccgaatccgcttttgttggagaaggaagtggtgccgaaccagcaggactcggtggaaaatgtgccgaatccgctttgttggagaaggaagtggtgccgaaccaacagaactcggacttaaactcatgtgccatggaatccactcacgtttcgtctgccaatcacttttttgcacagtactgtgccgaaatggttgaaacacttctcgggaaaatgtcggacaaagacgccttccatttgcgcaaggagatgaatgatgttttgacgaaatacgaggccgccaccatcgacgacaaatgagaagagggaagattgattgattgtctgccagtgatttttatgggtttctgcgcttgaattttttccatttgaacgtcaatttcgtcagtaaagcaaaatatatttnnnaanaaannnnaaaaaaaaaaaaa

SEQ ID NO: 90049 - DNA, 636 bp, Heterodera glycines
  misc_feature (588)..(588): n is a, c, g, or t
  SCN-specific regions: Sequence locations=1-108,130-257,279-532,554-636
ctcgggccaatattacgcattcgttttttcataaatgccgggaatttgcggaggaattgtacggaaatttagtaattcgaaaaacgaatcgaaggaggatttttgcattgaaaacgacaatttggaaatgatggcggagctcagtgaggaggacatggactcatctgaagaagacgaaaattggaaggaaattaacgacgaggaacaaaacacatcggcaggacagaaggggacgcaagtttcgcgaagaaaaagattaaaagaaagactggaacagcgaaaggccaacgaaatgagaaccgtttttgtgggtaatgcgccaccgacttcaacgcggagagacattaccaaaatattccgggctttcggaaaaattgaggccgtttatcagcggactttgcttcagatgacggagaaattgacaaaattgatggagggaaaggacaaaacattgaaagaccgcttaaaatcgaccaatttttttgttcgtttttcttcgcaagaggaaactgagaatgcggcatgcaaaatgaatgggactcatttgggtggcaacacaattcgagtgacgacaagcaaccgacgcanatttgagcactcactttccatttttctcggcaatttgccatactccgc

SEQ ID NO: 90050 - DNA, 1006 bp, Heterodera glycines
  SCN-specific regions: Sequence locations=1-244,266-538,560-921,960 -966,990-1006
ccaaataagatatttaatccatttattggtcctttattttcgttcttgttgtctgctgattatgggcaatgaacactcaaatcgctcaaagggtcatccgtcatcttcgtcctcaaaaaaggatagtccggcgactcgccttcaaaaagcgctgccgtccgcgctaaaattcggctcaaatgatctctcgtcgagtgccttacgacgccttttggaacagtcgaagaaaagtcgaagtttgcaactgaaaggggccggcatcaaaagagtgccgtcgggaattgtcgaggaggtccattctttgctcagaattttggagctgtcgtcgaacaaattgcgcgaattgccttcgaccatcggcactttcagcatgctcaaacagttgtacatcgccaacaaccgtctgaccaatttgcccgacgaaattggctgtttgaagacattggaattgctcgatgtttctggcaatcagctcactgaactgcccgacccattggccgcgtgcaattcgctgacccaaatgaacgcgtccaacaacaaattcagcacatttccctccgtcgtgacgcgactgctgcggttggaggtcatcgacttgtcggagaattcgatcactgaacttccggacgaaattgccattctgcgcgccactgaactgatcattcggcgtaaccaattggccttgctgaacgcctccaacttgaccaaatgcgagcacttgaagattcttcgcgtggaagagaactgtctgccgagggaggcgttcactgccgaacttctcgaaaagtccgagctgactctgatcactcacgagggcaatcttttcgcggagaaggaatttcaggcactccccggctacgacgcgtacgaacagcgttttactgcgacacgccgcagacttttctgattgtgcgaaataagaaaataattataaatttctaaagataatttttatttttgtacttatttttgctttccaaaatgtttttaaagacatttggtggcc

SEQ ID NO: 90051 - DNA, 749 bp, Heterodera glycines
  SCN-specific regions: Sequence locations=1-88,110-749
gagcagaagacgaaagagcacgcgatgcagtccaagcagcagccacgggaattgaaagccaaggaaacgatcatccgaaaacagtttcgacaagcggtcaaaattcaaacgcgccaattcaaagcgtaccaatcccaaatgctccaaatggcgccccgggaggagcacagagaactgctgaaccgactgaaggaggaacagagtcggaagatcgcctcccttgcggaccaatacgaagcgaccattgaaacgatggtcacggaacaaacgatcaaattggacgcccaacaggaggaggacttgcgacagctgaccgaaaaactgaacagggagctgagcatgttgacggagtaccaggagaaacagcgggttgaactgagcgcacaaattgagcgcgagcgagtgcaactgcaggaccgcgtcaaccttcggcttgctgtgctgaaacagaaaatgaacgaagaaaaggtccattttgagcggaacagagagcgacagttggcgcagttgcacgaccgacaggcgcaagcgttgagtgccttctccgtcgatgagagacggaagaaaagttccatgggaagtgacgggggacggaacgacgcgtcgtccacaaatttgtgaattgggcccagcgggcattcgttgccttttctctccttttgtcgccttcaattttcaattgtttcgacaatttttacttatctttttctttctccaacgaatttttgtatgtttttgtctttacttat

SEQ ID NO: 90052 - DNA, 423 bp, Heterodera glycines
  SCN-specific regions: Sequence locations=1-258,280-369,394-423
ctttattctgttggctataaagatgagtgaaaatgaactcggtcgtaccctggaccagtgtttagcggatactgcgcttaaaattttggcaggtggttctattggtgttgtcacagcgcttgcgcttttcaaggggaagaggtcttggccggtttggcttgggacaggcgttggcatcggcatgggcttcaacaattgccaaaatcaattgaagagggacactgccaaaacgatggcccaaaagtcagcaaagaatggtcaaatgcgatgaataaattcacccaaaatttggaatgtatcattaggctaaaaacatttgtcgattggaatgttgatacgactcagctaaacatagtgaaatttaactgttcatcgtttgttttgtttttcaccagttgagaaaatacacatacgaaataaaaa

SEQ ID NO: 90053 - DNA, 888 bp, Heterodera glycines
  SCN-specific regions: Sequence locations=1-549,574-866
aggacgagccatggatgccggcggagaaagtatacacaatcaaaggccgtggtacggtgatcaccggcaaattggagcagggcactctgaaaaagaacgacaaagtgaccattgttggactgggcaaaaaattggacaccacaatcgccggcttggaaacattccgcaaaacagttgatcaggcggagcccggggaccaattgggagttctcctcaagggccttggtccgaaggacgtgcgcaggggaagtgtgctgctcaaacagggccaagacgcacattttacggacaaagttcgagcgcagatttacttgctgaaaccggaggagggcggctccaaaatgccgttggcccacatgttcaaggagcacatgttttcattgacatgggactcggcggccaccgttatgttgcagggccgtgacttcgtcatgccgggcgagactgttgagctcgagtttctgttcaacactccccaatttgttcgtccccaacagcgtttcactctccgccatgacaaaaccacaatcgcctgcggcgtctttttggaggctcttcccgagtcggagggcgaaattcgcgacaaaaagtggaggaaaatgcaaatgcgaggagtgatggaaagggttggtttcaatccgttcggcaaccgatcgtttgagcgagcgtgcaaacctgactataccaattcgccgaaggacaacccggccgaggcattgttcaaagccgaggcaaaagcctagaaagaactttagcgaggggcacgactttagatgaaggatttgttttttcattaattaaatcactcatttccgtttcatttatttggcgttctgtttttattccatgataaattcctctttaccaaaaaaaaaaaaaaaaaaaaaa

SEQ ID NO: 90054 - DNA, 651 bp, Heterodera glycines
  SCN-specific regions: Sequence locations=1-149,172-498,520-651
taaaaagaaaaaaaatgttgttttatgaccatcacacgagaacttgttgttttttcaacgtgcaaaagtgcgccttcacattcgcactcatcggttttgtgctcaatttggtcgcattggtcccaatatttttgccatattcgcccacttctcaagaaaagccaagcatttacattggcaaatgcttgcacatcctgttttctgcgatgctgtttttgtcaatcatgttggcctacaaacttcgcaaagcttggctctatacgccataccttatttacacgggaatttcgttggctcttgcagtttttggctgcttaacctatttgtactttctgattacggacccacaatcactgcttgacgacaattggcgaaaagcacacccgggcaaagcaacgaacgattcagaggctcgcgcaattgcgtcggcttggcttgctttgatgttggtttatttgctgttcagcggttggatttattccgtcatttaccgcgcttaaaaagatttttgttttaattccattgaaattattcatgaatcacccatttatcaaaatttgtatgtctccttttttaaatctctacatttatcactgttatcattatcagaccgatgattgatttgtgaaatgcaaattatcaaaattaaaa

SEQ ID NO: 90055 - DNA, 362 bp, Heterodera glycines
  SCN-specific regions: Sequence locations=1-362
cgtggatctacaattaaatatcttcgaattccggacgaagtgcctgatctggtgaaggacgaagtcaaggaagtccgacgtcagcaaaaagataaccaacggatgaagaagcaatttgcaaagggaacaaaaggtgccggtggtccatcagctggaggcggcagacctcaacagggcggacgaccgggcggtgggccgtcacgaggggcgtacagaggcggggcacatccgtcgggaggccagccaaggagaaactgacaatgcattattttcgccatgttttgttgtttgctagatctccatttggaaccaattaacgctggaataaatttccgaagactttaagacacaaacaacatgaa

SEQ ID NO: 90056 - DNA, 844 bp, Heterodera glycines
  SCN-specific regions: Sequence locations=1-109,136-183,205-256,278 -538,562-607,632-687,709-844
ttaccgtttcgtggcttacacgacggtttctttctccatcatctcacttttgtcggtgtgcttgacactgccaatgctgaagagttacgtgtccaacgtgggcatgaaaatggactctgagctcagctcatgccagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccggaaaccccggagcgcccggctcaccaggacagcccggacaaaccccgcagacgccttgcgagcaagtgcacccgcctccatgcaccccgtgccctggcggtcagcccggtaacaatggcccacctggacccccgggagcgccaggagcacccggccagcccggcaccggaggaggacagccgcaacccggagagcccggcccacctggacccaatggccagcccggacaacccggacagcccggagcgcctggacagcccggacaacccgcaagcccaccgccaacggagcccgctcctgcaggcccacctggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatctgtcccaaatactgtgccgtggacggcggagtgttcttcgaggacggcacacgaaga

SEQ ID NO: 90057 - DNA, 326 bp, Heterodera glycines
  SCN-specific regions: Sequence locations=1-326
cgaggaactcactttttggctgggtcaattttcttcagtgcgctgacagtttcctgggtcctttgggacaacagaaatcagcagcacaaaaggacttcctccgtgcgctcaattttggcgtcggcacaacggcaaaagaatatggaggaatatttggagcagcagaaactttatgaggagtacaaaatgtcagtttctgacggtcataattaaacaattatttgatcattcattttgtcattaattgatcagtcgttgttttgtttatgtcgttattaagaagtgatcttttgcttttctgctgtaattgacatgacttttaaaaa

SEQ ID NO: 90058 - DNA, 614 bp, Heterodera glycines
  SCN-specific regions: Sequence locations=1-219,242-377,399-614
agcctgattttctgattctaatttccaattttcgaatacattcctttcagtgatgcagccgcagtcaaagcgaaagattcaggtttcttttctgatcagaaatgggtcggtcgagtcgaagcatcgcggcttcgtcaacgccctccaatttgacccgacgacgcgcagtctcttttcggccggttcagattcggtcattcgccagtgggacacttcggcgccgtcgggcagcgccgcctttctccgctcattggagcaccactgtgactgggtgaacgacaaacggcaaattgtgacgcgggacagtgatgggaacgtcgaactgtgggatgtgatgcaatgcggcagggtgaacaccttcccgatgggcaccaacatggaggaagtgatcaaggacaatgtgcggaaggtgtggatcccgagttggttcggcgtggatgccaagtgcggggtgttggaaatcactttggacgagagcgacgcgttctccgcttgggtctccgcccgtgacgcgggtttcaccgacaaagccaacgatgccaaagttaattacggcggtctccttttgcgcagtcttttcgagcattggccccacgcgtacgttggcgacgacg

SEQ ID NO: 90059 - DNA, 914 bp, Heterodera glycines
  SCN-specific regions: Sequence locations=1-156,178-179,201-407,432 -464,486-888,910-914
tccagcaaatccctccctttaatcatcgcctccattattattatcctcttccatttgacgacagttttgtccgatcacctctgatcaccattattcgtgcgtcttcaacttcttcatcattctgtcgcccgtttcgattcccctttccccaaccatcacaaaaactccaccaaaatcattgtttctccactacttttgtgtagcgaatgttccgtccgacggagctgtatttttttacactaacaatagcaccagtaacagcagcaacacggaggaacaactgttgaccctcatcattttcaaggagtacatccgaaagaaacagcaccaattttggaacgggacgacggcacggaagaggaaaacaacagcaaacgaagaagcaacgtcaaacagaacggaggatcaacggaaagagagggagacaaaggagcaggtcatccggacattggatcaacaccaacaacaacagaacgagcagcaaaacggagataaacggttgagactactaacaaagcaaaagcataaacaccgacaagttcaacaacagaacaacaacaacagaagaaggagttactgtttgctgttgaggctcatcagacagtgacgacgacgacgtcgagcagtacaaaccatcaccaaaaaaacaaattgttttcattgttttttgttgttatttgcattttgttagggttcatctacagcatcagcctcacattttcttcgctccatccacccaaacaacaaaaattagggtagcaccaaaagacataaacagagcagccagatttttatccaacgccacctctctctcatcactcactcatttttgccttcaattcctcattctcacacacataccaaaaaaagtgatcagcaaagagtgatcaaaaccccccaaaaatggcagcacc

SEQ ID NO: 90060 - DNA, 792 bp, Heterodera glycines
  SCN-specific regions: Sequence locations=1-493,515-792
caagtttgagaataattcttcaaaatgaccaaatttgtttgtgttttgttgctgctttttgcttggactctccaaattgtccatccttccgtagttccgtccgatcaaatttatatcatcgaattcaaccgcgacaattcgaacaatcaacaggacaatgatttaaaatcggccaatggagttgaagacagcaaaatgaccaatggcgtcatttcacaagactctgcccaagttgtgacgaccaatggcacgaccgagttggaaacggacccactcactgtttcagtggaattgcaaagaggcggacgtgctgttggcaatcagttcaacatcaatttcactgacatcagctatgtgttggtgtgcagtgcaagattccgcatttcattaccaagcgatacaactctgcgaagtcactcgaaaatgactgccgtgccgaacacatctgatcaattcacgttgcctaatggagtgcatttgtacccgggtctttctcacactgctgaagtgatcttgagcggaaatggacagcctgaagtgaccattctggacacattgactgtgctgaccactgaaaaatgtccgaatgatgtttgaatgaagcgctgaaaaatttcgaaaaaaaaaatttcgaatttccaaaaagatcaatgggtttggtgtaagcaataccgattggattagaattgggacaaacaaatttaatttcccaatcagtttgatccctttatttaattgtattaccaatattctccattattcgaatgaaactttttgtatcaaaataaaatc

SEQ ID NO: 90061 - DNA, 639 bp, Heterodera glycines
  SCN-specific regions: Sequence locations=1-232,256-639
tgccagatcaattaacttgacaattaatcccttgtccctaattttcgccaatttttgtcctccaaatgatttgtcccaacgaatcgaagccggacactgccaatggcgagcagcacaaaaattcagcggcaatgaatggccacggatttgtgccctcgggcaatgccgaaacggagggaaaagccgacaaaagacaccagcagcaaagaaaactgtacaaagcagacgaaaacccaccatttctgctgacctttttgtttggctttcagcaagtgatggtgtccctgtccgtgctcgtatccatcccgtttctgatctcggacgaggcgtgcccaggaagggaccgtgatcagctccgagtgcgtctgatcgccgccacttttgtcacctgtggcattggcacaattttgcagacggcgtttgggatgaggttggctcttctccaaggcgtcgctttcgcttacattccatcgatcaaagcgttcatgagcatggaccaattccgctgtaatgccacgattgacgactttgtgccgccgaaagtgtacgaggacaaaatggccattatccaaggcactctgatggcctcctcgagcatcacttttctgatcggcgccacgggaatggttggcaaaatga

SEQ ID NO: 90062 - DNA, 405 bp, Heterodera glycines
  SCN-specific regions: Sequence locations=1-405
cactgctcaaaatacaatgaaaactgctcttgagttggcaaaaaaaattgcttgtggtgtatttattgcacacgtttttcgccaaaaagttggccgaattcttacgggagtaggtgattccatgctgccgactatccacgatggcgacattctatgggctcgagtttgggatccgaacgatgctttacgaccgggggacgtcgtgtgtttagttgaccctctcgatgcagaagagtatgtcataaaacgcatttccgctgtccacaaagactgcatagaagttcgcggcgacaatgcgaaaaagtcgttggactcgcgcaaatatggccccgtgccggctggacttgtccgctaccgcgtgtctttgcgactcctccccttaaatcgttgaacattgcgaaaacc

SEQ ID NO: 90063 - DNA, 593 bp, Heterodera glycines
  SCN-specific regions: Sequence locations=1-67,89-140,162-593
cattcgttttgccattttctatggcttaattaaacaaaggcacttgtcaccacacattcactaattacccaaatgctttgttttgccacctcaaaatgttttcctcaaagcttcgaccaatacaaaagccgatcaaatccactcatcttcatctttttgctgacgattcatcttttattagcggaaattgcttcggaaaagtcatcaaaagaaacatttaaagattctctggtgcaaaattcgccaaaaagcgacctcaactttctattccaacaacggagcactcagaaaacagctttcatcagacatcattatgcttcttccgtagcaaatggccaatctggacaacattctcggcaccggcgacggatacccaccggaattattggcaaattaattgccaaattaagcggaaagacgggaaaaattgcagcgactgcaagcaaaagcgatgatatttttgttgggaccgcaaaggttggacgaattccaaaccgcgggacagcgcccggacgcttttacaaatcgcgcgggttcgaacccccgccctttgtctcttacgcggcccccgcaggaagcgaagtggccaaaag

SEQ ID NO: 90064 - DNA, 666 bp, Heterodera glycines
  SCN-specific regions: Sequence locations=1-5,29-221,245-548,570 -604,626-666
agaatatggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgttaaaatagcccaaaaacgtcatcataagaaaggagcattggcacttaaagagatccgcaagtaccagaagagtgtgaatctgctcatcccgcgccgtcctttcatgcgtttggtccgcgaagtcacccaggacatgtcgcagtcgaccgacctgcgctggcagggcttggcactgctggcgattcaggaggccgccgaactgtacttggtctcattgttcgacgacaccaatctttgcgccatccatgccagtcgagtgaccataatgccgaaggacatgcaactcgtgcgcaaaattcgtggagagacttttcttaagccgttgtcctcgcagtactgatcgaagaaaatggtggtggttgatttcatagtcgatgacaatttgaatatgatatttttcgcaaatctcttttgtattctcgacccattccattttcactattatcctactttgtccaaaccccaaaatctttctgataaatcagctttactgc

SEQ ID NO: 90065 - DNA, 241 bp, Heterodera glycines
  SCN-specific regions: Sequence locations=1-116,138-157,182-219
caacagcagtcaaaagtggcgaaactaaggacatcagccgggggttttctttttccaatggaagcgggttgcactctccaagagccgatgatcagctaacatttttcatccatattttgttgtattatttattcattataaaaggctcaacattttgattatataaaatttttatttttttccaactcaaaccatttgctcaaataaaaagataagctcaaaaaaaaaaaaaaaaaaaaaa

SEQ ID NO: 90066 - DNA, 449 bp, Heterodera glycines
  SCN-specific regions: Sequence locations=1-389,415-423
gtttcgtttatagttcatatttatttggtaatcgcatcatggaaatgaccggcggtgaccatcagctcaaccattttgtccagcaactccaagcagaaattcagaagcagggattgcaggaacagattttgaaaatgaataatcgatgtttcgacctttgcatcaccgattcgcgtcttccgagtaaattggacggaaggactcagacgtgcattgccaattgtgtcggtcggattttggacgcaaaaacactgatgtttgaacatctccaaaaacgttctggcagtggcggagccatgtgaacgatggccaacccactgatcaattgctgtcgctgtttttgttattcttgttgccttttttgtcttccgtttatttgacgaattggcactatttttaattttacaaaataaatacttattcaaaaaaaaaaaaaaaaaaaaaaaaaa

SEQ ID NO: 90067 - DNA, 292 bp, Heterodera glycines
  SCN-specific regions: Sequence locations=1-132,154-292
aatgaggagccgggccaaaagagttgcaacggatgtgagccaagttgtgacaatccgaagccggagatttgcactgcgcgcttttgtgactgttcatgcgactgtgtgaagggattgttccgcgacaaaacgaaaaaatgtgtgcccaaatgtccgtattgaggaaggaaattgatactaacgatgtaatgatatcaaattatttaatcattcattaatctaagaaatagcaattatttaaaaattgaaaagaattagaatttgttagttttcaataaatccgttaattaaa

SEQ ID NO: 90068 - DNA, 402 bp, Heterodera glycines
  SCN-specific regions: Sequence locations=1-115,137-250,277-402
acgcagcagggagcccaattcggagttggcacaacgagtgatactgcggctgaagcggcaggacggagttctgctcagttcggacggaccgtacggaaacattttgaaattcaaacccccactttgttttggggaagacgacctacgaaaagcggtgaatgcactcgataaagcattggccgaattcacaacggaagaagagaaaacgaaataaaattaactttatgcaaatttcccactaataatttaagtaacaataaaataaattaaaggtataaaaaaaataggtatcacatcttatttcacaaaataaagagggaacaattgtttttacattgggcagaatgaaatgaaagaatcgacccgaaaaaagaaaacaacgattagaccgggcaaagaaaa

SEQ ID NO: 90069 - DNA, 594 bp, Heterodera glycines
  SCN-specific regions: Sequence locations=1-594
gatgagaagaatatggtcgtggagaagaatacttcatcttcaacttctgctactgactcttcaccagacggagggaactatatcaaagaggaaatgctccagagagaggttttttgtgagtgtcttggtggcgaacgtgtttcggtccgtgcttcgcttatgtttcagagccaaacctttgccaatatgtggaagtctttgaacgtggacaccaatgagttgcctgacgattttgtcttcccgatgacgagtgttgcagttccggtctttaaaaagattatcaattggatggagagtcacgtcggacagcaagtgcctgagtttgaagaggacccaaatactcgcgaacgcaaatggttcgtccagactgacttcgaaaaggattttttcaaggtcgaagttgaagagttggttgactttctgaatgctagcaactttctcaatttgcaatctctctatcgtcattcgtgtcaggctatggctgctttgctcaaggaccgttctcctgaggaaattcgtgatctgcttgggattgaggacgatctgactgaggagcacaaggcggaaattcgtccgcaaaatgtttggtgcaac

SEQ ID NO: 90070 - DNA, 776 bp, Heterodera glycines
  SCN-specific regions: Sequence locations=1-536,558-776
aaatgttcaacaatcacgccaaccacttcatgccgaatttttgcattcccccacctccgccaccacaacttcctcaacctttgaattcggctcgagttttctttccgccggttcctcatcaccatcatccggcttattaccttcaacctcaacatgcacatcctcatatgaaccctcagttcttcaatttaagcgttccgcctcctcaaattacgcaaaatatcagcagtttgatcgcagcaaatattaacaactatccaactcgtcatccgctcaatggcacacatcaaataaccacatcggaaaggttcagcaaaacgttccatactgggcatgcgaatggtttcacatcgaaaggcaatggagcgccgctcagcaggtcaagaaagcgatttcttgaacaaattaccaacgaagaagggtggatttaattttaattaaatacatgtttgaaagattcagcacctcggggagaacttccaattgaactggacacagcgcccagaaatcgtcaactttcgggacaaagttctactgaagtcgaccaggaagccgccgacgaatcaccaaacagcaaagagtcgggttgcagtgaaaattcacaggaaagtctccgtttggtgcccacggacaatgacagcgacggcgaacaccccgaaatgggccgcaactggcggatattgatgctgttcaatgggctcgtcagggatgaggatttggccccgaattgcgaacggcctcaggcagaagatggacgaacttaccctgacattcag

SEQ ID NO: 90071 - DNA, 596 bp, Heterodera glycines
  SCN-specific regions: Sequence locations=1-596
ctttcttcgtgaaaaacttcggaaatgtcgacgcaacaacaacaacgtaagacgcgttccccaattgtattggagcgtggagtctctggtcgtgtcaaatggttcgacttctggaaaggctatggattcatcacacgcgatgacgggggccaagatgtgtttcttcacgcgtcatccattgttcgaaaggtccaaatgcatttcgtgctgattgaggggcaaaagttggaatttgacatcattgatggtgagaaggggagggaggcggccgttgtgtccgggcctggtgggattcgcgtcggtacagccatccgatacaatccacaacagcaactggccgctggcaaggacttcaaacgtatcaatgcttctgctggtggcagcagactcccgccgcgtcctcctgtggcgaagaagaccacaaagaaaatggcgaactccaaatgtgatgaccataacgaacccaaagtggacaacaacgaagagcagcaggagcactgatcggtgttcagatgctgcatatttctttattgtcttttaattttgaaattcgactcgaaatttgttaattagaaaataaagacgattatttaaaa

SEQ ID NO: 90072 - DNA, 272 bp, Heterodera glycines
  SCN-specific regions: Sequence locations=1-249
ccgacgacaacgaaagggcagaaacgattaacgcatttggacgactgatcagattcatcgtagaagcaatgatcgaagggtatggccaaagagtgactgagttgagaacggagcgaaggggcagcggagagacgacggaggaaaagggcaaatcggacgacgaattgaaaagtgatcgaaacgaactacaaaacataccatagattattcatacaaaacaaaaacatacacatataaatatgtagccttaaaaaaaaaaaaaaaaaaaaaaa

SEQ ID NO: 90073 - DNA, 425 bp, Heterodera glycines
  SCN-specific regions: Sequence locations=1-62,122-381
cgggatttcccactccgaaaaacaaaaaatatccaaattagaaatttgtcaaaaaacctgggaataaaaagaatttgatttaattttattaaaaaaaaattatttggaattttaaaaaattccatttttattttgtacacttttcaggttgccaatccgaacagtgaggcgaagaaaacggacagtccgccgatgactccatcgccagcgaccaccgcgacaaatggcggcactgtgtcagcggcgggaaacgaaagcgctgccgtgctatggggcaaactgttcaggcacccctcattttggcaagtcttacagtgaaaaaatgggcataaaatcagaatgccaaattcaaagaaaactaaatcactgtagtctgcactcaatttaaatttttttgatttaaattaataattttattaaaaatt

SEQ ID NO: 90074 - DNA, 70 bp, Heterodera glycines; identical to SEQ ID NO: 81115
  SCN-specific regions: Sequence locations=1-70

SEQ ID NO: 90075 - DNA, 648 bp, Heterodera glycines
  SCN-specific regions: Sequence locations=1-87,110-648
ctacgtatatgcttaaagcatttaattagcattggaataattgccgcaaataaattgcaatgactcaggaaagcacaatgatttgtgttgacaattcggaatggatgcgaaatggcgatcttccgcccaccagattcaattgtcagcaggaggccgttcgcgtacttattcaacttaaattgagaagtaaccctgaaaatgctgttggccttctttcgttggcggatcgtattgatgtgctcaattcactgaccactgaagatcgcaagttgttggtccgtcttcatagtcttgaaattcttggcgtttcgaaagttttcgatggaatcaaaaccgcatacttggcactcaaacacaggaagaatcgcaaccatcgtcagcgcattgtcgtattcgtgggcagtccattggacccattgttggcagaaaaagaaatgtttatgaaattcgctaaaaagctaaaaaaggaaaaagtgagtgtcgattttgtcctatttggcgaggccaccgccgagaacaacaaaataattgccgattttgtggacattcttaacggcactgaagagggaggagcctcgcatttgttggtcgtgccggttggagacaccaaactgtacgatgcattgcttcgttcgcccatttgtgcgg

SEQ ID NO: 90076 - DNA, 361 bp, Heterodera glycines
  SCN-specific regions: Sequence locations=1-152,174-332
cagcaaaatttcacactgaaaatgtcttctgcgtccaccattctcgtaaagctgctgataattgccatttgcctttcattaacaattgccatgccagcagtggacaatcaaattgaaagtgttccacttcggcaaaagcgttatggctacggcggcggtggatttggcggcggatttggcggtggaatgggctttgatggctgatttggacgctgagccgtgaagaacattaatacgcattgtgaatgatcagaaatcgatcaatataaatgatgtgcgacagaactctgtttttaaagactttcaagtttataaaataaattagttagcggaaaattttttttaaaaaaaaaaaaaaaaa

SEQ ID NO: 90077 - DNA, 993 bp, Heterodera glycines
  SCN-specific regions: Sequence locations=1-874,898-993
gtccaattaagaaaaaaaagatttttaattatgccatttttgactttgaatgccatgcgttcattgtgccgtcttccaccatcacttttctccaacggcatcatgcaaattcgttttgtgcaccatcacaaggaattggaggaacccggtgggtttgagcgtttcatgggctggcgacgctcgaaccccgcaaaagcgaaccgaaacacccacatcaacgaacgatacatgagaaggttgaggggcgccaaacggctgataattgacctggaagaggattatgccgagcgacgacaattggatcagatgcgaccggatgaagtccgaatgtacttattgcggaaggggaagccgaacattttcaaggatgtggcgccaagggattggaatgagcaccagataactctgaacacattcggtcaagcaattgacccgtatattcctcccgaaacttcgctgttttcacgaggggccaaagacattttccccgatttgaaggcatttgctacccgcaaataccaagggatattctacgggttgaggaggattcggaagaaggacggatttcagaacttcaatttgaaggatttcacaaaacttgccgagcaaatctacgcaaatgcgtacaatgcgttggcactgcgagacaaaacgaagctgcacgaactgatcactgaggccgcgttctctaaaatgtggcccgatgttgagaaaggcacactccattggaaattggtgcagttcagcgaaccgtccaaagtgctaacggtgcgctgcttggacaacccgaccaaatcgggcaacgacattgcgcagattattgtacgaatgcacagcacacagattttggcactttacgacaaggacggccatttgttattggactctgaggaggagccaaggcaatgtttggaatacgtcgtctttgagaatcacgtggccagcgtcgatggaatgtggcgtttacactgccgcatttaccctaattggctg

SEQ ID NO: 90078 - DNA, 584 bp, Heterodera glycines
  SCN-specific regions: Sequence locations=1-584
ccaagtttgagcacattttcaaaataagttttcaattatttgtgccgatgaccttcttcaaggaggtggactatttgtcgttgcgtctcgacgacccggtgtccgcgttggccgattatctgcccaattccatcatttacaccattaattattcgttggcccttccgcccaatttggtgctgctttacatgggcctgaggccaagtctgatcacttcccgagtcaaattccccactttgggaatgacttgtgccaatctgttcggattgttcggctttcttcttctcaacattgtctatttatacacagtcttttccgacgtcagactgtccttgttcatgtgcagtttattgcgcaccgttttctacaacaccacttacgtgtgctatttcctcttccccgtccttgccgttgaccaatacctttacgtgtgccaaaacgtcgagttgagcattcgctctctgaaggcggtgattggcgtgtgctttgccattccgatgattgtggccgtgtacgatttgtggctgcagaaagtcattctctacgactttatgttcgcttatattcgcatgagtccctacaca

SEQ ID NO: 90079 - DNA, 1237 bp, Heterodera glycines
  SCN-specific regions: Sequence locations=1-325,350-643,666-946,968 -1237
cccactcgcttaaggcgcttcgcaatttgcgtcggcgttgacgaagaaaatgggacttgtctgatggtttatgagaacgacttaaacgccattgaagtgaggatggtgttttccggtgtgcaaattggcaaatggtaccggttcgacttggcaaaaggcacgagacgaaattgggaggtagcggaggaacgattgccgacgcggattatgccacggggggacgcggggagtggcggaacacgcggggatcgcattcagctttgccttcccattttctttgtccccaacttcaaatgttttggctgcacttggcgtgtcacttcaccaacttcttttaatgacaaaatgcacttcaatttcgtttcgcctcgattggaagcgccaggcaaaattaatttcagcgaagaacgactggccgaattgaacatccgtccgggggagcagtgttttgcatttttgacattggattgccaagggcccgggccgagcataaaaccgccgcaatggacactcgatgcagtggagcattttcacagggtcaatgttgacccattggccccctccgttctgtccgtttccctcggcgcttcgaaagaatggggcattctgctcgatttggtcattgaatctgaggacgaaagaaatggaatgggtttcattctgtgcttacgcgacggaaaattcgcttttggtcgaattttaaaaaccgaaggtcacaacgacagctgctggagggcaaatgtgggcgacactgtcggcttctctttgattgatgttgattgctttaattaccccgttcggttggctttgaatgttattgcctggcaatccccggcgttcacttctgttgactccgacgttcttgccgaccaatttccccaagaatccttgcccgaatttccttcagttcgccttatttctaaaagtactggaaaaatggctcaacatttgttcgaactctgttttcctatcgatgactcccaaatgtcgtgtttgcgcatgggctccctcaaggtggaccgacttggtgttctgatcgacttgaatggtgatttgttgtccgcctggagcaacatgaagcgcaaagggactgacgccatttcttcactgttattggcccgagtgagggcccgtttttcatcattgcctgaccaacagcagccgctttggatggtggccgaaatgctcgaaattgccaaaatgcgagtcgacacggaaagcaaacgacaaacgctgg

SEQ ID NO: 90080 - DNA, 620 bp, Heterodera glycines
  SCN-specific regions: Sequence locations=1-620
gagaattaaagcattttaattgttcaatggaagtcaaattgaagccctattccgatccgtcccgttgggtggccatttacccgctgtacatcgatgcctccaagtcgttggcacagggtcgccgaattgcgaaggcgaaagcagtcaacaacccgacatgccaagaaatattcgatgttctcaaccacgccggccttcgctgtgaattggaacagaaaaaaacgcaccctcgggcgcagtcgcgtggcgccgccaacccgaaacagcaacaacaggaggagggacgaatccgagtgcaactcaaaggggacgacggagaaaatgtgagcgaaggggcggcacagccaaagttcatgacccgacaacaaatgatggaatacgctgcggaaatggtgcccaaactgaagacacggcagcagcaaacccaagtcgaacagaacgacgcgacggggaagcagaagaagcggaagtgaacgaacggacggacattcaaccaatgacatcaaaatgtacaattaatacaattgttgtttgttatatagaaactctcgttttctttttgatgttgtatagaattttggttagaaattaataacaaattcagacatttaaaaaaaaaa

SEQ ID NO: 90081 - DNA, 803 bp, Heterodera glycines
  misc_feature (786)..(787): n is a, c, g, or t
  misc_feature (789)..(789): n is a, c, g, or t
  SCN-specific regions: Sequence locations=1-88,124-746,769-803
gtccaattaagcaagacaaataccttcaatcattttcattgtgtaaaatggccagtaattcaaatgcccaactgttggatgcatgcgaaaaaggggcggaattaaaaaacatcaaatccctaattgagcgcggggcgaatgtgaactttgccgataaagacggtctttcccctttgatgggggcatgcgtcttcggtaacgttgagattgcgcactgtcttgtcgagttgggcgcgacaattgagcaaaaagatgacgagggattgaccgcccttgggcatgctgtcattgcagggcagctcgagtccgtcaaaatgttgaccggaaaaaacgcgaactgtttggtgtttgccaaagacaatcgctcgccgatggtcatcgcctgtcaggaaggccgcatggaaatcctgagccattttcggtccgttggtgtgaatttgaatcactgtgacgagcacggaattactccgcttatggtcgcaactcaaaaaaagagggtggacgttgtctgtttcttgttgcaaaacggagccgacaaaagtcagactgatgccaaagggagaaccgcgctcgcatttgccgatgacctgcgcgattcgaaagaacgtaaccagcttttgaagttgttgagtgaccgctgaagtgagaggaaagggacggtgatcagaaaattctttgtcagagattaaaaaatgttttgccgttgttgattttgaccgtttaatgtgttcatttctaaattcattggtgcttctttttactcatccataaagcgcctttacaacnnanaaaaaaaaaaaaaa

SEQ ID NO: 90082 - DNA, 547 bp, Heterodera glycines
  SCN-specific regions: Sequence locations=1-32,56-547
cacgacttggaaggactgtttgcaaggctgaaggagcttggcatcaaaattgccatttgcacagcggacagtcgggcgggaacgacgcgagttttgaagactcgaaaagtcgaacaattcgaggatttgatcgtttgtggcgacgacaaaggatcagtgccgaaaccccagccggacaatgctctgttcatctgccgacaattgggagtggaccctaagaatgccatggtaatcggcgacactcctgccgatttgggaatgggacggtctgccaaactcggctcaatcgctggtgttctggcggggattggagaacacaaagaactgaacgaagctgaccatttggttgaacatgttggagaacttcttcctctgattggctgagatttccacgttgtcgtgggactgcgcataacccaaagtcggattgaatcaatcctttgttctgtcgatacgtcgtgcttttccctccccccccccaaatttccccctttttttttgtttcccctcccatttttgccaacacattccgaatgaatgagcttac

SEQ ID NO: 90083 - DNA, 911 bp, Heterodera glycines
  SCN-specific regions: Sequence locations=1-607,630-856,882-911
ccaagtttgagatcaaaaaataataatttatgatggctgctcaaaggattttaggcgctcttggacaaattggtgttggacttactgccgctggagttcttgctcaagctgcactttacaatgttgacgctgggcaacgcgctgttattttcgaccgttttaccggagttaaaccgaatgttactggcgaaggaacgcattttttgatcccatgggttcaacgtcctatcatgttcgacattcgctcgacaccaagggctgttaatactatcactgggagcaaagacttgcagaacgtgtcgatcactttgcgtatcctccatcgtccagacccatcaaaattgccacaaatctaccttaacattggcacagattatgctgaaagagttctgccatcaattacaaacgaaattctgaaagcggttgtggcacaatttgatgctcacgaaatgattactcaacgtgaatcagttagccaccgtgtgtccgtcgaactcgcagagagggccaaacaatttggattcattcttgatgacatttctatcactcatttgtcgttcggtcgggaattcaccgaagcggttgagatgaagcaagttgcacagcaagaggctgagaaggctcgctacttggtcgagaaagctgagcagatgaagctggctgcaatcacaacggccgagggcgatgcccaggcttcgaaacttctcgcccaggccttttctcaagtgggcgacggactgattgagcttcgcaagttggaagctgctgaggagatcgcggagctgctttcgacttccaagaacgtttcctatcttcccaaagacatcagtccgctgttagccctcccacaatgatttttctgttggatttaaatgtttttggacatgttttcattatctcacttattgatt

SEQ ID NO: 90084 - DNA, 660 bp, Heterodera glycines
  SCN-specific regions: Sequence locations=1-257,279-660
gaattttctggcactgtttgcgccgattgcggtgcctcttgtccgagttgggcttcgctgaatcacggcgtgctgatctgctccgattgttgttttgtacatcgaaatttgggccgtcacttcagccaagtccgttcactgacaaaaggcgtttggcacgacaaacaattggctctgctccaattgctctgtcgtaatggcgccaacaatgtttgggagcattcgctgatcgattcgttggggggcgcaggtcgggcgaagaagaagccagtctccaatgatccgataattcccaaaaaggaggcgtttattacggcgaaatatgcgcaattggcattcgccatcagaccggccaaggacgaattcaatgtggacgatttgaatcgccagctttggtcgtgtgttcgcactgcgcacgttgaaaccgcgttgaggcttttggcgcttggcgcgtgtccaaattacgcggacactgagaagggaaacactccgttgcatgtcgcggccaaagagggtcagaatttgcaggcggaattgctttggttgtacggggcggacattggccaacggaatggggcggggcaaacgccggcggaattggcgaaaacggagggatttaacgaactcgcggaacgactcgtcgaattggagtacgaaatg

SEQ ID NO: 90085 - DNA, 571 bp, Heterodera glycines
  SCN-specific regions: Sequence locations=1-444,488-571
aaggagggtttgagtcaagaaactattaaaagtatggctgcaattgagaagcctcagattgttcaacaacccgtgcaagtttttggtcggaaaaagacagcgactgccgttgcattcgcgaagaagggcaaaggcctgataaaggtcaatggacgtcctttggagtttattcagccagaaattctgcgcatcaaacttcaagagccaattctaattgtgggcaaagacaaatttgcaggcattgacatacgaattcgcgtcaaaggcggtggacacgttgcacaaatttatgctgttcgtcaagcacttgccaaatcggtggtggctttctaccagaagaatgtcgatgaacaaagcaaaaaggagctgaaagagcaatttgtcgcctacgaccgcaatttgttggtggccgaccctcggcgccacgagccgaagaagtttggaggacctggagctcgtgctcgctaccagaagtcttaccgttaagatctatgggataccattttttgacgatcctttttgttgttgatgtaatgcgttatcattaaaattttgttggaaaaaaaaaaaa

SEQ ID NO: 90086 - DNA, 670 bp, Heterodera glycines
  SCN-specific regions: Sequence locations=1-89,111-670
gtccaattaaggtcttaaaatctgagaattaaaattttgtggaatgtctaacgacaaaaaagacgaatcatcaatttcaacgaatacccttgttaacaaagaaaaggcttctattgttcaggagtcatcatttgtcactcctggcattttccgtcgtcgtaaaatgctcacaggcagacaactgaatgatgaaggaaacaatgaagctaaggaaaaaagcgcggatttcaaatggtcaattgaccaaatcgcaaagatacaacccattgaatttgatgagactgaggagttttcattgccacctgaaaattgggacccttgtgcaaaattcaagactccacaatttgaaaatattgatcacttttggactcacaacaacttaattgctccttcaccgggactattcgccacagcctctgctttacgtcgtgttcaaccgtccgccaattctccaaccacctcaccgtttcagctcgctctttctcctttcggttcgggtccttcctgctcatcgaaatgctctttgtccgattccacattcatgtccccgacaatgatgctaactcattcccaaatgtctgagtcgaccaaagcgaaaatgtttactgctaaagaagagctaacgacgacaagtactggcaatggagacacaaaagagaatatgattgcg

SEQ ID NO: 90087 - DNA, 601 bp, Heterodera glycines
  SCN-specific regions: Sequence locations=1-570
gtttgagccatttaaaaaaaaatctgacaaaatgaatttttctccgatcactctgtttctgctctcttcacttgccattttctatgcagcggttgcattccgccaacaaacggtcgccgttcgcggccgtttaatgtgtggggataagccattgacggacacgaaagtgaagctgtggaataagaacaaaattggccgtgatgatcagctggcggacgtgaaaacggacgcgcagggaaatttcgcattggacggcggcgtcgggtccattttcggcatgaatgtgcacctgaaaatttatcacgactgtgatcgtggcatccttccgtgccaacgcaaagttaacctcggcattccgggcgagtacgtcacgcggaccagcaccgttcagcgatggttagacgccggcacaatgaacatgcagctgaagtttcatgacgaatcaacttcatgcatcaactaatttaatgtttaagaggatgagatgaaaaaaaattcaatttttgaagcccttgaaaaacgttttaaaatttttgactttgtcttcattatataaacttattaacaactaagaaaaaaaaaaaaaaaaaaaaaaaaaaaa

SEQ ID NO: 90088 - DNA, 397 bp, Heterodera glycines
  SCN-specific regions: Sequence locations=1-32,54-397
attttcatttccatccttaaaaaaaaattcaaaatgaaaagccttactcaaattaccccaattattctcccaatatttttgttactcttggttttatcaccaccaaacgcaatcggccaagatttgtgccaatgggacagcggcaaatgctttgaccgagggtgtccatatggttgtccatatgacacggaaccagaatgtggttgtacttcaccaaagcatgacgccggcaagaagcaaaccaattagcctagaagccgagaactaaacaaattaacagaaaaaaggcttgaaggagggacgcaggatgaatatttgtctaaaaatgaaatacatggattaattaatgtattatttaatgatttaatccgaaaatgataaaaaaaaaaaaaaaaaa

SEQ ID NO: 90089 - DNA, 625 bp, Heterodera glycines
  SCN-specific regions: Sequence locations=1-54,77-625
caattaagaaaaatggttatttctcaaattgctaaaacactatggtcacacaataaagaagagcatttttgcagttattgctacggcttacggggcgaacgctttaagggcacgtttaagagatgaccgaattcgatacagttttgcagaacgagcccgtaaatatggtctggtaagttttgggcccgcccagcgacttcgccgtgtcactgttttggtcaatcgcgagtcgggcggacgacgggcggccgaccttttcaagcgcaatgcacttcccctgctcaatttggccgggctgcaagtgaatgttgtggaggtctcttccgcttctgaattggaatcgctgtgccgcgtgttggacaattctgaggccgactgcatatttttggttggcggtgatggcactttgagtagggcactcgtcggattgagccaaaacagtgcgccattgccaattggtttattccctggtggtcgaaaaaacattgcattttggagaatttttcaatcaaaaaaccagaacagagattcgatggatttgaatgaccaagactcaaaatcagtgccaatgttttgcgaaagtgcaatggcactgattgagggggaaaatcgactcgtttatcca

SEQ ID NO: 90090 - DNA, 480 bp, Heterodera glycines
  SCN-specific regions: Sequence locations=1-480
caatattttgcgcaggagagaaccgatgtccagactaagcaaatattcctcgcaatttgcaggtcatttgtttcgcccgctgttccgctgaccgttccgctaagcgaagatcgtcaggggaatatttacgtcagttgggatgttttgtccttcgacggcattcgccgctccttcgctggtgctttggcctggcagaaaagccaattcgaggcatttctgaccatcatttgtttgattgcttcttctacgctttctcaggacgtcctccaaacggcgtcggaattacgtcgcaaattgcgcttaattgacgaatttttcgccgatccgttttcctatgcccaagagaggcaaaaacgatgactggcaaaatgttggagacggaaagcaaattttcgggtgaagcgataattctggcaaatttaccgttgtgtatttcaggaattcattgctttggcgaatttttactgatgttgagaaagc

SEQ ID NO: 90091 - DNA, 789 bp, Heterodera glycines
  SCN-specific regions: Sequence locations=1-82,105-208,230-789
attaagagcagctaggcagccgaaatttattgttagtcatgatccccgcctgttactccaattattaaatcctccgcgtcgctcaaattttggtcaaagttttttgatactcgattaaattggcattgtaggagaaattcgacagcgaaagttgtacccaaaaaagtgcttagagataattgctatcagagcacttcgttggactcgggtcttcgcattgccacgcttccggcgtatggacaatttacgacaattggcgttgcgatttatgctggttcacgaaatgaagtgcattaccctcccggcacagctcatttcctggagaaaatttcttttttgtcgtcacaacaattcccagacaaagcgcacactttggatttgttggagaaatttggcgctctgatcgactgtcagtccacgcgtgacactttcgtttacgccgcttcatgtcgcgttgagaatgccttcgacgtgttatcaatcattgcggacgcggttctgcggcccaacattttggacaatgaggttgaatattgtcgtgatgtcatccgttatgagaatgaaacactttccagacagcctgagtgtgaacctttactcactgattggatacatcaggctgcttttcgctcgaatacggtcggtctttcccggtactgtcccaacaaattggtcgatgtggtaaactccggccacattttgtccttccttagccaatattacacttcgccacgcattgttttggcaagcgtgggtgttgaccagcaatttcttgtcgactcgggcaaa

SEQ ID NO: 90092 - DNA, 671 bp, Heterodera glycines
  SCN-specific regions: Sequence locations=1-186,211-405,428-671
gtttgaggtaaaaacacacaaattatcgtgtggattattgtaatgcatccctacgaattcaaattggacgcgatactcagcagatcagaattacccgtggaaaaacttgaaaagcacgcgtggaacccggaggaccggtcgttgaatttgtacgtgaaggaggaggacgtgctgacgatgcaccgacacccggtggcccaaagcacagacggaatgcggggaaaagttggctacacgcgcggcttccacgtctggcagctgaattggccggtcaaccaacgcggcacccacgcggtcgtcggcgtggccaccaaagacgcgccgctgcacgccccgggctatgtgtcactgattggggcggacgcggagggcttcggctggaacattgtggagaacaaatgctaccacgacgcacagaacacaaagccatggtccttcccttatgagcagccattcgtcgcgccggagaagcttttctgcgtgttggacatggacgagggccaattggccttcgccaccgactccaaatatttgggcgtcgccttccgcggcctcaaaggcaaaaaactgtacccggccgtcagtgcggtgtggggacactgcgaaatcactctcagatatttgggcggactcaatccggacagtcacttgatggacacttgtcggaggtc

SEQ ID NO: 90093 - DNA, 593 bp, Heterodera glycines
  SCN-specific regions: Sequence locations=1-187,213-228,252-571
tttccaattgtttcttaaattaagctgctaactaaattcgttaatcgaagcgacaaaatgaagtggacttacaaagaggagaactctttcgacaagcgccgcgcggaaggcgaaaagattcgccgaaagtacccggaccgaattcctgtgatcgtggagaagtcgccgaactcgcgtctgcgcgatttggacaagaagaagtatttggtgccagcggaactgaccatcggccagttttacttcctcatccgcaaaaggatccatcttcgccccgaagaatcgctctttttctttatcaacagcgttatcccccagacaatgacaaccatgggacagctctaccaggaccgccacgaggaggacttgttcatgtacatcgcttacagcgaggagaacgtttacggctgatcgtcggttgggcggcggagtgtcggtttggccgtggcgcataaaactcccatcgatgggagggaataaccagcgaatcgtcgtcggcttttatgtacctttttcatccctttcattcatatttttcaagtaatttgtgtgatcacgcatcgatgatgattatataaaatcgcttttttcaaaaa

SEQ ID NO: 90094 - DNA, 505 bp, Heterodera glycines
  SCN-specific regions: Sequence locations=1-179,201-345,369-505
ccaagtttgagcaaatgttccaaaaaaacacagcatttttcctcctatttattgccttctttctcggcattgcttctgctcggctaaagcgtggctcttacggctacaatccgccgccaactcctctcccgttgcctcagccctgcgggcagtacaatcagtacggaagcggcggcgcctttggaggcggcggaggaggcagctacagtcagccgaactgcaacacatacgggcagcagaacaactacggccagtccaattacggtggtcaaagtaattacggtcagcaggaaagtgcgggtggatttggcggaattggcggcagcccatctcagttcggagtgggggcgccaggctgtggcggggcgagttgctaatcgactgaccgatcggaccgatgcgaaaagccaaccgatcagcgaccaggcgattgaatccgtcatttcctgttaatcaattcatcctagcgttctttttacaaccaaaaaaacaaaacaaaaaaagg

SEQ ID NO: 90095 - DNA, 105 bp, Heterodera glycines
  SCN-specific regions: Sequence locations=1-84
aaatgttatctcaatattttgcacaaaaactttatttgtgtccgcataatcgacaacgttttgataagaaactcttatactgtgaaaaaaaaaaaaaaaaaaaaa

SEQ ID NO: 90096 - DNA, 661 bp, Heterodera glycines
  SCN-specific regions: Sequence locations=1-42,64-390,413-513,542 -612,635-661
caagtttgagcatttaaattccaatcttccaaccaattctcttttcgtcaaaatgctttctcccttctcctacgacccgttctatcgccgttcgttgtggcctatggccactcatgttggcaacgtcctttcgcccttccgccagttggagcgcgaactcgaccacttcttcgaggggatgcagcccatgcttcgtgaccacgccgctcagctgaacgtcacggacaagggcgaactcacttacaaagtcgatgtcagcggcttccgccccgaggaaatcaacgtggaggtgattggtaatgagatcatcgtcaacggggaacaccgcgagcagaacgacagcgaatcggtccaccgtcagttctcgcgccgtgtgctcatcccggagggcatccaaaaggagagcatcaagtgcgagctggacggcggccgtttgttcatctgcggaatgaaaacggctggcaaaggcggacgtaccattcccattgaaatgaagaagaaggcggccgtggaccagcagaaggaggaggagaagcagcagtagaaaaggacggcggaagtgaagacggactgactgtcggtcgaccgaatgatccattgacattgatctttttattttgatacttttgcaaagtgatctataaattatttttccttcaaa

SEQ ID NO: 90097 - DNA, 633 bp, Heterodera glycines
  SCN-specific regions: Sequence locations=1-243,265-633
cccaattcttacgtattcccttttttgtttttgtacttcaaatttactgctaatttcttagaattgcttcacacaatgtcggcgatcgaaaatgacgagacaaagagcagaatttggcagcaactgaagaccaaactccactcgacgatggtcgccttcggaagcgggtcggtgcagttgcccaagctgatggacacgttcaggcatgattggggctccgaattgacttcgtacgcggtccaactcggcttcggctgcaacgacgcggcggtgtacaaaatgttgctgacgatgcccgacgaaattgaaagcggcttcatatcggccactggcaccttcgcgttcaaagtgattccgaaggcggagaccagcgaaaacttgacgaagatcgaccagagcaaccaataccaagatgaaatgcgaagaatatttgcacggcgtcgctcctcaatgtcgagcggcttccatcgttcattccctttcaaccagtctttccatgtgcgtccgcctgtcagaatgcctccaccgccgcctccgatgcccttcaatttgagtgcacccatcttaaacggaccgaaatttccaggacttgtcattcagttgcctaactgtgcggatgcgcagcgtcgcgtt

SEQ ID NO: 90098 - DNA, 597 bp, Heterodera glycines
  SCN-specific regions: Sequence locations=1-198,220-597
gtttgagcaaaacgatgacgaataaaactgcactgatcatcgcttccgacgggtcagaagacattgagctgatcgtcaccagtgatgtgctgcgtcgagcggggatcaatgtgaccattgctggacttcaggaccgtgcccaaattgagctggcgcgtaaggccaagctgcaggtggacgcactgttcaaggacgtccttgacaagcagtacgacgcggttgtgttgccgggcggtcagccgggctccgacaatttggccgctgacccacgggttggcaccgtgttgcgcgcacatgaaaaagcgggtgccattgttgcggcaatttgtgccgctcccattgcatttgtggcacaccaaattggcgttgggggcgtactcacttcatacccatccgttcagaagacaatcactgacgccggctacgcgtactctgaccagcacaaagtgtgcgtgcacaaaaacgtggtgaccagccgtgggcctgggactgcctttgactttgcgctgaagcttgttgagctgttggtcaacattggcaaggcggacgaaattcgcggggcgatgctgctcgactgagactgatcggtggcgttga

SEQ ID NO: 90099 - DNA, 534 bp, Heterodera glycines
  SCN-specific regions: Sequence locations=1-534
gttatgctcaatgacaccaaattagagtcaactttgagcacgacgattaaatcaatcgaccttcagattgaattgcctaaatgtttggattgcctggctgacggattgaatgtcacggaagaggccattacagagaatggcggcggcacaattcgtttcctgcgttcttccccgccagtctccgtccccatcttgcctccttacattttgctgttgcacgaccaaacaaatgatgccaatgtttggcggaaaactcttcagattctgtcggcctccggcttttgctgtgttgcgcctcacctctcaaattttgtttttgacgaggaggaaaatgtaaattttttgctgaacttaacttcacatatcggagcacgtgaagttgtgcttgtggccagttcgatgtccggcatttacctcattccgttcctttctcgtggaattaagaaaaaggacattcatttccacgttaaagcattcattgcaattggcgtgtcggacactcaccgactaaaagtggaagaattggtcaataac

SEQ ID NO: 90100 - DNA, 510 bp, Heterodera glycines
  misc_feature (482)..(482): n is a, c, g, or t
  SCN-specific regions: Sequence locations=1-409,431-482
ccctgcgcctcctagcgactcaattgttaatgccaatggccctcagttaaacaatcaacaaacggacactggtctcgtaaacattgttccgcttgcatggcaaccgccgaaattcacaaatggcggaatccaaggacaatcagagtcgaatcctatgccttttggtggaggattttcatttacgactactgttcctccagcagctaacggtcctttccaatttggtgctgcacctccagtggccaacggaaatgtgttccagtttgctgagacgactgattctgctgtttctacgaatgttcgacacggtgttacgggaaggaaattgctgcacgctcgaaggaagaagcgttgattgcattcaatgttagaaaaatcaccggttttgtttttgttcgttagaatatgttattttcatggaatattatgtccaggaaataaatttatttttgatttttttgcgaataaattgctgaaattcnaaaaaaaaaaaaaaaaaaaaaaaaaaaa

SEQ ID NO: 90101 - DNA, 781 bp, Heterodera glycines
  SCN-specific regions: Sequence locations=1-712,736-781
tcaatgagttggttcatcataatcattctgctaattttcttcatttttctgcttgttgtcttcttcagtttgccaaaatcattgccttttgacccttcgggcaaacactgtcttatcactgggggttcacgtggcattggcaaagccatcggtgccgaattgctcttgcgcgggtgccgtgcactgtctgtgttcgcgcgtgaccctatcgctttggcaacggcacgaaaagagttggaggcgttgtgccgtcagccgggccaaaccgtccacacttttcaagttgacctggcagccgatgggccggccaaaattgaggaaattgttcgcgaagcggagcgtcagtcgggcgctgtcgatttgctggtgaacaatgccggtacatgtgtgcagggagcgttcgacgagttgcccagcgatgcgtttgagcgtcagttgcgcaccaattttctaggcgctgtgtatgtgacgcgctctgttgttggcggtatgaaacgacgccgttttggccacatttcgtttgtgtgttcagcggctggccaattggcaatttggggttattccgcctattcgccatcaaaatttgcactccgtggctttgccaacgcgttgcacatggaactgttaccatggaatgtcggcgtctcaattctatttccgcccaacacagccactgacgggttccgtgacgaattgcgtacaatgccaccacagatccgtgccatctctggcactgccgggctgttccaagccagcgatgtcgccgcacgccttgtccaag

SEQ ID NO: 90102 - DNA, 296 bp, Heterodera glycines
  SCN-specific regions: Sequence locations=1-296
agggatggcaattgcgtctgattataaaaagttgcatgcgaagtcgactaaatgccaaaagattaagctgtcaaaaatggaacagaaattattcggtcagaagccagtggaaatcattggaaaaacccaacacaatggcattgtttggtatattgtacagttggagaagaaaaacgccattctgctgaaccatgactttgtgatcaagaaatatccacaattgttgctgaaaagttacggcttgtaatttataagttatcctatataggtaataaaaaagtttgagtgttaaaaaa

SEQ ID NO: 90103 - DNA, 362 bp, Heterodera glycines
  SCN-specific regions: Sequence locations=1-229,251-340,361-362
cataaatggaccaagaaatgagtgcgggaattaacaaagccgtccttctggaaagatcaatcatgaaatcttgatggaggagacgcgtcgaattccaattttaggcgaagtcgttggccaattacgaaatatttatggttcttcgttagccgagcagttcaaaaacgaactcattatcgccagccaacttaatcgtggaccgatgaataatgggatcagcaacccgcacatggacatgcttcttggtgttgatgagaaaattagcgatcttttgcaccaattgtaatcacacagctgatttactctcacaatgttgttgccgataaattgtatgaattcgaaaaaaaaaaaaaaaaaaaaga

SEQ ID NO: 90104 - DNA, 320 bp, Heterodera glycines
  SCN-specific regions: Sequence locations=1-296
ccaacatttacgaagttacaatattttataagaataaggaaatggcgatagataaaaagggccacgtgactgttagttgtgcccgtgtgaaaatacagtttcccagttacgcttttttcggccgaagggtgagagaagttaacgctaaaatcaagagtttgcagaacgaatgtgacatgattgaggggaatgtccaaaagctgcgaagtaactttcgaccgaattccgcgaattgacacaaacgctgtattctgatgctgcttatttatatttattatgcataaactttaagcatcaaaaaaaaaaaaaaaaaaaaaaaa

SEQ ID NO: 90105 - DNA, 743 bp, Heterodera glycines
  SCN-specific regions: Sequence locations=1-33,62-240,263-401,425 -521,543-743
gtttgagataataggaatcctttctatcattattcaaaatgtctcaccgtaaattttctgcacctcgccacgggtccatgggcttcacgcccaagaagcgagcgaagcgtcatcgcggaaaggtcaaggctttcccgaaggatgacccaaagaaacccatccatctgacggcgttcatcgcctacaaggctggcatgtcacatattgtgcgcgacgtggacaaacttggctcgaaggtgcacaaaaaggaagtggtggaggcggtcacaattctcgagacgcctcccatggtcattgtcggtgtggtcggttacatcgaaacgccgcgcgggccgcgtccgctcaaaaccgtttttgctgagcatttgagcgaggactgcaaaagacgtttctacaagaattggtacaagtgcaagaagaaggcattcacgaagtatgccaagaaatggcaagacgaggcgggacagaaatccatcgaggccgacctgaataaaatcaagaagtactgttcttatgtgcgcgtcattgctcacacccagatgaaactgatgaagcaccgcaacaagaaggcacacataatggagatccaaatcaatgggggtaccgttgccgaaaaaatggactgggctcgtgagcacttagagaagcagggtccccgtggagcagtgtgtgagctcgctacaccatcgactgcatcggtgtcacaaaggaaagggttgaaaggagtgaccagcggatggcac

SEQ ID NO: 90106 - DNA, 670 bp, Heterodera glycines
  SCN-specific regions: Sequence locations=1-670
gtccatttaagaacccactttccaataaatcacaatggctttcattggatacggcgctcttacggccgcgctgagtggcatcattttgtacgcaaatttgcccacccgtctgaccattggcgccattgtgccgaccgttgaatttttggccgagacccaactgaaaaagttggaacccggccaagctgtggctggaccacaaattaaggctagcgatttgttcaatgccggccatcctctgcttgtgatggctgtccgtcgacctggctgcgctttttgccgaaagcaggcgagcgcgttgtgcagcgcggcgagcacacgttttgcggacaaaggcgtgcgtgtggttggcgtagtgcatgagcagcacggcgtggaccaattccgcccatttctgccctgcgcggacgcaatttatctggatgaggaaaaacgctttttcggcccttcacagcgttggcttccgctttggatgggctttttgcgtctgtccacctatgtgaactattacaaagcgtggaaggctggctttgccggcaacaccgagggagaaggccgactgttaaggggtgtttacctggtgaatggcgataacatgctttttgcacatttggaaaaacaatggggcgacgaggtcaaaatggacaaattggtggacgcagtttcaaag

SEQ ID NO: 90107 - DNA, 460 bp, Heterodera glycines
  SCN-specific regions: Sequence locations=1-437
gtttgaggaaatttaagcttttgcattcttttcaaatttactttgacttcaataaagaagaaaaatggcttcatctggctttagcgtctatgttggcaacattccgtacaacgcaactgaagcggacattggcaatttgtttagtcagtgcggagtggtcaccaatgttcgcattgtgtacgaccgcgagaccaatcgcccaaagggctttggcttctgtgaattccaggaccaacaaggagctcagaatgcggttacaaatctgaacggagccgagctcaatgggcgtgcgctgcgtgtcaattggaccaacaaataagaaggttgtgcttgaactggacggatgatgatggatggattgtcatttttgaggatcgttttgacaattttcatttttctttgttgattggttttttgaaataaaggaatggttcgttaaaaaaaaaaaaaaaaaaaaaaa

SEQ ID NO: 90108 - DNA, 653 bp, Heterodera glycines
  SCN-specific regions: Sequence locations=1-14,36-62,85-653
ttccaaaacgagggtttgagaaataataacagtcattgtgattgtaaaatccactaaatggcaaaagaaaacaaaaccggggaacaacaaagcaagcgaaagaaatgtcgccggtcaaattcgccctcagatgagtttcatcgtccaatggaagtgcccgaccacatttatgtggctgggatgccgagacatcgcgcgaagtccgagacgaaacccgaaatgtttgtgccaagccgaataacggtcgctggtgggaacacaaccgtcgcttccaaggcgcagccggtcgaaattctcagagagcgccaaactcttctccaaccttcggacaatgaaaacaatgtcatgaatggcattccggaaatgcttacagcaaacgaactgacgcacgaggacagcacaaacaatgcgagtgaaataatggcagcgcaaggcaacgaaacgacatcgatagttgttgacaaggacccgctgaaggagttgaagatgatgcggcggcgattgattcagctgacgaaacgcgtttccgaattggaaacgcaaaatgcgcagaatgccaatgaaaggactttgctgctgggtattgtgagtgcgtctactttgctaagtgtcgttttgttggcttcacaaattcgcacatggctgagccgcta

SEQ ID NO: 90109 - DNA, 470 bp, Heterodera glycines
  SCN-specific regions: Sequence locations=1-15,38-47,69-309,336-435
attcattttattattttattggcccttttcctaaaattcaatttacaaaaatggtttccaagcttcttccggtcattctctgctgcttgtttttggcttctttcgccctctgctcgcccaaggctgctgatgtgctgaaatttaaacgagaagcggcgatcagcagttgtggagctggacagtttgaatacgggggcggctgttgtacgacatgcacaagcgatgctgattgtacgggcgggaagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgatcaataaatatttttcggaaaaaaaaaaaaaaaaaaaaaaaaaaaaaaaaaaa

SEQ ID NO: 90110 - DNA, 870 bp, Heterodera glycines
  misc_feature (822)..(822): n is a, c, g, or t
  SCN-specific regions: Sequence locations=1-72,94-320,343-870
attttgttcgccatttttgcagtcaaaacatcaccaaaccgacaacaaaatgtgacgagcaagaaaattcttccgccccctcctgttcttcttcgtctgctgcccttgtccatgtgcaaaaccgtggccaatggccggtggaagtgttggccaaatttttggccgattgttttgtgctcggcgactttgtctcggaatatttaataaacgcagatgctggacgaagttgggccgcacatgaagcgaatgcggtgggaggacgaacattgggacggacaaatccaacgctaccgggagagggaacaaatgctggaaaattggcttcccgaaaaccaagcactgatccgacgcatttggcacacttcgtttcccgccccatttgagccgtcgccgtacgtacacattctcgacctgcaccaggacggattcatcagcccacatttggacaagtcgaggtattgcggccgggtgatctccggtctgtcccttctgtccgcttctgtgatgcgaatgcggcacaaaagtgccgagttggggcagctgtgcgtggccgatttgttgctcagccggctcagtctttactggctcagcgggtcggcacgctacgacttcactcatgcgctgttgggggccgaagagagtcgctttggcacccaaacggtgccaagggagcgacgcattgcgctcatttgccgggaagtggtggtgccaacggcgaaaagtgaccaaatcgactgacaaaacgaatcaatgaatgggcgagagcccaaattttgcttatttattaatttttttttgtgtgtgttatttaattttattcgntttttgtgatcttttttttgcatagaatgaaaaattatgatgaatgtt

SEQ ID NO: 90111 - DNA, 624 bp, Heterodera glycines
  SCN-specific regions: Sequence locations=36-154,180-624
cctcgtgccgaattcggcacgagggttaaaatgagtgaactgaatccattgaacataagcgactctctattcgcgactcacctttcatcgcagcactctccgacttttttcgggacttctcaattccaaccgttccccagcagggaattgattgccacttcttatgcaaatgccttcaattaccattccattgaacaacagcgttcaattgactcccacaacttgacgacattttctccgtcatgttgctgggaagggcatcatcgtccgttgccgccctcaaatacattggcaatcaatgccactgaatgtcatgcaaatccacacgagtgcgctgatgagaatgagcttgaaattggctgcggtggacttagcgttctttctgttagtcacgatgggacagacaattcgtttttcatcagcggtacatctgccgacagtttgagtccacgagagagcggtggcgacgttcatcgacgccccttcaacaacattttgaattcaaacaatacgccaccgttgaactctgccacgagcaaagggtttcgcacagaattggaaaaacaacgctatttggagaggcgcagcagaaacaacgaggcagccaagcagtcgaggaacaaa

SEQ ID NO: 90112 - DNA, 672 bp, Heterodera glycines
  SCN-specific regions: Sequence locations=1-14,37-174,196-672
ctcacaatggcgtcaaaaattaaaccattaatttgtccgtcgatattaaatgctgatctgtcagatttggctaatgagtgtcgaaaacttatggccgctggtgcggattatttgcatttggatattatggacggccatttcgtgccgaatttgacgttcggacatccgctcattgaatgtctgaggaataaattgggaaatgacgcgaagttggacgtgcacatgatggtgtccaacccgtccaaatggctcgaccctctgcacaaagcaggcatcgatcaattcactttccattgggaggcactcggagaggacgaagcggtggacacactcatcgaccgagtcaaatccaagggaatacgatgtggactgtccatcaaaccaatgacgccgctggacaaactgatgaagttttgcgaaaagatcgacacagcactcataatgacggtcgaaccgggattcggcggacaaaagtttatgcaggaccaaatggaaaaggtgcgccaactgcgaaaagcgtacccaaacttggacatccaagtggacggcggggtcggactggacaacatcgaacactgtgcgaacgcaggggccaatatgatcgtttctgggactggaatcgttcggtcggctgacccgcgtcagacaatgccaaagatgaaggaaactgtc

SEQ ID NO: 90113 - DNA, 510 bp, Heterodera glycines
  SCN-specific regions: Sequence locations=1-510
actttgattaatccaatggaaaagagattgaatccatctgcacttcctacgcttatgttatcgaatttcggtggttattcggtggagacactttgcacgcttgggaaggagttcgtattggaacttatgactcggatgattagcattgtgagcactttaaaaatggatattaaaggagacaataaaaaagatctagacattgttcgaattcaacttgattattctcgtctcatttttctctgtcttactgaggtccgtcttcgcatcgatttaaaacttgctgagggaattggagagaatcagaatttgaaagatgttcgtccttctgatgaacggctgttggagctcctttcagagccgaatcaaccggaagaaaatgcgaaaaaggcaaatttggcagagagattcgaacaaaacagaaaggagttaattcgattgaattgtcatttaaaaaaattggattggttgtcagttaatgcggagaatggagataaataattctgcgaaaaa

SEQ ID NO: 90114 - DNA, 506 bp, Heterodera glycines
  SCN-specific regions: Sequence locations=1-308,330-350,372-506
gtaatacgcagaaaaactgctccatttgataagaattcaaagaatttgtgattttatccgtttttgtctgccgttttcatccgattattccgtttttgtcttgaaatttaactgtttttaatcgttttctgccgatggtttgcgttccatgcataattctgcccgtcgtgttggccatttaccttcgatttgttcagccatacattttgcgttttatgcctcagcgatggcgtatttggtttgactcggtgctttacccgacatgtccagtgaacaaaatggaaacgacaaacaaatcgaaaacggagaacaacaaaacagacggagaaggagagacggggaaggaatgcgaaaaggacaaatgaaacagaaaacatcaacaaagttgtatttaagtgattatgaaaatcaaaattcactaaactgatttcctttgtgcatcaaaattcgttgtcttctgagaataataaagtcgcgattcaagaaaaaaaaaaaaaaaaaaacaa

SEQ ID NO: 90115 - DNA, 632 bp, Heterodera glycines
  SCN-specific regions: Sequence locations=1-5,27-632
tggacaatttccttttttggacccttgcgccttccaaacggctttcaccgccgcttctgacggaaggcgcgtcttttcaacagcagcaggatgagagacaaatgcataccgttgacctgtctcaacggttcatcgactcacttccctcttctttttttctgggtgaacatgcaacttacaaagaccatgccgccatttcactgcttaatttggctcacaaccattttgtcactgtccccccgttggtggcacagttcatcaatctgatcagcctcgatataagcaacaatcacttggcattgttgccaaaagagatctcttcgttgaaaaaccttcgcgaactttcacttagaaacaatttgctagagaatttgcctaaagaatttcaacgactgcaatgtctacgggaattgaacatttccggcaatttgttggagcatttcccgcgagaactgctccaaatcaaatctctccgtgtgctttatttgggtgccaatcgtctacagtcttttccgtcggacatatgccgtttgtccaaccttcaagtgctttacctgggtggaaatgcgttagtcgatgtgccggatacaatcgggcagctgtcagagttaacttcgcttggtttggcggac

SEQ ID NO: 90116 - DNA, 545 bp, Heterodera glycines
  SCN-specific regions: Sequence locations=1-225,247-512,535-545
aacaagcgacagttatattgtgtgactcgcccaaaatgtctaagatgggccgaatggaatcggacacggacccaaatacggtgacaattctgaggaagcaccaagcgccccagcgtgtactgaagtcggacgcggatgttaatgcggcaaaaaagcgcggcgacgacgtggaaacgacgaagaaatatttcgcaggggtgaatcgtcagcacaaaacggacaaaaacaccgcggttttggacgcggagacggagcaattgcaccacgaaagggtttcgctcaaattgggcactgtgattcagcaggcgcggcaggccaaggaatggactcagaaggagttggcaacgcgtgccaatgagaaagtggaggtcattcgggagtacgaaaacggcaaagccgtgcccaaccaatcgatccttacgaagatggagcgttgccttggcgttaaactgcgcgggaaggaacttggccagccgcttgcgcccgcctcaacggccaaaccgacgacgacggcgaaaaaatgagcagccgcaagaggcgaaagt

SEQ ID NO: 90117 - DNA, 591 bp, Heterodera glycines
  SCN-specific regions: Sequence locations=1-120,144-174,202-387,409-591
tccttctccccagttcaaatctttaacgacgaggccagcgaggagcgtgccgagaatgcgcgtctttcgtccttcattggcgccattgccgtgggcgatctcgtcaagtcgacgctcggacccaagggcatggacaagatcctgcaatccatgtcgacgggcgaaatcatggtgaccaacgacggagccaccatcctcaagtcaatttggttggataaccctgcggccaaggttctcgtcaacctgtccaaggtccaagacgacgaagtcggcgacggcaccacgtccgtgtgcgtgttcggctccgaactgctgcgcgaagccgaaaagctcgtcaaccaaaagatccacccgcaagtcatcattgagggctaccgcattgcgtctgccgcggcgctcaaggccctcgaggcggccgccgtcgacaatggcagcaatcccgaaaagttccgtcaggacttgatcaacattgccaagaccacgttgtcgtccaaggtgttgtcgcaggaccgtgtctactttgcccagctggccgccgacccggtgctgaagttgaacgggcccacccacttgggtacccttcataacatt

SEQ ID NO: 90118 - DNA, 604 bp, Heterodera glycines
  SCN-specific regions: Sequence locations=1-541,563-604
attccctccaatttcgttccatcgttttcaaaatgatgtggatgttcttccacactcaaatcaaggacacggttctattcaaatggtggaaagtcgaaactatcggaagtcttctgatcacttgtttggtcatgtattttggtgccatttgcttcgaagccatcaaatggcttaggcttatgcttgaacaaaagtcgcgtcagccgaactccgccaattccgccggactcaacatgacagaccaaaacaaaacagtgccaatgactaatcgccggtacgccgaatcgctcctctcccgggtccatcttctccagagtgttctgttcacggttcaactactgctctcctacctgctgatgctctgcttcatgactttctctgtttggattggaatggccatttgtgccggtgctgccaccggtttttggctttttgggaggagagtgccaatgttggcatttgcatcgagcggagcagcggggagcggacagggatatgcgagcaccggccgaacggaactccattaaaagccatgcattcattttccccaattaatttgcatcgaataaacgcatttggccaaaaaaaaaaaaaaaagcccaaa

SEQ ID NO: 90119 - DNA, 860 bp, Heterodera glycines
  SCN-specific regions: Sequence locations=1-365,387-814,836-860
gtccaattaagaggaagcgataaaagtaattttgtcgatggattcacaattattagcgacgaatgaccattctaatggagaaacagcagcaacattagaggagatctacagaaaagcacttgaatattggaactcagttgggtctgacttgaacggaatgcttgggggctttcaacaattgcaccgccccgacattaatgactccatcaattttttgtgcgaattgaggaaaaagtcctttcttcgccacttcgaccgcgcgttggactgcggctgtggcattggccgagtgacaaagcatttgcttttgcccgccttccgttccgtcgacatggtcgacttctccgaccatttgatcgctcaatctcacatttttgtgccttcttcgtccaatcccacggaaaacaattcggttggacagcgttttgtcgaatctttgcacacttttgcgccggccgaaaagggcggagattacgacatgatttggatccaatgggtgaccggacaattggaggacaaccatttggtggactttctcagaagatgcaaggagagtgtcctccgtcgggacggttgcattgtggtgaaagacaacgtggccaaagggactgaaaaagaatttgacgaagtcgacaattcatgggccaggccccgggaaatgctgcacaaattgttcgaacgagccgactgtcgaattgtgctggagagaaaacagccgaacattccgaaagctctttacgaggttcgaacctttgctctcaaaccgttgtcaaatgatgaaacaaatgggatgaatgatgattgaaaacacacatattttattcattatttacttcatgatttttcctttctctgtggtt

SEQ ID NO: 90120 - DNA, 582 bp, Heterodera glycines
  SCN-specific regions: Sequence locations=1-27,59-582
cttaagtgtcggtcaataatgaaattatttttgttattttctttgtttttaatacaattttcttccgccatcgataacatggaacatcttatgccagaaaatgacgcagacagtttgatttcgtatttagaatttcagcgttggcataaagcggtgatgggagcagagccacgggaaagctcaatcctttttggcaaaaatgataaagacgcagatggcatgctaacggtggccgagtttgtgccattggcatttgagcttagccgaaagcctccggaacgtcagacggacaaaatttttaagaaatttgatgtcaattcggacgaacaattggaccgtcaggagcttttgaaaggcgattccatctccgaggaaattgttgatggtctttttcaggtcgccgatgtgaacaacgatggtcgcatttcatttgacgaattttcaaccgtggccaacactttggaaagtcgcttgtccaaggatgagaaaaacgcgggcatggccatgtcattgttggcccaattggacacggacaaagatgaaccaattaatggcactgaactgtttgaatatgctcacaaa

SEQ ID NO: 90121 - DNA, 551 bp, Heterodera glycines
  SCN-specific regions: Sequence locations=1-245,275-551
atgatcgggacgggaatccgataactgcggacgatctttgcgttgccggcgcgttggctgtgctgatgaaggatacggtgaagccaaatttgatgcagacactcgaagggacgcccgtctttgtccattccggtccatttgccaacattgcgcacgggaacagttccatcctggctgatcaggtggcactcaaattggtcggctcggatggctttgtgatcactgaggccggctttggcgctgacattggcatggagaaattcttcaacattaaatgccgaacgagtggcctttggccaaatgccgttgtcattgttgcgacggtgcgcgcattgaaaatgcacggcggtggcccgcccgttgtgcctggcaatccgctgccctttgaatatttgaatcccaatttggagttggtggccaagggttgtgacacaaacttgcgcaaacagatcgaaaatgcgcaactgtttggcgtgccggtgctgatctgtgtgaacaaatttggcaccgattcggacgacgaattgggacttgtggtggacaaaccacgc

SEQ ID NO: 90122 - DNA, 115 bp, Heterodera glycines
  SCN-specific regions: Sequence locations=1-66,88-115
atttccaggactcactgccagttggatgaaatgaaattcaattgtactgctttcattatgctttcaaaagttaactttcaaattaatgtccattgttctttaatttagtatgttt

SEQ ID NO: 90123 - DNA, 797 bp, Heterodera glycines
  SCN-specific regions: Sequence locations=1-625,647-797
gttttctctccttcattttagttttgatccatctgatcagtttctttttttctcacaaacaatttgtgttgtgtcatcgaacaaatgtcgactgtcaccaacggcaaagctgaatcgtccatgggccgatacgtctacatcttgccctacctgcccactgtcatcccttcttattttttttacaaaacggcacagtcggcgcggaaatgggcccctgtccacaagttcggcccgttcaaagtgtctgcagcgcatggatttgcccttctcattcccatgccgcacttggtgatattggcgttgcaaatttggtacacgcgattgtcacgtcgtatcaatgagaaaaacaaatgatacaaaatgtttccaaacagagcaatatgcttcaattcttgtgacactgtttccattttgtcaatgattttttgtggcaatttaaattcgttttgttattcggcaattattgcttttcactgttatgcttcgaaagcgcctcgctctatataaaaataatataagaagaattacatgttcattcactaattggcttgtcccattaattgtcgtgaaattggacggatttttttaaaattaaatcttgggtacttatgaggttaacgccacataaaaatgtttttgtttttaatgacaaaaatgtgtttccaggggtattcggggctgctgatcacgaatatgacatccatttcgaccgattccgaaccgggactcgaacaaaaagccgaaataggttgagatgcatttgaagctattttatatgttacctgtgtacggtattg

SEQ ID NO: 90124 - DNA, 791 bp, Heterodera glycines
  SCN-specific regions: Sequence locations=1-21,43-791
actctgttggctgcccttggagatgaagacgctgaggtgggctttctccttgggggaggcgaactattgaactcagagcgtgaaacccccttttggcgttgtcgaccccgacgcaagcgtcgccgaaattgaggacgcattccgcactttcatgtacccgcagagacattgcgattattctgatacaccaacacttggcggtagcatgatctcgataccaaagtggcaccagacacagtggctcaccatcccggtcgtgctcgaaatcccctccaaagaaatgccttatgacgcgtccaaagatagcattttgaaccgagcacgtggcctggtgaacactgacgacctcaagtcatagaagaagacattacaaaaaacaaattctcctttattagtcaatgaatgtgtttaattaattatgggaatgacgagaacctacatacaaatttgtacttttggtcttttcttggtactccaaaacccagacattatgcacaacaaaatttggttttgatgcatctatcagcgattgatcccttcagcacgttgaatagtaacatttattcccaaattcccgttttcagcaaaaaaattcgcatgatttgtgtcaaaagccaaacagtctgattgagaaattgcggcagcgaccccctcgtgaatacttcgtggactggcttcccagcaaagtcgacgccgattgttggataattccaatttgtaaacgaaattttcggcttcctttttggtcccaattagttgaacaactgcgtagaacatttggtagctttgac

SEQ ID NO: 90125 - DNA, 543 bp, Heterodera glycines
  misc_feature (527)..(527): n is a, c, g, or t
  SCN-specific regions: Sequence locations=1-5,27-400,470-543
catttgctcgatcagttcgtcgcgccggcccttcgtctgtggatggtaatagacctggtctcctccgttctattggtgatgattgtcataaaaaaatgttttgtgcgcattcgaattccgcgcacaaaacgtcaaattgagctgagagcggcgaagagacgcaaaaggaaggcactgaaagagtcgggcggaggagacggcggcgagtcgcaggagagcgagcacaatcagtacagaggtgggcaaaccatcgttctgaactcgttcaatggcgcaaatgggggcaatgggatgaggagaagcggaaacggagcgaacggaggggcggaaagggcggcgcaacggcaaacgattgcctcgagaagcattcccgtttagagacagcgcaacggcacaagccaattaaggaattaattaacgaattaattaattaattaatgaacaaattagctaattaacgaattaattacgaatatttgttgatcagctcgttttgtttacttattaaatataattttgctcaaaanaaaaaaaaaaaaaaaa

SEQ ID NO: 90126 - DNA, 1166 bp, Heterodera glycines
  SCN-specific regions: Sequence locations=1-1128,1150-1166
gtctatgcgtcgtccaaatggtcgactgcccccagcaaaacggacaccgccagcaattgcctctgttcaatgcttccgagcattttttcgaaggggctgagaaactatttgaaatttggttcgataatgaccagcagaagcgagaaaatggccacaaaagcacactgagaaccattcccgagaacgaactgcggcaacttctgaacacggccgggtgccacattctccaggtgcttagaacagctgaaatcgatgcgtatttgctaagcgagagcagcatgttcatctcggatcgacgtctcattttgaagacgtgcggacagacgcggccgttgcttgtgatcgggaagttgttggagttggcacggaaacattgccaaatggacacagtgaccaatgtgtattattcgcgtaagaatttcttccggcctcatttacagccccaactccacgccactttcgacgaggaagtggattaccttgacggcttcttccagggtggaagcgctttttgcatgggtcctctgaagcacgaccgatggtatttatacactttgactacgccccgtgctccgctgaactgttccgaccacactttggagctgcaaatgaccggaattcctgtggagttactcagtgtctacagtaaatcggcatgccccggcggtgcggcggagtgcactcgccgatccggcattctgtcactgttacctcgggggaccatcgtccaagacgaactgttcgagccggtcggatacagtatgaatggggtcccggctggtgacgaatacgtgaccattcacgtaactcccgagcccgagttttgctacgccagcttcgagacaaaccatcgccggggctgtctctatgaacaaaccctgcgggtgctcgactgcttcaggcagttttttgccggggattgggctgttcggatgattgcgaagcaatttaagaccgggacgcttcattttgacactttttgctaatgaacattcaaatggagcaattgaagtgcagcagagattgtgggcggaggatttcccgggctatcggcgactgagcgttcaaatgcttcgccttcaggcaaattggggggggggggagggggagaaatcatttaattagtcgaataaaatgccaaagtcatttcagagtgacactttgct

SEQ ID NO: 90127 - DNA, 641 bp, Heterodera glycines
  SCN-specific regions: Sequence locations=1-641
gtccaattaagattcttttaaatttgaataaatttgaaatgacgacaatagcggcgaacggtggcggcgaaacattttcacgaaaagtttttgtaggtggactgcctctggacatagcgcagcagacggagctggaactttctcgcgcttttcgacagttcggcgaacttcaaatagaatggcccaccaaacgggtgaaccagggcaaaacgacattggacggcaaaccggcagggcccggctacgcgttcattgttttcgctgacccgcgttcggtgggtcttttgttgagcaaatgtcgccgtgaggtgacagcgcccggggagaagacgcgtcgttacttcctgacactgtccagccgaacggtgcacaacaaacccgtacaggtccgtccttggcgtcactcggacgccgtgttcacccctcgttcggggttgcccgttaacatccgatggactgtgtttatcgggggccttccccgtcccaccagagcgatcgacctttaccaagtgctgatgccccccatccgtggaggcgttggccgtgactgtattgtgcacgtggacatcgacgtggactcggagatgcgctacccgaagggggcggcacgcatttgcttcagtcgctacgacgcattcgtg

SEQ ID NO: 90128 - DNA, 964 bp, Heterodera glycines
  SCN-specific regions: Sequence locations=1-4,35-849,871-964
gtccaattaagactttcaaaaataataatttaatcgacaattttccccgcaaatggccgaagagaatacaaatcaatcggaaggactcgacttctttctgaaccgaagcggatggacagatgcccaattggaggaagtcattcggcttttgtacggcaaaaggctccaacaactttcgattgcccagcgtttcttggactcggcgcaagaagcaaattttgagctgaaaggttttcaaatggtggcgcaggaggagcagtgccgaaggccgaagaaaatgcgcgtggcggccatccaaaacaaaattgtgttgtcgacgagtgcgccggtgcaagcgcaaagggacgcactgcaccaaagagtcggcaaaatgatcgacgcggcggcacgagcgggtgcccaaattgtttgcctgcaggaggcgtggacgatgcctttcgctttttgcacccgcgaaagattaccatggacggaatttggagaataagccgaggacggagcgaccacaaaattcttaagcgaattggcaaaacgacttggcggtgtgaaaattgcgccaattttggagcgtgacattcacaaggatgaccttttgtggaacaccgccgtgatcatctcacagacaggcgcagtgatcggaaaaacgcgcaaaaatcacattccgcgggtgggcgacttcaacgaatcgacttattacatggagtccacccttggccaccccgtcttcgaaacggcttttggcgccaaaattgccgtgaacatttgctacgggcgccaccatccgcaaaattggatgatgtacgcgttgaatggtgtgcttctgctgatgctaccaaatgcacttgtttcttctccccccactgtttgaggtgccgacatcattttcaacccttccgccactgtcagcggactcagcgaagcactttggcccatcgaagcgcgcaacgcggccatcgccaaccac

SEQ ID NO: 90129 - DNA, 494 bp, Heterodera glycines
  SCN-specific regions: Sequence locations=1-301,326-494
gtccaattaagatgcccgcccctttggctgttcaacagaaaatgataagcgaagacgggtcggacgcaaacattccccagcaacacttttccgccaatggcaccccccagcaaccgccgtccgccactgtccctcccgccgccgcggctgcgcaccttttgaagaattcgctgtccgcccctctgctggccaatttgccgcccgtccctccccaatgcggccccccaaccgtttctttggcattgctcatcgatttcgccatccattggaactaccgacaattcgaaattttgtccgaactgaacagcaaaaagaaggagacggaccggaagatcagcgtggtcgagtttgctcacaacactcgtctgattttcgtgcgtcttctcgccattgtccgttggctgaaaagtgccaaaaaattcgagccgctcgcctccattcgccacttgctcgacgaacaggcgacccgttacgtggagaccgccgatcggttg

SEQ ID NO: 90130 - DNA, 541 bp, Heterodera glycines
  SCN-specific regions: Sequence locations=1-32,54-76,99-305,327 -338,360-541
ggacaatcaccgaaagctcatcagagttaccgctcctcctccgcagaggcaacaacaacaactgatcaatggcgtagtaatgtctcacaatcaacatttgcacgtgccgaacacggcaattggtgggaggacgacgacggtggacatggccataccccaacggcagcagttgtccgacagtgaagtgttgccggtgcatcatcattgtctttatcgaattgaccacccacaaattctttcttcgggcactgcgacagacttttcggtccttcagaatttcccggcggccaaacctcgcaatgccgtcaatttgaacaataacaacatgcaacaatttgtgccaacaacagaatcgttttcgtcgccttcctcgtcgtcggcgccaaacactgccattgagctgacattgatgaacggcgaattgtcgatggactcatccgctaccatttctcagtttcatccaattgtcttggacaattcgcccaccaagacactccccgaagatgtgcgaaatgcttatgagcagatgctcaaagagaat

SEQ ID NO: 90131 - DNA, 651 bp, Heterodera glycines
  SCN-specific regions: Sequence locations=1-651
cttctcctcctgcccaatgaaacggccaaaaagagacaattcccgtacaaaatcggcctccgtcgtcgacagtttctccttcaacggtcaacgtttgtcctgctccaactcgtcctcttcacctccgccgtttcattcggacgaagcagcgaacgatcgccaacaccgaagggcatcggcacaacagcagaagaagataacgaacaatgggacggcggatgtgatgaaaaaaatgccgaaaatgaacggcacaacgagcagaggatggacaagggagacggacagcagaagtaacgacaacaacaacaacgaggacgacgaaacggacaatgggacaacgacggaagaacaacagaccgggacggggacatacacaggcatgcgcgactcggccacttcgtcgtcgtcggcatgctctgcttcatcgacgcttcgtcgaccgttcgaccatcccaccaacctctttttgtgccaacaagcgctgaactcgtccaacaacttgacgctgaacggcatgcccacgaccaacaacgagctactgttcccctccgccacaactcctctcctgcaacaatacggcaccaccgcccaacttggcactgctcaattcggcatctccgcccaacttggcactgctcaattccgcatctc

SEQ ID NO: 90132 - DNA, 616 bp, Heterodera glycines
  SCN-specific regions: Sequence locations=1-163,185-616
aattaagcgaatttactaaatagaaatggatcttttcgacatttttgaacacataaacactaacgaagacgttcagtttctgcgtagttctggaaatgctggtgccttggcaccacagccgttggtccccaacactgtctattcattgtccgatctgtgttcggcattcagctctgccgcttctctttctgcccctcctatgggcatggcttctaactccgatgcttttgggctgcgttcgacaattctccccgcggctcctctctctgcccctcccgtgggcatcagtacgaactccgatgactttgggctgcgttcgacaattgtccccgcggctcctctctctgcccctcctatgggcatcagttcgaacatcgataacactggcgcaactcgcgaacgcaaccaccaatacttttttggccatgactttacgacggaatctttctcgagcaattccgggacgacgcgcataagaaaaccgcagccgctgaacttctcgttgaaagtctttttgggtggtattcctgctaatatgacgacgaatggtttggaattgaactttgcccgattcgggaagagtatcatcgactggccgaagaagacgggcaacaag

SEQ ID NO: 90133 - DNA, 544 bp, Heterodera glycines
  SCN-specific regions: Sequence locations=1-4,29-83,158-160,217 -259,329-330,378-413,443-476,498-513
cggaaacgagcgcttccgttgccctgaggcgttgttccagccatccttccacagcatggagtcggctggcatccacgagacgtcgtacaactccatcatgaagtgcgacattgacatccgcaaagacttgtacgcgaacacggtgctgtccggcggctcgaccatgtacccgggcattgcggaccgtatgcagaaggagatcaccgcgctggcgccgtccacgatgaagatcaaaatcattgcgccgccggagcgcaaatattcggtgtggatcggcggctccatcctcgcctcgctctccactttccagcagatgtggatcagcaaatccgagtacgacgagtcgggcccgtccattgtgcaccgcaagtgcttctgattgagcggcggtgatgtccgcagggaggcgaaagaaggaggaaaatgttggaggataaaatttgatttttttttttttttgctgttttggcatggcgtatttaatttaaaatgataatatatagaggcggatttaaaaaaaaaaaaaaaaaaaaaaaaaaaaaaa

SEQ ID NO: 90134 - DNA, 473 bp, Heterodera glycines
  SCN-specific regions: Sequence locations=1-473
cctagtttgaggtatacaacagttttcactcggatcggaccgctttggcatcttcctccatcgtttgtcgtaaacagtgtggactttgacggacctggtctttattttgagaaagatgtgttttctcccttcaaatagcactgtttttgggcgttccattggttttattcaccaattcggtcgtcgctttctcttcccacccattgcccaatgtgaacacgtggccggactcaaaatggacaaaatgcttcagctccaatgccgattttgttttttcactcgccgaaatggtcgttggatagtcgaatgcaccaaatttggaaggcacaggacaattttacgcgatttcaacgccgatctctattggtgatgtgagaggaaagactaaaaattattttcgaatgtggtcgaatttacaaataaaatttgttgtagaaacaaaccgaaagagaaacgatcgaattgtatgaaaa

SEQ ID NO: 90135 - DNA, 659 bp, Heterodera glycines
  SCN-specific regions: Sequence locations=1-266,320-369,391-440,470-659
gtttgtaagacaccaccaattaagagctattacaactgcacaattcgactatttgtttaaaaacgccattttaaacgccaaattttcgcggaaaagtgacggcactcattcacttttactcattcttcccacattcacttcacttcactcatccatttgacctgtgacctttgcgctgtgtgatggacgttgacggtgctgcgcaggatgagatggttacggatggtcccggttacattgccaactgtccgaccggcagcatggcccagcagagcagcaacaacggcggcgggagcagtacaagcagcagcagcggcggtgggaacggtgccggagggaacagtgcggtcggctcctcccaccagcagtaccggtccatgtcgccgctgagcggcctgggcatggcggccgcttcttcagcttctggcaccagcagcacgtcctcctcctcctcgtcgtcctcctcctcagtgattccgctggacattggcctgggcatgttgccgattgcggagaattggtgcaacacgcaggtcaaggtggtcaagtttaactacatgtggacgattaacaacttttctttttgtcgcgaggaaatgggcgaagttttgaagagttcgacgttcagtgccggcccgaacgacaagctgaagtggtgc

SEQ ID NO: 90136 - DNA, 476 bp, Heterodera glycines
  SCN-specific regions: Sequence locations=1-413,435-476
ataagatgaaattgggcatctgcataagctggggacgaactggcgggcgattgatggtgcctccgagcaatgagccaatccgaccattcactctgatttggaataagacggatggtttggttgcacttcttgggcaaaagttggaaaagggaacttgggttctcttcacactgtccactcggacggcctttttgcattctgtcgaccgaaaattggttgaccgcgtgtccatcacagaccaacgtcgtgagacagcagttgacagtatgaacattcaggtgatggcattcgttcgctccttccgacggtacaacgattattatcgcattggcatggaccaactgatcggatgggttttggtgtcggaggattcatttgtccgaagggtcgtcctccaagaaaacctcgctgctcaaatgtccatcatcttcaaacatgactgtgtgcgtggcttcaattgggtggccgtctcggtg

SEQ ID NO: 90137 - DNA, 829 bp, Heterodera glycines
  SCN-specific regions: Sequence locations=1-829
cagtctcagagtcagtaactgaatattaaaaatgaaagtggaaaagattaagacaaggagaggcaagaaatttcttgaggacagagcaccgaaattggtcgaaaatgacaaagtgacactttttgtgaagggaaagaaatgttcagtgatgctcaacaaaatacttggcgaactttaccaactgaagaagccattggccaatcgactgcaacgaaataatgacagccatccctttgaggatgattcgttattgtgcagattttctcacaaatttgacgcttctttatttgtcttcgggtccagcacaaagaaacggccgaattcattgctttttggcagaatgtacgaccatcaaatgttggatatggtcgaattgcaagtggagaattttgtctctagcgacgaatttaaacaagtcaaaagcgtaaccttggggtcgaagccatgcatcattttgcaaggtcacctttttgagtctaacggaatacttcaacggattggcaatttaatggtggatttgtttcgtggccccaaagtggagtacttacggcttcaaggcaccgaattgataatttcattgacagcagtttccgaagagcggattaaattcagagtttacagagcatccctaaagaaggacatggaatctgcgaccccaaaaatagaattggttgaaatgggaccgaatattgacttcaaaatcgacaggacgaaattggcaagcgattcgctcttcaaaactgcactcagaaaaccccaggaagttcagaaaagtgccaaaaagaacgtgaaatttgatgcattcggaaacaaagtggcacaagtgcac

SEQ ID NO: 90138 - DNA, 965 bp, Heterodera glycines
  SCN-specific regions: Sequence locations=1-615,638-965
aataagatgcgttctcatcagtttaatttacgccaactccgtaagcctttccgaaatgtcgcctcaactaacagtgaaggccttcgtcatcggaacagcatcgtcgggccaccgggagttccatggacatcgttggccttgttggcaacagcacctccaattgttgcgcctgaagatgacatcctgaacagtctttttgctcaggttggaggaatgccaactttgaaatccaccggcaccactgttgaacttgtgcggcgccgttccttttcttatggttcaaattgtgcaaaatgcggcaaaccattgcgaaggactccgaccaccaacgacaactcaaagttgctctactgcaaagactgcaacattatattcagcagttcttcttcgaatgacgcgtcgtccaagaaattcaacattttgaagaacggtcccatccaatcgccgccgtatccgaccgaaatttcggcatatttggacaaatatgtggttggccaacaacaggcaaaaaaggcgttgtctgtcggcatttaccagcattacaaacgcttggaaaacaatcagcgttttctgaatcagttttttgacaacaattttccaaatgtggcgtctgttcaacaacagcatcaccagcaacagtcgcaaatgcatcccaacataagcattcactacccattctcacacccgcacgacttggcaactgacttgctttgtgcgattgcacctcaatgacccaagcgggctatgtgggcgaagacgtagagtcagtgctgcaaaaattgctgcaaaatgcgcaagggaacgtggaaaaggcgcaacgtggcatcgtatttttggacgaaattgacaaaattgctgccactcgtgaggcgatcagtcacgcgtacagagacgtgagcggagagggcgtccagcacgctttgctaaaaatggtcgaaggcgctgtcgtaaatgtgaagacagga

SEQ ID NO: 90139 - DNA, 577 bp, Heterodera glycines
  SCN-specific regions: Sequence locations=1-43,65-577
gaatttcatatctctgaattaacctcggcaatgcattctctcgcctttatttccttcgctttttgcctttcactaacggacgcttttcgtactcaatcgtccggcgtccgggggacacttctctgtggaggaaaagcactcgcggacacaaaagtgaaactttacgaccacgacaaagggccggacgcggacgatttgatggggacgacgacaacggacgagcagggacgattccaagtcagcggaaagaccaccgaactgaccaccatcgacgtccaactccgcatttaccacgactgcgatgatggcatgatgccttgccaacgcaaggtgaccttcaacatccccgattcgtacgtcacgtcgggtgcggtgccggcgaaattctttgacattggcacagtgaacatgcaaatcatattcgaccacgaagagcgatcatgcattcattaattgacagatctttatttttttattgaacaatgaatgatttgtgagttattctgctaaagagtccgttcttcggtctttgggcctttgcctcagaatcaaatttctgtttggaaaaaaaaaaaaa

SEQ ID NO: 90140 - DNA, 593 bp, Heterodera glycines
  SCN-specific regions: Sequence locations=1-593
aatactcacttttcaaacgggtctcaacgccgccggcagaacacaaattctgaacagcgactcttctcttccttcgactttttcttccgtcctttcaattgcattgagcgatttgcacgtccgaatgcaaaatgtgcaagaagaccaagtccgagccttgctgcaagaaacaagtggtggagctgcgcaatgacattgccaccaacggatgcatcgccgggggcatcgaatgctgcgatttgacggcgcacactgtgcagcgaagaccccaaacgactggccaactgtttctggaggagctgtacttcgtcaagcacgtcgacaacaattcactcgctgattctccccgcgagcgtgaaattctggccgaatatcgcaatttgctgtactccatcattctgaatggacttcgccaatggagcaagtcgggcgtactggcacaaatcacgaacggagaacagttcgaacacgcgctgaaattgttggagggaaaggagggcattccgacggtggcggacgaagagcgaaagaggaaatttttggatgactcaaagtgttcgttggtcaatgcgttggacgaacttttcaacctt

SEQ ID NO: 90141 - DNA, 613 bp, Heterodera glycines
  SCN-specific regions: Sequence locations=1-613
tattaattaacgacgccatcacaatgtgatgatgacccattaggaccacatcgaaagtttcattcatttcgttcgttcgatttccatggaatgccctccgggttcttcgttcgacccttccccgtctccgtctgtcgcttctcagccgttttccgaggaatgccattccccggacaaccaaatttctcttgataattctgtgcctgaggaaagtccgaatggaaatgccaacgtttgcatgggcgaggcaaagccccgctgggggccgacccatgccggggccaaacagttggcatcgatgtacggcaaagggaaacgactccaagaagtcacttgcatttgcgttgcgtcagccctttttctgtcggtcggctgctccctcctttaccactttcggcttgtccccgtcggtcagctcattttggcatccctcccccgtgtgctgatggccgatttcaactcgggcgtcgtccattggggcgcggatacgtggggaaccgtggacactttcgtcggaaggaattacaatcgttcgtttcgtgaacaccacgttgactcgacagcgatcactcggcatgatttagtggaagtgaatggagacaattttatgctg

SEQ ID NO: 90142 - DNA, 435 bp, Heterodera glycines
  SCN-specific regions: Sequence locations=1-435
atgtcggcagttaaaggacgacgtgagcaggacagaaaggaatgggcagcctattggaatattcgatggaaggaggtggaggtgcgatggatggaagtgcttatatcgacatggaatcttggtcaaatgtattgtcagcatgtggcgtggacaaccatgaaatgcgtgaaagataccaccaagttcgacttcgctcgcgtagccaaaatggaaagtacacgtacacacttacgacccgaacctttgaagacgctgatggcaagaaacttccccaaccggttgaaacacggaagcagttggacaggcgcgagtatcagagctacttgaaacttcgtgacagaagccgtcaatcaattcacaagaaacgtgtgtgttttgttctttttactatttcataaggtctaatttttaattgtaaccgtttaatcgattttg

SEQ ID NO: 90143 - DNA, 971 bp, Heterodera glycines
  SCN-specific regions: Sequence locations=1-456,479-618,641-971
taaagtttttcgttcccaaaaatggactcgcaactctctgctgctgagacttctgtcgactccgtatgccatcaattggtgctccgttcggctaattggcaaatttcgcccaaattggagcagagcatttactggaacgttgaccgaatttttgtggacctcaattggagccagaacagatcctgcccaaaccccgaagtgatccaagtgcaacacacgccaatgcccagcaaagagaaagcaatcgaataccttcgtcatatcctcgacaattcgtttcgcatccgtcgtttggacctgaacatccaagtctcaaccgaattggtggtcaatgacattttggacgttttgaatggccatgctaaagtacaacttgaagaactgttcgtccgacgtcgttatgtgggcagcaaattctccggtctcgtgccgctcattcggtcgaatgccaaaacgttgaaacaaattggcaaaattggtttgggcgaggctatcaaagcactcagtgacgagatccacctcgaacgtctctcgttaatcaacttcgacctggtcgaacaagaccagcgtttggacagcgaagaattggcccaaaactcgcgcttttacattcgtcggttggctggcattggcaccacctttgaccacttgtcctacacttgtttcaccggtttcgagatcaccaaaatgccagccctcaacatgctccgtcagtgcaaggtcaaaagtcttcgtctgacgatgcaaagcggcgtggccatcaaagacccggaactccctcgcccgctgttgccgatgatgcagcgaattcaattggtcggcggaatggacgcgtcgtcggagagactgtcgttgctgtttcccgccctggaggagctcgaaattgaaaagcaggacctgatcactggccaccgattggaaaagcgagcgcgcgtcctctccaattacgcgcccgactttgtcggtgacgc

SEQ ID NO: 90144 - DNA, 531 bp, Heterodera glycines
  SCN-specific regions: Sequence locations=1-23,103-531
aaagggccgaaatcgcaaaaaaatgaaactgaaaagccgccccagcagaagcagcctcaagaaaagccgggggcgcaacaggacgacacggagacggaggaggacagcaaagaagacaagcggaagccgataaagtgtcaggaggagaggaaatgctacgcacactcggagtgtggcgcaaggagcaaatgcaaaccggcgacgctggacaggaagaagaaggtgggcacgtgcgactgcggcgtgtgcgggggattccaactgttattgctgtgcagtctcaacagtggcgccctttcccttgacaaaaacattgtgccgcgggagtgtgccggactgaaagatgcttgtgtcgaaaagccattattcgtgggcagcaaatccaaaaagtgcgactgcgaagtgggcttccaaaaggcgggctttaagaatctgagggatggacagaagaaagtgtgcaacaagcagaaatgtgatggcaaaaaagacacgtgctttggcatgaattgctacggcggaaaatgcagatgt

SEQ ID NO: 90145 - DNA, 491 bp, Heterodera glycines
  SCN-specific regions: Sequence locations=1-491
agtggtttgcactctatagtcttgcagtgcaacagtagacgtagaaaagaagcacgtcgcttgatgttcgcacccacatttgtgacgtgaggctgactcgccctcgattcaagttgggacgaaagcctatgaaccgagtctaagctcggcagagaccactagtgcaatgtagccattcactgataacaggatacatttgaagcacaaaggccgactggaccatcatcaccattgcatcggcagcatcttgtctctttggacccgcacatccgtcattgtgattctcgtgacatccctcccgctctctggctacctgttggttgtgtcatgcattcacttgtacaagtctggctcgcgatactttgcaagcagcggaggcacatccaccccggcatcgtcgctcgctggcggctcgtcgactggcgacgccttgattcccatggtcgtagcaggcgcgcaagtcttgggcagcatcggaaacttcatcaacc

SEQ ID NO: 90146 - DNA, 693 bp, Heterodera glycines
  SCN-specific regions: Sequence locations=1-124,165-450,545-693
atttctcaaagcgtatcagccgctacaaatattttaaaaggcctccgacaagcaagcaacaaattcgtcacccaacacacaccaccaacgatgagaagcgtcaacacaacaccgttccgtcgccgacctcttccgcttcgcattgtgtcgtccgtgctggtgctgctgctctgtacgctcgatgtgtcactggcagcggagaagaacggcgccagcccgcctatatataatacgctcaccttcattttgctcgttccgctagtcatcgtcatctgcgcgttcatctacctcctgttcatgaagccaaagaatgcggaaggcgacgaagaagacgaagaaggcaaaggaggagctgacggcgatgtcgagaagggagcggacgacgataaaaaggagactccaccttctgctgctggagacgtcgtggcggtgccatcggaacgcgtggttgatgagcagcaaaaggaggacgagggtggcgacaaagctgaagaggagaagaaggaggagggcgggtcggcagcggaagagaagaaagaggaggcagccgcggagaccggcggagagaagtcggcgaccacggaagagacgactgaggaaacgacggaaacgaccgacgaaacttctggaacccctgagacttccgaaagcggctccggctcggcatcgtcatctgcctctggctcgggatcg

SEQ ID NO: 90147 - DNA, 510 bp, Heterodera glycines
  SCN-specific regions: Sequence locations=1-19,41-510
caattaagatttattttagcttaatttttcttcctaaaatggacatcgatgaattgaaaaaaatgagtcctgagcagcaaaacaagcttctcgaggatgttcgtcgtcaatccgacacccaatcggttctgtctttgttggcctccttctctgaaaaatgttcccaacggtgtatcacaagtccgggcaacactttgagcggaggtgaaaaacagtgtttgcaacgatgcgtggacagatggcttgacagcttcagcattgtttcaactgcttttgctgccaaggcccaacagatggccggcatgggcagttttggctcgccagacggagggccgtctttttcatgagggtggacagctcattgatcgttgggaatttgattttgttgtttttcgcttgtttgatcttttagtggtttctttttgaaaacagcatcgactcgttgagcaatattttcaattttaatattagctcaaaatgccagacacagataaaaatttgtcaacaaaa

SEQ ID NO: 90148 - DNA, 109 bp, Heterodera glycines
  SCN-specific regions: Sequence locations=1-62,84-109
caagacttggatttatggaaaacgtccgaaaatccattccggtaaatgttggaacttattttctccctttctttcattttcttacaattagcataaaagagtgtatacc

SEQ ID NO: 90149 - DNA, 569 bp, Heterodera glycines
  SCN-specific regions: Sequence locations=1-14,36-81,103-142,165 -421,443-569
gtccatttaagcagtttatttatattttttttttacaaatttcgtggtgccatggcgtttcaacggatttaatgcaaatcgacgaacaacaacagcagcaaatggctgctgccaatgagtgctgcttcatatatccgttcccggcttctgggctgtcctcccgccaactgatgcgtgtcctctccgcttggctgatgccgtctttctccgccgacgaggagggcccgtcgatgaacgtgccctcctgcttttccgatattgactcctcgtttgaatgcgcttcattttctgtacccatggtcttctcccacgacgaatggtttgtccaatgtgtgcccgccctgggcgaacagcttgacaaacttttgctcctgtcccaacaccagcgggatagaggaaggaaactcatgcctccaacaacgacggaatacggacgacgacggggagtgtcatgtgcgacgggtgctgcgccatttgctcgcgttgaccacccgaattccgatgcggacacagcccaggaccgaaatgcgactgttcattgcggttttcggcactttgctccgctggtc

SEQ ID NO: 90150 - DNA, 581 bp, Heterodera glycines
  SCN-specific regions: Sequence locations=1-1,23-581
gcttcttcttcttcttcatgtatgtggaacggcaattcgttcgaattgtcgcggtcattacaatgggaggcagttccctgcgttccatccgtcgcattagctctttttatccatccctttccgtcaaccgaccacaacgcttttcatacgttgtacaaatgtcgtccgactcgaacaatgttcggcatggcgttgcgctcctttgttggcattgtggcggagattcaatgacaccgtccgacgacaacgccggcactgtccttttgtgctcgcgttgcggccgcctgcagccgttgcccgcgcgcatcgactttttctcctattttggcttggatgaccccgcaggcgcaacaattggcgaggcggagctgaagcgacgtttccggcgcatgcagtcgctggtccatcccgacaaatttgccggacgggacgaaaacgagcgcgctttggctgaacaacactccgctttcctcaacaacgcttaccgcacactccgcgagcccttcgcccgtgcggaatatttgctgactttgctggagacgcttaaaaatgacgatggtacgtcccctggcactgcttcg

SEQ ID NO: 90151 - DNA, 656 bp, Heterodera glycines
  SCN-specific regions: Sequence locations=1-121,143-318,340-517,540-656
ggtggattccttaatagtaacttctcttgtatttgacatcgattcattcgctagaaaattttcggccgaacaaagtgacttcactctaagtcgcttttcagaaatttttatggaaatggaactttcaagcatatttcttggtcgcttttctttttctgacttggttgagttttctgaaaatctgttcatctattgctcacgttttatgttcaccccattttcgagcactggttctgttggaaatggtgatcagattcatttcaactcagatggaatgtcatccggtagaattgcggaccgaaactacaaacaacgattatttggactttttctgtgctacagtttgtactttcttcaaccttcgcaatacgttgttccgatttctgttacttcttctcagttggatgatttctatgaatttactagctccgttcttttacctgaagagaatttcgaggctctttattgtttttaccgtcttctcaacgcaaacgcattctcaattgcccctgttttgggaaatttcaatccgcttctccaagggaccttccacccgaccctcctcgacaaatcttcgtctgaatcgagtggtatcgaactcgtccaagattttggattacttttttctctgagtaatagtgaagtgttgaagcaat

SEQ ID NO: 90152 - DNA, 700 bp, Heterodera glycines
  SCN-specific regions: Sequence locations=1-316,338-700
cccaattaaaccgagcaaatttcaaatttaaaaaatgtttctgaaaaggagaatctccgagcctagcgacgaagatgaaaaacaacggacaaatcaaattcctatcgataacaattcatgtgttgacggtattccgctgaacatccaatcattacgaaaaacttatgtggacagagaagagccatttttactggaaaaggacatgctttcctgtccatttgaccaattctctatttggttcggaaatgcgatcacgcaaaccgacctcaaatacgaagaagtgaatggctttgctttgtcaactgtctcgaggaatggaaggccaagttcgagaatgctattgctcaaaggtttcagtaaggttggtggtttcgtgttcttcactcactcaaacagcaaaaaggggaaggaattgagtgagaatccgtacgtctccgcactgttttattggccaaaggtaaaccgccaaattcgaattgagggtcgagtggaaattctcggggaagaagtggccgacgtttactggtcaaaacggccaattgagtcccgaattggttcaaagttgagtgatcagagttcggtaattccaaaccgagagcatttgacacgaaaacaacgtgagctggaagaactttgctcagtcaatggagaagaggcaattacgaggccaagtgattggttgagttattctcttccaccg

SEQ ID NO: 90153 - DNA, 670 bp, Heterodera glycines
  SCN-specific regions: Sequence locations=1-6,28-427,449-670
ataaggttcttttttaacagaaataaataaattttcgtcttattcaatggctcagtcacagaatggtggtgtcaaaaaccgtcggatttcacttggttcgcctaaggacctgaaggaagtgcacttttttgaggaagatgaagtccccgatgtgccgttaaatggtgcaagagtcaaagtttgctatgccggagtttgtctaactgacaaagaaatcagtaacacgaaacaagcacgtataactcacggcgttaaggacaccagtctttttccaggctacgaagtttccggagtgatcgatgagtttgggcccaatgcaactccggttgagtacaatttgaaagtcggcgacaaagtcattgtatggcccactgaagagatgtgccaaaatggctatgctgactttgtggcagtgccaaatttgtcgcttcttgtcaagattcccgacactttgtcaatgcatgtcgcgtcgattcttccggccggcgcaacttgggcactctctgcgattgtccatgcccgtcctgtcgttgaggccatcgccagcacaaaaggatgttgcaacattttaattgttggcgctggtggacttggactttggattctgacattggccaaacattttcttaccgcgggtcaggagaaccgaatcaaactgattggtgctgac

SEQ ID NO: 90154 - DNA, 592 bp, Heterodera glycines
  SCN-specific regions: Sequence locations=1-3,25-137,160-232,257 -531,574-592
tcctaattaaaaataacatgtaaaaatggcagcaaaggaactgttccttgctcagcagcccgacctgttcaagccgattcaatccatcaatgccgtgctcatactgatctgtctcggctcctccaccgccgtgccgggcattggcgtcctttggttcatcggcctttgctctctgatcgtctcagtcaccgccacggaatttgtctattcgtctgtcctcacgctgctctgcggggtgggcttttggctttcattcggcttcgcctcccacgtgccggacaatggccattcggccggctatattttcgcggggattttcctggtggcccaagtggcctgctatgccatccctgtgctgatcatttacgatcggagccgaacggacggtccggcagccgccggacacgaacaaatcgccaacgtacatccgtttggggtcaccacggacggatgtgagcagcactaccagtcaatgcaacatgaacgtcccattgtctgacattgccaaagttccgttcgcattgactcctcccattttttggcccaatttcaccattttttgtttattaattattaaacagtaattgcaaaa

SEQ ID NO: 90155 - DNA, 640 bp, Heterodera glycines
  SCN-specific regions: Sequence locations=1-179,203-273,295-640
caatggtaaagcttcagcgaattccagcggaatttggcattgagtgcaatgtttacggaaaatgcgaatttttcaatgccggcggttcggtgaaggaccgaattgcgctgaggatgttggaaatagcggagcaaagcggcagactgcgtgccgggatgacagtgattgagcccacctcgggcaacacgggcattggccttgctttggcatgtgccgtcaaaggatatcactgtgttattgtgatgccggagagaatgagccgagagaaggagctgacgctgaaggcactcggggcaaagattgtgcgcaccaaagacaaagcgcggtacgacagcgaacaatcgcacatcggcatggcgttcaaattgagaaaggaaacgcccaattcggtggtgttggaccagtacaaaaacatcgccaaccctttgacacacttcgaaggcaccgcggcagagattctggacgcgttggatggcaaagtggacatggtcgtcgtcggagtcggcactggcggtaccatcacgggcatctctcgcagaatcaaaaaggccaacccgaactgcataatcgttggcgtcgaccccatcgggtccatcctcggcggagaggacgaacacgcaggacataagtacaatgtgga

SEQ ID NO: 90156 - DNA, 1115 bp, Heterodera glycines
  SCN-specific regions: Sequence locations=1-37,60-127,150-155,177 -486,508-1115
ttgaaatgaccaaaaaaacagcggaaacagtggtagcaaaaaaggaaacaaagccaaaagaactgaacgaaatgcaactgcaaaggctcaatctgatcaaaaagatcaaagagaagaaagcggtggcaaaagagaagagggagagggagcggaacgaaaaacaaatgcaaagactcgaatttattcgacgaatgaccgaactgcgccatttgaatccgttggcttccccatcgcgtgggcctttcctctacgaaggcgactatttctaccgcgaaattttagtcggtcgatcagattcaaatgccaacaatggtgaagcggaggtcgattgtgtcagtgttagtgcccccggaggttttgatgaattattcgtcacaaacccagccgaaaatagtgccatttcgataagcaaaatgatttgtggaagaaagaaggctttgaacaacaaggaagaggatggagggacttattcagaagaaagtttcaaaaaccttggtgttgaagcccgcgaatttcttggcagtttcctcaaattcatcgatgaccagcgtctcgttgacttggcaacccaaggagtcactggtggtgcgtcaatgtttcacagtttgacgatgaaaaacgccaactgtctgcgagagtctttacggctttattgtaaatccggccaagcgcttcttgtgcaagttcatttttggctgttaaagcatttgagtcaaactcgactgacttcgtacttaaatctgttacgcttccttaaaaacgcgggcagcaatctcagcgattacattgcctcttctccaaccgctgaagccgaactcgaaaaggcgaacaaaaccatttcggaattcattgcgcaaaaactgtacgaacctccgttgagttcgtcttccaaatttatcgaatgcgatccgatcaaaaacgtgagtttggtgctcgtctatccgcaaatcaatgccaagatgagtcaacatacaatccgtgcccacgagaccctatttaggaatctcttgccgcttgctgtttgctgtgtcgagaaggttgagcttaacttgaacgtcgaccggcccatcagtgtggaggagtgcgcttggatgtgcattcagatgattcggcag

SEQ ID NO: 90157 - DNA, 465 bp, Heterodera glycines
  SCN-specific regions: Sequence locations=1-20,50-339,361-368,436-465
tggtgatggcagctgtgatcatttccatgggcttcagtgtggacattccggcacacgtctcctaccatttccacatcgcaaaatggacagaagatgggcaacgacagcggacaattgaggaacgaattcgaatgtcattcgcttctgtcggctttcccgctgtacaagcatcaacatgtacaaacatttgcattctttgtctactcgtcgtccctgtctatccggcacaagtttttgtgcgaatcctttgcacatgcatcacactttgtacaatccattcactgtgccttctgccggcgttgttcaatttgttgggcactttggaagcatttctaagctcaaaatttgcataaaaatattctcatcacatttttttataaataaatatttctatttaattaaatttgtcaatattttatttttttgttattttttgagcttttttaaggaataaagaatttgaat

SEQ ID NO: 90158 - DNA, 687 bp, Heterodera glycines
  SCN-specific regions: Sequence locations=1-687
atttaagcttttccttctcccccaattaattccgttcgctttctccgctttttctctccgatgacttccccctttcactccctcgtggagtctcagcgggaattctttcggacgggcaaaaccgccgaattggcacatcggaggcagcagctgaagaaactgcgcaagacaatcctcgacaacagcgaatttctctgcgaagccgtgcaaaaggacctgaaaagggacgcgaaactgaattatccgctcgaaatttcgtctgtgatcattgaaattgaatatgtactcgacaatttggagcgatggacggcgcctttaaatgtcgaaaagactttcaccacacttctcgactccccgcaaatcgttcgcgagccgaagggcgtcgttttgctcattggtccatggaattaccccctcaacactttgctaatgcctttggtcgacgttttagccgctgggaatactgccattttgaaaccgtccgaagtcgcgtcgaacaccgccgccgccgttgacgaaattatttcgaaggcatttgaccggaattatttggcagtggtgcagggcggcgttgaacagaccggcgaattgctgaaggaaaagttcgaccacattgtgttcaccgggtcagcgctggtcgcccgccacatttccagggcggccgcggaacatttgacgccctgcact

SEQ ID NO: 90159 - DNA, 1078 bp, Heterodera glycines
  SCN-specific regions: Sequence locations=1-265,288-318,340-465,488 -644,678-694,716-986,1008-1078
ctgctcctttcgcttgccgccctttggcttttcccccgccaccaaatgcggctcctctgggcattgtccgcgcttttcgtgtgcagcatccttttctgtttggcagtttctcttttgttcggcactcctccgacgctgatcccccatctgatgaatcagtcttcgttccaaccctttgccgaccttttgttcctgaaccccgtcgcccgtgctggccccttcctcgtcgctctgttcgtctccctttggctgctgccccgtctcgcccatcagaagcatcttctccgcgtcccccccccccccatttttgtccccaattttccctcttctctccctttttaggctttgtgtccccttggctccctccttctcatccttttgctcgccctgctcctttggtgtccccattggctttggtccgtccctccctatgcttcatcttcccattcgtccgttccttcgccttttttccccgccctttacgccgcctttcatcgcaccgcctgggcaactttgctgcttctgttggccattcttttggatgcctccaggggaaacgcattgaactccttcttctgctggcgctgcttccaccccctctctaagctggtgtttcccgttcttctgctctccgagcccatcgctctgtccctcttctcctctcttcatcgtcccgtccattcgacgcctctttccaccgtgctcgcttggatcggaatcctcgtctgttctctgatcgtcgctttgctaattgacaccgctctgacccgtccaatccgttggatttgtggcgcaagggaggaaacgaacgacgctgtgaacaccagcagcagcaatcgaatgaaaaacggaaggatgatcatggaaatggaaggggaggggaagaaacggacgttgggatgatataagcagagggtagaggagtgatcagaaggactgatcagacagacggaccaatcacttggccaacaaacgatcactcgaattaagccattaataattaataatccgaccaattaattaaattagcatgttgtgtataagaattagcagtctttacgcatttacttcacagaaa

SEQ ID NO: 90160 - DNA, 1046 bp, Heterodera glycines
  SCN-specific regions: Sequence locations=1-124,149-356,381-1046
gtttgaccaactccttcgtggaggcactgcggctggccggttcattcatcccgtcatctccatgggcgcccaggccgcgtgtcgtccagtgtaccagggccaagaaccgtcgctgaattgccaaaatcttttcttgaacaacatcatcttacggtggcgttcaaagttctaaaggttcaccgctcggccattcatttggccatctgttccaacccgatcaagccaattaagctgtactggcagtggaatgagcgcgttatgggggtgtactggcgacagggtaaccggaaaaaaaggctatgcctgagatcagtcaaatgtgcgaccggggcaatgtgacggtggagaaatcgcagcttttatttgttctatttgttgccttcaacctttgcctatggcttcaacatcgactgtcaatgaaaagcgagcaagatggaaacaggattataaatgccgaaaaatgggccgtctccattgtgagatgcgttcattggtccgtacgcgcaataattttgaggttgaacgcatcaaactcacttgtgagcaaccacttgcccaatcagtcgccgatgcagtgaaagaaagcgaggagcttgtcaatgtggaacagaagccgaaaaaaattccaatatggaggaggaaggattctgaactcttttcaaggccttgcacctttttggaggacacccgcttttatttgctctccaagcggcaaccaatccccgccgcattacgccgcaatggacttacatcgaaagctattgatgccattgtgaaggatttgttcggcaaagcaaaaagtggtgaagcaaagtcgccctcccccatggaccataagccattttctgccaaatcgtccacgaatgccaacaccgccgccaaaacacccgccacggtgggcaagcgcttgcgcaaggcccgtttgcggaaattgcagtccgccaatccgtcaacatccgccgcaaaattgttggtgtctttggagccgttgaatcgcaaagttccgcctcagcttcggcagtgcaattttacgcccaattatgcag

SEQ ID NO: 90161 - DNA, 644 bp, Heterodera glycines
  misc_feature (629)..(629): n is a, c, g, or t
  SCN-specific regions: Sequence locations=1-644
ttttttttaaatgcatataattaacaactcaatttggctcaaatttctcatcaccgcatttctgttcaaaattgcttgctctaaatttggttcaagtgaaaataaaggcttctttttttattttggttatggtagcaacttgcttgaagaacgtatccatgtacaggtaaaaggtgctacttttgtggcaattggagcgctgaagggttacaggctggcatttgttgatttcgaagaaccgaatcgttggcacagtgcagccgcaacaattgagcagaagcaaggctcacttgtttggggatgcatttggaaagtgccaaattcatttgcggacgaactggacaaacaggagaccaaatacaagcgaattgatgttactgtttttccacgcccaagtacaaatgaacgtttcaatttaaatatgcgattgttttcaaattttgttataaaatgccgtacctatcaatatgagaggcccgacatgaaatatggtctaccatctcctcaatataaacacgtgatcgtgaccggtgcagaggaacacggactgcccaccaaactacattcagtggttgcgcgaaaattttgaggacaatggctatgacgggcctgtggaattgaatctgaangcacttgagacaatg

SEQ ID NO: 90162 - DNA, 906 bp, Heterodera glycines
  SCN-specific regions: Sequence locations=1-906
catcagttgaataaagaacagtggtcagagtcgttttcgtacggccttttccgtatggaatttgttcggaccgggacaaatggcgatatggatcaaggtcacagattaggacgacctgctcattgtcagttaccgtgtacaaaaatagcattcaacgtgaaatgctaattaaaaatggcaaataccggtcagtctccaaactcaaaattatttaatgcggactaaatcgatgaaaatagaatttggggcgcgcttgcccttttttaggctgaaaaagtgccgggactgaagtgtccaaatccagccgttacggtaggggtcaactccgtctggccaactccgtctcagcaatgttcaaaaagctataacttttttctttgttggccaaacttcacaatcatggtatcattcgaaagccctagatgtttagaagatatttataagctatttctcagtgattaatcagctctcaaaaaagttgtcagttgaaaaccgcaaaaaaggcagaattttcaaagttttttatttctatctttttttatagttcgaaattttctgtaatttccagtaggctaatagagcctgtgaagagctttcgaatgatatcaagattgtttgattcggtcaataacttcaagagttatattgactcaaagttggcgggacggagttggcccgttccgcgttccgccgtgttagtgtttcaaattttccaaagatttctatttttttaattttgtcattttctttcccctagactcccatcacttttccgtattcccaaattttccatttttttaaatttccccctttggctcccttcactttgccatttttttccataattttcatatttttttcattatttttctcttttagactctctccgttcccttcgcttcttct

SEQ ID NO: 90163 - DNA, 624 bp, Heterodera glycines
  SCN-specific regions: Sequence locations=1-90,112-525,547-624
caatcgtcttcgcgctcttttaggccctctgatgacacggattcgcggggaagctgttcgtcacttttgatctgcttttcctattgttcttcaatcatatgtttcccttgcgccatttgtctttccatccgggtcattcagcagtatgagcgcgctgtgattttccgtcttgggaaagtgatgcgcgaggcggcagggcccggtctgatcttcattttgccatgcattgatgatttccgttgcattgatatgcgcacgacttccttcgacgttccgccgcaagaagttctgtccaaagactccgtctccgtcactgtggacgcagtgatttatttccgcgtgttcgatgccaacaaagctgtcgtcaatgttgagaatgcgacgatgtcaacacagcttttgggacagacgacgcttcgcaacattttgggcaccaaaactttgtccgaattgcttagcaaaagggaccagatcaatttcgaaatgcagcaagtgttggacaaactcaccgacgcttggggcgtaaaagttgagcgcgtcgatgtgaaggacgttcgcctgcccaaagatatgcaacgttcgatggccgcgtaagcggaggcggcgcgcgaagcgagggcaaag

SEQ ID NO: 90164 - DNA, 836 bp, Heterodera glycines
  SCN-specific regions: Sequence locations=1-836
ctttagtatttttcttttgaaatcgtataatggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcaccaccaccagtgaaaagggaacgtactccggaaccaccgccacgccgactttgtgttcgaaatctaagcagaaatatcacaaaagcgcacatggaggaaatcttcgctctgtttggggctctaaagtcctgtgagttgccaatggaccgtgtgcatgtgcatttgccccggggatacggctatgtggagtatgaaaaggcggaggatgcggagaaggctctgaaacatatggacggaggtcaaattgacggactggaaattcagtgcgaaatgacttttccttttaaagggaccggcggaggtcgtggtcattcgcccgtcgggattaattctatgggcattgggatcaagcgcgagcggagccgttcccctgcgcgtcgttttgccgctcgtttgtcgcctccgcgtcgcggccgtcgctcgcgctcgccgactccgatg

SEQ ID NO: 90165 - DNA, 657 bp, Heterodera glycines
  SCN-specific regions: Sequence locations=1-557,579-657
gccaagtttgagcccacaaatctgctgactaattccctactcattcactccgttccaaaatgccgaccactgtcgtgcgcacaacaaccactcggacgactggtggtggtgtacaccaccactccatcagaatggtgccgatttggtcgattaagctgatcactgcagttttggcccttctgatgctgatcctcatcttcttcctgcacacggccatttggcaatattacgtggtcactttcatcgacctcgtgctcacttgcggctttctgctcggctgggcccttccgccggtgctcaatcgtttcctcaccttttaccgatcggaccaaatttcgtattcgatcatcgccggactgaccattctctcgttgattctctgcgccgcttatttgattcacaacgattactacaaacacggggacaactacaaaatcatggtcggcgtcaccatttgtatgaccgtggagaccttgatgtgttgtgtgttgctttcgtggatatgtttcggtaattacacaatcgtcgaaacacgctaaacgacctaaggacaaaaagagaaaatgttctgaaaattttccaaagccccgtgcactttatgaaccaaactttttatcataactaggcggggaaagccgccttcgcccaatccacgga

SEQ ID NO: 90166 - DNA, 772 bp, Heterodera glycines
  SCN-specific regions: Sequence locations=1-29,70-352,374-772
caccgccggagcccaaccgcagcaagtggtacaacaacaccacaccaaacagcagcagcagcggttgtttcaacagcaacagcaaatcagaggcaaacaaaaataaaataaggaggagaagtccacgccaattggctcgactgggcaaaatcggcctgttttccattttttaccaaatgtccatgtaatttgagtttgatccgtaagtttagtgctgggccatcaagtgatgaacaataacgatatgcagctgctcatgaatcggttcaaggaggccagtcaacgggggagcaacgacgaggtggaaagatttttctcggacttgcgcaagacgccccacatgttcaacgcgtttttgaagctgaccaaaaaacagggcgtctgtatatcaggcgatccgtttcctcatcaacatcaaccgcaaggaggtgctgcaacacaaccgcagcaacagcactttgtgcagccgcagtcgtccttctaccagccgaaccaaccgcagcagaacggtggcaacattccatcgtcacagtttggcgggcccttccaacagcaaatgccgtcccacggcgccggaacggcgcaatggatgcaacccccgaaccaatcgcagcaacagtccgccgcctcccaacggaattcgtcctgacaaatgagcaataactgtttgatggatgaagcaaataaatgttttggcggatgtccaacgacgaaatgatctgattgtgagcagctgatttagttttgtttttttgtgtttcgaattatccca

SEQ ID NO: 90167 - DNA, 883 bp, Heterodera glycines
  SCN-specific regions: Sequence locations=1-883
attttgttcagtttagttggagatgaagcgagttacggctgatcaaaataaacaatcaaaatggcagtgatcagcgtaaatttgaattagcgcgaatttcatttttttcatacgtattatatatatgttatataggttttgagtttcgtttcaaaaaacaaaatctcccggccgaagtgaaaatgacaaatgtactcaattctccgatgctcgaagggattaaggacagcggacgacattttgtatcggggggaattgcaggtatggccgaggtttgtttcgcacatcctttcgactgtatgaaaacgcgattgcaaatcggccaattccatggcattctcgattgtgcgcgccgtacgctgcttaatgaaggcccatcaggtttttacaaaggccttttgccaccgcttgtcatcgaaacgccaaaacgtgcccttaaattcatggcttttgaccgctattggcgtgttctccgttcggatgcgcttcccacttggctggtgattgaatcattattccatgtccggactgttcaccggtctcactgaagctgtgctcgtttgtcccttcgaagtggtcaaagtgcgactccaatcggagctgaacacgcccttctttcaacaaaaaagttcagctaccgtcgcccgtgaaattgttcattcgaatggttggggcactgagggcctttaccgtggcattggtgctaacctttggaggcacggcgtgtggaactcgtgttacttcggaatttaccataatttgaggcttttcctttgctccatcccttcaaaaaattctcagtcctccgccgatcgtttggaaacggccagcttgaccatgcgtcttacgatcgcctcactctccgcaattgtggccaatttgg

SEQ ID NO: 90168 - DNA, 603 bp, Heterodera glycines
  SCN-specific regions: Sequence locations=41-89,284-363,429-430,455 -512,578-603
ctgaaacgcccggaccgcctggacccagcactgaaacaccaggacccgaatcaagcacatcaacaccatctgagggaccaggaactccgagcactgaaacacccggaccgcctggacccagcactgagacacccggaccgcctggacccagcactgaaacacccggaccgcctggacccagcactgaaacacctggaccgcctggacccagcactgaaacgcccggaccgcctggacccagcactgaaacacctggaccgcctggacccagcactgaaacaccaggacccgaatcaagcacatcaacaccatctgagggaccaggaactccgagcactgagacacccggacccagcactgaagcgcctggacccagcactgagacacccggaccgcctggacccagcactgaaacacccggaccgccttgacccagcactgaaacacccggacccgaatcaagcacatcaacaccatctgagggaccaggaactccgagcactgaaacaccaggaccgcctggacccagcactgaaacacccggaccgcctggacccagcactgaaacacccggacccgaatcaagcacatcaacaccatctg

SEQ ID NO: 90169 - DNA, 593 bp, Heterodera glycines
  SCN-specific regions: Sequence locations=1-31,53-214,236-265,295 -299,322-535,558-558
tttgccaagacgtattaccaaggaaacgcaacgtctgctgcaggatcctgtccccggtatttcagcagttcctgatgaggccaatgcacggtactttcatgtgataatcgcgggtccggacgagtcgccatttgccgggggcgtgtttaagttggaattgtttctgccggaggagtatccaatggctgcaccgaaagttcgttttatgacaaagatttatcatccaaacattgacaaacttgggcgaatttgtcttgacatactcaaagataaatggtcaccagctttgcaaattcgcaccgttcttctctccattcaggcgcttctgtctgctccgaacccggacgacccgttggcaactgatgtggcagaacagtggaaaaacagcgaaacagaagcgattcaaactgcaaaacagtggacccgattgtatgcgcatgcctgattactgtgtgagttggtgaggacttggcttggctggcgctagaagggcggaggaacatcttttttttgtttttgtgaattaattcgtggatatgtgaagacgacgacggcgacactttctttcccactctttttcctccccctttttt

SEQ ID NO: 90170 - DNA, 330 bp, Heterodera glycines
  misc_feature (156)..(156): n is a, c, g, or t
  misc_feature (160)..(160): n is a, c, g, or t
  misc_feature (186)..(186): n is a, c, g, or t
  SCN-specific regions: Sequence locations=1-301
aaaaggccagcgcagagttgactttgataattgaagacaaaaagacgactttggacgagaaggtgaagcggacggaggagctgacagccaaaatgtcggacaacacgaagaaggagctgaatctgaacaacagtgccgacgtcgtcgccttcgtcnaagnttcgtactccgccgtcgccgtgccgngcggtggccacggagggcaaagcatgatcaatcagtctgatcggaggattcggcattgttgtgtgatgaaatgtagccaataatgaaattcattgattaaattaattttcgttttaaaaaaaaaaaaaaaaaaaaaaaaaaaaa

SEQ ID NO: 90171 - DNA, 687 bp, Heterodera glycines
  SCN-specific regions: Sequence locations=1-37,59-149,177-297,322-687
atttcaatggcatcgaagtcgccccaaaatacgctgccctcctccccaaatcacatctgccatcaaaataagcagctcaataacaatttgaaaagggtggggaatggcgcggcgcttggcacttttcactcggagagattttcgtcgttggaaagagagaagcaaagagaaaagaattccggagaaagcgatggaccaaaagcgaaacgaatgaccgaattttcaacggaggaggaaaagccggagaagaagcgggacggagaagacaccagtgaaaagtacaagggaagcagtgaccaacagcagcagcagcagcagcagtcgatggggtccaacggcacattaaaccgaagtttgtcgtcgcccgaactgctccaacttccccggttcggcttccatttgctcgtaactccgtccaccgcgtcgccctccccgctgcctaccaatgaacttcttcagccattgctaatcaccagcaccgcactgtccaattcgctgctttttcctcccaaatcgtccttttccgcattgtcctcctcgtcgtcgctgcaaagtttgaaagaacagcaccaagaagaacacgaacagcaaattctgagaccaaaaatgcagctgaacggctcttccatcctttccattgatatcggacgattatctcaaaagaatgcctccgccgttcattgcgcg

SEQ ID NO: 90172 - DNA, 1065 bp, Heterodera glycines
  SCN-specific regions: Sequence locations=1-3,102-240,263-357,404-1065
tgcccttccccctttccctcttcgtccctctctctctccccctctccctctcaccctttcacccccttccctcacgcccctccttcctctcgccttctccccttctccggaacctcccccaaatcccttctcatctctcttcctcttctttgcacgctcactcaaataagctgggtggattgatatgcaacatgtaaacactcgaattattgggcacccaacaatcggtccctttgtcctatcatttatttcctttacttttaatcatttttaatattctttcgtaatgttctggggataacatccccactaatcctcatttttcgcttttttggccttccaatgaaaaaaaagccgaaaaattgaattaatttttaaaaatgtaaaaaataagaattttaaaccagaaatttataaactaacatcaatagtataagcaataaactgaaaaatgtcttctcaacaaccgaaattgtattattttgctggggttcgaggccgaggcgaatacattcgccaaattttaaaattcgccaaagtgccatttgaggaagtgagcataaacattgaagactggcccaaatataaagaagaaatgccccttggccaaattcccgttttggaggttaacggcgttaagttctcccaatccctggccatttcccgttaccttggagaaacttacggactatcgttcaatgatccgctggaacgtgctcttctcaatatgatcgtcgatcaaatttcagacactcagaacagcggtgccttcaaagaatggccaatggtccgtttggacttagtgccgtgcggagataaggcggcttttttccgagaaaagatacgcccgcagttggacggatgcgcgagtttagtcgagaaatatttggtggagaaaggcgacggcattttgcttggcaaagacaaaatcacttgggccgatatttatgccgctgaatttttcgcaaaatgcattcattttggagaaaaagactgcctcgaggcgtaccctcaaattaaatcactgatcgctcgcgttcaaaatgagcccatcatcaaggagca

SEQ ID NO: 90173 - DNA, 613 bp, Heterodera glycines
  misc_feature (577)..(577): n is a, c, g, or t
  SCN-specific regions: Sequence locations=1-613
cttacgttggtcctcatcttctgttaatgctttctagaaggtctctcccaatttttttttttcggcgttcccgcgcctcaaattttcctgttttttgctattcgactgaaaatggcgcacaaatgttggagagtgacacatcgggtgagcaactccaattgttgcgcaccattgtcgattcgcatctgacaaatggacagacatttttcgtgccgtggtccgataagcgggctttgcagtcgatacttttgccattcaaagagctggccaatcagggcgttgctttggaatttatcatcgacgcttgttccaaaaagtgtccgccctttttatggcgttgacaaaaaatgggcgagaaacgaccaaaaagttgggtgtatttgtcgactgtatggaaatgacttatgaagacgccatgcgattttatgcgaaatgggcgagcggactcgaagaagtgtcggcagattgtgttcagcaacggctgagcattttccttggccgcggcgttcgggcgggtgcccaaatgcgaagtgttgtgatgcgatgtccggagatacttttcatgggggttcctcancaaatggacatgttttgggagaatattttggatttc

SEQ ID NO: 90174 - DNA, 825 bp, Heterodera glycines
  SCN-specific regions: Sequence locations=1-58,80-555,579-709,731-825
cattctcggtctcttccccctcaagattcttgactacttcttcttcttatgtaaacaaacaaaataccaaacatccccccaattcgattcgccatttttcttttctttcttttctcatttacattgcgtttccgcaaaatgtcaaatttgaattttgaagacaatttgcaacgcgtacaagtggaaattcaatggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagacttcccctccatggaacaattgggggacggactttcacaagtgatggagcagttcaatctgagcaaatgcattgccattggggagagcgcgggtgccgacatcgtttgtcgttttgcgatgagcttcccccaactcgtcgtcggtgccgttttggtccattgcatttcgacaacccacggaatcattgccagcatcaaagagcttttcaccaatttgctccttaatgatggtgaaatgactcacagcgcgtggaattggcttttggtccacaaatttggaaatcatgaaatggacaaagaaaagcgcaattacgtcgatgccatcaaagcg

SEQ ID NO: 90175 - DNA, 647 bp, Heterodera glycines
  SCN-specific regions: Sequence locations=1-282,305-569,591-647
ttaagatgttgagtcggagtcctgaaatggaagaagaacgtttgcccattgtttcgatggtaattgtcgcggacaaaagtcgtgcgccggccaatttcattacgctaacgaaaacttacgacgacggaagtgacgcagatttatggaaggatgggttcggtttcgggttgttcaaccgttccgttcgttatatcgctgtaagccgacacatcgccgaaacgccgcccagcggtttggaagtgttgactgacgtggccgtcatttcggacaaagaagcagttccgtccagcttcgtctgcttggacttcaccgttgacaccaaagaacgcgccctgaagaagaaatatttgtgcgcccgcttcactcctcggactgatgcaattgacgcggtgaccaatttaattgttttggcgcggtcgcggaggccccccaaagggtacactttggccggtgacattgacggcatggacatttggttccgagtgtccataatccccgaaagttatggacgacttacgcacagccaatccacggaattacaacattttttcaccggcgcttctccaaaaggagtgggaatttacccgaacattgcccctccgttgggtaccaccgcacagaatcgacattcgaccactgacctcgac

SEQ ID NO: 90176 - DNA, 528 bp, Heterodera glycines
  SCN-specific regions: Sequence locations=1-528
gtcactaattggccctcgggcgttaaacgacgactgacagagtaattaaatttttccgacgccaaaacaatggcagaactcatcaccaaattgtgtacgacaaaactggccattttgaaatggcttcaaatgctttgtgccgtcatcaccgtcctttttctgattgacggtcagcgccagtcgtggttctacactttggtttttgtcgtttccattgtgttcggcctcatctcgttgctcactctgatcgccaactttttcctacactcgcgcaatcagtcggtccctctgcccgcctttgaaattggcttcaatgcgttggctgcctttgtctgtttggcatttgccgttttgctcaccatcgattcagtccgaatgttcggcgacgacttcagccaccaccgctttttgccaccagcgaacattggcaaggacgggtggcgcaatcggactttggtggtggcgattgtccaaatggttgacgccatttgctacggtctttcgctgcacagagtgcggcaacgaatg

SEQ ID NO: 90177 - DNA, 694 bp, Heterodera glycines
  SCN-specific regions: Sequence locations=1-161,183-186,208-496,519-694
ctccgttaataatttttggctaaaaatggtgaatattttggccgatttggtcgccttgggcgacgttgaaaagcgcgctttggactttttgccaagggcagcgcgcggctattacgaaagcggagccgacgatgagcagacgcttcgggaaaaccgcgaggcattcagaaattttctgatccgtccctttgccctgagagatgtgtcccaattggacccttccgtcaccgttcgcctttccccctcaacggccaacccgaagtgtcgtccgttcgctcgcacttttgcctgcccaattggcatcgcgccatcggcattccaccgaatggcgcacgacgagggcgaaatagcgacagtcaaggctgctggcgagacgggcactctgatgatttgcagcactttgtccaccgttccgttggagaaagtggcagaagcggcgcccgaggggagcactttgtggtttcagctgtacatttacaaagaccggacattgactgagaaaatcgtccgaagggccgaaaaggccggctttgccgctttggtgctcaccgtcgacgcgccactgttcggacggcgaagggcggacgagcgcaacgccttccaattgccgggccatttgaatattgccaacttcgcctctcacatggaacagtcgaccctttccggcgccgaagtcggctcctccggcctttcc

SEQ ID NO: 90178 - DNA, 633 bp, Heterodera glycines
  SCN-specific regions: Sequence locations=1-104,126-447,469-571,594-633
cccattcatccgttgacaaagggataatgctaagcggcgtaaaaatgcgaaaattgccgacaaaccgagaaaagggtggcaatttcgtgctgagggcggaagtgttggaggcggcgataaaagaggacaaagccaacggactgacccctttcattttggtggtcaccgtcggcacgactaacacttgcgcggtggaatcgtgccgcgagttggggccgatatgcaacagagagggcatttggatgcacgtcgacgccgcttatgcaggcagttttttcatttgcgacgaattccgccatttgtcggacggtgttgaattggcagattcgttcaatttcaacgctcacaaagcattgatgatcaattttgattgttctccgatgtggtttaaaaacggagacgaagcaatcgcatttttcaacgtcgatccggtttaccttaagcacgaacatcaaagggatgcgtacgattttcggcatctccaagttgcgcttggccgtcgcttcagggcactgaaaatttggtttgtgtttcgtgcgattggcattcagcgaattcaggactttttgagaatgcaaaacaaatttggcaaattgttcgccgatcttttgctcggagacgaccgttttgagc

SEQ ID NO: 90179 - DNA, 707 bp, Heterodera glycines
  SCN-specific regions: Sequence locations=1-45,69-138,162-707
tgagctttttcattcgttttgctaatgggtcctgctgctttgctgcttctcctcccctccctccttctgctttttctgctcatccgtgctcttcttgagcttatccccgtctcgcggttggataagcgttctgtgctaatcaccggctgcgattcgggctttggcttcgacttggcattgcgatgtttgggtgccgggatgcgcgtttttgccggctgtttgactcagacaggaattcagtctctaaagaaaagtgcccaagaaaagggaattgccgtggaacttttggaaccaattgaattggacgtcacaagtgacgaatctgtggcaaaggcattggaattcgtggaacgaaaattaggaccgggaaaagggcttcacgctttggtcaacaacgcgggaatcagtggcaacgagagttgggacgattggctgattccaaaggactacgaagatgttttccaggtgaacactctcggcacaattcgcgtcactcacgcattcaaacgactcgtaaagcgcgagagggagtcccgaattgtgattatggccagctcctgcggccgcgtggcactgccaacgctcggcccttacagtgtgtccaaattccctgttgaggcgtaccccgacataattcgcactgaactgattcttttcggtgtcaaagtggcagtgatcgaacccggctttttccgcactccgatcac

SEQ ID NO: 90180 - DNA, 598 bp, Heterodera glycines
  SCN-specific regions: Sequence locations=1-107,129-383,405-408,430 -511,533-598
attgctgccgtcctaaatctcctattatctccaatgttcggtcgcttcgtttcatcccttttctcctccacggtttcttccgtttttcgccccgaacgattcctgcaaaaattttccccaaatttctgctgtcattcgaactttctccgacaattttcgtttacagcccaaaatcattatgatgacattttaatgcgggacattcgcagaggttctcctccaaagcatgcgcgaaaaccacacgacagaaagccaatcaaaggaaccgcttttaggaaaggcattgttataaaagttgtcgtgaaacacccaaaaaagcctaattctggcaatcgacaatgcgtgttggtgcgtttatccaccggaaggcaatgcatcgcttacattcctggggagggacacaatttacaggagcacagccaaatttacgtgcgcggtggtcgcagaagggatttgatcggagtcagagcaaatgtcatgaggggaaagctcgactgtgcggcggtcaaaaagaaataaatccgaaaacgatcaatgcttttataattcggtaaaatattatgatagagtggtcaaaggacattaaacattggtaaaa

SEQ ID NO: 90181 - DNA, 499 bp, Heterodera glycines
  misc_feature (470)..(470): n is a, c, g, or t
  misc_feature (476)..(479): n is a, c, g, or t
  SCN-specific regions: Sequence locations=1-432,458-499
cttgtgttgaaggcaagtaacaaaaatatcaacaccaaacagcagcagagtaaggattcgacgtttcagaaatggaccaaacacccgttgaagatcggtctgttgagctatgttccgatgacgacgaaacaaagcgaaaagtcgaaaccgattctgaggattactttatggtggaaaaacaattgagagaacgtcgtgttggaatacaaaatttctcttcgatggttttgtttgaccggaaagcgaagcagcgacaaaaaatggcagaaaagcggaggaaagagcgaaacaatgcgaaattgatactctatggtcgtccccgcaaaacgaaacaatgctcttcagttttttcaaaggaagactttgcgcaaattggaaagaaagatggcagttcagcaaacgaacgcattaaacgaattcgataaaatacttctttttgtttcgtttttattttaataaattacttttcncattgnnnngaaagaaaaaaaaaaaaaaa

SEQ ID NO: 90182 - DNA, 622 bp, Heterodera glycines
  SCN-specific regions: Sequence locations=1-622
gtccaattaagaagctttagcgcagtcggtcgcttcgtcaaaacacacaaattcaaaaatggcgcgcaaaagccgccaagaacagcagcgaagaagccaatctcgggaacagcaagagaacattccgccatgttgtgcgcagatgcgtcacgagaacgagctgttgaggcgcgcgttacgcaaggaacgcgagcgccgtatgttcactaccaacgcgtacagacagctgttggagcagttcaaccatttggtggacttccggcgcgtggttgtggccaacggagggggcgaacggtcggaacaactgcaacagtgccagtcatcaccgtcgagcgtcaatggtgcgtctgtcccgttgtcatcagaagcagaaacggcattggccatggcaccgacagctacggcagcggccgtgacaccgtcaataacggcaccggtggtgaacaatcaacacaaacaaattataacggaacagccggcggcactgaaccaacatcatcacccaaattggtattttgtggcattagaacgagacgccaacaacacaagaggcaacagcagtaacaatgactccgccgaactgctccgtgacgagcgagtgtggcgaatgtttgctcgcagc

SEQ ID NO: 90183 - DNA, 699 bp, Heterodera glycines
  SCN-specific regions: Sequence locations=1-1,23-41,63-80,105-133,155 -294,316-699
cggcacgagggttatcaccaggttcttatacaaaccaaatgttgctcccttatttttcataacacttccatttgtaagtcaaattttatcttaaatacttagatttgattcgttaattacctaattcatattttctccatgacaaaaacttgttaaatgcttgagacaccacgaacaattcccgggtttcattcggcggggccgcgtcgactcagtttggccacgtctcactacagacagtttggaattgtcagttctccgttggcgacttcgtctccttctccgatgcttttctcgtctgctgctgctgccactctcccggatcgcttgccgttacgccgtccaaaaaagccaccgcaaaagttgcctcttttaatgccgcaattgcacctgcagtttccttcgagtcgaacgaacacaattcgcagcaccgatttgtcttccatttacacggtgcagccggaggaggcagcgttggacgagcgaaatgcacatttgcttcaatgtatccaaatgcaacaagaactcatcaatcaggccaccgctgcaattgcgctttgtcataaaaagttcaggttcagtgggactcttcaagagctcagcgcacagcgacttcttttggtttctcaggagcgccttgcgttgctcaaccgtcaaatggaccaattgaacgaacagcgaattttgaccaatttgtcc

SEQ ID NO: 90184 - DNA, 1165 bp, Heterodera glycines
  SCN-specific regions: Sequence locations=1-329,352-1165
tccatttctaaatacaaaatcatttctcctctttgatcagctgattccttccaaatgccttctgagtacggcattgaaaccgactcagtgactcttcagcgttttgtgctaaacgaacagaagaaattcccggatgcaaccggcgacctgaccactcttctgaccagtctgttgaccgctgtcaaagcgatctcttcggctgtccgcaaggcgggattggcacaattgtacggagttgcgggaaatgtaaatgtgcaaggggaagacgtgaagaaattggatgtgctgagcaacgaactgatgattaacatgttgaagtcgtcatacaccgtttccactttggtttctgaagagaacgaacaggtcattgaggtggaagtgagcggcacccaaggcaaatacatcgtcacgttcgacccgctggacgggtcatcgaacatcgactgtttggtgtccatcggaaccatcttcggcatcttcagaaaggcgagcaacacttccaccaaggaggaggacactctgcagacaggacggaaaatggtagctgcggggtacgcattgtacgggtcggccactatggtggtgctgtcgaccccgggccgtgtcgatgggttcactttggacccgagcattggcgaatttattctcacaaatccggcgatgcgagtgccgaagaagggcaaaatttacagtataaatgagggatatgccaagaaatggtccaaagggatcaccgaatacatccgatcgcgcaaattccccgaagagggcaaatcggcgtacggacagcgctatgtcgggtcgatggtagccgatgttcaccgcactttgttgtacggcggcattttcatgtatcccgcgaccacagatgcgccaaatgggaaacttcgcctcctttacgaatgcaatccgatggcatttgtcatggaaaacgccggggggaaggcccactcggggaaatgcccgattttggacatacagccgaagtccatccaccaaagagcgcccatctttttgggctcgaaggaagacgtggaggaattgctggaatacatccgaaaacacgaccaataagaaaatgagacggaacgaaagacaaccaatgaacaatcgagcaaaatgataattatctataacaattacatggaattggcagggcatttaa

SEQ ID NO: 90185 - DNA, 1024 bp, Heterodera glycines
  SCN-specific regions: Sequence locations=1-970,992-1024
taaagataaaatacttgcgacaatattctttattctgttgtcttcatcaacaaaattgacacaaaaagggacataatggccactgcttgcaagttggaaatgagcttggacgagatcatcaaagcaaataagagcaagaccaaccaggcttcaattaatgggcgaaagactcaaatgactggaaagcgattgattcgcggcaatattgcgaagggaaagccattcatccgaaagcaaatcaatgggcagaatcagaccaagaagtttggacttaaacgcgttggaattaatgttcgccgtggtcgccctttgagaaagtctaaccgtgttgttgtcatgagaaaaaatttcgctgcgaagaacagagccgtaatttccgctacaaagaatttagtgaataaactcgtcaagaaagctcttaacaaatcgaatgtttcgccccgtggcaagcgttttatcgctaattctgcccgtcgtgtccgcacaattattctcaacaaagtcagtccccgttctcgggtgatcactcgtcaacgccagcgaattgttgccgtacaaccgcaacagcagcccgtttttgttcaacgagttgtccgtgggcgtggtccaattcgttatgcgtccgatgctgcgttagttcctcagacgatgaaaatggttccgaagcgacgattccgcatcaatcctatgcaacaacagcaacctgtcctacttgtacagaatcaatcaccgaaacgccgattgccgtccttttcatcgatgagtgttcgtcaacacgtcaatgcattgcgtcgtgcgactactgtgcaacaactccagactcagtttgttaaccagcagctaccgattcgtcagcagtttcgagggcggcaggccatcactacccccgttgtgccaaatcgcagtcgaggcaaacaacaattcattcttgaccaacccgtgcaagcaggacctcaatttatgaaattttctccccgccgtcagcgccggcagactgcctctaccaatacgtcatcgttcaaca

SEQ ID NO: 90186 - DNA, 992 bp, Heterodera glycines
  SCN-specific regions: Sequence locations=1-23,46-512,534-992
gagaaaaattttcaaatctttccattttttgtaattaattttttatgacttaataactccgtgtttgttgttgttgtataaattaattagagcacttatgcagaatggaggcagattttcacgctccttggttttacgggtcactttcccgcgagaaaactgagaagtgcttacagtcatgcgcagatgggactttcctgatcagaaattcaacaaactatccgggcgatttcacactttgcgttgcttgcaatttgcgggtcgagcattacaggatttacatggtgaatgaccactttacgtgtgacaaagaggagctgttcgacacgctcactcagctcgtatcgcactacaaaagggatgccgacggactgtgccatcgtttggtgtgcccttacatttccgaggaatgccaaaggcagcgaactcacatcgatttggtgttagttgaggagcgcaaaaaggagttcgagcaagcggcgctgttactctccgttgaccatcttcggcttggcactgtcattggacacggcgaattcggagacgttctttcgggcacataccgaggcagaaaagttgcagtgaaaacgctgaagaacggaatggtccaggatttgctggccgaagcgcgttttatgattggccttcaccatgaaaaattggtctttttggtcggcgttgtcattgaggacccgcgcgaaagtgaagtgtacatgctgaccgagttcatggccaatggcaatttggtggattttctccgttcccgcggccgtcaccacgtggaccgaccgcgacttgttcaatttgcgcaggacgtggcggaaggaatggcatttttggagtcgcgcaattttgtccacagagatttggccgcccgcaatgtgctgttggacgaccgattgggggcccacatcggggaccttcggactccctccattggccaatcagcccgcaaaaaaagtcgcggaaagggaaagtttcccgatcaatgg

SEQ ID NO: 90187 - DNA, 393 bp, Heterodera glycines
  SCN-specific regions: Sequence locations=1-86,116-116,138-217,244 -344,371-393
ttttgatgtaaaatttgtctccattagcattgctttcattcattttagtttctacaaaaatcaaagcacaaatcaagggcactgtgagagatggcaaagtctaagaaccacaccagtcataatcaaaacagaaaggaccaccgaaacggcattcacaagcctaaaaaggagcgttacatgtcgatgaagggagtggacccgaaattcttgcgcaatttgcgttttgccaagaaacacaacaagcggaatgtgaaagcgtcgaccgaatctgccaagtaaacggacgaagaaatggcgctggagggattcgataggctgatttgagaccaattgtcagacttttgttattattttctttcttatttttgttgagtaaaaagggcacgggaaaaa

SEQ ID NO: 90188 - DNA, 266 bp, Heterodera glycines
  SCN-specific regions: Sequence locations=1-266
ctggggttgtcaatccgaacgcggttggggctgtcaatccgaacgcggctggggctgtcaatccgaacggtgccgcgttcgatgataccctaagcctttatggggaagaacgccttgatcgccattaggtgtggttctctacaaagaaagaggagagtggctcgaagtttatgctttcaatgcaagaccaatgaatgttaaggaactcaacccgtgttagctctgtctcatattttgcgtccgttaaatgaatgtacgaaaatgta

SEQ ID NO: 90189 - DNA, 873 bp, Heterodera glycines
  SCN-specific regions: Sequence locations=46-135,253-334,356-744,806 -841
cctggacccagcactgaaacacctggaccgcctggacccagcactcaaacaccaggacccgaatcaagcacatcaacaccatctgagggaccaggaactccgagcactgagacacccggacccagcactgaagcgcctggaccgcctggacccagcactgaaacgcccggaccgtctggacccagcactgaaacgcccggaccgtctggacccagcactgaaacgcctggaccgcctggacccagcactgccggaacttcctctacaaagacctacactgttccaacaactccaaaaccacctccgtgttgttatggctgtgactaccctgtcgactgccacacttctgggaaggattgcgactattccccgcttcagccgccttatcaaagcgacccttacccggttgggaagtgcgtcttcaaaaatgtcacttgcgccgctccaaacaccggcaaagtgctcttcatgaagctcaacaatgaccccaactccgtcgtttcgtcttccgtctcaccgttcaacaaagtcacagtcattttgcagtgcacctgcaaaccgtacttcgcaccttattgggtccaagtgggcgttgacggcaacccggccaagcaggtcaacgtcaaatcggcaacctgcggacgtcactgttactagaaaatgatgtccactcattgtccaacaaaagaattaagcaaaaaggaaattaattagaaaatcaattagagaaaaatttccttgcgcattttttaaattgtaattttctttattaataaatatgtagtagaaaaaaaaaaaaaaaatagaagaatatcatattattcgatataataattttttgaaaaaaaaaaaaaaaagaaaaaaaaaaaaaaa

SEQ ID NO: 90190 - DNA, 660 bp, Heterodera glycines
  SCN-specific regions: Sequence locations=1-632
aattttcactgcttttgcatacattcattctcgcgcattacaaaatgtcgattatatcaaataaaccgatgaatatctcgtttagtaattcctgtagtccggattgcccgggcctcacgtggtgctcctgacatccctaacagtgagaacatagacagagatgcggttgctggtttagtaaaaagtgttgctgagggttggtgttgtcatctggcggagaagaacacgttggcactgtttattccatccaaacttttctcatctactttatcgcgcgagaattttgtcgatctgttggagtactgtgaggagcacttgaaggtccgtcgcattttggcttgcttcaacaagtcggacatcaatccatgccagggcattccacgcgccctccgttgcattggcttcaccctcctcccgcccgaacgttaccccgctggcattgacaagaacaccatttttgcgatggtttacaaaatctaagcgcagtcgacgtccttctcccccccccctttctctatctttgtaaaagatcgacacaattttaaacgagttgtattttctatccatgtattcctacagaaaatagcgtttttcatccattcacagtgatgtcaaataaaagtgtgaccaacaaaaaaaaaaaaaaaaaaaaaaaaaaaa

SEQ ID NO: 90191 - DNA, 629 bp, Heterodera glycines
  misc_feature (452)..(452): n is a, c, g, or t
  SCN-specific regions: Sequence locations=1-374,396-542,564-629
cttcgtcctcctcccccttccccaactgtcgctgcttcctaattttgttttccgtctgctgctgttgctctttgttctgtcccttctccaatggcgaaaatgtttactgcacatactaccgggattccaacgagatcacttgcggtacggtgacttgtgagacgcattcgccgttcactcccgacaattccgagcttgacggtctcgacacgaaattgccgaggggatggtaccgtattgggacactgtcaatcagacacgacagggcgtagttcaacctgtacaggcgacgggccactggactcggctattgggacttttacacacagattccggagcggaattgcatcggtcaattcggcttgcacgcgggtgaaaacattgccggatctgtggcagtgaaagacaaacgatgttttgatcgcctcgtcgtgcaaattggagcgcaaatncgacccaccgaaaagttcgatgttctccaatgccgaaagcgtgtgttcaactcgtgttggcttggctcgcacactttgcacgaccaacacacttatctaaccaacctccaatcatattaaccaaagaatatacgaataacaaacaataataacaactaaattattaacaattaaaat

SEQ ID NO: 90192 - DNA, 657 bp, Heterodera glycines
  SCN-specific regions: Sequence locations=1-99,121-657
gagattcttcagatgcatttttgtgctagacagctgttcattccaaatgtctcggccattcccttggccaatgcctttcgttccgtccatcgaatttcattttgccttccttcccttttcggcaaaactcccaaccgaccaacacacttcctgagtggcatgccactgtcgtctgattcgaagaatgtccggctcgttgaagagtctgcccaacccatggaatggacggcggacgaattggcactgaaagagaaagcgacagccgaaaatgcatggaccccaatttaccgttaccgtggctttgtcggcgtttggttcattttgcgcttcaacttggtgttcctcatcttttctctggcttctcttccgctgtccatttctcagcatattcccatctccccctccattggcctcatccttttttcgtccctcgtttttgccggcatcaaaaaatatttcacgcgaattgtcgccgtcatttccgtagacaccgcctcccggtccatctatcgcattggctacccctccgtttttgccacacggcgcagtcgcttcgcccgctttttggacgttcagccgttgtccaccaattcggacagtgtgcgaggcgttgcacgccttcgctttaccgatggggcgaaagatgactttttgctg

SEQ ID NO: 90193 - DNA, 581 bp, Heterodera glycines
  SCN-specific regions: Sequence locations=1-513,535-581
tgcccttgttgtgctcggcgacaagtgccgcaaccagcttgcccgcgagtaccgcgacgccatcaagctcacctactcgcagctcggcaagacggtcccctcgttcctcgaggcgtccatcattgccgacgagattctcgccatcaaggacttgcccgccaaccccaagatcaacgtcgtctacaacaagttcttgtcggtgattgcctacgagcccacccacatgcacaccatctcgtacgccgacttgaaggccgcgcccaagctcgccacctacgagatggaaggcgacattttgtccaacttgcaccagttcatgtttgccacgtcggtccactgggccatgaacgagggccacgctgccgagtttgccgcccgtcggtccgccatggataacgccaccaagaacgccggcgagatggtcgatcggttgaccctcttgtacaaccgtcagcgtcaggcttccattaccaacgatctcgtggatatcattaccggtgcttcggccttgtaagttgttgtgtgtgctgtttggcgagtttgcgtgcgcgagttggcggggcgagtgtgagttggaaatg

SEQ ID NO: 90194 - DNA, 873 bp, Heterodera glycines
  SCN-specific regions: Sequence locations=1-392,414-873
aaggaaaagcttttgttcctgcgccgaatactgtggtggcatatccacccacattcttataaatacagagaagaatccctttggcgactgaccatccatccgctggacatgaactcgttcttcgcgcggtccatcccatcctcggctcgtcataacttctgaagagcggaaagggaggggaccgagcacagtcgtcgttcatccgcgcccatctcccgccacgacgccatttccgaacgacgactttgtcgacaaaagctcatcggcggagcagcgccataaaaatttgcgagttgcccccagcactttcacttgccatccaataaaaacgagattgaagccgtgccgaggcctttcctccccaagtgttttcaaagcaaccgcagcgccttcaccgtcttcacaactcttctgtttccgagtcggccaaccaatgagtgacgagacaattttaaacgcaacggacagcgattggcccttcagcaaaagcgaaactcggaactcaacggttgctgtgctgccccaaaaagtgttggtgacgggaggctgcggttttatcggctccaacttcatcaactatattttcgagaagtggcccaaagcaagcttcgtcaatttggacaaactcgccttcggcgcttctcccgaccatatcattgacgacattagcttctctccacgatatgtgttcgtccacggttctttgttggacgaaaatttggtgaaaacggtgctcaacgaacaccgaatagacacggtcatccatttcgctgccattacacacgtggacgaatcgtacaccgatcgcattggcacaattcaggagaatgtgattgccacaacaacactgctcgaggcgattaatttctatgg

SEQ ID NO: 90195 - DNA, 575 bp, Heterodera glycines
  SCN-specific regions: Sequence locations=1-435,457-575
gacaaacggacccgtttttctccaatcgactttccctgcccaataaaatgcatctttttcctcttttgctagtgacattcgcagttgctggcttcctctcattggcttctggccaacaaaatgccaattccacggatggcccagcagacgacgatgatgaagcggcgcccgttgacgcggaagaacagttcaggcagttgttccaggcagtagacgcggacgacaacgggtcaatcagcggggcggaggcattgcaattttggcagaacaaatcgaagacgatggacccagcggagttgaaaaagaagttggatacgttcaacgccaaaacattggacgaggcggtcgaacggggtttcaaaaaggtggacaaaaatggagacagtgcggtgagcccggaagaactcaaagcgtatattcaaagctgagaaaacagaggccagaggagaagtcagaaaggcgaagcaacgatcagacgaattgaattcgtttaattcatagacggactttcgtttcaccccttattcagctaattaatttttaattattacattgatttgtataaattgtccaaa

SEQ ID NO: 90196 - DNA, 409 bp, Heterodera glycines
  SCN-specific regions: Sequence locations=1-160,186-409
gtcgtctaagataaccaaaaatgaccaagggtacccccagtttcggtaagcgtcacaccaaggcgcacacgctctgcaagcgttgcggtcgccgcgccttccacaaccaaaagaagacgtgcgcccagtgcggctacccctcggccaagctccgctccttcaactggtccgagaaggccaagcgccgcaagaccacgggcactggccgcatgcgccacctcaagaacgtcaaccgtcgtttcggcaacggtttccgctctggcacccccaaggccgcctctgcctaaagcaaccacaactctgtgattttcaaacatgtgtatttgtgtcggtttgggttgatgcaagtttcccgcgccgtcatttcgtgtcgatacatttcccacgtgaatggatcaaaaaaaaaaaa

SEQ ID NO: 90197 - DNA, 636 bp, Heterodera glycines
  SCN-specific regions: Sequence locations=1-175,197-251,273-381,403-636
tgtccatttaagcctcatccgatgggtcccttctctttgtttccgttcgtctccctttttctctctgccgtccttttcgttccgtccgccgtttccgaattggtctctcttacggtgggtgtcagtgccttcagtgcgttgggccttttcatcggcgattttggcggactttacacactcaccaaatgcaaattttacgaatgctgtgatgcgccgtggataaaccgggacatcgcaatgagactcgagcccgacgtggatgagcgtctgtacgggcaacacattgcacagaatacggtggtcagggcgctgaaggcccatttggccaagtcgaacccaaacaaagcattggtgatgtcctttcacggatggaccgggtcgggcaaaaattacttggccaaaatgatcgccaaagcgatttacaagaaggaaatgcgcagccaattcgtccaccaattcgtggccactcatcacttcccaaatgcagacgaagtcgacaaatacaaaggccaacttcgtacttggatacggacaaatttgacgaattgcgaacggtcgcttttcatattcgacgaaatggacaaaatgccaatgcaagtgttggatgcaattgtgccgttcattgacttttacgac

SEQ ID NO: 90198 - DNA, 433 bp, Heterodera glycines
  SCN-specific regions: Sequence locations=1-401
ccaaacaaaaaacttaaaacttcgtttccataaaatcaaaaaatgaaaagccttactcaaattacctcaattattctcccaatgtgttttttgcttctgcttttatcaccaccaaacgcaatcggccaaaatttgtgccaatgggaaggcaaatgtgtggactatggttgcccaactgcttgcacttcagagtgtgtgtgtgcttcgcttgagaaatttgtaaatgcatcaaacttggcgccgggaaagcaaaccgattagcatcgaagccgaaaattcaacaagaaaaagcttggaggcgggtcagaatgattgatttgtttgcaattaattacttggaataattaattaataattccatttgatgatttgaattcgaaaatgataaaaaggggaacttcaaaaaaaaaaaaaaaaaaaaaaaaaaaaaaaa

SEQ ID NO: 90199 - DNA, 751 bp, Heterodera glycines
  SCN-specific regions: Sequence locations=1-521,543-751
caagtttgagctctagttaaatatgcttacgagcaaattttctgaacggattaaaagccttcaaccactttttataatttgtggctgtactgggacgggaaaaagtgatctcggcattgaattagcaaagcatttcaatggcgaagtaataaatgcggattcaatgcaaatttacaaaggtcttgacatagcgacgaacaaagtgacaacggaagaaatgcaaggcgtaactcaccatttgatgagtttttgtgatccgtgtgagtccaattacaacgtccatcactaccgcaacgccgttttgccattgatagaaaggctatgggcgaatggcaaattgccaattattgttggtggcactggttattatatggaagcagcaatttattatgacaatttggtacaaacaaacgcccaaaaatcagacgacctaagaaatgagctgttacaaaaatttcccacctgcgacttattacacgaggaactcaagagagttgacccaatatcagcaggggaagtacacaaaaatgcaaagtttaaagtgctgcgagctttggaaatattttattcaactgggcaaacaaaaagcgaacaccataaaatgcaaagggaaggacaagctgcgaattttcacttggctggccgtctccatacaaaaagcacattactcttcactttggacgccgacaaagaagtactaagccagcggttgaacagccgagttgacgacatgctcaagcggggcttaatc

SEQ ID NO: 90200 - DNA, 678 bp, Heterodera glycines
  SCN-specific regions: Sequence locations=1-18,45-179,201-445,467 -637,659-678
agtttgagattttagcagtatttttaatttaaataattttaaatgatgtcttcgagttcttttgagcaattatcgtgcgaaattgccgaattggagaagttacgccaacaatcacaactcccaaatgttcaaaaggctatcgatgagctaattggaagatggaaagtgaaaaaggaagaacagaaaatgaaaacggacaaagggacagcggagacactttcagccccgacagaagcaccgaaactgatcagcggaagtgtccacgttcgtccgacaaagaaactgaccacttacgcgtttgatgagagtgacaagttcgtgaagctgtactattccctgcccggtatttccgactccgtccccggcacaatttcgaccgatttccgtgaaaactctttttccattgtttgctccgacgtcaaagggattgactacgaaattcgagtgcaaggactttgtcaggctgttgagccggaaaagtgtgtggtgaagcaaaaaagcggtgaccaattgttaattatgctgaagaaggcgaaagaacgacaaaattggggatcccttctgaaattggaaaaggaagtgggcaaaagcaaggcgaaaacgatggacaaagagagcgacccgcaagaaggtctgatgaatatgatgaagcaaatgtacgacgacggagatgacgag

SEQ ID NO: 90201 - DNA, 894 bp, Heterodera glycines
  SCN-specific regions: Sequence locations=1-285,307-894
agaaaatatttttttaaaacctatttctattttatactcacgatattctcatcaatgagtactaaccgaggacgaggacgtgtgtctttaccgagtggagaccattctcaaacttctgaatatgggggtcgtggacgtgggatgtattctttccaccaacaggacgtgaaagaaagttcgcaaatcgctggccgtggacgtggaactactctccaacagaagacggaacacggaggcggctacagcatgggtatgcaacaacagcaagaaatttcaccaatgcgtgggccccgagggggccgaggacacgacgtctcgggacatggcttagaccgtcaccctgttgctcctaccatgccctctccagttccctttggtggcgtttccgccgtccaaccaacttctgggcgcggacagcttccgtcgatgagccgttacggagcgtatgctgcattcaccaaacaacgtgaccaaatggaccagcagaaagctgtgctcgaagaagtcgcgactcgattggaagaacacaaaggggatgagacgagcgttgaaagtcaggctgaggaagttacgagtacgacgttgcagcgtggtctgcttcagcacgaagtgggaggaatggaggcacagcaaatggttgtgggtgagcaggcgcaatgcccatctgctgagggtgttccgcatgccttcctttgcgccgggtgtcagttccgcgcggattgtgccaacttgcttcgtgccatcggtgctcttttgaaagacttcggcagtgctgcatctgttgacggaggacgcaacaacgggactacctaaaagacataacgaatcgtcataaatatctccaccgtattttaacactgaatttgagttctagatttccatttaattttctta

SEQ ID NO: 90202 - DNA, 626 bp, Heterodera glycines
  SCN-specific regions: Sequence locations=1-3,46-626
gaaattcaaaacaaaaacaataacatttaaaactctttggtgcctaaatcaccagctctaccaaaatgaccttaacgatggatgaactgagaaacaaagtccaaaatggccaaattagcaccgttgtcgttggctctgtcgatttgcacgggcgactgattgggaagcgattgacggcacggcattttgttgaaatggcgcaaaaaaaggacaaaatgtccatgtgctattatttccttgcgatgacaattgaaggccacgtggccgaagggttcgaagtcgcgcggtgggaaaacggatttggcaacggccttttgcaactcgactttggcacgctctgccgcaccccgtggatggaaaagacggcactgataatggcggatatgcatgatcaccgcgatttgcctttcttttgtgccccgaggacaattttgcgtcgtcaattgcaaaaactatccgagaagggctttcgggcgaagttcgcctccgaattggagtttcatttgttcagcgagagccaaaagagtgcgcgggaaaagcaatggcgcaatttgggcacggcacagccgcaccaccggtgcatgcatttggtgggctcatcgggggacgagccgttcatgcggaga

SEQ ID NO: 90203 - DNA, 494 bp, Heterodera glycines
  SCN-specific regions: Sequence locations=1-494
gtccaattaagccgtttgaatttcggcacttttcacaatgattgcggcattttgttccacaaggacggcgggcagtcgaattgtgaagggcattgtttgctcctccgatttctcctcccattcgctgtgcggtccgccgctgatccgttcgccctttgacaatccgttgcgccgttttgaaccgcttacacccaacaaaagcgccgacggcacggccgacggtgttgcgtcattgtcagccgagcaaagtggcacgtcggcccagggcatcggtctgaaggagttcagggagacgaccacagtgcaggcgctgcgcgccttcggccaccaattggcggacgcgatgctgtacttgcggaacgccgtgcgtgccaccgcgtacatgccgttggtcagcgggcgacggaatgcagcggtgattatgacggcacaccaaagcacaacaacggagacggctgttggaagcggtggcacggcgccgccgacgacggggg

SEQ ID NO: 90204 - DNA, 577 bp, Heterodera glycines
  misc_feature (562)..(562): n is a, c, g, or t
  SCN-specific regions: Sequence locations=1-56,78-555
agtaaattgaaacccaacattttcaccaaatcagcaaatgtcaacgaatgacgttaaggaagcggctgcctccactgttcttcctccgtcttcaagtcaaagcatttcaatggcttcttccgcggatgggtcaccgcttagagaggaaaacttcgtacattcattgaaatcgcaggtggacggagaaaacatcgaggaaatcattcaaagccagaaaaaagcgttggaacgttttgagaagaccaacgaaatgctggcgacgtgttcttcgctggcagaaaagcgattggatcgggcgagaaaagactttgccattggaagggaaaagatttgccgagctaaatccgacttggactcaatcttccgacggatcgcctccttcaaacaaacattggccagcaattacccggccgaatttgtcgcagcgcaaactgactcgcctcacaatcagaatagtgactgcatcaatgaaccaaacggatgactaaatgacgtaatttccgatatttaactcttttagaattattttttacgaaaataaattttctttcgggtaaaaaanaaaaaaaaaaaaaaa

SEQ ID NO: 90205 - DNA, 600 bp, Heterodera glycines
  SCN-specific regions: Sequence locations=1-281,303-600
gtaaaaacctattttcgcggattccatcttttcatagcttttacatataacagaaaggcacaagttgccatttttactacgtattattttatttgttgatgaataatgtcttctcgaagaaatgaatatctcgatgcgaaggttttaggtttttctacaataatttttcgaaaaacagttaagatttatgttggtggtttacctgaggatgcaacttctgaagagttggacgatgcgtttcatcgctttggacgcatacgaaaaatctgggttgctcgtcgtcctcctggctttgcttttgtcgagtttgaggatgcacgagatgctgaagatgctgtgcgtgcactcgacggaacgaggatttgtggcgtcaaggcccgcgtagagctttctcatgggagcggaagagggggcggacgcggttttcgaggcggagggggacgttatgacgaccgttatggtcgtgatcgttatgaccgtgatcgcgaccgtcgttatcgttcaaggtcgcgttctcgcactcctcgccgttcccgaagccgctctcctccgcttcgtgagcgcagccgatctccgagctacagccgtcgttctcgctct

SEQ ID NO: 90206 - DNA, 536 bp, Heterodera glycines
  misc_feature (520)..(520): n is a, c, g, or t
  SCN-specific regions: Sequence locations=1-330,352-362,384-536
gtccaataaaggccattttgaagaatttatttgcgtatttggagaactatctaattgtggttgtgagtttggaaactctgtcctcacaaaatgcctctttgtcccaaatgtcagcggcctgtttattttgctgagcgcgtcacttccattggaaaagattggcaccgtccttgtctccagtgtcataattctgcctgtaagaagacgctcaccgttgggaagcattgcgaacacgacggaaagccatattgtgagcgatgctacggcgcattgtttggacctcgcggctacgggcatggcggagttgagtctcatgtgttcttggacgggactacctgagaaaatggtggtgcgagatgtttaagaatattatatatctcatatgatgtttgttcaattaccattcaactgaagttctaccttaatcattcattttctatccacatacgtattccattccatgagttgtaagaaaaattcatatgtgtataatgtgccaacatctcagtatgtattgtangctatgatttatgtat

SEQ ID NO: 90207 - DNA, 830 bp, Heterodera glycines
  SCN-specific regions: Sequence locations=1-502,524-561,616-830
ccccgtcgggtgcacagcttggagaattgctgaagcaatttgcttggtcagtcgttcttgcaccggaagacgtcgactgaacatttcgacaatgcgtgccaatttgctgagccccaacacttttttgtttggaaggtatccaatgtggactttgccaagaaaagggacaagatgatgttcacacaaagaaaacatttcaatgtcacggacaatcaccatttcatcggtgtcttcatcaaaaaccgcctcgttcagcacatcatcaaagttttcgtcgtatccctttgtaaaataaagcattgctttcgcggcacgcactggcgttttgagcagaccctgcctctgtacgtcttcgcccacatggctgatgatgctctcgtacgccttgaccatgttgtccaattgcgggtgctctcccagccccgccattggcactgccgtcggcgaagggggcaaaagcctcgaaaccttatcaattggctttgctgctgttgctaatgtctcctcctcccccttcttcagcttttgctcattttcttctccgctgattgcttccaaaaagccgctgctgctgctgctactgctataacttgtgttgcttgtgctgcttttgctcatttgggacaatttcgaattagaatgagcacaacaatcaatcagcaaaggctaaattgacacgcatttatgtctgttcgatgggcttccgtggtgaatgagggataaaacatttgaaaatgccttggttgaaacatcgggattttctgatttcccaaaattttagggcattttaattacatccccagaggaatgcgctcttataggaaaaaaaa

SEQ ID NO: 90208 - DNA, 529 bp, Heterodera glycines
  SCN-specific regions: Sequence locations=1-529
attccacttcactaatctgacttttcataatggctgcacgttctaatactaataaagaaactctaaagaaccattcaaacatagataaaacaattgcaaccaagaagctggtggtacaagactacaaaaatcgattgaaggacagaataaaatcggttaaatgataattttgaatgtatattgggcgcttcgaaggtaaattgcgatgatgcgacacatcgatcaaacagtgccggaaaattaggagagcattatgcaatcagaaacgaagcaattgcgagggctgcgcttctcgtcaaggcaacaaatgagttaaaaatgctgacaaatgaaatccgagaatttctcactattcgcgacttcaattttataagcaactcaatttccaaagcagaagaagatttcaaaaagcgattgaaacaatatgaaaatgattacagtgcacttcggatgagcataagcacaatggcatcagagattgatcgagaattggtggaaaattctttgtatagattctgagttatttttg

SEQ ID NO: 90209 - DNA, 645 bp, Heterodera glycines
  SCN-specific regions: Sequence locations=1-645
gtccaattaagaagccactgttatttgtaatactcacttttcaaacgggtctcagcgccgccggcagagcacaaattctgaacagcgactcttctcttccttcgactttttcttccgtcctttcaattgcattgagcgatttgcacgtccgaatgcaaaatgtgcaagaagaccaagtccgagccttgctgcaagaagttatcgtcttgcttcagcgaagagatgaaggggtcccagatgttcagacaagtggtggagctgcgcaatgacattgccaccaacggatgcatcgccgggggcgtcgaatgctgtgatttgacggcgcacactgtgcagcgaagaccccaaacgactggccaactgtttctggagaagctgtacttcgtcaagcacgtcgacaacaattcactcgctgattctccccgcgagcgtgaaattctggccgaatatcgcaatttgctgtactccatcattctgaatggacttcgccaatggagcaagtcgggcgtactggcacaaatcacgaacggagaacagttcgaacacgcgctgaaattgttggagggaaaggagggcattccgacggtggcggacgaagagcgaaagaggaaatttttggatgactcaaagtgttcgttggtcaat

SEQ ID NO: 90210 - DNA, 979 bp, Heterodera glycines
  SCN-specific regions: Sequence locations=1-529,551-979
gtttgagacctgtcaaccccaactccgtcaaacatccacaaattaaccctaagtgaactaatggccgccgaatcgcaatacccaattccttaccgaagcaaactcaccgaaccttttgagccgggacaaacgctaattgttaaaggaaaaacagcggaagactcagtccgtttcaccattaatctccaccatacgtcggccgacttcagtggtaacgatgttcccctgcacatttctgtgcgatttgatgaaggaaagattgtgttcaacactttctcgaagggcgaatggggcaaggaggagcgcaagagcaatccatataaaaagggggacgacatcgatctccgaattcgtgcccacgacagcaaattcactgtttatgcggaccaaaaagaattgaaggagtttgagcatcgcgttccgttaagtcatgtcacacacttttccatcgacggcgatgttctcatcacgcaaatccattggggagggaaatattaccccgttccttatgagagcggaatcaccggcgatggttttgcacccggaaaaactctgttgattttcggaacgcccgagaaaaagggcaaacgtttccacataaatttgctgaagaaaaacggggacattgccctgcatttgaacccccgttttgacgaaaaggcaattatacggaattctttgatagccaatgagtggggaaacgaagaacgcgagggcaaaattccactggagaaaggcattggctttgacctgaaagtgatcaacgaggagtacgccttccaaattttcatcaacgatgaacgctactgcacttacgcacaccgagtggagccgcacgacctccacggactccaaattggcggggacgtcgaaatcaccggcattcaaatcttctgaaaggatttagaaaactggcgaatgaattgaatgacgatcattcgttgtgatggatgggtgttccgttttaattaatctgaca

SEQ ID NO: 90211 - DNA, 669 bp, Heterodera glycines
  SCN-specific regions: Sequence locations=1-263,285-422,444-669
gtcgcatattggcagcggtgggtctcacaaacaatagccaaatttattaaaatgtctgctgctaatgatgttgctgcaactgctaatgatccatcaactgtcgtttgtgaagagaaaaaatcttccgccgctgaagaggaactcattgacgttgttactgttggggaaaacaatccgacggggagtgccgggacaaaaactggggagtccgacgaagtttttgttgtggaacaaatcaaaaacaagcgaagtgtgaacgggacggatgagtatttgatcaaatggaagggttacgacgacgagcaagatgacacgtgggaacccctggaaaacttgcattgtcccgaattgctcaaggaatttgagacgaattattgcccagcaaagacaaagcgtcgcaaaaaaagtagcggaaaagtagccaaaaagagaaagatttccagtgactcaacactaccaacaattccacttgtgctgaaggatcgttaccacatcggagaagatggagcagttcctgaacatatcattggggtcatgaaacacgaagagtccggcaaaatgatggctcttttgacttatacggaccacagagaagcgacggaatttgtacctacggaaatactgctggagaacaaactaaccgcaaagatgattttgaatttctaccag

SEQ ID NO: 90212 - DNA, 1316 bp, Heterodera glycines
  SCN-specific regions: Sequence locations=1-1316
atttattcaaatcgcttgggaagagtctgcacagagttaacggatacatttcaaacaagagcggttttgtggacgcgtggaaattggcgaaggaaaccttggaattatggactgaaatccaatcgtcgacacttcgaaatttaaatgatcttctgaaagaagtcgctcgttatcaagaagaattggctcggatgcgaaaacgtgccaaagacgcggacactttggaaacgatcaatttgatgctaacaacgaccacctgtctgcaaaaagcaagggacacgttcaaccagcgaagcactgaggtggtcagtctgaaacagagcaacaaagaatggacggctgccagcacaaaagaataccttcgagcacgcaacaaattgaacaaggctcacgaggagtacaagcagtacatggacaagtacagccaaatacgcgacactttcgaagaacgcgtcaaccaagccgcacgctctttccaagaacatgaccgactccatttgctacaaatgaaaagtttttttacgcaaatggcgaaatgtttggaaaatgcccacggcgcaaatgcacaagtgagcgcaactcttcgccagagagtcgagcagaacattaacgtggagcagatgatgttccgatttatcgaggagaagggcaccggcactgaaccgccacaaaaactccaatggacaaatgcggacgaacttccccccgaattggacgttgtctcgtgcgtccaatcccagtcttcctcctcaaattcgtctgccatcgtccctaacttttccggcaaccaattgcagtcgaatgcgaatcatttgctcggcctgaatgactcgtggctaaccgtcggcggagggaaaagtatcgccgcgggtggcggcgaatcggcaaacagtggcggaagcattgacggaggattcggggaaagtatgtgcagtttgggagtcaaaaggggcagtatcaacggatgttcggagcaaaataagtcggccggagagagcgattccgagaggcatttggagttgcctttctctgccaacccttcctcttctgttctgtccaatttctctgctcaaaatccatcgtcctcttatgttccccagcaaatctcttcttggcttggccgtcagaagttcagcggtcgtctgaagaaacatttctcaacttctcagtccaatttggccggtccaatggcaattgaaccattcgcagtcggagaaagtgatcagcagacaaaggacgaactcatcggatcagcttcgaatttttccaaaagttgcaatgatccatccatcaaaacgaattcttccgctggtctt

SEQ ID NO: 90213 - DNA, 532 bp, Heterodera glycines
  SCN-specific regions: Sequence locations=1-532
cttgtgtcaaaaaaattgagttcccggatgagcctgtttttttttgttcggataggttggccagatacgaacagtccatgctaattgagacgggacatgtgtacgcccaggcggcacgcgacaatgcgctggcggcacgcaacaattctgtgacggcgcaagagagtgcccgggccgtacgtgacatcaccgaccttatggtcaaacagctcgagtccaaggaccgtcaaatcgtcgacaaagactttcaactggcacaaaaagatgtgctgctggaagaaaaagaccggctgttacgccagaaggacgagatgatcgcacgtcttcagggttatatcaacggacttggtgttccattgcccgcgccggcagaacagcagcagcagggcggcggtggccaatgagagagagaggcctctgacagaatccgactgaccggaagaaaaaaattcgtggacttttcttttatgtggaatgttttgttttgttttttttgatgctttgcgcctaaaaaataaacattgcttctgac

SEQ ID NO: 90214 - DNA, 652 bp, Heterodera glycines
  SCN-specific regions: Sequence locations=1-424,450-652
cattttcccaatgcgttttgccatcgccccttctctctgtcgtcgtgtgctttgtagacattgttggcctcgtcttcattttggtcggcttctgtcttcctccgcttcagttccttggcactgtccccaatcggtgaccgccaccaccagcacgaacagcttcagaacatgccgttattcgtcacaggcggctgctgtagcacccgaaaattatgaatttcaagccgaaattgacagtcttttgggcatcgttgcgaagtcgctttattcggaccaagaagtgttcatccgtgaactcatttcgaatgcgtcggacgcattggaaaagcggcgatgttcggaattgcaaggcgacgcagccgaagaaatggcaactctcgagctgagaattgaggtggacgagaagggcaagaagcttacattcgtcgacacaggcattggcatgagcagggaagagctcgtcaatttgctgggcacaattgccaagtctgggtccaaggcgtttcgagcggacgagaaaaacgccgcggctgccgaggcaatcatcggccaattcggagtcggcttttattcggctttcgttgtcagtgagaaagtttccgttaccacccgaaaacttggcgaagtaatggggcacatttggagttggaaa

SEQ ID NO: 90215 - DNA, 856 bp, Heterodera glycines
  SCN-specific regions: Sequence locations=1-70,96-403,425-856
gacagtgccgtcaatgtcttctggcacagtgtctccccttcgtgacgttcctctgcgtctctctgataagccctcccttccctttccctcccctcgccgtttgaccaatgactgtccttcttccccttctcccgctccgatcactttgtatctccgattggtcagttgggtctgctcaatgggtggccttctgttcggctacgcttcttcctccattaatgatttgctccctttcatcgtccgtgagatgcgtcttggccctgctgaggttggcgtggtcatctcctgctttatggtcggcgcgggcatcggcggttttgttggcggaaggctggcggaccgaattgggcgcaagcgcagtttggtgctgttcgacgcgctgttcattgtgttcagtgtgtgcacttcattggctccaacatttacgtttctcgtcatcgcgcgaatgttttacggcttcacttgcgggggcatcagttcgtctgcgcctgttctcctcgccgagatttccaccatagaatttcggtcccaaagtgtgtcgatgagtcttttgttcatcgtttttggcgaactgtgcgttttcatcatcggcgcggtgttcggcaacatttggtacgaaactgtgtccatttggcgatggattaacattgcggtggtgatccccgctgttgctctgctgttctgccacgctttcctggtgcccgaaagtccacgatggttggcccaaaatggacagttgcaaaagtgtcttgacactttgcggcgaatgcgcagcgattcactgcaaacgcaaaaggaattccgagaaatccaacaggtcgtcaacggcaattcgggaagagacaatttcggtgat

SEQ ID NO: 90216 - DNA, 701 bp, Heterodera glycines
  SCN-specific regions: Sequence locations=1-1,23-80,108-663,686-701
cttttctgtcctcccaattggttgctgctgatcatcatccgcttattcttccggcactgattaccttcgtcattttgctggtctcttctgtcttcttttttatttaccgcagattccgacagaagccaaatattattttgttcgttgggttgtcgggttcaggaaaaacgacactgttcaccaagttgataaactcgaagaattgttgggactcattcatttcgctgaaggaaaatcagttcgacagttacgcgacggacaatggccaaacgctcactttgctcgattttcccgggtccgattcattcaagaaaactttgtgtcgcaagtggctgaacgagaaacggaattctcttaagggcgtcgttttcgtcttggacagtgcgacgttcaacaaaaaagatgccgccgaattgctgtacgatgtgctgtttgagtcgggcaatgccgtcccggttctgatcgcatgcaacaaacaggacattggacacgccaaatcgcactctctcatcaaaaaggcattggaaaatgagttcggcttgatcaatgtttcgcgtgaagctgccctcagttcgatcagcggagaatccgaaaagcgaattttgacaaaaagcgggaaggaattcgcctggtccgaattgaagaacaagaaaattgattgtttggagtgcaccacaccaaaagatgagaatttatcattg

SEQ ID NO: 90217 - DNA, 620 bp, Heterodera glycines
  misc_feature (528)..(528): n is a, c, g, or t
  SCN-specific regions: Sequence locations=1-620
ccaagtttgagtaaaataaaaccaaaaaaatgcgaatttggccttcccctttcgttcctccgtcccttcccttcgcacttttgctccccttttgcttctgtgtcgctctgttgttgcgctttggcgccggacgcgacgacgccgcggtcggcgaattgcaacacaaccgactgcacccgccggacaccaaagagattcagcagtgtttgtcgcccgacttggaggccgaggaaagcacttcgggccgtttcttcgccgctgtgatcgacgccggctccaccggcacgcggcttcacctcttcgagttcagccacgagttagagcaggagccgagcgcgttcaagctggaggccgagatttacaaggagattaaacctggcgtttcgtgcttcgccaaaacgcccgaattggcggcggagaatgtgcgcgaattgttgctgaccgccaaacggcaaattccggccgaactttgggccaaaacgcccatcgctttccgcgccacggcgggcgttcgtttgctgtcggaanaggaggcggacgcaattttatcggagattgaaagtgaagtgttgtccagggggcttttggtggacgacgacgcggtgggcgttctcagcggc

SEQ ID NO: 90218 - DNA, 922 bp, Heterodera glycines
  SCN-specific regions: Sequence locations=1-3,25-464,487-922
gagaaattaatttcttacaaattttcgcttcaaatgactttcgcttttgctgtgctccttttgcttttcattcctccgctgacattggcaaaaaatgcgcgagcggagggacccgtgccggttgttctttggcatggcatgggcgattcgtgctgcaacccgtacagcatgggcttcatccgcaaattgattctcaccaatatgccccatgcttatgtgctttcgctgcagttgggctcctcagttgccgaggacattggccgcggctatttcgccaatatgaacgacgaagtggcggccgtgtgccaacagttggccgaggacgcgcgacttgcgaacggttacaatgccatcggattttcacaaggcgcactttttgttcgtgcgctcgcccaacggtgtccgcacccgcccattcgaaatttgatttccatcggagggcctcagcagggcatttttgggctccccttttgccccggttccttttacgtttgctcgctcatccgtcgtttgcttgacaatggcgcgtacaccgaatttgcacaacacaacctcgtccaagcgcaatattggcatgacccaaatttggccgagggctatcgccgcgcgaacattttcctggcccacgggaactgtgaacggagctgcgacagcacgtatcgcgacaacatgggcaaactgcgcaactttgtgctggtcggtttcagcaatgaccacaaattggtgccgaaggaaacggcgtggttcggtttctacgccgacaacgacacacaaacgatagtgccaatggagcagactgaactttacaagcaggatcgcattggactgaaaacactgaacgagtcgaaccgtctccattttctgactttcaacggcgaacatctccaaataccccacgatctgttcatctccgaaattgtcg

SEQ ID NO: 90219 - DNA, 568 bp, Heterodera glycines
  misc_feature (565)..(565): n is a, c, g, or t
  SCN-specific regions: Sequence locations=1-41,71-290,326-356,413-568
caagattattcaacatggccgacaacgctcccaagaagcgcactttccgcaagttcacctaccgcggtgtcgatctcgaggatcttatggacctcacctctgagcagctcgttgagctcgttcactgccgtgcccgccgtcgcttccagcgcggtctcaagcgcaagcccttgaccctcatcaagaagcttcgcaaggcccgcaaggagtgccccgagaacgagaagcccgctgttgtcaagacccacttgcgcaacatgatcattgttcccgagatgattggctccgtcgtgggtgtgtacaacggcaagaccttcaaccaagtcgaagtgcgccccgagatggttggccactatcttggtgagttctccatcacctacaagcccgtcaagcacggtcgccccggtattggtgccaccaactcgtcccgtttcgttcccctcaagtaaggatcacatctctcttgtttgtgtttcgcgaaatgtaatcaatgctgtgcgactttcttgtgcggtttcgttctcttgtgcggatcgagcaaaaatacacggcgtacttcatgtcngaa

SEQ ID NO: 90220 - DNA, 433 bp, Heterodera glycines
  SCN-specific regions: Sequence locations=1-237,262-291,323-433
accaggccattttggctgaggaggaccgtgtcgtgctcatccgatttggccacgattgggacccgagttgcatgagaatggacgagacgctttacaaaatcaccaacaaagccaaaaactttgccgacatttacttggatgacatcagtgaggtgcccgacttcaacaaaatgtacgagttgtacgacccggtcaccgcaatgttcttcttcacgaacaagcatatcatgatcgacttgggcaccggcaacaacaacaaaatcaattggccaatgcacgacggccaagaactgatcgacatcatcgagacggtgtaccggggcgcacgcaaaggccggggtttggtcatctcaccgaaggattactccaccaaatacaaatactgagcaacacaaatggcgacggagcagaaatcgggcggccgcatgttgtc

SEQ ID NO: 90221 - DNA, 797 bp, Heterodera glycines
  SCN-specific regions: Sequence locations=1-591,616-797
ctcaatggccgtgccggctttctcgcctctttgcttgaacttcgtttactttttggtcaacaattactttccgacgatgaaattcgttctgttttggatgctatggtttcttccggcagaaaatactccaaaaagcacaaatctccggcccaactgatgttcgaatggtacaacactgaataccttggcgcggcgcacggcgtcagcggaatttaccaaatgatgttaagcttttgggacttgttggatgcttctgcaaagtcggatttgaagcaaagcgtcgattggctgttgagcacccaattttcggatggcaattttccctcgtcgtccgatcgaatcggattgtctgaggaactcgtccattggtgccacggcgcctccggcgttttgcatttgctcatcgtcgcctctttggagtttaaggaggacaaatatttggagtcggctgaacgatgtgtcaatctcatctgggcccgaggaattctgcgaaaaggacccggcatttgtcacggagtggccggtgaattgtgagagaatttagagagagagagaaagagtgagaaatcgggcgggtgaataatagcactgaataattattaatttaattaaaaagcaaaggcatttccaatgtttgtgttgtcttttcaggcaatggctacgcttttcttctcctcttccgactcaccaaaaatgacaaattcctgcaaatggcccattggttcgccttcgtaatgatggccccctcttttgaggcgtccgcccgtgtccccgactgtccgtcgagtcttttcgaa

SEQ ID NO: 90222 - DNA, 925 bp, Heterodera glycines
  SCN-specific regions: Sequence locations=1-26,48-104,130-925
ttcctaaattgttgttgcatctaagttctgttttataataatagtaatgtcgctgctgcccatcagtcgctgctcctcccttttccatgccgcccgttctttggcgtgccgtcgtcctcctcccctggcgtcgtgtcattgtttgctctcagtgccatccacggcaccgttttcgtcccatttgtcgtcgtcgtcgccagtcgtcctccacagcctcacaactccggtgacctccactcactggtgccatcgtcgtgcatttgcctctcaatcgacgccatccgcaccggcgccaaattcaacaaacaatactccggctgctgctggcagagggggcattgggttgtatcaccgctacaagcaatggttgcagaactatccggccctgtacaaattgcatcgactcactgttgacggctccaaatggtgttactccgatctcaaaacgttcttttggttggcctacggactgcgcaaagggcgcatcacactgaacgatctcaacgcgcgcgaactgttcatctacatccaggccgggtcccaattggtcaaactgagtttgctcgccgcgttggctgtgctgcctgccggatttccgctgataatcatttcgatgcttgtgtcgcccaaattggtactgacccggcacttttggaccgattggcaaagccaacagttccaaatggacgacctgcggcgcaacgagcgcaaactgttcccccgcattgttgacgcgttgcggcagcacaacccatcgtcagcggccgcattggcagcgcttgagcagcaattgccactgactgttgaccaattggttacgctgcaaaagtcggcgaacattgtgcccgcctcgttggacgcgtacacgcagcagcaccggttcttcctgaaaagggtgcacaatttgccgttttggaccaccgac

SEQ ID NO: 90223 - DNA, 987 bp, Heterodera glycines
  SCN-specific regions: Sequence locations=1-3,25-305,327-745,841 -925,957-987
aattgtcattcgttttcatttctctacattcggtggtattcctcgattcgtctttcacacgcattttaagcatcatcaaatccaattcaaccgcagcttacctcaaacaatgtcctcctcttctggtcacccgcaaacatcaagcgcatccgcaatacgagcattgcaaatggagttgcgctcattgcaatcacaaccattggagggtttcactgtcacctgtgatgatgacaacatgttcaagtggacagtcggcatttttggaccacccggcacattgtaccagggtggctacttcaaagcacatttgaaattcccaacaaattacccatactcacctccaacaatgcgtttcattcatccggtgtggcatccaaatgtctacgagaatggcgacatttgcataagcatattgcacccaccggttgatgacccgcacagtggcgagatgccttccgagcgatggaatccaacacaaagtgtgcgcacagtgttgctgtctgtgatttcgctgctcaacgagccaaacacgtcatctccggccaacgtggacgcatcggtgatgtaccggaaatacaaagaccacggggaccaggagtatgcgactattatcaggaaacaggtggaaaagtccaaagaggaggccaaaaaggacggcatcaaagtgccggaaaccatcgacgaatacgtggtgaaagcgaagccgagagtgcagggcaacgagtccaacgatgtgattgagctggacgaggattactacgactacgaggacgacgacaccgatgaagacgctgaatacggcggcgaagaagagcaggacagtggccaaggagatgacgaaagttgagcggaactactaacaaatgtgtctaaacgttttctgtgtaaaaaaggacaatcaaccaacgatttgctctgctgtttgacataaacaattaattcaacatgcaaaaatgttttccatgtttttttttgaggataaaacat

SEQ ID NO: 90224 - DNA, 519 bp, Heterodera glycines
  SCN-specific regions: Sequence locations=1-430,467-473,496-519
gcagtgccaatggcacaaaatttccgccttttttgccaccaaacgccaccatccgtcaattcggacggttccgaggcgaaacggcgccaaataaatgagccaccaaaggaggggtccggcggagctccatccctttccgtcgacccgttcggctgggagccgaccaaatgggaacgctttttcctcgtgttgacgcggtgttacgagcgcagtgccgacattcccgcaattattcctctccgagttggtaaacagtacacgaaacgaatgcgcctcctccgcttttccttcgctttgctggtcgcgatcatcgtctgctttggggccgagttttacatggccagttgggaccgacgcatgcgcaggggccaactgagcgatggcgacgtgaaatttttggaaaagatgcgcgataaagttagatgacaaaagagacacatacacacacatatatatattattttttcgcaatgatttccaaaatatttaaaatatctgaaaaaaatatctagggtttaa

SEQ ID NO: 90225 - DNA, 653 bp, Heterodera glycines
  SCN-specific regions: Sequence locations=1-398,421-653
atgcttaaagtgataggcaacaaaaatcaattcgaagcattcgtttcgtccaccgaaggggaaagcaaaagatcgctttttgtgcacttttccgccccttgggcctcctcttgcgcgcagttggacgatttgctgatggaacttcagagggaatacggacagaatgctttcgatatagccaaagtcgacgcggagtcattgcccgaagtttcaatggcacaaaaagtctgtgccgttccgtctgtcatcattttcaagggcggaaaagtcgccggccgcgtggagggatttcagcccgccgaattgaaagattgggccgccaaatgttcgttggattcgttttccgctggtgaaagcgacgctccgtccggcgctgccatttgcgaggatcccaactcgcgtctgaagagactgatcaacactgctcgactcactctgttcatgaaagggacgcccgaggggccgaaatgcggcttcagccgtcagattgttgatttattgcgcagtcacaacgtggatttttggacctttgacatactcgcggatgagcaggtgcgacaaggactgaaatcctacagcgattggcccacttatccgcaagtctatttggacggagaactgttgggcggactcgatgtgatcagagaggagct

SEQ ID NO: 90226 - DNA, 1143 bp, Heterodera glycines
  SCN-specific regions: Sequence locations=1-494,517-550,572-1143
ccctattctattctataaaaagtatccatttcttattaatcactctactatgaaatacagcacttttcggttctcagctgtgaaaggtggcatggctctattatgctggtaaaaaataatctctaagatcattttcgccttgtcgttgtgggcggcggaacagctggatgtgccgttgtgtcgaagttcgcgagaatattacccaaacaacaaattgctgtgattgaacatcaaaatattcattactatcaacccggcttaacattagctgcggccggtctgatggattttgaacagctccatcgtgacgaaagttccattttgccacacggcgtgaaatggtttcaaaagccagttcaccgtctccatcccgattcaaatgaacttttcttaaaaaacggtcaagccatttcctatgattttttagttttggctacggggcttgaacttcgttttgatttaattgaaggtcttccatccgggacagaatctgttcttctttctccttccatcagttccatttattttcccgatggagcaaaaaagacattagaagagctcaaaaatttttcaaccggcgaggcagtttttacctttccatcaacgcatataaaatgcgctggagctccactgaagatttgctttttggcggaagaaattttacgaaggaagggagtccggtcgaattgttccgtgcattattacaccgcacttggtcggatattcggcgtaccaaaatatgccgcttcccttgagcgcattgtgaaagaacgtggggttgagtttcacccgcgccacaatttagtgaaagtgaaccccgaaaaacacgaggcggagttcgaattgctcgacgaaaaagggaaaggcacggggcaacggcaaattgtcgagtattccttcctgcacattgggcctccatgttcacccgtcaaagtccttagagaatacgctaaagaaagccggaacaattcaaatggaacacaacttaccgaccctgaaggatgggtgaatgtggaccccggcactttacagtcccctgcttttcaaaatatcttcgctatcggtgattgtgctaacacacctaattcgaaaacagcggccgctgtgtccagtcaatttaaagcactttccaaaaatttgaaa

SEQ ID NO: 90227 - DNA, 963 bp, Heterodera glycines
  SCN-specific regions: Sequence locations=1-471,495-963
ccaagtttgagaatcaaaatgagacttagcttatcacgttttgcctccaccgtggcaatgttcgccggagggcccatcgagcggccgttggcctattacagccagtttcggcccgcttcgctgaccatgcatcaatacttggactttggccgcaagggcagtgcgtttacctcctaccacttcctgaagacggaactgctggtccgcatggcgaacattatgcaggagttcgacctgctgcccgccaaactgatgcagacgcccagcgcacgccatgtgggctcgtggtacaaacaaagcttctctgaactgctccatttcgagggcctcgagcccagcgacatggcgttggacaagttcaacaaccaattgcgcacaattttgcatcgtcacaacaccgtcgtggagacaatggctgaggcactgctcgaactgaaggaaagccacggcgtggacattgcatgcgaacgcaacattcagtacttcttggatcgtctctacttgaatcggatttccatacgaatgttgcaaaaccaacacttggcaattttcgccgccgcctgcgacaccaatggcactaacaatcagtcgcgcaagacagtcgtggtggacccggccggccatgttggacacattgacccgcagtgcaatgtgcgcgacattctgctggacgcctacgaaaacgcgaggtttctctccgagcaacacttttgcgtgtcgccaatgctcgacttgcgctgcttcaacacccgaattcccgaccagcaaattagcgtcccgctggttccgctccatttgtactacattgtgttcgaattgttgaagaattcgatgcgtgccaccattgagcatcaccatcgggtcaaaggctttgatgccgactcttccgatgatttggcagaagtgcgtgcctgcattgtgctcggcgcggaaaacctttcaattaagatcagtgatcgcggt

SEQ ID NO: 90228 - DNA, 521 bp, Heterodera glycines
  SCN-specific regions: Sequence locations=34-501
agaatttttcattttccaaaccaataaaagatggcaataattgcgaaagtgtttctccttctccttctgtttctcatgtcaatggcttctcttttattttgcgcgaattggccaaaaaataccgtccctttggagacttatgtggacgaatcgctccatctccattgcaaattgtgcaacaaaatcgccaattcagcttcggacggagccaaatggctacagaaatcggaggagggctatgtgtctctgctgaagttttgcatcgacgaactgcgcaacagcgacaaacgcagccaaacattgccggctgaggagggccatcaccaatttctgttcgcgtgccacggattcaccgcggacaaacgaaaattgagcgaaacgattggggcgatagcgaaaaaagaagccgacttctgcaaggagcagaaatattgccaaatgttttgatgtgttcagtgattttcatattttagtgcctttttaaatacaaatggacaaattaaaaaaaaaaaaaaaaaaaa

SEQ ID NO: 90229 - DNA, 454 bp, Heterodera glycines
  SCN-specific regions: Sequence locations=1-454
gaagatgtcaaaaacggggctatccgcggcaattgatgatgaattcgaccctgacattgatctttcacagaggtccaggtcggattgggttggttcatttgctggtaatccgtccacagctccgacggtttatgcgatgttcaacaacagcgtttggacttttatgcttgtttacggcgtgacaggccgatttatttccgcaagtgttgtaagtttactcacgatgccagccactgctgctctgtgggtttgggaggctgatcgcgactacgaacgctgggaagggtcgcgggtgttacgtgagcgccgagttccaaaatttgtgctcccgcgaacgattttcgattggtctgactttgattatgctcaacagatgagaaaggctcctaccggttaaggaaaaagactatttacctaatacatatttgaataaagagcattgtttcaaaaaaaa

SEQ ID NO: 90230 - DNA, 694 bp, Heterodera glycines
  SCN-specific regions: Sequence locations=1-194,221-485,511-556,578-694
gttgcacaaaggttcttaccaatgaagactccgcttgacagttcttacgaccatttaatcgaatctcccaaatattttttccatccatcgtccgtttttcgttcccctttgctgggagcgacaaaaggagcgaagattggactttgggttgatttgacaaattccgacaatttttacaacgaggaagaggttttaaacaatggaagcaaatttctaaaaatgaaaatggtggggcacaaacaaacgccgacgcctgagcaaacgacggcattcattgaagcgattgaccgttttatcacgaataacccggacgatgtgattgtggtgcattgcactcatggtttcaatcggaccggctttctcatctcggcctatctgtacgaaaagtgcgacatgagtatcgaaatggcagtcagagaatttgcggagtgtcgtccgaatggcatttacaagcagtactacttggacgaccttcgcaagagatacggcgatgaggacgaagacgagatgacagtttgaatatccaatagatcggcaaaacactgtgatttccttttagttccccggaaggcctttgtgggagaacggaccgatcagtgacgacgaattcaccaacaacggagcatttgtcatggaggcgacttccaacaattctgacgttggcattgcttcgaatgggccttcgtcttcctcg

SEQ ID NO: 90231 - DNA, 498 bp, Heterodera glycines
  SCN-specific regions: Sequence locations=1-498
atttggttatacaacaacagtttgtattttttttgttttttaattcttaacaatggctcctccaaaattctcagacctcggaaagtctgcaaaggatttgttcagcaaaggctatgcccatgggttcatgaaattagatgtcacttctgacgttgctcccaccgtccaatttaagacttccgcagcgcatgatctcaattcccaaaagttggatgggaaccttgaagtcaaatacaaaattcttgaacatggtttgaccatcaccgagaaatggaagacggacaaccaactgacgaacgtgctcgaattgaaggacaaggttctgcgaggactcaaactgacggtggagacggcattcaagccgcacgtggaaggaagtcgccatgccattgccaaggcggactgggcaaatgatgcgttccatgtcaacggggatttgactttgtttggtggcccactgttcaccggatcgtttggtgctaaaatgagcaacgattg

SEQ ID NO: 90232 - DNA, 545 bp, Heterodera glycines
  SCN-specific regions: Sequence locations=1-545
cagcaaatcactggttcatatcaataacaatccccggcgctgtccaaaatatgccattgttcgtttgaccgaagggaccaatgtgcttcagttttaccaattattgcttgataatggtcaagaagaagtgtcttttgtcaacgaaatgcgtgaaaatgccttccaattatatgagaaaccaaactaatgacacgggaaaggatgaggcatcaatagcagctgatacaggtgccggaaagaaaaagctgcctgacgctgaacaaaaacagacgacggacacaaaggagcggaagagtccgataatggtcgacaaaggagtgcaagtgatccccgaaaggacaatcttcccctcgccctctttcagttcatcttttcgcactcaattgccggcctctccaattttgcgtacggccaaaaaggaacagacgtcgagtttggtgcttccattgcgggatgcgagcaatcatgaaaaactttcctttgattgatggaccgataaactttgtcttttatttgtcgttagtctcgcattacaattagtttca

SEQ ID NO: 90233 - DNA, 666 bp, Heterodera glycines
  SCN-specific regions: Sequence locations=1-266,290-666
gtccaattaagttttgttttcatttctttcggcaaaatgtctctgtcagcgctcaaaaaacagttcaacaaggccaaccagtacctgaacgaatcaattggcactgctgaggcgacgaaacttgacgaagaatttacggagatggaaagaaaggtggacatgacaaacgaactgatcacgcaggtcatcgcgggtaccaacgaatatttacagcctaaccctgcggttcgtgccaaaatcgccgcattgggcgcaatgtccaaagtgcgcggttccaccaaaaatcaatcgtatccccaaacggagggaatgttggcggacacaatgcaaaagtacggccgttcgcttggcattcaatcggactttggaaaggccctttgtgacgcggccgatgccttccgtcaaatggccgacgtaaaataccaattggaggacaacgtaaagcacaactttctcgacccgatcagcgattttcaaaacaatgaactcaaagatttcaatgcacatcgcaacaaattgaaaagtcgacgattggattacgacgcaaaaaagcgcaaacaaacaaaagaggacgaattggtacaagctgaggaaaaattggaggagtcgaaacgactgacagaaaaagcgatgttcaacattttgaacaacgacgtggaacaaatc

SEQ ID NO: 90234 - DNA, 398 bp, Heterodera glycines
  SCN-specific regions: Sequence locations=1-398
ctggtcactatccaaggcactgcctacacagtggccgacatggccaacttattggcattggccaatgtgccaaatttggcaaccatttaccaaaactcggcatcacaaattaacgcacagcaatacacacccatgtattgcgtgcatgggaattccgcggacagcacaccgcagcaatacgcatatccgaacggaattaactcaaccggcacagtgacaaaaggggcgggggacggcactgtaaacatcgactcgttgagagtgtgccaacaatggaaggaccagggcaaattggtgaatcaagtggtcgaaattgcaaatgtttcgcacgaaagaattttgcacacccggcaattttacgatgtgatcgactcaattcttattgcctgagtaaatga

SEQ ID NO: 90235 - DNA, 870 bp, Heterodera glycines
  misc_feature (846)..(846): n is a, c, g, or t
  SCN-specific regions: Sequence locations=33-47,71-209,236-364,387 -464,488-518,540-844
cctcgtgccgaattcggcacgaggtttgagttctattattaaacttcctagaacaaacaaattgctttccaatttataaaatgagcagcagcaaaatcacgcgtgaccagctgaacgagagtgtggctgaagtcttgaaacaatcccaagagaagaagcgcaatttccgagaaacgattgaactgcaaattgctctgaaaaactacgacccacagaaggacaagcgtttcagtggaactgttagactgaagcacatccctcgtccgaaaacgaaggtttgcattcttggcgaccaaaaacattgtgacgaggccaatgccaacggaattccatgcatgacagcggacgacctgaagaagttgaacaaggacaagaagctgatcaaaaagctcagcaaaagctacgacgctttccttgcctccgaatcactcatcaaacaaatccctcgtattcttggtcccggactgaacaaggctggcaagttcccaagtgtggtgtcacacaacgacatgctgaacgcaaaggtggatgaagtgaaggcgaccgtcaaattccaaatgaaaaaggtgctctgtctggcggttgcaattggtcatgttgagatgtcgcaggacgaactggtctcgaacatttcgctgggcgtcaacttcctcgtctcgttgctgaagaagaattggcaaaatgtgcgctcgttgaacatcaaatcgacgatgggccccgcggtgcgtctgttctgatcggttacgatttttgcgtccgtatctttttgatgtgtgacctgaccatccaccgatcggccactgttgttgattttgttaaatgcgaaaaatgaatattatttgttanaaaaaaaaaaaaaaaaaaaaaaaa

SEQ ID NO: 90236 - DNA, 714 bp, Heterodera glycines
  SCN-specific regions: Sequence locations=1-298,320-508,530-714
gtccaattaagcatccattagcattagcaaatgtgcgacgtcctcctcatcctttccctctccatttaactttagagagaagcttgttttcattaacataaaagaagatgtcaagcatcagcccggccaatcccaaaaaattctccataccttcagagaccaattgtgtggtctgtgtagacattgccacgggaaatcattattcagtcgcatcatgcaacggttgcaaaacatttttccgtcgtgccattgttaacaatcggtcgttcatttgcatggggaatggcaattgtccaattgacaaaggggttcgctgtgcgtgccgtgcctgtcgtttggagaaatgtttgcaggtcggaatggacccgaatgcgatacaatccgagagagaccgaatcggttacacgaagagaacacggcgagaaaaacttgtgggatttgacgaaggcattggccacgagaggggcgacctttgcgcggagtcttttgcttcgaacgatgccgatttggaggagtccgatgaagatgacgtcatttttcgcgataccgaaccaatcggatgctcaccttctgtaaatattgcgcagcgttcaaagtctcagctttacgaagaagttctcgagcgtctcactcaactcgagaacaatttcacacttttgttgagtcggagcgaaattcaaccgtacgcgactttggaagaagcgttaaaagctc

SEQ ID NO: 90237 - DNA, 1066 bp, Heterodera glycines
  SCN-specific regions: Sequence locations=1-945,967-1043
caattaagctggtgcttcttttaatgtctgaaaacatgggtgctatttttgagaacattgctttgcatgactttgtcgtgaaagaagtgataaacagtttcccggacaaaaagagcatttttcttttacttgcgaaatccgatgagaaggctttgctcatctgcaacaaacaagcttttgaagaggaagtggcaaatgtttccgattggttggtcaaatcgaaattgcgttacattgattcaaatgatcgttttggaaactttgaaatggcattgccttctgaatccaatcaaatcaaagtcacgttcatttatccggctaccgaatgggacattgagaaatattcgcgtcagacgccgttcttcatttatgagacgccggaagactacaaaaatatcactttgaattatctttcggagattgactacgttaaacaactcaaatgggtttacaattttttggagaagaaaagtgagtcggagcgaattgtttttgaggatgaagacaaacagaatggttttgttcttgcgcccgatttgaaatggaacgggactaatgtggatgatctttatttgttggcaattgcacatcgccatggcttgcgttcagtgagggacttgactccagacgatttgcctcttcttgagaacattcgtgaccaatcagccaaattaatcaagacgaaatacggattggatcagaatcaactgaagatgtacttccactaccagccgactttctaccatctccacgtgcacattgtgactctgaagtacgatgccccgggttggggaggcacttcgattctgctgcaaagcgtcattgacaacatcaaaaattatcccaacttctacaaaaatgctactttgcccttcatcggaaaggaaaagcattcccttaccaagaaattctttgaggctgggcgtgtttgaattttgaataccgattttgaattttgttgttacttttgataatttgacgatgaaaatctcactgaatgactgtttttattgttgttttactacggattaaacttgataattaaaaaaaaaaaaaaaaaaaaaaa

SEQ ID NO: 90238 - DNA, 826 bp, Heterodera glycines
  SCN-specific regions: Sequence locations=1-6,31-108,131-571,593 -666,694-801
ggccatggaaattaaggaaaaatcaaagaatacttccacaagtgcggtgcttccattaacggcggaagaacggatgaaacgtcgacaaattatgaggacggaagtgttggaaaatgtggaaccttttctcaaaatgaagaaaaaaagtttggaagatgcgcaggaggacgagcgcgagaatttccgccgttttaaaatgtttgagacgagcgcacttcagcaaaaggcaaagattgaggaaaatattcgagactaccgcaagagtttgaccgctctcgaaatgctctcagaacaaaattgaaaaaggcgttgactcggtcgagatcacttacaaattggacgagaacctttactcgagggcattggtcgaagagatggacaaagtttgtattcggctcggtgccaatgttatggtcgaatacgaattggacgaagcgcgacaattgttgcgcgaacacctggaaaatgtggaaaaaagctccaaagagacggaggaggacatcgcatttctgcaggatcaaatcactaccactgaaatcaaccttgccaacctgtacaactacgctgtgcaaaacagaaaacagatgtccatgaactccgaactttcagtgggacaaatcggattggacgccgtggaataaaaacagaaattcatgagttaaattctttttgaaataaaactatttttgctatttaaataacaacagtcctccactatgtccagtacctattctttttcttttcacttctttcttttcgaccataatcgtttttcttttcgttcataaaattgactttctgaaaaaaaaaaaaaaaaaaaaaaaaa

SEQ ID NO: 90239 - DNA, 906 bp, Heterodera glycines
  SCN-specific regions: Sequence locations=1-519,542-608,630-804,826-906
caatttcaaatcgtccagcaaccacgaacgtcttttcttttcagaatatgccgatcttcggcgatccttcctccccttatgacgaagccgtagagaaagcgactgcggagacgatgacaaatgagaactggacattgatgtttgacatttgcgaccgcgtagcctccgaaggtccccgcgcctgcaagcagtgtttgttgtcggtgcgcaagcgtctcaaccaccgcgacccccacgtcgttctgctggtcttgtctctgttggactgtctttggaacaattgcggaacgcactttcgacgcgaagtgtcctctaaagactttgtcggggagctcaattacaaatgcacaaatagtaatcgcgttgttgcgggaaagggcccgttcgctggtgaagaaatgggcggagaacgaatgctcaaaggacagttctctttcgctggttgaaagtctttacagagatcttcgagaccaaggactgagctttgagctcgattcgacaaccaacaatcattgtcagaagaagaaggcgattgtcagcaacgatccgaatgtcatgtcgagtgagcaggaagaagcggacattgcgaaggccattgctttgtcattgccagaaggagggaagcagcaggcatcctcacgaaatttctacaccagtgccgtcgttggaacagctccgaccaggcatatgcccattaattccacgacacaaaaatcgcagctcaaaaaagtgaaggcccttattacttttgatgccgcggaggaccaccaggtgtcctttttagctggcgaattgatgatccgattccgacaatgtggaccaaattgggggggccgggttaacaggacccggcgggggagccaccgggacttttttcggggaagtgtgttaaccaaaaacttcaac

SEQ ID NO: 90240 - DNA, 372 bp, Heterodera glycines
  SCN-specific regions: Sequence locations=1-342
cccaagtttgagcttttctaaaaattaactgctgccaaagtcttcatcatgtcttcaaagcctctctacggaaaggatgttcttacggaaggttcggagatctcgcgtgaattggaggcacgtcatcgtaaacgtaaggaggaggacaagcccatctggtacagcaaataccttataaatgacccgaaactcggcacccgctacttttggacttttgctggggtgaccaccgttctgttcggtgcatacattcgccgctgtcttcgctgattggacaaaacgatgggaatgtcttattttcggaagtgtatatgttatttagacggaataaattgttaggataaaaaaaaaaaaaaaaaaaaaaaaaaaaaa

SEQ ID NO: 90241 - DNA, 925 bp, Heterodera glycines
  SCN-specific regions: Sequence locations=1-732,754-925
gtatttttgacgattcttctatttctttttttcttctccaatgctgaaaaattaacgtttcttggcggacattcattcaatgaaatgggagaatttcgtgtgaaatttcgtcaattggaggcggacattgaggaactgaagggcaaaaatgaagcaattcaaaaaagattggtcgagttcgaacagaaactgtcgacaagcgcaaattatacgcgaattgtgagtggacaagagatgattcgaattttggcgaaaaacaattggaaccaaacggacagtcacaaggaactgttcttgtttaagccaaatctgttaaaagtcgtttgtctgggagctgaaaaggttccacgtactgtacgtgccaaaaacagggcgccaaaaaatttggaaattgtttactacgaagtgaaaattctttcagcggaacaaaaggattttggaacccaaaatgactcaattggcattggctttgcacccaagtcgatgccattaggcaccaaggttggcacgcaccccggcacttttgcctacttcaacgatggcaatgtacgtggccacagaattgtgggcagcaccaagcaaaacttggccaaattcgatgccggtgacgtcatcggatgtggactgaatttgaccagcaaagaaatcattctgacgaagaatggcgaacgattggggaaaaaggagcagccgtaccaccgcttcatttcctctcattacggcagcgaattgtttgatagcaatttcttcttcgcatcaaaagaaaccgacgatttatatccggcaatttccttgaacaaccccggggacgaagtggaggccaattttggaccgaacttcaaatacacacttaattaaatgacatatccctttttccgatttattatttgtatttgaaaaataatgtgttaaacagtaaaaaaaa

SEQ ID NO: 90242 - DNA, 796 bp, Heterodera glycines
  SCN-specific regions: Sequence locations=1-173,195-796
gagatgtacattcgagaattaaaatcaccagatataaaaccccctgaagagctccttcaggttttttctaatccatcccgccgttccattcgtttggccgatgaagcacggcaatgcgcgtaccaaaacgagatgtctcgtttagcgcgaattattcaatctcaacaatggacgatttcctctcaacagaggaccatcgaatcgcaacaacggacaatcgaaatgttggtctcccggcttcctcggaatgatggagcggcggctccgcccaatggcgacgaacgacgtgacatgggaggagcgcccaacgaacagcagcatggccaaccgcccattcttcaaattgacaatcgtccgcacattgcgcccgagcccaatggtcgaggaggacaaaatggaggcggacatgggcaacgcccaaacggaaatgccaacatcgttcgtggccaaaatgtcgtaccagtggctcctcccccatttgtggctcaacgacaacaagagcaaggacaaaacgaaggcgggaatggacgacgcccacacggaaatgccaatatcgtgcgtggccaaaatgtcgtaccagtggctcctcccccatttgtggctcaacgacaacaagagcaaggacaaaacgaaggcggaaatggacgacgcccacacggaaatgccaacatcgttcgtggccaaaatgtcgtaccagtggctcctcccccatttgtggctcaacgacaacaagagcaaggacaaaacgaaggcggaaatggacgacgcccaaacggaaatgccaacatcgttcgtg

SEQ ID NO: 90243 - DNA, 906 bp, Heterodera glycines
  SCN-specific regions: Sequence locations=1-20,42-906
gtccaattaagccatgttgtccaaaaagagtgaaggggtcacaacaattgcacttgaagaaggactaattgacgtaacacgaaccgactccgaatcgaagccaatttggcacgatgccatccccctaaaccacgtggtcgccgtcaggcaaagccgcgtcaaattacgctccggcgtgccaacgggaaatgtctcctccattgagtcggcaaatagcaactcgctgttcctttactactcatacagacgaaatgcatacgcatggcgaattagggagtgcgtcatcaaattcgagacgaatacggacgttgaaaaatggtcaactttgctgggaaatgcactcaccgcccaaaaacaccgaccgaaacgtctgttggtgttcatcaacccattcggtggcaaaggacacgcaatttccatttgggagaaggaggttgagccaattttcaaattggccaacatccaatacgaagtgcgcaagacggaaagggccgaccacgcgttggaaattgtgcgcgagttcagcgtcgactcatgggaaggcattgacggcatcgtttcggtcggtggcgacggccttttcaacgaaattctctccgccacagtcattcgcacacaaattgagcatgggaagaattacaacaacatcgaaaccgtgttggagaggccacgcattcggctgggcataattggggccggctcggccaattcgattgtgtcgacagtgcatggagtcaacgactaccaaaccgctgccattcacgtggcggtaggaaacgaacggatggtggacatttgtgcggtctacgaaaatgggctgctttcacgattttctggcgatgcgatttcgtgcggatggcttggcgatgtgttgcgcgactcggaaagctaccgatgtttggggcc

SEQ ID NO: 90244 - DNA, 651 bp, Heterodera glycines
  SCN-specific regions: Sequence locations=1-194,221-335,357-474,502-651
gtccatttaagatgatgtttttccaattgtcatcctcagcaccaacatcatcttccgtcgatgggccacagcagttttttcaacaccaccaccaccaatttgtcccatcgatctcaccactgttcgacacctccggcgccggcatgttgggcacgttggcggcacccaccactgcctcaatcttcatgccgtccttgttcggcggctgcggcggggccgccgccggtgatggcaccatcaccgccgctggctcgctgatgcaaagtttgttgagcgcggcagtctgcagcggcgcattcccgttggtcggcacgactgttgcagcctcaccgctgactgctaccacctctcaacatcgcaaattgttcataggcgggctcagccatgagacgacggatgaacagttacgtgattactactccaaatggggcaaagtcattgactgcattgtgatcagggaccctgtgacgaggcaatccagaggctttggctttgtaacatatgcaacaattgagatggccgactccgcgatggcagaccgtccccacacaatagctggcaaggtgggtgatccaaagcgtgcaattccgcgcgagcaaatgctgcaggcgaccagctgtccacccgcctttctcgacgttgagcccccct

SEQ ID NO: 90245 - DNA, 643 bp, Heterodera glycines
  SCN-specific regions: Sequence locations=1-211,233-621
caattaagatgggtctccttttcatggctcgtattaattattttcgtgctttttcttcaactgtttcaagatctttcaagcaggtaaagcataccgtccaggacaatgttacaaccattgaattagtcgatgttcctattgcgtcaactcatagagaattgaaggaatctgctgctactcaatctaaaactccggatgactgttcttgtgttttatgcaaaattccaacaagcatttcctacaaagatgtgcttattctggaacaattcatgcgattggacggcactgttttcccaagacaattaactggtctttgccatgaccagcaacaacgacttgagcggtgtgtgatgcaagcgcattggtcgggacttttcccggatcggactataccggaatttgaccgtgctgggtacaagcgattcaaccgacattgggacgacgatttggcaatgtttcggctgaagtacaaattgcaccctggcagttggttttacatcaaacggtacaatccacgaattcgagagtaccgcccattcaaagccgacgaaattcctgacattgagagagagtgatttattgtgaattctctttatttcatttgataaacgtaaacggattaaaaaaaaaaaaaaaaaaaaaa

SEQ ID NO: 90246 - DNA, 823 bp, Heterodera glycines
  SCN-specific regions: Sequence locations=46-416,458-753,775-780
ttttttttttttttttttttttttgtaaacagctaaatttatttccgactgtgttccaaatcggttataaaacaaacagttatgaccacaatcgataacaaaaagagtgcttttgccctgtccttggccggtttacaaagttcctcgtacacttcgtccgaattgtacactctgtccacatttggcaacgaaaagcgtccgcgcggtgcggcgcgcaattggcgctccaacgcttccctttcacgcgcgtctttttgctgctttggcaattggaaattgttccctttagcgaatgcctgattctgctgatgacatttattatcaatgctaatattacgctgacaatgaacgattgaaaatgcggatgagacggactgaggaagaattcggagagacgaataaatgtataagaaattggccatcccctcgtgccgaattcggcacgaggcttttaataccctcgcactaattactctcaagatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtacggcggcggaatgggcggcggcggaccatggggaggaaatttcggaaagaaatgagaagggagcaaaatgtggtgatcaagacgaacagaacaagccatttgattgaatatttgtgaaaatagtcaatgtaacaattagaaagaaataaaattacaatttaaaaaaaaaaaaaaaaaaaaaaaaaaaaaaaaaaaaaaaaaaa

SEQ ID NO: 90247 - DNA, 846 bp, Heterodera glycines
  SCN-specific regions: Sequence locations=1-461,483-647,831-846
atgcttcctgcccctttggtcggtttcattttgctgttagggcattttgtgtttgtttctgtcggttccaatttccacgtgctcaaaaaacggggatacgacgaaagcgaaagttacagcagtgaagaagagccaacgtacaagcgccacgggtatggcgggcgctttggtggcaaacgccaccgttacccaccggcgcatggcaagggacaccgcccgtcgacgtacgatggcttcccttacggcgattctccgcttcttccccaagtcatcgccgcccctccgatgcctttctcgcctttgcaattgccttccatttcgaaagcccaaagcgaccttggcgcattgcaagtcgcttctcctgttttggaaggctctccaccgaaagaatcgcctcctctcgacgcttcccaacctttgaacggcgccacggcaattcagtcgcctgctgcagcgcccgagacaaacataatgaattctttggcggcttctcctccattggcaacatcgcagcaattggcatccctttgggtgggcggaagaaagaaacggtcctttaaagagccaaagacaaaaaaagcgaaagaacggaaagcgatcagagagaatgagccgcaggggacggagacaacactcgcagcggacacagaagagacgacggaaaagccgacaaagaaagcggcaaaggaaaagccaaaacaaagaatgatggaggaaaagggcgaaaaggaagcggagaaaaagaaaggaggagaagcaggcaaagaaggagagcaagtgggcaagacgaagaagaagcagcagcagaaggcggagaagcaggaaaagaagcggcacagaaaggag

SEQ ID NO: 90248 - DNA, 445 bp, Heterodera glycines
  misc_feature (425)..(425): n is a, c, g, or t
  misc_feature (427)..(439): n is a, c, g, or t
  misc_feature (441)..(441): n is a, c, g, or t
  SCN-specific regions: Sequence locations=1-207,229-445
tggcatattgccaaaacagctcggctatatgctcattcaggacggcgccattgcaaaatctgaaggtgatttagtgaatgccgaaagattggccaccgttgtgttgcgaatgatcgccgttggtccgttctttgctccatccgtcgcccaggccaatgcgcaaataaatgcaagtggcgatgagggcaacgagttcaatcggctcacagttttgttctccgatcaccagtatgacattgtaatcggaaatagcgccgggggtatttctatcggcggcggaaggcaaacgcaacaccaaaagcagacaattcatgtggtgaaacgaacgctgcccatatgcgaatagacagaccaatgaataaacaagatggaatttgtgcatttttcatttaaatttgaattgcaaaaaaaacagagagtggaanannnnnnnnnnnnnanaaaa

SEQ ID NO: 90249 - DNA, 631 bp, Heterodera glycines
  SCN-specific regions: Sequence locations=32-220,242-261,284-609
cctcgtgccgaattcggcacgaggccaattaagcattttctagttttctattgacttttgcaataaattgaagccttctcatctgagatgtctgtgcctgaaactcattcgccaaccgttgagcaattgccaaaacttccaacggaattgcagtccgaagttgctcaacgggctgggctaaagcatgtgacgacgctggaaaagaatgtgctgccgactaaggaggatttggaggaggagcgcaagcacgagagcttaaagaagggcattcagaactttgacgcgctcaaattgcgccacgtggagacggaggacaaatgcatgttgccctcatcaaatgacattgccgtggagaagacgccacagctggccgcggagttcgaccagtccggactgaaacacgtggaaacgacggtgaagaccaacatcgaagtgattgacaaggcggaacaaaactaagccaatggcgtgacataaacaacagatgttttgaagacggatttgtgacgattatttttggtgtcttgatttgctttctattttgtaccttctttatttggtgagctttacaaattccagagattatgagataaatcgcgttaattcaacaaaaaaaaaaaaaaaaaaaaaa

SEQ ID NO: 90250 - DNA, 695 bp, Heterodera glycines
  SCN-specific regions: Sequence locations=40-164,188-217,302-695
cctcgtccgaattcggcacgagggtaaatctttgttttgttaaaaatgctttctctcgcaattcgacgtttcatcgtccaacattcaaatggcacatttatgagcactaattttgtcgcgacatcgtcaaactttttgctgatggaccaagaaaatgacaaagagacgaagaaggactttaggaaaattgtgaaactgctcgaacgaagtccgactcagaaaagaaagaaagagcaggaaaaagcggaagaaaatgcgaaaagagacaaaagagaagagaacggaagggaggaggaaaggaccaattggaaggagcacatcagcaaaagtctgcacaaaagttacgacgaatacgcgacgaggaaaagcatggaaagttggaagaggagggcccgaagggacacattttgctatatgagagaccggaacttgcccgacttggtcacttacacccatcggtacatcgaaggcctaaccgaactgaacgggaaaaacaatcagaggtccttcgaggacaacgagttggttgttgttgtgttgaaatttgtgatgaacgaattgctcaaagggaataatgtccaatcggcgcggaacgaacgcatagaaaaaaaaccgaaatgattctaatcgtcatcaattcggaatattaattgtttctttccttgtttttagtgattaaaaggatcaattaaaaa

SEQ ID NO: 90251 - DNA, 903 bp, Heterodera glycines
  SCN-specific regions: Sequence locations=1-136,158-168,193-209,231 -509,531-796,818-903
tatgatgatgaactccgacaattcgagtgctatcaacagcaaatccttcgatcaaatttcggagattggatcaatggccacggacggactgcttcaggacgacggagtgccggattatgcaaaaatcataatcaaacagcagcaggcactcattgccacgcttatgaacatgcaacagcagcagcaggagtctcggtacgcgtcgaccatctcactttttcaacagcatcagccgcactttctctccaacaacgattcgtcctttccccctcctggcatccccacccatccgtctcctccgcccggcatccgtccacccgtctctcccgcgccagtgtcggcacctccgccgcctccaccgggctttcgtgcacccccaggcttcaacgtaagcgtcagttcccgcaagttcgaactcgactccaccaaatccgacaccggcggctcccacaaattcgacatcagagaggagctgaagaaggcatttgccttagacgacaccaacgaaaacgacagctcctccgccgagcagcagaatttgtcgccacgttcgcagaacattcgcgaggcacagaacgcgcgtctgcccatgtcgagcagtttctcgtccatcgaaaatttgcaaaatttcaccggtttaagccaacaggactcatcttcgcccgtctccgcgctcagtcggcagcccatcgccgcggccgttccgtctcctcagtccgcgtcgtcgtcggtgtgcgccttggcacttaattatgtgttggttgatcaaatggtgttgaattatgagcgagtgtacgagcaaaaggagaaaatggccagcgaaactctcaccatggtggacagacagtcttcgcccgaacggagcatttaccaacgctttgccaacctcggcgccgtcctcta

SEQ ID NO: 90252 - DNA, 570 bp, Heterodera glycines
  SCN-specific regions: Sequence locations=1-89,115-158,312-356,381 -384,406-411,451-570
cggccatactcacataacaaattcatcatgggtaagccacgtggtttgaatgctgcgcgctctctgagcaaccgccgtcgtgatcagcgttgggctgacaagcagtacaagaagcgtgctctcggcactgccttcaagtcgtcgccctttgccggtgcctcgcacgccaagggcatcgtccttgagaagattggtgttgaggccaagcagcccaactctgccattcgcaagtgtgtccgtgtccagctcatcaagaacggcaagaagatcaccgctttcgtgcccaacgatggttgcttgaactacatcgatgagaacgatgaggttcttgttgccggtttcggccgtaagggtcgcgccgtcggtgatattcccggtgtccgcttcaaggtcgtcaaggtctctggtgtgtcgctccttgccttgtacaaggagaagaaggagaagcctcgttcgtaagaagttttgcttgccacgctcgccgctctcaactgcttgcttttgcgcgtgtgcttgtcgtgtgttgctcttccgtgctggccggttcttccgattccgtcaatacaactc

SEQ ID NO: 90253 - DNA, 530 bp, Heterodera glycines
  SCN-specific regions: Sequence locations=32-104,127-422,453-530
cctcgtgccgaattcggcacgaggattaagtcaaaaatggatcctccgtcagtaattgcaagtgccgatgcaaatggtgaccaacgccagcagggcggcgatgtcaaaattgagcaagtgcgaaatcaactcgacggcgtcacaacggtgatgtcgcaaaacgtggagcgtattctcgagcgtggcgaacgccttgaccaattggacaaccgcagccaggcgctgcacgagtcgtcgcagtcgttcacccacacgagtcagcgagtgcagcggcgcatgtgtctccaatcgatgaaatggtccatcattttcggcctcttcctttgtgttatgcttgtgctgctcgtgctgaccattctccgcattttcaacgtcatctgaaggcgaacggagcggcgaaacgaaaaacaaaacaaaatgagaaaataataaataaaaacatttattttttactcatgaataaatttacattctttacaaatgagatgaatctgtgcgcatattttaataaatcatcaaatagataaaaa

SEQ ID NO: 90254 - DNA, 538 bp, Heterodera glycines
  SCN-specific regions: Sequence locations=1-457,479-538
gtttgagatacctcctcctcccattcgttcattcttctccaattcgtcctttcccttctcaaatggcccaattccccgtcgccaacattctcctcgcctcccttttgttgggtttcgtcattttgaacagcaaaacgaatgcgcagtttcaatacggcggcggaatgttagccgaagggccccaaatggaaggccttttggaggattacggtagggtgggcgactatcccttcgaaagtcttgcaaaacgcgcgccgctcgaccgttccgcaatggccagatttggtaagcgcgcaccgctcgaccgttccgcgttggcacgattcggcaagagggcgccgttggatcggtccgcaattgcgcggttcggaaagtgaggagaaacggacggatggatggaaaccggtggaaaatggcggaaggaaaggaaccaccggcggaaaacaaacattttctgttttcattccttctcaaatttactttttccacacacattttatggcgaaaaagaaattattttctcggttaaaaaaaaaaa

SEQ ID NO: 90255 - DNA, 609 bp, Heterodera glycines
  SCN-specific regions: Sequence locations=1-609
gtcaattggtctttcgactcgctcagagggaattggcgccgctcgccactcaaattgaccgtcatgaccaattcacaaagctccgcgagttttggcgcttactcgtccaaaacggacttttggggatcacagttccggcggagtttggcgggtcggaacgcaattattttgaccattgcattgtgatggaggaattgtcacgtgctagcggttccattggcctcagttacggcgtccattccaacgtcggagaatgtgcttggcgaggaagactgcggcttgtacattctgatgtccggtcttgattcggagcgattggtttttgcggcggcacccctcggattgatgcaatctgcttgcgacatcgctttcgagtacgcccattgccttcggcaaaccgatcggcaattttcaggtaccgtttcgacttctgttccgcatttcgacgcccgctcagcttatgcaaggcaaattggccgatatgtacacgcgtttgtgcgcctcccgggcgtatttgtacgcagtagcacggaacgctgtttcggctgaatgtttaaaggcaaaagattcggcagcggcaattctttttttggccgaaaaggcattgga

SEQ ID NO: 90256 - DNA, 729 bp, Heterodera glycines
  SCN-specific regions: Sequence locations=1-290,316-329,351-654,676-729
gtccatttaagatttcaaataagttaattaatgtgctccagttctgtagccgcatttcgcttttgtcagttttcttcgtccttattcaaagcacagtgtccgcagcgcattttttgcagagccgcatcgactgtcatgtcgacctctgaagaattcaaaaagcagaccattgtgccggatgtggtcacaaaggcgccggaaaagcgggcaaaagtggtgttcgacagcggagtcgaggctaatcttggcaacgtcctgacgcctacccaagtgcagaatccgccgaaagtcacctgggaggccgaggctggcaaactgtactcccttatcatgaccgaccccgacgcaccgagtcgcaaggagccgaaattccgcgaatggcaccactggctcgtcgtgaacattcctggcaccgaggtggacaagggcgatgtgctaagtgaatatgttggttcggggcctccccaggacacgggtctgcaccgttacgtctacctgatttaccaacaaaagaacacaattaaagacaccgaacacggccacctgaccaatcgttctggtgacaaccgtggtgggtggaaaactgaaaaattcgcgaaaaagcacgaacttggcgacccggtggctggcaatttttatcaggctgaatttgacgactatgtgccaaaactgtacaagcaattgggttgttgaatgaagagacgttttgctgaattgcgatggaaatga

SEQ ID NO: 90257 - DNA, 468 bp, Heterodera glycines
  misc_feature (153)..(153): n is a, c, g, or t
  misc_feature (159)..(159): n is a, c, g, or t
  SCN-specific regions: Sequence locations=1-19,64-468
gagggttatttgtcgggaatttcttattctttctacaaaatatttccatttcaaatgttgccaccgaaggaaatttgggaaaacgatgcctacgatcggtggaatgattttaatgtggctctgatcattgtgatttgtgtcattggctttgcnactganactcgctatgcaccacagctgccatttggtttacagtggcgcaacgcaataaaaaggcacggatcccacggcatttgtcttcctctgatcgcccttacatcggacgtccggtggaaccaatggttatggaagagggccatttggtgaaagacaaatccaagcaggacaaggcatacagagaactgacaaagcccgatggactcgttatcaccagtgtttaaaataattatttacttatggaaaagccattaatcctatattttcaaattgaacatgtaaattagtaaaaaaaaattttgttaaaaaaaa

SEQ ID NO: 90258 - DNA, 389 bp, Heterodera glycines
  SCN-specific regions: Sequence locations=1-368
gtttgagttaaattatttcctgctaattactcgttttaaaatatctgcggaaatggcagtcattgcaccgaaaatggcagcaattgaggaatttgaacacatctcctgcttacactacgaaaaggacactttcaaacccaacgactgttgtgcaaacccaagaagcatcactcaatcagcaaaagatgtggtcacttttgaatgggccaaagagaaagtgcaaatcgaagaacaccgttcgctcgagccttctaagaaggaacacaaatggacaaaaatggaacagaattgaaaagaaaagcaaaagaagaaaatgcattttctttggattgataaagcgatcattcgatgattaatttgtaataccaataaacaatttatgcaaaaaa

SEQ ID NO: 90259 - DNA, 591 bp, Heterodera glycines
  SCN-specific regions: Sequence locations=1-341,363-562,584-591
ccaagtttgagctgtcatcgttttcccttttccatcctttcaattcaattcgatgtcaatcgatgaaattgagcggacaattcctttgccttcgtcccatctcttctctcattcgcaattcgtccgggctgagattcactcttttgaagaagcttttgtccacaacaaacgcttcaaagagttcgaaggattactcaaaacgaatcacaaaacttacgaaagtgtcgaagcgaaattcgacctgcaaaaaatcgaaaaaatgagcactttgacgaatcgactgaacaaattggcggatcatttggggaaaattggccatttgcattttgaaaagggtgagcttaatgcaatggatttggaggagaagccaatgttcgaaattgttcggcttgcggaacaaaaacagcacgaaattgaagaaggacgaaggaatggcaaatcgaaagcggagaaagtgaccgaagcgatggcaaatgaatgattttcagtcatttgtttgagttcatttttaatacctttgaatgggtttctgttcgaatgtctgtctggtcaaaatattatgtaaattctgcaaaataaaatatttttaaa

SEQ ID NO: 90260 - DNA, 691 bp, Heterodera glycines
  SCN-specific regions: Sequence locations=1-195,218-529,553-691
cccggtgcattgctaatcatcataaaagatgtcaccgaggaaaaatatttgatcaatcttcctacatcacctggcccatcttttgctgatcgaaatgctaataacgaaccaagaaattgccgaaataagccaatggaaacgatgaaagcatcgagcagcagcctttgttataaaaacagctgttttttgtccgatttattgtcgaatacgaacagaagagggaatttgcggctgctcgaaagtgagccgtttgctaacgaagcggcaaccgaagcggaaacggagcgacttttgttcgcggaattggagcagcaaatggacgaagacggaaacaaacagaaacacccggatgaacaaatgccgtgccattcagcttcatcttcggcattttctgctgacaactatcacacccaattgccaatcttttgcggcgtttgttttgccgaatgcgccgcctttgattctttcgcattgcgccgctgtgaaccgttcggtgcgacacacactttctgcgacgactgctggcgacagcacattggccaatgtttgagcaacggccgagtgccaatcagctgcatggcccccaattgttcatccgtcgtccgcccttcggtcgctttgcttgttgttggacaacccattgcgcagcggtaccgtcaactcatggtcaaacgacgccgtttgtgccgcg

SEQ ID NO: 90261 - DNA, 647 bp, Heterodera glycines
  SCN-specific regions: Sequence locations=1-87,109-129,151-171,193-647
caattaagaaggaatttcgcgttgggactgctaatctttagtctcaccatttttttctcttcctccaatcattaataattcaaacaactgatcagttcctgatcaatcattgcttcaaaatgtccgacattgctggtgcttccagcagcgctttttctgccgatgcttcttcaacaaagaaaaagggcgattttttgtttctcgctgagttgggcgaaggctcctattcaaccgtttatttggcttcagagcgccaaacaagtcgaaaatttgcagtgaaaatgtgtctcaagaagaaaatcatcaaagaaaaaaaggtgcagcaaattttccgtgaacgtgacattctccgacttttgtccacgcccgcaaatgcgtgcccatttgttgtccatttgttttgcacatttcaagacgatgagtcgctgttttttgtgctttcctatgcgcccaaaaaagatcttatggcccggctgaaaaagctccaacggttcagcgttggccagtgccaatttgcgatggccgaacttttcttggcactcgagcacatccatgccctggacgtcatccacgggtatgtaaacgcggaaaaaatttggttgcccgaaggccgggacattttgttgtcggactttgggtgtgccaaa

SEQ ID NO: 90262 - DNA, 564 bp, Heterodera glycines
  SCN-specific regions: Sequence locations=1-564
gagaaatgaatcgtgctactgcaaacgaagtctccgtttttgacgattttcattctgacatagaaaagtcgaagaaaattaacaaagatcggttgtccaaattttgtcctaaacttttcaagaaggaaaatgggattggaatgtcttcaattgcttcggtgccttttgaagcacttttggccggtgaattcgtcttcccatgttcctccatccattcgtatgttcacaatgcctacaaatcgaagaatcccgcagaaattgcggatgaattggaattgttgctgaataaattaacggatttttgccgaagtgactccgactttgagaaggttctgaatttttctctcgcattgtccgattgttttggccgtttatttttcgattgcaaatcgctcgaattgaatatgaaattagtgcggatgcaggaaaaagttaaaaacctgacgtcagcacaatttttattcgcccagaatatggccctaatcaagaacaaagctgcttttgtcccctcatttgatgactgttcagattatattgtaaaagaaattcgaatgcgtgaactct

SEQ ID NO: 90263 - DNA, 686 bp, Heterodera glycines
  SCN-specific regions: Sequence locations=1-133,155-473,496-686
cgttacgtcgcttacagtcctcgcgccaaagaaactcacctaaatacgagtcgaatatttcttttttaattggcgtgtggcttcaaaacagaaaagtgccaaattattttcgaatttgagaaatgaattccaattcgttgctcttctctctgttcactttactgttgagcatcgccgccaatggccatttttgcttcggaaaagccatgggccagcagcgctcgcgacgagtggcggctgtggacaatggcaattttatcgtcgtggacggatccgtcagtgttgtcaatggagtgatctccggcaatggctgttattaccatgacggaaaagtgacggattatggcaaaacgcggacgctgaccggcgcagaacgtgccaaactgaagaagttcatcgacgaaatgcagcagatgagcgtaaagttcgcgcaggaaatgcaacggatgttcagcgcgacttttccgttcggtccgcccgcggcgccgccgccgcaatttcatttaccaccgcaagtgccgtgcttctgctcatcgtcgtcgtgttcaaagtttagagaaaaggcaaatcggatgaaataaatgatggaggaaaatgaatgtgatttggcataataaaactggctactgtagatgggctttaccatatagccacatgtcctaatgatactgtagcttttatttatt

SEQ ID NO: 90264 - DNA, 466 bp, Heterodera glycines
  SCN-specific regions: Sequence locations=1-9,31-269,291-304,330 -356,378-429
tccgcttttaataatttcaaataattttccgctttttccaaatgttccatttgcgtttcgttgtgcttcttctgctggtaattgtcggccttttcattggccccaattttgtttctgctgattgggataaaaaggtggccggttgggacgacaagaaagtgaacaaaggctgggaggaagccgaagcaccgctcaacatccgtgcccgtcgcggcggatgggatgagcgcattttgggcggtcgtgaacaatgaatggagagaatgagtgaagaagaagaagaagaagaattcgggatggatgccaaaaaagtaaacattcattttcaatttaattccccctttccgcccccatttgagcccctttttccaaatttcaattatcaaatgcataaacctgttctttctctccaataaatgatccgattttaaaaaaaaaaaaaaaaaaaaaaaaaaaaaaaaaaaaa

SEQ ID NO: 90265 - DNA, 820 bp, Heterodera glycines
  SCN-specific regions: Sequence locations=1-820
agatccttttgcactcaaatccttatagtaattactcaccatggacatatctctgtctctgaacggacttggagcaaagcctttggtgccgattgctgacctgggcgacagcaacaagtactcggcggaagagacggactgccgcaataaattggcctcattgtaccggctggtcgacctgttccattggagtcaggccatctacaaccacatcacacttcgactgcccggaaagaaccacgaaattctgatcaaccctttgggcatgatctatcgcgaggtgaccgccagttcatttgtcaaaatatccgtcgacggacgcattgttgaccctggatcaactccgctcgggatcaaccaggccggatatatccttcacacggccattcacgaggcccgtcccgatgtcaaatgtgtgcttcacctccacagcgcgtcgggtgccgccgtttcgtcaatgaaatgcggtcttttgccactgaatcaggaatcgatggtcatcggacctgtggcgtaccacgaatattgtggaatgctttctgccgaagatgaaaaaacggagattgtcaaacatttgggggacaaaaaagtcattttcttgcgtaaccacggctttgccgcctgcggcgcctccgtggaagaggcgctccacttggcctatcacacgctgatcgcctgtgagactcaagtgtccgcgatggcggcgggcgaaaaaaatttgatatacccatatgaaattgcgaagaagtgctcttatgacatcgcacaacacggagccaacggaatgaatcgtacggcatcggcccaaaacggtacaatg

SEQ ID NO: 90266 - DNA, 1091 bp, Heterodera glycines
  SCN-specific regions: Sequence locations=1-50,79-863,885-952,974-1091
atttcgcttcgcattttctgtttcccccagttttcgctgcccgaaacagcaaaaggaaagaaaaaagaggaaagggagggagagcaacgaccaaacgcttcgacaattcctccgacaatccctccaccctcccaattccctcatttgtcagcccctgtccaacatcagaccatccattccatccgtcgcgcataacgcagaaggacaggcgagccgatcgcagcgatgacgacgataacgccccaacaaaaaccaattcttaaagcggtgattttagtcggcggcgcccaaaaaggcactcgttttcggcccctctctctccaacttccgaagccattgttccccgttgccggtgtcccactaattgagcatcacatttcgcagctttgcgaacagttggaaaacctccacgaaatttttattgttggattttacccggccgaacaatttgcgaactttatttctgattgtgagaaaaagtatcgacgcgtgccaatccgatacattcaagagaactgtccgttgggcactgccggtggccttttgcagtacaaagacattctaatcgacagaaaacctccggatgcactctttgttctgaatgcggatgcttgcggagaattccctttccttgaaatggtgcaggagttgaaccaaaagacggaggcgaaatgcttgattttgaccactgaggcgacacgggagcagtcggtcaactacggatcggtggtcattgattccgtcggtttggagtgttcgcgtggccgtgttcttcattatgtcgataaacccgcaactttcgtctccactcacatttcctgtggcgtttatttgctccgcggcaattcgttcgatgtcattttggaacaagcggaaaaaacagcctccgagcgtggcctaaacaccgactctccgacgatgcaattgtttcattcaaatcaactttggtttgaaaaggacatcttcccccaaatgacctccgatggcactctttttgcatggcatacaaaccgttggtggtcgcagacaaaaacagctggtgccgtcctttacgccaaccgccattatttgggcctttaccgcgcgcgatg

SEQ ID NO: 90267 - DNA, 468 bp, Heterodera glycines
  misc_feature (449)..(457): n is a, c, g, or t
  misc_feature (459)..(461): n is a, c, g, or t
  SCN-specific regions: Sequence locations=1-58,81-159,181-468
gtccaattaagatttttaaacacttaccaaaaaatgttgggccacttttccaaacttagtgttcgttgctacgcttctgccactagctttcgtccgttcttcgaccgggtgctcatcgagcgttttctgcccgaacaaaagacgaagggcgggattatgattcccgagaaggctcaggggaaggttctcgagggtactgttgtcgccattgggcccggttatcgcaatgacgaggggaagacaattccgatgcaacttcaaattggtgaccgtgtcttgttgccggagtatggcggtgctaagatcgtcatggaggacaaggagtaccacgttttccgcgaatcggacatcatcgggaaattcgaatgagtttgtgaggcggtctctgattttatttgtttttgtttgaatcattttttactattgataaattgttgtcactttcaaannnnnnnnnannnaaaaaaa

SEQ ID NO: 90268 - DNA, 659 bp, Heterodera glycines
  SCN-specific regions: Sequence locations=1-431,453-581,603-659
ccaagtttgaggtcatcgatgttgatccgttccaggcagcaattgtgcgcactttttcgtagttccattcctcttttaaagcccagaatcggctgttattctgtgctcgctcaaatgtcaactgaggttgaaaaggcgcagaaagcgaagccgggcggagacacaatcttcgggaagataatccgcaaggaaatgccttcgacaattctttatgaagatgacgaggtgctcgcgtttaaagacataaaccccgaggcacccgtccattttttggtcattcctaagaagtgcatcactgctctgtccaacagcgaagagcaggaccaagcagttctgggcaaactgttgctgacagcgaataacgtggcaaaggcacagggtctctccaacggatatcgcattgtgatcaacaacggtcgccatggatgtcaaagtgtgtaccatttgcatttgcacgtgcttggcgggcgtcagttgggctggccaccgggttaaacacttggaaatgtcaatcttatcgattgattttttgaagggacttctggcacttttctacacactttgttggggaaatttggctattttaaatgattactgaaatgacattaatgaaatgacattaatttattattgcatcatactatattccccagataaaa

SEQ ID NO: 90269 - DNA, 1345 bp, Heterodera glycines
  SCN-specific regions: Sequence locations=1-462,484-997,1019-1091,1234- 1345
cttaagtcttctgtcctttcaatttcaaaaaaattgctcacatttgtgaaattttgtagctgtttgtctgtctttttccgcatcgataacacttccaaagagaaatggctgttgacgtaaattcggctctgaccaaggcttacgacgagttaaggagcattgacatgaacatatcaatgctttccggagtttcagaaagatttaaccggaaaagaagcgcaccaacaaatgattctttctctactccctttgatcggcgtgtgcaggagggtggccgaaaaattattatcgggccggaaagcagcgatcgcaatgcgaagcgtgggcgttacgccgcggacgagggtccgcctggtgattattccccgccctcttcagcgcgtactcaccgcactttgcaatctagtgtcgtgatgcccaccattgagaccaaatcgcgtacggcggtaatcaacgagatgaagaagaacgagaacaaagaagaccaagtgcgaaaccgacgtcttttcggtaatcttttggttgccacgttgcgtaaatttcaaaacgaggaaaagacggttgggagcaaaggacaagtgcagattgacaagcaacgcgaagttgagcgtcgtttagaggagacggagaaggaaaacagaaaccgaatgatgcgggagagagaggcactgatggcgaagaagcgcgagaaggaaatggaaattcaatccctccggcgtcaaaaggccattgagcaatcggccgaagagaaaacgaaacatttccgtcgccttcagtgcttcatccaaactcagactaagcccccgctgttcttcctcccctccaaacacacactccgaactttggaactcctcaaagagtcatcaaagaaaattgaaacactcattgagttacgacgtgatgaaatgactcgcgaattgcgtcggctcgacacgtacaccaccgccagctttggcgggacaattggtcaggctaagaataatgtggcggatgagtcggacgaccaagacgaggaggagacaaatgttcgcggcggactgaagtcggcgattgtggtgaaaatggaaggaatgactggcgaaacagttgctgaagcggaagaggagaaaagggacgaggaggagggcgaagaagaaacgggacagaaagacggagagggggaggatgaagcagagcccaaagatggagaggagggggaagaagagacggggcccaaagagggcgaggaacaggccgaacagcaacaaaatggccgagcagactcagaagggccggactaagtttttggtttgttctggctgcccttttgttgtttgtcgtctgcaaatacaaaccatcgtcgact

SEQ ID NO: 90270 - DNA, 695 bp, Heterodera glycines
  SCN-specific regions: Sequence locations=1-152,174-293,316-390,413 -665,690-695
gtccatttaagctgcgcctttttcagtccgtttttgccatttttgttcacaacagccaacgactcgactgagcacaacgaccaccacactatcgaccagtaaaaccattacagcggtggcgggtcgacgagtctttcccccgccgccgttcgccaccgccgccccttctcttcggctggcctctttttcaccactctcttcgcccgcctcacctctcccgccacttttatcaaaacttatcatcggtgcgtttgttggccgtaataattctccccggcgtttgctctgtccccaacagcgcagcagcagcagggcactaacattggccaaaggcttcttcctctctacatcagccgcttttatggcggaaaggagtggcgccggacacataaatcacaatggaattgccacactttccgaacgtaatgcgcacagaacatcggtgcaacagtgtccttcgtttgcgccgtttaaaccaaatcgggcattaattgtttcaaaatcttcgctgcttgagtatgaatttgatcggagagggcctaaaaatgaatacagcggccttgacgacccgcgttttctcaaggagttgcatatacaacaaataaatatggaagaccttagaataaggcataaacttcagttacattatttggacacaatcgttgaagaattggagaggcataaaattgagtgga

SEQ ID NO: 90271 - DNA, 969 bp, Heterodera glycines
  SCN-specific regions: Sequence locations=1-969
ggccgaacactggacgaagtgatcagcgaaatggacttggccaaagcatacggagcaccgtacgatttggtcgaacaaacgcttaacaaacggcggaaaatgctgcgaaaaacggcgaagggaacgagcagaaacattgggcccaaaaatgcgaaggatgccgcgtacgaccacaaaatgatacggcacaaaatatttccgatggcagccgcttcttatggggacacggaaaatgtgaagaattgcattcggaacacttttcgaaatgccacgttgtaccgtaattcggtggtacagtgtaacggtaaggcttatgaattgtgttcggcatttacggcagtgtcccatgaggacaaagcgatcattttgtcatttcgtgggacggacacgggatatcaattaattgaagaaacgattcaaattgcacttttcaaacgatcccaatcacctgacgaagaatgggggaaagttggaagttatttcctgaagattttcaatcagctcgtcgaagagggaaaaatcatcgattatttggccaaattagtgaacacgtacaacaactacgagctttgggtgaccggacattctttgggtggcgcaatggctgccattgccagtgccaccattggtgacgcgaaactgatcagtgcgcagcgactaaaactggtcacatttggacagccgaggacgggcaatggcgaatgggcgacagcgatggaccaaaaagtcggccccttcaattaccgcgtcgtgaacaaccgcgacttggtgccgcatatgccgcccctttggttcgaagggtaccgccaccatatgactgaagttttctataacaacgcaaagaacaaaaccgaggaatttgtcatctgcgcggatgaagccgaatcggaggaatgtgcgggaaaatattggttctacaatgttcgggaccatttgaattattttgggaaatcggtgtccgaatgggga

SEQ ID NO: 90272 - DNA, 527 bp, Heterodera glycines
  SCN-specific regions: Sequence locations=1-297,321-340,363-527
caaagtaggacaaccacaacatctacaacggacaaaacagcagcaggaatttgtcaccttccgttacacttggccagtgcgaataacggaacgactgatcggtgccggtgaatctgccattttgaatgtcagcccggcattttgcactgccttcaatggtgtccaattcacttggcttttgcgcatttgcgaggaggaaatattgcctgcggacactagcgaccaaagtgagggcgacatttcgatggactcgtcgtatttcgcatcgggcggcgatgacgacgaattggagatggtgcagcaacaacagcagcaaaggaaagtgaacatcaccctctactacaaggaggggccggcacgcgacgttaagctgagcgggggaaacatttccattcgaaactcggagggcattctcttcgacaatatgccattgcgcaacttggagtacacaaagggcggcggatggtcgccgataagcgactaaaggctggggggacggcagagggacgagcagcgcaagttcagcg

SEQ ID NO: 90273 - DNA, 842 bp, Heterodera glycines
  SCN-specific regions: Sequence locations=1-842
ttcaacttttctcgtcctttgcccctttcgctatgctttccctcaatggcactttccctcctcagtctcttaaacccttggctttggcatttgttctcgatggcgggattggttcccaattggaggagcttggctatcccatcaataactcggtgatttggagtggggaagcaataatcgatgcgcccgaccttttggccaaatgtcataaaaagtttatcgatgccggggcggacataatcgagacgaacagttaccacgtcagcattcagaaactcatggaaagccggggcttttcgctgggacaggccgagtccatcctccacaaatccgtgctgattgcccgtgaggcaattgctgcttcgggtcgtccggtggccctcgtcggtgccgtcggtccttacgccacctatttgagggatgcctcggaatacaccggtgcttacgtgaaaaagcccgacttccaagagcagaccatcatcgactattatctcctccaatgccgtcctctgattgccgcaggagtgaccacgctgaacttcgagaccattccgtcggtgaaagaaatcgaatgtgtggccaaagtgatggaccaattggacgacactgtgcaggcgtgggtttcctgttcatgtcaagaccggaaaaggacgcgcagcggcgacgcatttgcggacgcagtgaaaatagcaaatggacacccaaagattgtagcgatcggtatcaattgcactgcgcccgatcatatcactgaattgctaacagaggcgaaaaaagcgaacaattcaaaggcattggtggtttacccctacagtgggcaagtgtacaacgcggaaacccgc

SEQ ID NO: 90274 - DNA, 1512 bp, Heterodera glycines
  SCN-specific regions: Sequence locations=1-170,194-302,324-598,620 -836,893-934,958-1512
ccgttgttgtacggattcgcatgatgatagcgtggaagcggcgtgcgttgtactccgtgtttgcgccacgctgtgcaattgccaaaaattgctttcgagttaagggttcaacatttattttaaaaacaacagtacaatttgaaattgaacacatctacaaaacaatggacaaaatttcaagagggaaaaaagttttatgatctccgcctccaaattcaacgacgcacggcaagttggggtggcgcaagcggatgccatgctttatgtaatagtgcatgcggacctttaattttttgttaccgacaaacaaaacaaataaaaataccgttatgccgaggtagcctcggtacgcgggggccgagtgggtgtccaggatggacaggtcattacagcggaccggaaaattgcgcacggacgggcgcaggtgggcggtgcgcagttggacggagcgcaaatgctccacaatgtcccgccgtttctctaagcttttgaaaagcacatgcagctcgtgagcgttgcattcgaaccgcttgcagagatggtccacgagcggaacggggcgacggcgttcggcacatgcacatttttttggagtgcctaaatttaaatttaaatatacgtttaaaacaaaagcaacttgttgctggcgtctcctcaccaattggagcgagcggctcgcgcttcatctcctcgtcaatcaggctgatccaactgggatcatccgcctcctcctcttgctttttcgttggctctttgttggcgtcctgtaaatccatttcgggataagcgttgtttatccaatcggtggcaagaattaaatccatttaaaatctgtgaaaataaaaaaaaaaaactataaataaaaagaaaattacataaaaaaaagtaaaatggacgccttccaacaatttaaaagggaggatggacaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttgccaatgtgccagtcactgtacacagcggcgtcccacgcgcggaacaagtgcgggagtgtgccaaaaaagaaaaaaccttgctggtgctggatgatttggtggtgggtatgagtcaacaatatttagacgcactcttcacccgtggctcacacaattggggcgtcagcgtaattttggtgactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagatatccgccttc

SEQ ID NO: 90275 - DNA, 759 bp, Heterodera glycines
  SCN-specific regions: Sequence locations=1-759
gtgaaagtgacgccagtaataataacagttcgaaatggacggggaattaaaccaagggacagacccgaaaattgtgcacagagatgtcattgaaatgtttcctgagttggatctgacgcaaattgtctctgaatttggccatctttcgcctgagggcctcgccggcattgtcattgaccgaatggcactcattcctcggaagaaaaatggaacattgaagagaaaggcagacaatgagagcaatgacgaagttttgtcggaatactcggggggcagtgagacggcagaacaattgggcaaccttctcgtggacaaaatgcttggcgaaatgttacgatcgtgcaaagttgaattgcgaagcaaacgcgctgtggtcgattcgtccgcatggactggtgtcaaaacattgatgattgagcactttccaatggtccgtgccgacttcgtcaccaaaatggtgcgccattttgaaggtgccattgtaccaactgcaatcgcttgtttctttgtggagaacagttttggggacaagttgcagaaaattgctccttcgtttaatcagtcattttggtacaaaatggcgattcccattcaatgccgaggccgtcgtctgaagcaggcttatgtttctgagcagttgcgtgagcacttcaaactgtacaacgaactgatgtgtcagtaccagagccaatacccggaactgcttaccggactcaaactcacccagcaagctcgccatattctgttggaacgttctga

SEQ ID NO: 90276 - DNA, 652 bp, Heterodera glycines
  misc_feature (636)..(636): n is a, c, g, or t
  SCN-specific regions: Sequence locations=1-652
ccaaacatgccaaacagcggcgtacaaaatcactacagaaaacgcgtcgcatattactacgattccaatgttggcaactattattacggccaaggccatgtgatgaaaccgcaccgaattcggatgacccatcacttgttacttaattatggtgtttatcgtcacttggatgtttatcgtcccttccccgcctcccttgaggacatgacccgctttcacagcgaagagtacatggacttcctccgttctgcaactcctgaaactttgaagcagttcaacaagcaaatgttaaaatttaatgttggtgaagattgccctgtctttgacggactcttcgagttttgccaactttccagtggcggctctttggcggctgcggtaaagcttaacaaacaaaaggctgaaattgccatcaattggatggggcgggttgcaccacgccaaaaaatcagaggcgtccggcttctgctacaccaatgacattgtgctgggcattttggagctgttgaaataccacaaacgggttttgtacgtcgacatcgacgtgcatcatggcgatggtgtcgaagaagccttttacaccaccgatcgagtgatgaccgtttcttttcacaaatacggcgactttttcccggngaccggcgaattgaaa

SEQ ID NO: 90277 - DNA, 1117 bp, Heterodera glycines
  SCN-specific regions: Sequence locations=1-183,205-256,278-802,838 -1084,1106-1117
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcacgttctgaaaaaatacttatgaattaattttgcaaaataataaataattaatgaaaaagt

SEQ ID NO: 90278 - DNA, 1079 bp, Heterodera glycines
  SCN-specific regions: Sequence locations=1-386,408-1079
attttggccctctgtcagcacattacgaggaagacgatgaactgcttacaccgacaaagcgacttcgcgaattgcggctgaattctgacgaaaaatgtgcgatgtccgattcaatcccacgggctgttgagctgtttatggagaagaaacgagcaaggatttcaaaattcctgtacacgtacaacggcaacttgcaattgaatttgccacaattgcacgcatttgcatgctcaacgggcggactgattgatgacgaatttagagaaagaatttggccaattctcgcaaaaaatctcccacaagcaaaacgatgtaaagatacgcaatgggacgccctccgctcggaggaatacaatgaccaaacaaatcattcgagcgacgaattgcaacaacaacagcaaacccttttcctatcagattccgactttgaatctgcactttccacgttcaccccgtccatttcgggctgtgatgatcaattgatggatgcggaggacgacgccgagggggacgacgcccaaagaatggccccccaaaacgcaacggtcttcgacttctctcctgaccagctgcgtgcccacaaggaatggaatcaggtcgaattggacgtggcacggacattggcacggtttccaccgaacattgacgaggacgaaagggcatgtctgcagaacgagttgaccccacttattgtgaggatattgtgcgaaaatgaagacttccgttactatcaaggctttcacgacgtgtgtctgacttttctgttggttctcggcgctgattcggccctccaagttatgcgggacatttgtgcccgaggcgccttccacaattatttgtgctgttcgctcgaagagagtgcaatgcgcgagttgcaggacctgtacgtgttgctgttcctgcatgaccaagaagtggagaagcggctgagaagcgccgagttgggcactctgtttgcgctcagttggcccctcacttggttttcacatgcactccaaaattactcccaggtggtcctgttcttccaccttttcctctcttctcatccgctgatgccaatttacgggagtggccgcgtt

SEQ ID NO: 90279 - DNA, 1794 bp, Heterodera glycines
  SCN-specific regions: Sequence locations=1-431,549-1204,1226-1794
gtccggagtcactgaatgcgttcattgagtcatcgtccgcccaattgatttcgcgcaaagagaatttcaaattggcgcagcaaagctttctcgagtgttcccaatactacggagagggcgcctctgccgtgccggacgttttttcacccggattgcgtcattttgcaagcaattcaaaaatgcccttaatgaactcgaagcgcggaaagcatctgaaaaagttggcatttttgccataattcgtcggaagattgggaaaagtgcaatggatattatgactgccgtccataggttcgatttctcagtgctcacttccgaccaagttgatgttctgcttccaatttttcttgccaaattgatggacattgagcgtttggagcggaaattgactctgatgaagcctttggttttctgttcccgaattgtttggcctttctctgcttttccctctccaagtctctcttcgtgcgcctcctcttcccctccccccgtctctcccttctcttccacccttctctctcctccactcgttgtccctcttcgttttcgcgaattctgtgcccaacccattcgagcagttcattttcaacacaaaaacttctgacagagagagaacagaggcaaaaggccaaagtgactttcgcgcgtttctttggttgcaattcgcgcggcaatgagtgcaattgagggggaaacgtgtggagtgttgggacggcttcagttcgaagtccatgcaatcgttggcttcgcccgactttgtgccggcgatgtgttcgaagtttcggtaaggcacggccaccagcgatggcgcagcagaggcaaaacgttggcggacaaaagccagcggtgggagcagcgcatgtcgacgatggacgtgctgtggaacgagccggtggtggtgaaggtgctcgaagtgaaattcctcaagtcgcgctgtttgaacgaacgccaatttgacccagcaaaattcgcattggcacagccccaattggtcacgatgaatctgaatagtgccgggagcatcaaactccgtttggtggtcacttggcttccacttttggcaacaaaaacaattggcgaaaattcgctgaataattgccaaaaaggaaatttgacggagagagaaaagcaaaggacggaccatcggacgaacggatcgaaacaaaacgccagactaacgcaaaatgaacagaaaaaaagagaagaggaagaaagggggagggaaatgcaacagcaaaacacggagacgaaggaggaggaccaatgccagaacgaatcggcggacggcgcagcggtcaaagtttgcctgagggacaaaaaaaggcaaagggagcagcgaattcagctggggaacagtgtcagcacggggtcgaattttggaattggcaaagagaaatggcgctgttcttccacaactttgctggacgacgtgtacaaagacttggccaagtccattccgactatcgatgaccttaccgttctacacccgtcccatttcgcgtctcttccctcgtcgtccccacgccatcggtcgttcgactcggaaagtgaccgcgccaaaacggaagcgaaaaatccgcgtcgcattttctcatttataaaacgcggacaatccgaagcgagtgccgatcagcagaagaaggattggagaaagtcggcgagtttaggagaaatcgcattggcaaaagacgaatgctttacgactacaaatgcggaaaaagcatcgccagtctctacggaaaagaatggaaacggtgcaaaaaggggcaaaccgagcagtgtgaagaaaggacg

SEQ ID NO: 90280 - DNA, 583 bp, Heterodera glycines
  SCN-specific regions: Sequence locations=1-583
cactttcgacatcaccgtgcaaaacaccgccagcaatttccttcgcaacaattacattttcataacggtcggcaaactcaactcggccgtcgaaacgattgaccaacaattcattgaagtccagaaatattccaagcaggacaaattgttggaaatgcttaaaactgatgccatttggaggccacgcccaaacgaagaccctttcttgaagccggccaagaaaacgctaattttcgtggaaacgaagcgaaattcggaccgtcttgcaattgctctgacacaagaaaaattctacaatacgcaaagtttgaacagcgatcggaccctcgaacaacgtcacttggccgtccccaaattcatccagggccaatacgacattttgggggccactgacgtggccgctcgtggtatcaacataccgaatgtcgaacacgtgattaactacgatttgcccgagaaagaaatcgacacttacatccaccgaattggtcgcaccggaagagcgggcaacacgggcttggccacttccttcttcgacccgacttcacccgaagacatggcccacggcgctttttacgttgag

SEQ ID NO: 90281 - DNA, 826 bp, Heterodera glycines
  SCN-specific regions: Sequence locations=1-826
aacaatcgtatttgggcaacaaacgaccaactccaagtggattttcctggaccaatcaccggactcttcaaagggaaacaaaccagctcggcaacaaattgctttgcgcaaccagcaacactgtacgtcaaatggcacagtctccaactcctgtcgccaatccatcgcgcagaccactgcaattacgcctccgagtattgccaactgcaagacaacagctcactcatctggacttcagcatgtccaaacgacaactgcttcatgtgcgacttccaagaagccgaagaaatccacggagaattcaccaagctcaacggtcaaacaacagcattttggatctcggaagaccgacaaaaggcactgaccttcaccgagacacatgcagtccaagcatgcgacgggagacaaatcgtcctatcggagcagaacttcggcattccaaaagagcaatatgacatcatcatgagcaaccacacaagagagagacgcaacgtgcaacccgagcaactcgcttcgcagctttcagctgctcaacttgccacaacaatggcactctcgcagctctatttgaaggaatgccagcgcaatgtgcgtgtcagcaacccaacgcttcaggcacggaaactcctcaagcgcgataatctgcaagcccgatggatcagcgaaacaacaatcgaagtgtttccctgcgttccaatctccctctccaacatcagctaccgaacaacaaaggactgctacaagttcattccggtcacaatacatttgccaaacgcaacaagagacgcattcctcgacccggagatgcgcatcctctcactcatct

SEQ ID NO: 90282 - DNA, 659 bp, Heterodera glycines
  SCN-specific regions: Sequence locations=1-216,238-491,513-576,599-659
gtttgagcaacaaattgaaagcctaagtagctcatattccaaaattatggaagcgaatagagccggtcaaattgcgccaaatacaaaggctgaaaatcatgggaacgcacggactgaaattcgacagcctgcaaatacgacattcagaaaaggtcacagaagagcccattcgatgccatccaacgcacagaaagcggacaaaacaatggcaaacggaaaacaacaaacgatcggtgaaaagcaacccgaacacaaacgtgcgtgtgatgcgacatcggcacattcgcctcaaaccgaatattcttaactcttcggctgcagcgaacgcttccaagaaaagacacccgcagccaaacttcgacacaatcgaagtgctcgaggaggagcacgagttcgaggtccaatgtcaagcttggtaaggcgaggctgacgaagtcatcacaaataaaggttccaatcaacgaggaggaaatgatgagctttcccgggatggaagaaggctcacaaaagtcggataaaatcagcacccacaggaggttttggcagctgaattgcaagggcgtccacttctccggccttcccacttggctacaacacaatgaattcctccacttcggacatcgacccccacttccgagttttggttcttgctttaatag

SEQ ID NO: 90283 - DNA, 698 bp, Heterodera glycines
  SCN-specific regions: Sequence locations=1-80,103-116,143-244,270 -309,332-698
gtttagagccaaaaaattctttactctattaaataaactcacttattttgccatggaattaatcagaggcgtgaccgacagaatgtctgcaatgtgtttctaaagtcatgcaaaagcgtgcggctgtctgtgtgcttgttggtgatgaagacccgaatgtgaaagggaagattaacttcatccaggagaaggatgactctccggtgaccatacagggtgagatcactggcctttcgcccgggaaaacacggcttccacgtccacgctttccgtgacctgtccagcgggtgaatgtctgctgggccccacttcaatcccacgaacaaaacccatggtggaccgtgaggatgagacacgccatgtgggcgatctcggcaacgtgttggccgggcaggacggagtggcaaaactcgatttcacggacaaagtgatttcactggtcggtccgcacaacatcatcggccgcgcgcttgtcgtgcacaagctcgaggacgacttgggccgtggtgaaggactcaagaagccggagagcatggagactggcaatgcgggtccccgtttggcgtgcggagtgatcggaattgctcagtgatgggggaatgacgaccataagcggaagagagatctgattattgacctatctcattttgtcgatacgacagttattcaatttgtaagacatgtttaaacattcaaat

SEQ ID NO: 90284 - DNA, 966 bp, Heterodera glycines
  SCN-specific regions: Sequence locations=1-25,47-128,150-966
cgcagagaaagcagacaatttccgacacacagcgagagagcacagactttgcggagagcgcaggtcgaagggccatccccaaaagaggccgcttggcttcccgagcagaagaaacacacggccgacgagcattggcacggccaccctttcaacacggcccaagcggtgccttcgcagccattcgatagagcgacgaacgacggcactttccctcccccctccattctcagctttctttgctcacgcacaatctctccccccccaccccccgttttttggtgctttgacaaaacgacgaaggcaacgcggaggaaaaggagcaaacggtgatttatgacgaagttaatcagctgtcgaagaacggcaattgcgtgggaattctctccgattgttttttgcccattggcggtgatctccgcacttttctttggtgtcggatgcaacgccaaccatctctattccgagggtggctctttccccgtcctttcctccgacaattcgccgcccattccaaatgatccgccgacttttggttccccagccgaccttcttgacaatgaattgcagcagcccaaccaacagtaccaaactgagtttgccccttccatggaacaaatggtcgacgaacaaaggcgcaatcggctggccaaaattattgaacaaatgagggataatggacagtttagccagcaggaaattgccgatgggcccggactctttttggaagaaggagaagcgaatgttcccattgagcgaccatcggaaacggagacttattgggacggactaaaagagggtgaactcgagtcttccgaaatgttcggtgaaaacgaagggaagaaaattgctgccgttaaaaagggccaaaacgaatttgtggagtttgtggagccacgtcaacaccaaaacaaccgccacaaagaatggatggacaaacgtgtgccaaccgattcggacagaaaaacg

SEQ ID NO: 90285 - DNA, 800 bp, Heterodera glycines
  SCN-specific regions: Sequence locations=1-800
ccaagtttgagatgggcagtaaacgccgtctcttacttcattttagtcaggctcaccagacttttagacgtgcggagttcgatgccatttgtcagattaagggaatttctgtggtgcccaactctccttcggatgggatacacattcaatcgtttgagtttcaaaacgacgaatttgacgtctttcggctgttggaaagggccgtgttagtgaaagcggcgtacgaactgatcgccgagggggacgggcatgagcaagtgatggccaaattggcatccgatccgagttcgtcgcttgcgcgcttcgactccgccgatcagtcgtggtctctgctcgttcgtccccatcaaaagaagcgcagcggcgattacgcccgatcggttgttgagcgttacactgccattccgcttctgactctcgcgccagttgaccttgcgcatccgagcaatgtgttctcggtgatcgaaatgtacgaggcgaacggacggagggaaacgccggacaaagtttactttgtacgactcgttgggagaggggcgaggacatctgaagacactcttttctctgagtcagcgccggtacatcggcaactccacgatggacccggaactcgcgttcatccaggccaacttggccaaaactcggcccggcgcactcgccatggaccccttttgtggaacaggtggactgctcctccccgccgcttatttcggttcctccgattttggcgctcagataaaatgggacgtcgcgcgagcgaggggccgctcgtctcgtgacggtgagcagtggctctgtgc

SEQ ID NO: 90286 - DNA, 894 bp, Heterodera glycines
  SCN-specific regions: Sequence locations=1-593,615-894
ggctgcaggtttccatgatcggattcgacccaacaaatgaacaaaattcggggcaacagcttttcatggccgaaattggacaacgaatcaacaatctcatcaaattcaacatcggccccaaatggatgagtttgaactttgccgctttgtttttccgattttttggctttccgtcggaagctgctaattgtttggaagctgctttaacattcccccaatttttggacatttctctcactcaattggcccaacttttgctccatttgaatccaccgatggaaaatgccaaaaaggaaaatgacggaattgaaaggattttgcgtattgcgatgcaaaaaggagaaaatgagcccgtccctttccatttgatgggcattttccatttgcgccaaaatcgctccgttttggcctaccgtttcttcagagaggcgttggaccgcgacccgaacttcgaacccgcgctgaacgaattgctacggatgaaatgcactcagagagtggggaaaaagccgcgactgatccgcgacatttacgcaccaatttgctgttggcccaatgagcagaacgtcgtctgtttcgagcggagggccaaagggtcggtctggagggaatccgtccgttgtttccgcttggaatcgccgcctgtttcctccggcggggaattccccgccgttcactttgtgtatttccgctgcaacactccttatacgggtcgcagttaccccccgcctccattcgcccctttggtcgccccccttttacgcccggcaggtcggaactgcgtcaaattgaacttcgtcgattcatccaacaaatcgaggctgaggaatcattgaagaccaaacgaaatgaaaggacgtcccatcgtccgtcggtgttggcactcgattacgg

SEQ ID NO: 90287 - DNA, 799 bp, Heterodera glycines
  SCN-specific regions: Sequence locations=1-799
aagaatcgtcgagccgaagagagaggaaagcaaaactgacaaagagaaccgatcaaaggctaacagtcgccctccttcgcccttttcgtcgtcttctcagcgtccccgacgttcggtctctcccgtctccgtgtcaaatggatttcacaacagtagggcgtcgagtcgactgggctcaacgaattctttggctgctaaccattccaaaactcattgccaaccggatgtagccaatttgagaaaatattcggcatcgacgctgcctttggcgcaattacggcagaaacaaattgtttaccaggagtggcagtggcgctatttaatcggaaatggcggtgaggcgctggccaaaatggtgcgagaagtacaggaagcaggcggacaccagccaaatgttctgagctacggctataaagaggtcggacggctccatttctcgggacccgtcgaagctgtcgaagaattgcacaagaaaataactgctaagattagcctgttgaacaaaaacggctcaatgatgaaggacagcattagcatggagaagcaattccattgtcaagtgatcggaaagggcggcgagtttttgcgaaggctgaaaaggaagcacggagtgaaggaaatcaatgtgccatcagagttttccaactcggaccagattcatattgaaaggccctctctcttcaagcttcgctcatgtaaagacgacctgcttaaactggtggatgattggcgcaacgattgctacgaggaggtgccggtccagcgtcgttttgtgccgatgattcggggaaaaaattcg

SEQ ID NO: 90288 - DNA, 1205 bp, Heterodera glycines
  SCN-specific regions: Sequence locations=1-80,102-1205
aacacatagacgagagagtagtggttagagaaagatacaaaagggcgccaattcaaacacacagtgaatccccaagccgatttatttattttttacagactatggtactccctctgactgccgccctatccaaattgctaagctgtaaacccgaaaatttatcagaatatttgaacaaccccgaggcggtgaacaaagcgaacgcctacctgtgtggcaaaaaactcaaaacaacctatcagggtcctgattgcaagaccaaagatgtcaaatttggcacattttcgctgaaacctgccgctgaaacctacgcctttgagggatttcttggcaagtttccgaaaattctgtttcggtccaacaccatgcgttcagatgtcaaagtccaacagtatttctacataaaacaccggattcgcctactgtaccctcagctcaagtgcattgttgagtaccacaacaagggccattgcaaatactacccattgggtacaaatttgtatccgaaaaaaataaaataaataaaccccattaagagttgttggccattgaggagggctgtgagagtgcacccatcgaaaaacctgccgctgaaacggactatctggactacttgaactttcgcagtgggtggcaatcagcactctactgatcaatgaagcgtgcgagacaatcggaaaagttgggcgccttccctgagattgagttcgccgtcaacacaatgggcgtcacggtgtattgcccacggcacctgcaaacgcctcggtttgtgccatgggaccagcccgggcggtgcccgagctgcagaagcggaactgttgagctggactacatcatccagcccgagggggtgaccatcttttcgaatcggctaaagacggacggcgagaactttgtgccatttgacgcaattggtaagcttctgcatctgtttgccaaaaacctaacccttttcttaagtggattttgccgatcgtgctaaattccgcataagggcacggaataaggtgttcactttgccgctgcgacacccggaggtccacgccgcaggcccgagcttggaagaagccgtaaaagaacagaaggaaatgacgcagatgccataagcattgtccatttttccattatttttggtcttgttctgatggattacccaagaataatcgaaagtgaactcgcttttctcatcccttcggggattattg

SEQ ID NO: 90289 - DNA, 600 bp, Heterodera glycines
  SCN-specific regions: Sequence locations=1-600
ctggcattctccagcgctatgaaatgcaacagtttcggctgagttgcgccaatttcgagtcggaatcgagctgttgctcgacctcacaacagatggagataattgtcgactccgagtcggactccaatctgacgcggtgtccgtgttgtcgctgtgcccaagtgaatttgatctgtgccaactgtctgaacactaatgatgtccgaattggcaaagcgcgggaggacaaacggcgtctgttgaggagcaaaagtgccatttgccatctcatccagaacgcactcgccgacgaaatcaaattcgagggtgaatttcaccacctcagtcgctccattgaagaaattcgggcgaaaattgcgcacaaaaaggaccaagttggacgacttagacaacgcatttcgcacacggaaagtcaaagtgagcgcaatcgacagaatgtgctccttctcgagaagaaaatggtaagccattcggaccgaatcaatcggacaaatgcgaagaagacggagctgcaaaagcagttgatgaacacaaaagcgaagttgaacacccaaattgtgcacatcgcccgcttcctcttccacttgctccgcctggaga

SEQ ID NO: 90290 - DNA, 682 bp, Heterodera glycines
  SCN-specific regions: Sequence locations=1-490,513-536,571-682
gtttgagaagctattttacatgaattaagacaacaacaaaaaaattatgtctggtaaagtgcattagtacccgcttccttttggtttctaattcgccaacactcggaggaatgccaaagaaaagaccttctcttgcgcttcttcggagaggtgcgagtgttgtcccttcccccgagattcactcggcttcgtcgagtctcgaaagtgctttctctttccaccaacaaaacgtaaggacagcctttctgttcggcaaaaacaatgtcctcgcattttctggcgacagagaagcccctggttatttgtcgcttcatcatgaccaaaatcggatgcttattctcaaatggattccgaattcgcttctcctttcgaaacccgggggttcaacaacaaatgctgtcaaaagtccaagtcactcatcgcattgtgtgccggtgtcgattaaattcgagaccgtttcacatttgcacttgcataaaaatgagggcactctttcatcttcaattgtccttatcgattctgatggtgttcaacagttttgcttttcgttctctcttgagcaacattgtttctcctttctgaagacgttggaaggcgcacttttcccacttttcaaaatcgaccccccattaaattccattaaaatcgaatgcggtgccacaggtcgtccactaatgggaat

SEQ ID NO: 90291 - DNA, 877 bp, Heterodera glycines
  SCN-specific regions: Sequence locations=1-71,93-199,222-370,392 -621,643-667,689-877
accacgaaatacacgaacaaatccacgaattttacgaagtgtccccggaagaagtgaaagcaactgccagaggaattctccagagaggctgcgaatccatcttcaaacgtatctttggagaatacaatgcggaggaaataatccagatgcgcgacgaaggagcatccaatgttgaaattgaggagaaaatcacagaggcactgaaccaaattcgaagtccgcagaagcgacaggaggccggccgatttgcgatgtcatgtcgccgaatattcgcaatgattgaacgtcgtcgacgatcggcggataacgccgaacattcgctggatcaactgttcaaatcgcatttgatttggctgaatgagcagcaacgggaggagctgaagcaaatgaaagggtccggaaagggacggacggaaatgcagcagagagtgatggaatggtacggacagttggaggggcaagagaagcagaaagcgcgagaacacctgcgggacggatgccgggacatattggcacaagtgttgggcaaagaaaaggctgaccaactgaagcaattgagagaaggcggcatgagcgggacggaattggaagcaaaagccaacgaaatggtggaccaaattcaggaggaggagaagaaggcgaaggccaaggaatttgggacagtgtgcagaaagatactgctggaagagtccgattgaacacggcggacgcatcgccagcgcacacttccgccgagagcactgctaacgcaatgctaacgaactctgacactcttccgattcgtcccattgttcactcattggcatttcacttcccatttttccattgtccgcccgccattacttttacgcgcattctttctaaaatatccgttctg

SEQ ID NO: 90292 - DNA, 1122 bp, Heterodera glycines
  SCN-specific regions: Sequence locations=1-168,190-1122
ctctcctataattttgggctttcaattcaaaaaaatttcgccatccctgtgcgtaaatgactaaaaaaggcgacgacgaaagcggcggtgaagcagcggcggcaattcgtgtgctcgtgacgggtggcaccggactggtcgggtcggcaattcgacaggtggtgacggaggaagagcagcaacagaagccccagcggttgcaggagcagtggtttttcgtgggcagcagcgagtgcgacctgaccgacttggagcagacgcgggcgcttttccgccgcgttcggccgacgcacgtggtcaatttggcggcaatggtcggcggactgttccacaacttgcgccacaacctccaattctttgtcaagaatttggcgatctgtcaaaatgttctccaatgctgccatgagactgacgtggaacggtgcgtttcgtgcctttccacgtgcattttccccgacaaaacgccgtacccaattgacgagacaatggtgtacaatggaccgccgcatgacagcaattttggctattcgtacgccaaacgaatgatcgatgtgctcaaccgcggatatgctcaggagcacaatcgaaagtacacttcggcagtgccgtgcaatatatttggaccgcgtgacaattacaatttggagaacgcccacgtggtcccggcactgatccacaagtgctttttggccaagcgcgacggcggccctgtggtgggtgccggctcgggcaaaccgttgcggcaattcatttactcgttggacctcggccgtctctttgtgtgggcaatccgcgaatacgaggacgtggaacccatcattctgtccgttgacccttccgacgaagtgacaatcactgatgtggtcaccgccattgtcaaagcaatgcaatttaagggcgaagtcattttcgacacgaccaaggcggacggacagtacaaaaagacctcgtcaaatgctaaactgcgcgcccggctgcccgacttcaaattcacgcccttcgaacgtgccattgcggagtctgtgcaatggttcgaggccaattacgagaaggcgcgcaaatgaacgaatggacaaacggccgacggacaaacgaccgaaaattcttagtgatagacaatta

SEQ ID NO: 90293 - DNA, 600 bp, Heterodera glycines
  SCN-specific regions: Sequence locations=1-600
atctcttttatctccgactcatctgctgaatgaaacaagcctgaaccttagatgcccatattgcccaaagaaattcctaaagaatactgaagccatttctcacatggatccgtgtctgaagagtcggccttacccttgtacgaactgttctaggcggtttaaatctgcgcaaaatttgagccaacatgagaggattcacacaaatgttcgaccttataattgccagtattgtgagaagaattttactcagaagtcacatttacaacagcacgaacgcatacacacaggtgaaccggccttctcatgccgttactgtggcgagacgttcaatatttattcatccaaaatacagcacgaaaaaagtatttgtggccttcacgaggccttggacaaacagaaagaaaattcgagtgaaaagaacggtttcgcaaagattgcaccacttcctcaaccgagcaaaacgacgccgaccgaacaatcatcgtcacggggaccagcagtaagaccgactgtgagaacagcacacaacggcactattcacgacagattaacattttgccgcaaagactcagcctcgatgacccatctctgcgtctcatt

SEQ ID NO: 90294 - DNA, 785 bp, Heterodera glycines
  SCN-specific regions: Sequence locations=1-82,104-130,152-166,191 -551,573-785
aaatccttgcctaagaatgttggtattaagatgtttgccgattaccttatacagtggtcctttatctgggtgaaaataacacaaaatttatttattttcttgatggcgaaccattgcagaaacaaaaggatttgggcattttaatcaatcaaatccttttctaaccatattaataaaattttaaaaaattccatatttttcttgttatcagcttcaccgaacattaaaaactcgaagcttgaaactttaatttcggcatataaaagctatagcagaccatagttaaaatacgccaaagaaacttggaatctattaaaaaaagaaaaatgcacgcaaaattgaagcagtccaaaaattttacaagaaaagcattcaaaaaagtggccttgttcccatgccggatgaagaaaggcgtgcattttcacctctcgtcccaaaaaacgagaggtgagaggcgagagtcccaaaaatggcgagagttggcgagagacgagaggcgagggttgtcccacccctgatatgaaaaccgattgaattcaattcactcaaaagttttgaaataaaatgcaaaattcgaccaaagacccagcagcagaaggaaattctgccgatgtgatttgtttgggtcagaatgagggggccaccaatgctgaatcatcatcagccagtgatccgcaacagcaaaacattttgaaggatttttgtgaaaagtttgcctcgttggaattgaattcttcgcagcaactgtccatgattggggaactcagagcagataataacaatct

SEQ ID NO: 90295 - DNA, 802 bp, Heterodera glycines
  SCN-specific regions: Sequence locations=1-107,181-509,531-612,634-802
ctttctctaaacaaaacgaacatttgccagcagttggctcaggacaacggcccaaagagaagtgaagtgaattgcctctgctctgaacactgatgatgatggttcgttcttcctcctcttccttttcccttccgtcgtacttcctttctctcctccccctccttctcctccttttctcccaatgttcccaaatttcttttgcttgccaatgccaatgggccccgccaaaggacaattattgttcctccgattgggttgcccacgtgcaggtgatcaaacgacaggacggcgtgcgaatgccggcggggatcaccgaccgacagacggacttaaactcgcgacacgaagtcaaatatttaaggatgtttaagatcagcaaacaaatgccggtcaatcagcagaaccaagtgattctccctgtcaatgtttatacggccaccgaggatgccgcctgtggcattttgctcgagtcgggacaccaatatttgttggccggcgattacgtcaacggcacaatgctcaccggactgtgccggcaaattctgctcgaagaccttaaggagtcacgaaagcacgacattctcgagtggacagaagtgccgcaaaagctgaaagaacagctggaaaagcaggaatttgatcagaaatgcaactgaacagaatggaaaaagaaagagaggacaaacaattgcaaatgaatgatcagaaaaaatcaaacggacagagaaatggcccaatcgggcactttttgctgaacgaacatttccaataaacgacgaataaattagcctattggcaaaac

SEQ ID NO: 90296 - DNA, 781 bp, Heterodera glycines
  misc_feature (752)..(752): n is a, c, g, or t
  SCN-specific regions: Sequence locations=33-687,744-781
cctcgttccgaattcggcacgagggtttgagttccatcacaaaatgtcatcggcagagcgtaaaattgacgtgaatcggactaattattcagtggttgactccgaatttgattctatgcgtgaacgctttgagaaggaaatgcgccgagtggacgaggaaatgcagcgtcttcgccacgagttcgaggggtaccgccccgccgcttcgcgttcttcgccttatacaacggcgggcactcagcccatttatggtggaggaagttcactgagcaatggcgcgggcggcggggcgatggcgcgccattcgccgacttacgacccgtacttggaaaacctaaagagcccactgatcaaagacgaaagtgacgggaaaacgttgaggctcagattcgacgtcgcccaatacagacctgaggaagtgacggtgaaaacggtggacaaccgtttgttggtccatgccaaacacgaggagaaaacgccaagccgcacggtctatcgggagtacaatcaggaatttatgctcccccgcggcaccaaccctgaacagatcagctcaactttgagtactgacggcgttctcaccgtcgaggcaccgcttccccaattggccatccaaaaccattaaagaaaacggagaaaacaatgaggagagaacagagcgtaattttttttgaaaattacttaccgtccccacatttgtcatcttcaaaagaacaaatttatttttcaattgccttttaaaattacatggnctaatgtgagaataaacaattttttgggc

SEQ ID NO: 90297 - DNA, 417 bp, Heterodera glycines
  SCN-specific regions: Sequence locations=1-4,34-385
attcttttaaattttttaatttttaattattttggctctgtcaacttcaatttgggaatgccttctcatacacttctaattctttgcttgctcttttgctttgccttaaccaatggaaatgccaacagtgacaacgacgccgaagacactgacattgaatcatttgtccgcgaaaggtgcgactcggcttgtgaggaccccggcgaaacatcggaggagtgcgcattcgtttgtctgaactgtgtccaaacagaatgccaacactgcaccaatggcaccgaatcgaatggtggcacaaaggaaaaatgccaaaaatgttttgaagaaaacaaagcaaagtgtgtacagtaatattgactaatcttaaaaataaatgaccaatggcaaaaaaaaaaaaaaaaaaaaaaaaaaaaaaaa

SEQ ID NO: 90298 - DNA, 489 bp, Heterodera glycines
  SCN-specific regions: Sequence locations=1-395,421-454
ggcccctttcatcaaccccgacgagcagtcgatgatcgactggcttcattaatttcggaccgataaacgtgggaatttcggttcctcccgacatgaaaccgtacaaatcgggcatttaccatccgtccgatttcgactgccaatttaaagtggttggcctccattcgatgcttgtagtgggctatggagaaaatatttatggagacaaatattggatagtaaagaacagctggggacaaaaatgggggcaggagcacggatatctgaactttgccagaggggtcaatgcgtgcggaattgaggacgaaccaatcggactgatggcgtaaaggaacggacggaccaaaacatttgaattgaagagaacagaaaacgaacaaacaaagttaatgacaaaatttatttttgtattgaaattctaaatacgaaaatggaaattaattggttctattgtaaaaaaaaaaaaaaaaaaaaaaaaaaaaaaaaaaa

SEQ ID NO: 90299 - DNA, 813 bp, Heterodera glycines
  SCN-specific regions: Sequence locations=1-438,460-623,645-813
ggaagttccattagagtgaccatgaatatcaattcttcgtctctaagttccttgaagggccgcgacctcactctcaaaccggacgtatcaaaaccacgctgggatcagtcgacttatcaaggccgggcgcgacactttttcgctgtgttgaatcctcttaatttgtttacctccaatcaaggattggaagaaagtcgcaacattgtcttagattatcgaaaaggcattttttccccagaattaacagttgagcgtttatggaaggccaaacatctgtatgaatcagcttatcatccgatgtctgaccaaaaaatgttgccttttggtcgaatgtgcgcccaagtgccatgcaatatggttttgatcggtggcatgctcagtttttataagtctccgttggccgtcgttttttggcaatggaccaaccaatcattcaacgccgtcgtcaattacaccaaccggtctggtgactctgtgagcactgaccaattgctgaaggcatacgcatgcgcaacgggcggggcattaaccgcggctttgggattgaatgccgcggccaaaaaaatgccgccacttttcggtcgtctcgttccttttgctgctgttagtgttgcgaacacaataaatgttccgatgatgcgacgaaaggaatttactgacggaatccaattagttgatgagcgcggcgttcccctcgcaaagagtcaaacggtggcatggcacgcggttgcgcaagtggtggtcagccgagtgctcatggcaactccgtacatggtgctcactccccttccccgtcaatcagttaacaaaaaa

SEQ ID NO: 90300 - DNA, 960 bp, Heterodera glycines
  SCN-specific regions: Sequence locations=1-960
ctccttctcaagcttatccaggcgggcattgtcgatgattgggatgatcctcgtctgttcacgctgactgcccttagacgtcgcggagttccgtccgagacagtgaacaagttcattgcccacctcgggctcaccgtggcccagtccagcattgacccggctatgttcgacgcctttttacgcgatcatttgaacgttactgcaccgagaacaatggcagttctcgagccgcttagacttcgcattaccaattatcgagagttgggttttataccagcgaaaagcaccttacgggtcaaacaattcccatcctcaattaatgaaagtacggacgaatgggaaattgcatttgacgagtttgtctacattgagcaggctgcttttagagaggttgccgaaaaaagttatcgtcgactgacattggaacagccggtgggactgcgtcatgtcaatttggcagtcaaaattgacaaactggagcgggatgagcacggaaatcccatcgaattggtggtaactgcgaatccggtgagtagtgagtgtaagccgaaagcattcattcattgggtggcgagaccggtgctttgtgaggtgcgtctctacgacaaactatttgtacacaaaaatcctgaggaccctgccgaagtccctgggggttttttgactgacataaacccgaactcgctccatgttctttcaaatgcaatggttgacggaagtattattcgcactattcgtccgttggatcgctttcaatttgaacggaacggctttttctgtttggatccgaatgattcgtggtcgagtgagaaaaaattcgtcttcaatcgcatcgtttctctgcgtgaggatgcaggaaaaaacatttaaacttttccctgcttttttctgtttatttttatttattagtgcattttcattgttttgttgttgatagataaattgttgactctctaaaaa

SEQ ID NO: 90301 - DNA, 746 bp, Heterodera glycines
  misc_feature (719)..(720): n is a, c, g, or t
  SCN-specific regions: Sequence locations=1-716
ttcagtaatttttccaaaatattaatttaattctcatctattggacaatgagaggcgaggctaaggacccaaaaggcgaagcaacggcagaagcggtttcagtggagaagcaacaggaaatccttcttatgaacaaattggcttctactggcaaactgccgccaaaatctgctagcaattttctccagaaaaagcttcaacaaagaaaatttttcgattccggtgactacaacatgaacaagaacaagcctattccaccgccgataggccagaatttgactgctgccaacactcccaaactggccgttccgattgaaactgaacccgagaaaaaaatggaagaatcagctccgattattgtatcgcaattgctcccaatgatgcgtcccttggccggctcaatttcgggttgttcgatggatggcggcgaatctgacgatgagggcggacagcttcagattcctcgacctgacacagtgccgcagcgcaaatcgtccattttacatccgtcagcacatagcaaattgagtcctcaaccgcacattcaccacgaacacactgacgagtcgttgaccttcccccagtcgtaaggagtgaaccgaaggcgaaaggagcgcaaatcgaaatggtgatcttccaacagcaattatagctgagatcggctttttgtttgatgtaaaatttacttggacttttgaggaatgacttttttgggcaannaaaaaaaaaaaaaaaaaaaaaaaaaa

SEQ ID NO: 90302 - DNA, 817 bp, Heterodera glycines
  SCN-specific regions: Sequence locations=1-307,329-817
gatcatagaacatacaatacatcattatgcttttacttgcctccctccgaggtccgtgtcgtcgtcctcgcgttctcaaaacgctgcgctctcttaaagtccctcacttttccacaatgaaccgtgactatgtcattgaaactgtgaatttcacttccgaacgtgactctgtgttcaaattcttgcaagaagtgtttttggtcaacgagccgatcacccgcgtcatcggttgcaccccctcggacacctcaccaatattcgacgacatttgtgagaagtgttctaaatttgatttgtcatttacggccaaaaacaacgatggaaaaatactgggagttctgttgaatgcgcccttcaaattggaaaatattcacgaaagctacagagacattgggcgcatgccgaacaaaaaggaattcggagaagagattcgcaatggcccttttccatctcaaaatgccaatcgaatccacgccattctcactttcgtgaatagtcatatcgcactgttgccccccgaagaggatatcaaattagtcgaattgcaggccatggctgtaggtccaggacacgccaggactggcttgggctccggtatgctccgtgcactcatccaaacggcttccgcaaaaggctattcccatttgttcacctgtgccaccgccatcgcctctcagacggggcttaaaaaatttggctttgacgagatcaaaactgtccctttcaactcttttctggaggacggagtgcaatcttttctggggttcacgacaacggagtgggcgcaaaacttgtggcattgcatatctgaagtctg

SEQ ID NO: 90303 - DNA, 740 bp, Heterodera glycines
  SCN-specific regions: Sequence locations=1-740
gaccattagccgtcattgtcgcgaaatgacctggtcgatcatcttactcgatttgaccgcatttttgagcaagttgcttcgcaagtgtatgctctgaatgattcggcagagaaactgcgcgacatttttgtggaacaccgacaaaaattgggtggccatttcgcactgattgacccatttgagaagcaaaaagagcggcgacgactgatcgacgcttattcggcactgaaaggcatcgacgcctttccctcttcgaatgcgcttttgcaacttggcgaatattttccgaagcaacaaccggggacggcacagccccaatttgggatgactcagttcggtcagccctctgttggtggtggcctttttagtgcctcaaaagcgcccgccttcagtttcgccccctccgctcaacagtcctccaccaatctcttcggcacaccaaaaccaacgccttttggtatgccaaccacaactgccacctcgccaagtcctttcggtgctgcggcagcagtcattccaacttcggctggcgcgtccgctgtgccgtcgcttttcggcacttccgtctcttccgccggcggttcgtccgccccttcacagccgacatttggcgggttcagcaacacgctcagttcggcaagcagcgggacgctcttcaaaggctcggcacccgccaaaccgacaaatcttttcggcagtaaatgatccaatggcctattccttctatttgtttttttttg

SEQ ID NO: 90304 - DNA, 492 bp, Heterodera glycines
  SCN-specific regions: Sequence locations=1-216,241-470
gtccctttaagcagcgtgaggatgactttgaaaatagttagttctcttgagaatttgatcagattgactccggatgtccattcgattcttgtcctcgatggggacggagttccggttgtcagtgcaggcgaagagatacgaaatcggtcccagtattcaatttcttacaattcgcttgtcgagcaggccaaaaagttgggcatgggagaacagaaattttgggtgtttcgctacgaaatgaaccaggtggttatgctcaggagggatgcatttgccgtattcattatggcttctgcaaatgccaatatgggaattctctgcactatgtcagcgcaacttggaccaattttggaggaatgtaaagtcatcgtaaacgaagtcataaatggacagatggccgggcaaagtccgagataaatgaccaaatttttcttgtcgagaattttacatcataaagttttaactataataaaaaaaaaaaaaaaaaaaaaa

SEQ ID NO: 90305 - DNA, 642 bp, Heterodera glycines
  misc_feature (631)..(631): n is a, c, g, or t
  SCN-specific regions: Sequence locations=1-352,374-642
gggacgtggaggaccaattgttcgacttttacacgcccagcgagccgaaaaagaaaaagctcctccaccatccgtcggccgccgcttcgcccgtcggtgcgcgttcctccctctccggcactcgcattggttcacttgcgctcggttcgctgactctcaacgcggcgcccgacttggaattatattctcccgctttgccaccctccgcttctttgaacgccgttgcgccatcgaaatacggtccctcgcccgcagcgaactcttcggcacggcaattgctcggaggaggggcaaggggcggagattctgttggcagtgttccgtcggcagttgcgcctgacgaatgtccgctgaagaagaaatacgcgaaggaagcgtggccagcggaaatgagaaggcgttcgggcagcattctctgagcaaataagcaaatgaactcgaataaaactgcaaagtttctgcgaaacaccccattttcttctgttgttaaaattgtccgttttatccctcccttttcatctcattcattcctttcgctcattcttctccatttgtgtgtattttgtttgctatttttgtttgtttgttccattttcgttcgaataatttttgccgattaaattttcttttnaaaaaaaaaaa

SEQ ID NO: 90306 - DNA, 582 bp, Heterodera glycines
  SCN-specific regions: Sequence locations=1-582
attccatccccttataataaatattacttccttctcttccgaattctctattaaaatttgattgccgtgcaaaaaatggacggggacggcgacgaaagctattgcgactcggacttggagttggagcggagctcgtcggcgaacaatgtcaaccaactgacgttggtgcccaccgaattcacttccattccggaggccatgcagaattttaatgccgattttgactcgagatacggggcccagcatgcgccgttcttccatggatctctgcaggatgccattgccgaggcgttcgactcgcccgcgggtggcgctgaacatcgacggcctttggccatttacctccacgacgaccaatcagttgcggcgcacatcttcgctcaaacggtgatgtccaatgtgaatgtgagcaacctgctcaagtgtcagttcattttgtgggcttgggacgtttcgttggcggacaacaaaaagcatttgttcgattggttggagttggccaacctgaccgaagtgtccaactacatcaaaatggtgccgcgttccgaatttccgatgcttattgtgctgatcaaggatcgt

SEQ ID NO: 90307 - DNA, 660 bp, Heterodera glycines
  misc_feature (651)..(651): n is a, c, g, or t
  misc_feature (657)..(657): n is a, c, g, or t
  SCN-specific regions: Sequence locations=1-130,154-207,229-271,295 -406,430-660
aaccgctctaaaaccgccgaaatgcctcccaagagtaaaaagatctctccaaccccaagaggccggctcctacggtcctcaagtgcgtgaaggcgagctcgtcttcagcgttgcccacatcttcgcctcgttcaacgacaccttcgtccacgttaccgatctttccggccgcgaaaccatcacccgtgtcaccggtggcatgaaggacaaggctgatcgtgatgagtcgtccccgtacgccgacatgtgggccgcccaggacgttgccgtccgctgcaaagagctcggcatcactgccctccacattaagctccgtgctaccggtggtgttggccccgccacccccggacccggtgcccagtcggctctccgtgctcttgcccgtgccggtatgcgtattggccgcattgaggatgtgacccccatcccgaccgattcgacccgccgcaagggtggtcgtcgtagtcgtcgtctctgagcgcgcacggtgggctattgctgttcttcaacacattggtctctgttgctggctggtcagaaacacacccatgggagtggagcgcagtcgtgtgtgaggttgccgtgtcgggttgaggtgtcattttcttgttgctttgcctgtgcgaacacaatacatacatggccgctgcngaaaanaaa

SEQ ID NO: 90308 - DNA, 626 bp, Heterodera glycines
  SCN-specific regions: Sequence locations=1-409,445-626
gtcaaatctcgtcaaaatgtcgctcgttgtctccgaaaagggctcgttctcttacatcttgcgtgtgctcaacaccaacttggagggtaagcagaagatcatgtacgcccttacctccattaagggtgtgggtcgtcgctacgccaaccttgtctgcaagaaggctgaggttgacaccaacaagcgcgctggcgacatcaccgccgaggaactcgagcgcattgtgaccatcatccaaaacccgctccagttcaagatccccaagttcttcctcaacaggcaaaaggacatccgtaccggtgagtacgcccagaacgtgtccaacgctgtcgacaacaacctccgtgaggatctcgagcgcctgaagaagatccgcgtccaccgcggtctccgtcactggtggggcatccgtgtccgtggtcagcacaccaagacgactggccgtcgcggtaagactgttggtgttgccaagaagaagtaagctccattttggtgccgaaaatttttttgtcgtaccgactgctctctgcctcggatttcatgtctttttgtcgtgtgtggcgtatgggttttcacatcacaatacatccgcaaatggatcatgcctgaaaaaaaaaaaaaaaaaa

SEQ ID NO: 90309 - DNA, 856 bp, Heterodera glycines
  SCN-specific regions: Sequence locations=1-195,217-823
accctttaagagcaatttcattataccgcgattcgcttttttccctcataggagtgacaaagatggagccgtcaaatgaaaatgttaacggggacaacgtgccaaacgccgcgttgaagggcgggcatccgccggccgaaaaaattggttgcatgcgcattgcacgcaaggagcgcaacctgagccaacagccggaggagcgggagaagagcggcggcaccacgcccgcctcggcatcggagagcggcgactcggcgcacagcgagggcgagacgcgtgtgcggccgggcgcaaccaatgtgcttgcgtacaccgacttggccaaacagaccaagttggattatccgactgatgcggtccgccactgccatgagaagccgttcccaagcaagcaggcatacactgcgcaccgtaccaacgcggcgcagatgcaagcgcaccagcagttccagccaagacgctttggacacctgaagttccagacacgcgagtacggcccgttgcacaaacagtgagggggaaaatgaatagtgccaccgacggatggatgggagagggatgcataggaaaacgatcgacggatgatgagataaaattgggcgagagcaaacgacgacgagatgccaagagttgtttattttgttgttttgattccagtgtctgatggagcactgcttttctctttctttcttttctgtcatttccacacttttcccttccttttttcttgacatgggccaaaatgttgatgattgttttcgtaacaaaacttcaaattgtacaaatgcaacatttctcatttatagtaaattattttgttttgaaaaaaaaaaaaaaaaaaaaaaaaaaaaaaaaa

SEQ ID NO: 90310 - DNA, 656 bp, Heterodera glycines
  SCN-specific regions: Sequence locations=1-8,34-73,101-537,559-634
cttcgtgaaaaattcggcacgaggaaaaacatactattgtatacctgataaatatgtgcatcttccatttctcgctttttaaataaattgttttgaaaaatttaaccgacctagacagctttatacaaatgataaatgaccttgggttccagagagctcgtcaacttgagacacacattgaagttttacgccgcaaaattgaattattgcgagaacagaattatcggttgttggagaaccgtcttctgagagaccagaaccaacttctgagcgatcagaaccaacttctgagagaccggaaccaacgtgtgagcgagcagatccaacttctgagagacgccgctaacgagcgccggcaggctggcggtggcatcgacgagggtgccaacgtcggtggacaggccgaaccaagtgaccgtgatgccactagtgccgaaggacagcgcgagccgaacggtggtggcaacgatcgtgatgcgggtgccaccaactgactggcatttacaagaccgagagaagcagtttcctgttgatgtaagaacataaacaaatgaaaaccatccactttttgttgcagaaaatgtattagtaagatcatacagaaaaatttaatagcaataaaaagatgtgtgtgaaaaaaaaaaaaaaaaaaaaaa

SEQ ID NO: 90311 - DNA, 471 bp, Heterodera glycines
  SCN-specific regions: Sequence locations=1-131,199-471
ggtttcattttccatccaaaatcaaatctttgacctttgaatttcaacccttcacccatgccatttgtaccttatcggctcaaaaccatggaggagcaacaacctctggcactgttctactaatgaccgggacaacatcagcaacaagcagcactaataacactattaatactaataataacaacaacaacggtaacagtacctgtgtgaaagggtcgtcaacaacgcatacggtaacggcgcctccatcggacatcagtttgacagagcggatgaagcatttgctgaacacgggcaatgacgcggatgtgcactttttggttggcagcgatgacaaaaaagagcttcttcctgcgcataaactgattttgaagacggcctccaatgtgttcgaggcaatgtttcgatttgacacggaaaacttgttccgtccggcatgttgaacaaggacgagctgatcagcgtgtatct

SEQ ID NO: 90312 - DNA, 836 bp, Heterodera glycines
  SCN-specific regions: Sequence locations=1-396,418-445,468-500,524-836
ggaccatctaaaggcgcattctctactaccaccaccccgacctccccaatttccactacggtccgcagcatccgatgaaaccggcacggttggcggccactcacagtttggtgctcaactacgaactgcacaagcatttgacgtgtgtccatccgcccaaggccacccaacatgacttggcccgcttccatgcgcccgaatatgtgcagtttttgaagcggatttcgccgctgaacgcggatcagtacgagggactgttcaatcgctttaacattggcgaagattgtcccgtcttcgatggcattttcgacttttgttccctttacaccggcggaacgctcgagggcgccattcggcttaaccacggccaagcggaaattgcgattaattggagcggagggttacaccacgcgaaaaaggccgaagcatcgggcttttggtacggcaacgacattgtgatcggcatcatccaactcttgaagtgccatccgagagtcctttacattgacattgacattcaccacggcgacggcgtccaaaaggcgttcaacctcaccgaccgggtgatgaccgtctctttccaccgctatggcagatatttcttccctggcactggcgacatgtacgacgttggcatgggccatggccgctatttttcagtgaacgttccgctgagggaagggatggacgacgaaagttaccacagcgtttttaagcccgtcattcaggccgtcgtggacaatttcaatccttcggtgattgttctccaatgtggcgccgattcgttgggctccgatcggctcggctgttttaacctcagctttgacggccacggg

SEQ ID NO: 90313 - DNA, 363 bp, Heterodera glycines
  SCN-specific regions: Sequence locations=1-341
gtttcttggtcgttactacacggtgtttgatgtgggccaaagtcgtgttggttttgcgcaggccaaagacggaaatgaaattccaattgagcctcaagtgcgcgattgcgtaaggggaggcgcactttgctttgatcattccaacggagttgacgattctgatcagcagatggttgagggcgattttgtaatgacggactgaagaaaattgattttatttatgcaattttcagttttatacaatttttaatccatgacgaagcctatgagtaaactatttttcctagtctgataattgtaatcaccatgtaattatcaatcgatgtgataaataaatcattaaaaaaaaaaaaaaaaaaaaaa

SEQ ID NO: 90314 - DNA, 430 bp, Heterodera glycines
  misc_feature (9)..(9): n is a, c, g, or t
  SCN-specific regions: Sequence locations=1-65,103-430
atttcctanaatgtccggaattgatcaatagagttttccaattcccccaaatcccgtgctgtgccttaaaattgtttttaaattcaaaaaataaataaaaaacacttgtaaaagtttgtatttttgccaaatgccccaaggtttgacaaatgatttgtggccattcagctgagtaaagcctctccaattggtccgcatgaatcagaacttttcttattgagttccccgtcatgtcctttttctgaacgcttccctcctgccctgatgctccggaaaaattcgttcgcaatttccgcgttttccgtcgatgcttcgagctctttgataagagcatttccaatgccctggaagacgtgaaaaggcgccagaattattcgttcaaactcaattgattgtaaaagtggctcatcgacagttcccatggtgagcg

SEQ ID NO: 90315 - DNA, 522 bp, Heterodera glycines
  misc_feature (519)..(519): n is a, c, g, or t
  SCN-specific regions: Sequence locations=1-45,67-108,133-522
gtccatttaagataagcggctctccgatctttttttggattcttttatttaaataaatggataacgaaaaatatgccatgcttgtgcgttccgttcacaaaatcgtttctcttgcggacgaactcattgagcagaacaacgagttgaccgaatacgtccagggtttggagttgcagggccagcaattgcctgacctcgaaattccggccagggatatggtttctgctcttttgcaaaactatagtggccagagacacgcgacgggtgttcaggcaaagatggaacttcttagagaggcgatcaacaatatttcgaaacttgccgatttgttcgtggctcgtaactgttacttgatcaagcgaattcatgcacatttggagacggaacgcttccgtaccaatgatagagggattaactgaacgaatactgatcaatcaaatgctttgtttttgaagacaaatctacaatatttttcatttaaattatggtttattagttatgaataattgaaaattttcncta

SEQ ID NO: 90316 - DNA, 860 bp, Heterodera glycines
  SCN-specific regions: Sequence locations=1-188,216-860
agggcgtgtttcactgctgctttttctgttccgtcgcaaaaggggcgatattcccgcggagaattaatcgagaaaatccgcacaacgccacgcgaccaatggacagaagcaaaacgaacaaagggagaagagaaaggcaatcgctggcagacatttcccaagaagtgatcagccaaatcctccgtctgtttcccttctcttcttcttccctccgcgttcacttctctccattctcttcgtccctgcttttccgtgctaagtctacttcatctgtccaacagctcaaaaagcaacaaaatatcccctcacaatcactttgtcgcgctgtgatcaatgacaatgcgaatgtacaaataatggaccgaattcgccgtgtcgcctcgaatttgtcgctaactgcgaagggacaaagagaacggcgacaaaatttggcattactttggggaagaggagaagcgaagaaagcgaaaaatggagaacaaaaggaaaggacgaaggaggagggggcattgagcaaattgtgtaagatgtccgtcgacacaatggcaatcactgcgcttccgctcgactgttggcttaaggaacggctcaaaaattgggtccaattgtccgggcacgaaggaacgattgtgcccgcctcaaatcacacgctttggaagaagcagccgaggggaaatcgggcagaggcccatgcttatgaagaaataatgagagactcggaattgtgcggaatcactcccaaattttacaaggaaatcgctcacaacaacgaaacattcatcgaaatccaagatttgctggcacaattcccaaacacaaaaagtcgtgccattatggacatcaaaattggcacacgcaca

SEQ ID NO: 90317 - DNA, 561 bp, Heterodera glycines
  SCN-specific regions: Sequence locations=1-219,252-459,481-517
gtttcatgttaaaccaattaattacagttgcacttgcacgttgcactttcttgatttcttcacaacaagaacatttcgcggtaaccaacgcgacttggccagggagcgcaatctgaagaaacagcaacagcaaaaaaagcaagagcagggcacgtccactgagaaacggatggaaagggacgcagaagcaatgcgcctaaaacagcagaaagctgcagcgaaaaaagccgaagaggaaaaggcaaatgcacaagcgccgaaggtggtgaaagtggaccctttgaagggactgtgacaagcgaaaagaaccactcggccatgggatgcacaaactgacgcttttccgtgctttatttagtcaatttttcgaattcttttcagcaaaaaccataattaacaaaacttctgcccataacaaaagcatcgcatttaagctatgtagttgaacgccttcatattctttcaaatgcttcatgtttttatatgtgtgttacgcttcaataaaggctatccgtttaaaaaaaaaaaaaaaaaaaaaaaaaaaaaaaaaaaaaaaaaaaa

SEQ ID NO: 90318 - DNA, 851 bp, Heterodera glycines
  SCN-specific regions: Sequence locations=1-205,249-409,431-790,812-851
gatgcttttcctcgcctatagggcaacattatgtaggaatttacgcctaagtgtcgtttcgaaagcagcaaataatgttgcggaacaggggacttcttcagtttcgggaaataaggagaatctgttaaatgcctatttacagctctccaaatgccgtctcaccgcattgatcgcttgcacttccgtcagtggttttctgatgtcccccgccctctcttccgccccctcctcccttttcttctcttgcgtcgttggcactgcgcttctttcggcttctgccagtacatgcaacaacgtaatcgaacgtcagcacgataaacagatgaaaaggacgcgttcgagagtgctgcccgtagggaggttgacgcccattcacgctttgctcttcgccggtgccacgggaactgccggacttggcatcctttgcctcagttgtaatcacctcacctccgcccttggcttcgtaaatctcgcgctttacgccggtgcctatacgccgatgaaacgaatccatcacagctgcacttggatcggtgccattgtgggtgccatcccgccactcatgggttattcagctgccaccggtcatctcgattcggccgcttttgtgctcggcgcactgcttttctcctggcaatttccccatttcaatgcccttagttggaatttacgtgccgattattcggcagcgggatacaaaatgatgtgcgtgacgaacgaaggattgtgcaaacggacaacattgaggcactctgtggcgctgctttgtctctgctcttttgctgctcctttcacacatttgaccacttggaccttcgctttcacttcactccctctaaacctttcaatgc

SEQ ID NO: 90319 - DNA, 850 bp, Heterodera glycines
  SCN-specific regions: Sequence locations=1-172,195-685,723-850
caatctttgattagcaaaaatggtatcagcaattgcacaatatttcctagcctttcttctgtcagcatccgttatcgcatttttctcgtttcttcttctgactgctttgtccattttcaaaccatggaccaaaaggaacaaatcccatttcgtcgccccccgttttcactttcgtccggaagaagaagaagaggcgaatgcgcagttcccttgcctgctgacgcgggaagagacgagttggaaggggctgcagcactcggaacccgaactttacctgtcggtaattgtgccagcgaagaacgaggaaaaaagactccctcggatgctcgacgagtgtttgaaatatttggaaaagagggcggccaaggactcggaatttacatatgaagttattgttgtggatgatgggagcaccgacggcacagctgatgtggccttctcctacgcacgttctcaccccctttttattctccgacttccaaaaaacgtcggaaagggcggcgccgtccgcgagggcgccctctgcgcccgtggccaattcattttgttcgccgacgcggacggtgcgtcacgattttcggactttcgaagattggagaaacaaatgcattcgctttgcaacggcgatgttttgccgtcgtcggagccgacggattggacacatccggcaattgtggtgggttcgcgagcgcatttggaagaggaaagcatgagcagaaggtcgatattgcgcaccgttctgatggtcggctttcacgttttggtttgggttttttcgggtcgaagtgtcagggacacgcaatgtggcttcaaacttttgagtcgtgccccggcagccaaactctttcct

SEQ ID NO: 90320 - DNA, 674 bp, Heterodera glycines
  SCN-specific regions: Sequence locations=1-131,153-674
cgtaggggaccgcctgaattgggaatagtttggaggaccattaacatcagttggcactgccacggcgttttcaaggcacttctctcttttgagtttgccaattactcccgtctgaacgaatccgaagtcgaccctttgctgctttcctgggatgttctgatgcgtttttttggagatttggacgtcctttcccgggttcgcttttgcgatgccatcgatgtcaaaaccctttccaatgcgttggcccatttgtttaattctctctccgaccccccggggcataaagatgccatttgcgttgtttctaatgtcgacgagcttttcgctggcccttttcactataaattggtggaccgtcctttcgatcgtgaacattttacgagtaatctcttcttccggactttggccacgatccccgctttgtttcgcgaatggcacggcactctcagcaaaacggaagcgaacacagtcaatgaatacacccaaaaatatttgagtcatttgcttattcaacgtgaattgcgcagtttggaaaatatgaaacgtgggcggttagaggtccgaattctgtccaaagtgcgtgagatcgaatgcacttatcggctggaggagacgacaatgactttgacaatacttttgcctgaaaattatccgatcaaagcgccagaagtgga

SEQ ID NO: 90321 - DNA, 641 bp, Heterodera glycines
  SCN-specific regions: Sequence locations=1-140,164-210,232-641
ttcctatctcccgtttctttgtgtttctgtgataaataaaaatgtcttctcattcttcttctgttgtggttgataattgttgtccaccatcacaaatgacaacttcttcttcccccgctgcctttcgttcttctgcgctcgcttttcttcagttcctcaacaaatcggtcacccctttccatgctgtcgaatcggtcgaggccattctgaagagtgcaaattttgttcaaaagtccgagtatgacaagcttcaaattcaaccaaaggatcgtttctatgtcaaaaaaagcgagacttccatttttgcttttgctgctggcggtgcctttaaaccgtccgaagcgggggtttccattgtcgtcgcgcacactgacagtccttgcttgcgcattaagcccgtctccaaaaagacctccgaacaatttcttcaagtcggtgtttcgctgtacggcggcggtctgtggcgcacgtggttcgaccgcgacctgagcaccgccggccaagtgttgttccgcgagtcggcggacgcggacgcgcccatccgacacaagctggtcgacctgcgccgcccgcttttccacattcccagcctggccatccatttggacagcgacccctccaagttcgagctgaacaaagaa

SEQ ID NO: 90322 - DNA, 539 bp, Heterodera glycines
  SCN-specific regions: Sequence locations=1-204,226-416,450-539
ggtctgtgcagcacgaccagtcgggagtattattttgtgattgtcggtcgtcaggaccaacctctgttcgagatggacttcccgccaaagaagcgcgagcagcagcaggagacgcaccatttgctgcagttcatcgcgcacgccgcgctggacattgtggacgagcagacacttcgcgagacgcaaatgtattttaagattgtagacaagttcaacgaatggtttgtgtcggcatttgttactgccagtagaattcgctttttgatgttgcacacgcaaaaaaatgaagacggaatcaaacaattcttccaggaaatttatgagatgtacatcaaattctcgatgaaccctttctatcgacaagacactccgatcagatcgccaagttttgagcaaaaagcggcgatgtatggacggaagtttttaggggtttaaaaaagaccttggaaatttaagtttttgttgccatcagatttgtgtattttttgcattacattattttatacgggtttaaatcttaaataaaagaattcgctttt

SEQ ID NO: 90323 - DNA, 858 bp, Heterodera glycines
  SCN-specific regions: Sequence locations=1-82,104-453,476-619,641-858
gtctctgttaacaccaatggataggttcgtctcatttgttaacactcaatcgtcgctgtctcggggggaaccggcgccacatatttgttgtacacttacattatgaaaatccaagccggccacagatatgaaatcggtgaccaaaccggcaaaacgtacattgttacgggagcgacgtcgggaattggtaagacgatagcgacggaattggcaatgaaaaacgccgaagttgtgatggcatgcagaaacagaaacaaatgtttggaagtgcggcgtgacattgtgctgaatacgaggaacaaaaaggtcttttgtcgaatgtgcgatttgtcagacatggaaagtgtacacgaatttgtgcggaaaatgaccaaaggaaaatacgacttcaaaaaaattgatggagttattttgaacgcggccaccaaaagcaaaaagtacagcaccaacaaagacggagtggagacgaacttggccaccaatcatttgggctccttccttctcgttggccttttgcttcagaagctgctcgaccaggacggacaatcgcgcattgtttttgtcgggacggacatagcgacgaaaaacagtctaaaattggagcttggcaaattgaatactgccaaatacacaaataaatttctccgttccaccgaaaaattggacatcgaaaaaggcaaatacgacatgcatggagcatacaaattttcaaaactaacgcagcttgtattcgcacgtgaattggccgaacgtcttgaaggtaataataaaatccgagcggtggtggccgacccgggcggtgcgaagaccaatctgaacaaggacgaaccatcgcagaagtttttcctaacgcgttgg

SEQ ID NO: 90324 - DNA, 661 bp, Heterodera glycines
  SCN-specific regions: Sequence locations=1-480,502-661
cttttgatcattttgccaaattccctcgcctccctttgccctttgatctgttcctttttgttttcaaatgtgcggttgtccaacttccgcaaatgtcgtccacagttcgcccgaaccaccaaccgaaaaaagtgccgagttggccaactcatcgatcagcagatcggtcggcaacatcagcacatcgcctgccaagggattggcctgctctctgtcggtcaaccaaacgttcaaattggtcggcatcggctgctgtttgacttgcattacgaactttcccagcgcatttatgcacacttcggtgaacactgccgtgatggagttgaactcgtacctgaacgagtcgtacacgaaccgcggcactcagctgaccgaccagcacttctcgctgctccgctcggccatcaacagctgctggtacgccggccaaattgtgggcgcactctgttcgccgcgtttgtgcgacaaatacggacggaagcccgctttacattttggccactgcgatgatgactttggcctgtgcccttgcaaatgtgggccaaacttttcccctaccccgaagtgatggtcctccgcccactgatggcctccgtcttttccccgatgggcgaaaccggttgccatccctttccttcaggaaatttcgccaaccattctg

SEQ ID NO: 90325 - DNA, 478 bp, Heterodera glycines
  SCN-specific regions: Sequence locations=1-478
gagacaagacagcaaaagagcttaagagggcgtttagggattggtacttacgaattggcgacggatgaagcgccaattggcaataagaagagtggaagtgaaaggtgtggtggcatttgcattatcgacccaacggatctgttacccattgagcggtacattcgccttcccagtggcgtttttcggcctgtaaaagtgccaacaaatgcaattacccctcttcttacgagtgaagttaatgataattcagcagcagttgctacacttaccgatggacgacttgctctttttacgactgaccactttgattcgattgccgatgattcggctacatttctgccgttttccacgactttatccagtggaatgatgttagattgtgcaatgaattcggatgggcgactgctatgttctgacaaatagggcaatctttttggcctccgttttgctttgaatggttttcatccacccgattttc

SEQ ID NO: 90326 - DNA, 642 bp, Heterodera glycines
  SCN-specific regions: Sequence locations=1-411,433-520,596-642
ccgtccttgaaaagtcgcctctcagcgacggttcctcttctcccaatggccctacgccgacgtgccgcgcttcgatggtcgactcaaaagcaattcgaaaggcgcactgtcaggtgtgcaatttggacatttgttcaaccgcacgacagcgacacgtttatatggtccatctgaagaagaaagatttgttcaaatgcccccactgcgaatacacaaattcgaattccgtgtgggaagtgcaaaagcacagccgcgtgcagcacggcaaagacgcgcgaccgatcagtcaggaggagaagcacaagttggaaattcagatgtggagccaactttgtttccccgaatggaaacagaaacggaaaattgagcacggcgactcgacggaagaggagacagcgctgaaacggcgcagagagggcgaaggcggcgctgaagtggacgacttgttggagggatttggcgaactgttggggcacattttgcagcagcaaaacgaagcgaaaaacaacggacaaatagcggaggaggagggagaagaggaggacgaacagcagcaggaaagcggaacaacggaggagcagacggaggaggacgaatggcgggacaacgcgtcaccaagtgacaaagcgccgacaacggcgg

SEQ ID NO: 90327 - DNA, 1288 bp, Heterodera glycines
  misc_feature (1281)..(1281): n is a, c, g, or t
  misc_feature (1283)..(1285): n is a, c, g, or t
  SCN-specific regions: Sequence locations=1-731,754-1068,1090 -1229,1252-1288
cctgcttcgaggaacaaacgttggaggcggtggtggaaatgcctcacgttcaatcggtgaagtgatcgtcccaagaacttcagtcggaataattatcggaaaaggaggagaaacaatcaaacgtttggctgctgagacgggtgcaaagattcaattccggcccgacgatccaaacctacaagaacgttgtgcggttatccaaggaacgccggaacagattaaccgtgctacgcagatgatctctgagctggtcactcgcagttccggtgggggaggacaacaggaaaccttttacatgcatgtgccggcgaacaaaaccggattagtcattgggaaaggaggtgacaccataaaacagattagcgcggagacgggggcccatgtcgaactgtcgcgagactcgccacccaattcgactgagaaaatattcgtcataaaagtgggcgatgttgcaccgggaacaccactaccatcttttcacggcaatgctggcattaccaatgccacaacgcctttggccgttggaaatccctacggacccacgccgcatcaagcttttagtgctgcgcctgctcagcaagacccttcggcttggactcagtattacaaccaacaacaagcgatggcaattgcggggggtccgccttcccaacctgcttcttttggtgccacgccggcacagcattaccaaacagtgcccgggactatgcaaactgctgtttcacaagcagcacagctccattcaacccaaatgcagcagcaacaaatccatcaacagcagcaagcgaccattgctcagcctcagcaagctgtttccgccggaatgggcgcagtttcttcttctggcggacctgcgattaatccgcaaactggacaaccggactacagtgcccagtgggccgaatactaccgcaccatgggaatgcatgaacaggccgcactcatcgaagctcagatgaagcaaacccacgccgccgctcaggcacaacgtcctcagcaacaactttacatgcaatgaaggcttgcagaactcgtcgaagaaagacaataatgtggctgaatttctggttatttggattgctttttctaatattatcagtttccgttcgatttcttttatatttaatcatcattacgaaccgttctttgactgatttatttgttttcagtttatatttctttcctttgattgagtttaactggttcgataccaatgttcgctgcttgcgtttcctttttcttgtctttttgctgtttatgcgttaaatgtgtttgttgaanannnaaa

SEQ ID NO: 90328 - DNA, 1163 bp, Heterodera glycines
  SCN-specific regions: Sequence locations=1-427,449-653,680-729,751 -884,907-1163
gtttccgtcaagagcaaatcatggagaaatatccggcccgcaacaatctcgaacaccttgcgatgcttaagtgtaccgagaaaccgcacattgtgcgcaagacgggaatcatttgcacgatagggcccgtttgtcgttcggtggacatgttggtccaaatgatcgaaaatgggatgaacgtcgcccggatgaacttcagtcacggggaccacgaatatcacggcggtaccatcaaaaatgtgcgtgaagcagctgccaaatgcaccaagaagtacaacgtggctattgcactggacacgaaggggcccgagattcggacgggacttttggcagggggcggttcggctgaaattctgttggcgaaggacgcgtccattcgcctgaccaccgacccggcatttgagaagtcgggcaccgccgtcaacctctacgtggactacaagaacatcacgaaggttgtgaccaaagggtcgcgcgtgtacatcgacgacggattgctgtcgcttattgtggaagaaattttgggcgacgacgccgccatactgtgcaaagttgaaaacggagggaaattgggcagtcgcaagggcgtcaatttgccaggaatatcggtcgatttgccagccgtttccgagaaggacatcaaagacctgcgttttggtgttgagcagggcgtcgacatcattttcgcctcgttcattcgaaacgccaatggcatccgcaccatccgagaagtgctgggcgaggcgggcaaaaacatcaaaatcatcgcaaaaatcgagaaccaggaaggtgaggacaatgtggacgaaatcattgcggcgtcggacggcgtgatggtcgcccgtggcgacttgggcatcgaaatcccggcccagaaggtatttctggcgcagaagatgatgatcgcaaagtgcaacatggccgggaagccggtcatcaccgccacccatatgcttgagtcgatggtgaacaagccgcgaccgactcgtgccgaggtcaatgacgtggcgaacgcagtgctggacagctcggactgtgtaatgctttcaggcgaatcgaccaaaggcgattatccggggggatctctgaaaaccatgcaacaaaatttgtctggaaggacccaaacagccatttaccgctcccaaatacttcacaggagactg

SEQ ID NO: 90329 - DNA, 844 bp, Heterodera glycines
  SCN-specific regions: Sequence locations=1-12,34-552,575-689,712-844
gcgcccttatttccgctgaagagattttggacacaaaaatatctttccaagaaagtgttcggaaaattaaaaaaacccatgaagaaattaatagagccttcgacatggagaaatttgacataattcaaagaacgatgcgaatgtattttgagtcggaagattcctcggatgtgtttgaaggctttttgaacgttgtcaaatatgtgaagtcacttaccactgagcaattggacatttcgctcgtcaaactcgctctgctcgcattttacgaatttcagaaactcggaatcgcgcaaggccaacaaatcccttttgaccttcacattgataagactcttctcttggatgcgctcgtcccgtgtttccgacttaaaaccaaatacatcgaagcgatcagttccgtattccatctgaaggacagggaaatggttgaagttgcgattgctcaaattaaaacccttttggagaacgaagtgccaaaggctgtcttttggatggaccatttgaatctgcgcgaccatttcccatttaacacaatcgtttgtaaacttattttggaaaaccaaactgctttgatttatcctttcgtcggtgaaagtcaatttcgacgtaataaactcattcattatttggacaatttgttgggccttgttttgcgcaacagacgagcggaggatgaatatgagcgggaaattatgaaaaaccaaaaacaattggagaaggttgggtaaggggccagagtacaaattggggcagtcaaaaatggcgattcttttcgtaaattttcagaaatgtcgctttctcacttttaattgttattgttacccttatactgttccgctta

SEQ ID NO: 90330 - DNA, 818 bp, Heterodera glycines
  SCN-specific regions: Sequence locations=1-525,547-818
gtttgccttagagccggcaaaatatgttcaaacccaaatcgcttctccgccttttcctcattcggaaatgtgtcaattatcggtcaaagacttcattttctggttccgaatttattgaaaggcgagcccggctattggaattggttggaaaagcacggcccgactttgatggaaagaagcccttcgctttgctattggccaaacggagaagtttcagtgcccccgacgtgccccacgtttaccgccaatgttcccactttcgctacctttgcggcgttgacaggcctggctatcgactgctcatcggacccaaagagagcgtgctgttttgtgcccttcagtcggctcaccaaatcctatgggacggtgcgtcgccaagtgatgctcagctgatgtgtgcttccggtgtcgaccaagtcctcccgctcgacgagttcgacgcgtacatggcgggcacagttcgcaacggactgctcgccttggatttgccttcgatggccgatcacgctgccgatgcgcctgcacaaatgaagaaaatgtggaaaatgttgtcggacggcgtgtggacgcacgtctcactcaatgagcacgtggacacattgcggtggcgcaaatcagagacggaaaaggcgatgatgcgacggacatgcgcagtgggaggggaggcactgaacgcgatggtccgggaatgtcgtaaagcaaccaatgaatctcatattgtcggcttcctcgagttcgagtgccgtcgacgtggtgcccacttcctcgcctatccccccggcgttgccggtggttcaaatgcgaataccatccattac

SEQ ID NO: 90331 - DNA, 778 bp, Heterodera glycines
  SCN-specific regions: Sequence locations=1-778
gtttcatttaattcaattactacaaatttctttttcaacttgaaaaaatcgccgctatggccactaaagcaggaattttcattgtgagtgcaaagcgctgcgctttcggtgcctttggcggctcactgaaaaatcacacagccaccgatttgggcgaaattgcggccgctgcggcgcttaaatcgtcctcaatcgcggctgagcacatcgatcacgttattttcggcaatgtcatccaatcatcgaaggacgcggcttatttggcccgtcacatcggcctccgagttggcgttcccgtccatgtccctgccgttactgttaacaggctttgcggctcgggcttcgaggcgattgcgcagggaggccaacaaatcctcgcgggtgactcaaaggttgttttggcgggtggaactgagtcgatgagtcaggcgccgttcgcagtgcgcggcgctcgcttcggcacacagctcggtgccaagattgagttcgaagacgtgctttggcaaggacttaccgacgcgcacgcgaacatgccgatgggaatcactgcagagaatttgggtgcgaaatacaatgtgacacgagaggaggccgacgcttatgccattcggtcgcaaaaccgctggagactcgcaaacaatgccggctatttcaagtccgaaattgtgccggtcaaattgcagggcaacgcgcgagggaaaactgtccaggggaccaacccccgggaaagcaccgccgacaaatggcagctgaaaccgttttaaaaaggaggcctctc

SEQ ID NO: 90332 - DNA, 953 bp, Heterodera glycines
  SCN-specific regions: Sequence locations=1-121,143-552,574-775,797-953
gactgtctctgcaccgctgccttggggtctttttctaagggcttttaaggtggcgattgggaattctttgcacacacggtcgatgacctctatcaccgtgctgtgaagcatggtgatttcatcaatgatgatgagttgtgcctcacgaatccgtcggggaaagaacctctcaagcggaatgcttggaagcctgtccagtgacacatctctgaccagtctgaaggtggaatgggctgtcttcccatacggcagcaaaaaagctgcacacccagtggatgccttaaggataacgtccatcggaccacaagcagggctcggcttgtttccagcggaaacgctgatgcgaaagccttttttgaacacgcaaagaacgccctggtggcgttttcggcctgagaaatatctcatcgtcatgacaggagcccgccgctgggcatcttttaaccgcaactgttgaaaccgtataggaacggagccaattctccgtttttggcacacagaccattgttattgagctcaaacgtagccgaactgccctgaggagctcgtcctgggctgacctcatcagaaatgagttaaccggatcggatggcaacagagtcaggatcgtgcccgcggatcccgagcatttgagtcccgatggcgttcttgcgcagtcctccgagcgcagcatcaccgagatgggcctggatgaggacgaaatgccatgaagcaaagcagcggaagcaatgccattgcggcctcatgcatatgtgcccgtcctcgttcgggatttctccaggcccgggctgctgcgtgtgcccgtctcgccagctgtagtcgttcttggacctccctgatttcggcccggcatttctcgcgccctttttcactcggcttttcacctgatcagccgtcggctcgggaacatcccgccagtcaaacgattaaaaccctgaattggctaccgagtc

SEQ ID NO: 90333 - DNA, 745 bp, Heterodera glycines
  misc_feature (134)..(134): n is a, c, g, or t
  SCN-specific regions: Sequence locations=1-247,269-745
aaaattcgattgtttctttgtagaatggaagctgtcgggatgaactttgatcatcatccgtttccgtttgaagctcaatttccgcacctttgcccatgaaaatgtggtgacacaattcatttggtggaacactntaatccccatatgcgccacagccaaagcgacttcagtgccttcgatatctctcgccgggtgcagccgaagtccgtagaaatcgcagcgccgtgccgtctccagcagaacaaagtccgcctcggccggctccatgccaatcagtcgccggtgctgctccaacacggcctgtgcaaaagtgggcgtttggtgcggcacgaaatgagtgccggccaaataggcgccggcgtccggatagtccaacggagagaagtcgccgcactccgactgcacaatcagtgccaccaacagtgcagcggtgttctcgttggtacagattagctcaccacgggacaaatcgcgacggatttgaagagcaaaaaggtagcgcgtgtactcctcctccaactcggccgggttcggcgtgtaaaatttcaccacaaagaaaaagcgggcgtccgattgggcgaccataatttgacgcaaaatgcttttgtccttgtcgagccaacatctgttcccatagctgtcgatgaactccaagccgaaatagtcactttccaacagattcaaatacctacaaagttcctcaaacagtgcttggcccgccgctttatgcctgaaagggaaaaac

SEQ ID NO: 90334 - DNA, 206 bp, Heterodera glycines
  SCN-specific regions: Sequence locations=1-206
gagccaattagatgaagacaaataaaaggcaaaaagtttcttcatcagaagaagaattcgacccgaatcagaaggatgaggattatgacctgctcatggatgacgaagagcgagaaaaattcgacaaaatgactgaaaaggagcgagaaattgaaatttacaagcgactcgagcagcgtgaaatcatgaagacgagagagaaaata

SEQ ID NO: 90335 - DNA, 818 bp, Heterodera glycines
  SCN-specific regions: Sequence locations=1-785,807-818
gtttgactttcattccaagaattccctccacctttttctccaatttcttaaatgatgtccaacgcaaccaaaaacattctcggcactccaacaatcgtcgacaatgttagtttcgaccccaaagtgagcgccaatttccttcacaaagccatcgaagagaagcgaaaggatgagattatccatttgctgtgcaccatttccaaccaacagcggcaagaattggcacgcgaattcaaacaattgttcggcgaagatttgtccgccaaactgaagaaggcactctctggcgactttgaggaactgattttggctttgttggaaccgccagctgtttacgatgcgcagcaaatgcaccgcgcgatgtccggcctcggcactctcgaggggcgagggcacggcatgacattgcttcaattggcttttgtttttcagatcggttctgattgagattttggtcacgcatagtaaccgacaaattgatgagatgaagcgcgtgtacgagcagctgtacggccatccgctggagaaggacatcgtcggggacaccagcggcgcattccaacgactgctcgtgtcgctgtgcaacgattcgcgcgacgaaagttggagctccgacccgatcagagcgaatatgacggcacgtgctctgttcaaagagagcgaggtggagagcggggtcaacgacgttctgttcaaccaagtgctggccaacgagaatttcattcagttgcatttgattttcgaggagtatcagaaggtcagcggtcatcccattgagcaggcaattcagcaacagttcagcggagacacgagggacg

SEQ ID NO: 90336 - DNA, 1008 bp, Heterodera glycines
  SCN-specific regions: Sequence locations=1-71,101-126,166-174,196 -566,588-1008
ggcaactttaaggagccggtcgccgtattttactctgctgagatcgcctgcggattgttctacctgcattccaagggcatcatctacagggacttgaagctggacaacgtgatgttggagagggacggacacatcaaaatcaccgactttggcatgtgtaaggagggcattcagggcgacaccaccaccaaaacattctgtggcactccggattacatcgcaccggagataattctctatcaaccgtacggaaaatctgtcgattggtgggcttacggcgtccttctgttcgaaatgctcgctggacaaccgccgtttgacggggaggacgaggacgaattgttcacagcgatcaccgaacacaatgtctcttaccccaaatcgatgtcaaaggaatcggtgctgatttgtaaaggatttctgagcaaagcgccctccaaaaggttggggtgcagcgcggacggagaacggcaagtcaaagagcattgctttttccgtcggatcgattggcacaaaatcgaaactcgccaagtgcagccgccgttcaagcctaaaattcgatccgccgacgacacttccaatttcgactccgaattcactggcgaagcgcccaaattgacgccggtcgaccgattgttcctaatgaatttggaccaaaacgaattcaaagggttcacttttgtcaacgcggaatttaccccccagggcgaaaataaaacggcggacaaaacaatttgaaggggcggaggacgacgacgaaacgaaagatgacgaggacggaccaacagcagcgagtgttcattggcactgatcaccaaaatgccattggcagttccaaagtcgccctctctcttctcgcacattcactcacccaagcgaaatgttcgcattccctcaccactcgccatttcttcccaattagctgctttattattggaaagtttgtatttgtgttttagaaatgtctatgattaattgatacatttcatcattttaaaaaaaaaaaaa

SEQ ID NO: 90337 - DNA, 751 bp, Heterodera glycines
  SCN-specific regions: Sequence locations=1-751
tgagaccctatcacttcactcttcttcaatttccaattccgatttttcctcgacttttttctccctccttttcatcactttttcgccatccttcccctcgtttgcgtcaaataatcccatcacgcaataaattgttgagaagaccctccttttggtcacaggaaaggatttgagggacggcaaggtgggaaacggcgggaactccgacccctctccaatccgatccatcgttcggcgtcatccgcccttctcggcgcgctcgaccactcctcctcccttttctcgtcgtctcggcttttcggcgtctccgctttttgagcgtgtctcgttcggtttcctccccccccccccagtttgtcccctcccttttcccgacaaactttttggtgccacgacccgggaacacaaacccttcgccgtccgccgaccatcttaagcctccggcactcaactcaagtcgccagccgccccctcttaggctcccgacaaaccctcaccgagtcgtcagccgcccctttcaggctttcgaccattcatcactcctctctgccgccagccgaccctttaggctcccggcaactcaacccttcgctgtccgctgaccatcttaggcctccggcactcatcactcaactcaagtcgccagccgcccttttaggctcccgacaaaccctcaccgagtcgtcagccgcccatttcaggctttcgaccattcatcactcttctcccagccgccagccgccctttcagg

SEQ ID NO: 90338 - DNA, 928 bp, Heterodera glycines
  SCN-specific regions: Sequence locations=1-137,159-410,432-603,625-928
attaatcatcaaggtaaaaaatatggaccaaaatggagagggtggcgccttgttgggcactgataagcagagtgtttttcgcgatcgtgatgatgacaatattgcacagcagcaggattctactaatccaataagtcaaaatatggtttcaccaaaaaagcgttggacatcagcacttcgggttgtcacagcaatggcacgcttccgaaacatgccaaggcatcccaacaatcaacagccagcagatggtgccactgggaatatgaacagtgttgaaacgggcaaatgccgtaccgcttcgtcctcattttcgggctccagtgaatcggtgccaaacagtggtggccgaaattatgatgaagcacatgagaaagagtccgagtcaaacatcgatcccgtttatttggcattgaaagaagcaactgaaaaatatggaaataaagctggcaaaaatcgacgtttttcgcaaaacattggttgtggcggcgcaggcactggcgattcgaccacaacaccaagcagttgctcgcgcaacttgtctcaagcgtcgctgctcgactcgggcaccttttcggttagtggcgactatggcggcattggcatcagctccaacaatgccagcagcacgcgactgttcgtgagcggtggatcgacctcacaacttgaaggcggtcttttttcaagcgcaccaaataccgccagcggcagaggcgatcgcataaaactcactgaaaaaatgaaatcattctcattggattgtgccgaaccgccgtccgcagctgatcagcaccagcagaagcatggcattgccggtgtataccccaattacaggatgaagcaattgcgttctccacgaacacatgcggaaagttttgaccagtgcatgaagcggagctcgtcgcctgccgccgccacattttttgccggc

SEQ ID NO: 90339 - DNA, 657 bp, Heterodera glycines
  SCN-specific regions: Sequence locations=1-261,299-599,621-657
ccaagcttgaggtatttattctcgagtataacttggattttacaatacctaattgactccaaaatggaatggtattctggtgacgttactactgctctgaacatttaccaagagaagaaaggcattcttatcgtctatgttttttctgatgatgtaaattccacaaaatttgaccaaatttgggattcgtttgaccattcaattctggatcgcgtcccttatgttgctattcgacttgctaaggacactgaaggcgcaaatcaattcgctcaattctttcccactccggtttttcctgtctgttactttctcgggctcaatgctcaaccgctcgaagttctgactgccgttgaacagatgaccattgaacgtttgaacagttcgctcgctaaggctatttcgctatacaatgaccaaatgaaggaacaaggcttcgccacagatgcagtttcatttcaatcgaaaagcagtgagaatgacagtggcaaaaatacttccgaaaatgttcccgagcctctcaatgccacttcgaatgacgagaaactcgaatattatcgcaaacggctcgaagaaaagcacaaagaagacgccatgaaaaaggagcaggaggagcgggagaaggagataatgcgcagaaatgaaggcaaagcactcgct

SEQ ID NO: 90340 - DNA, 730 bp, Heterodera glycines
  misc_feature (2)..(2): n is a, c, g, or t
  misc_feature (30)..(30): n is a, c, g, or t
  misc_feature (48)..(48): n is a, c, g, or t
  SCN-specific regions: Sequence locations=1-104,126-457,479-570,592-730
gncattcctcagagcacccttttcatcgtncacgtggcttatgagttngcctaaaaagttcttccactttggccattctttcgtcgcccatccgaagggattgtctgaactcttcgaacttcgtccttagttgttcgcactgctccaagtcgttgccacattcttcgatgttcgtcgtttgcttctgttgctccatccattcctccaattccgctccgtccgccaaaaacgaacgcactgccaataccgacccggcaccccgtgccgcttccttggccatgccctccaatgcttttgcttggttctccacccgttccattcgctcggctacgctttcatgcccccttttggccagctgttcgccccgctgtctcagttcgccgaatgcctttctccacggcactatctcattttgcaaagtgtttgcgcatgccaacattttcttggccccctccgacgtcccaaggctctctctgcacaaaatcagatgtcgctgcttctcagtcagccaattttccgcttcggcagtgtcgaacagaaagtgttccctctgcaacgcttctccaattgcccgtcctctcagggcagcgcattttgtcagtttggcccattccctctccaattggtcgcatttttcgccaatttccttcgagcagatgtgtccggttccgatcagatgatgccctgttttgatcagattcggcacacgttccgaatgacagtccaactc

SEQ ID NO: 90341 - DNA, 1026 bp, Heterodera glycines
  SCN-specific regions: Sequence locations=1-515,538-584,607-1026
ctcagccgacgatcaccaaacggcttcggttttgccaaggctttttgtccttatggctaaatcggaagacccggcacatttggagcgggcgagtcgaatgatggaagtgggccaaagccattggaaggcacttttaaaaggcgaagaattgtccgttcgaaagtgccgccaaaggccaaccgcaaaaagcttctcccaattgtcctccgacagtctcaacacttctcagttttatcaactcattgcgaaacatttctgtgaagagtttccccagcaaatctgcttgggactgttcgttttggagaaaaatgcaattttggacatttttgcattgattggtgccgaatggcacattcgtcgtcctttctttcaaaatttgttttccgtgcttttcaatttgcaaaatgagggcgatcgacagcccatcgtcgatgctttggtcgaatttgaatttttcgcctcttccactggcggacattctccgtcagctgatgaattggttttcattctttctcttctctctgatttgtttcaacaatttgccacacttaaacctttacttttaccaagggaaaatgtcgaaaaattgtttaatttggtctttgtaagaatgctttttcaacttatttcgacacaaagaaaaattccttccgattatttcaaagcaatgaaattgttcttttctcttcaatcagttcgaaatttctactcggaaaatgatttatacactgtgcgaagtttgcagcaatttctgacggcattttgggaacatttggaaaagggcattccccgttggcatcgtttgcacatcgatcgtcagcattgggcagtgaaagtgcacaattcaaaagaattaggcgatgaattttaggaacaattgctgaagttattcaacgtcgtccaaaggataattttctccgcaaaaaacggacgcctcgcgggcgaagtgacagcaaaagcattgcgagcacttttgggagtttcccttttccaacggatggcactcgtgccggaaagcgctctgag

SEQ ID NO: 90342 - DNA, 880 bp, Heterodera glycines
  SCN-specific regions: Sequence locations=1-224,246-880
attccccttttaatacacaacagcaaccacagcctaatgaagccgccgcgtccgaagaagccgacctgacaaatttggcatcacaggaagcttccgacaatgcgggtcaaatgactactgctgtttccaacaccaatgcacagcaacccaacgatgccaccgtgcccgaaggagtcgacccggcatttttggctgctctacccgaagatatgagacaagaggttatcagagatcatttacttcagcagcagatcagtcaggcggacaataccactgctcgggtggatgccgatgtgccaccagtggaacggatcgcagcaataatgggaatggagattcccgaaggaatggaccccgcatttttggctgcgctacccgacgacattttccacgaagttgttcgtgaccatcaacgacagcaggagctggcccgtcagcggagggcacagatccaagcacagcagcaagaagccaatcatgcaatggtccgtcaccctcacattcaccatcgacattttgcaatgcctcgtttcctgtctcggagtattcggcctcacactcatcgagagcttccgtccacttctgccgcagctgccacttcatccgtggaacgcactgtgccgctactggacaaggaatccataagcacacttctcgtcctgttcctgttggatcaggagaagttcgacacggtgcgtcttcagaaattgttgaaactgatctgcatacatccgggcacttgcgatttcaccatttgggcactgctgtcaatgttcgatgggctggacaagttcaaatcagtggacggttccgaggcacctgcggatggcggcaaattccaatttggatggatcaatgagcttcgtttacagaatgtttt

SEQ ID NO: 90343 - DNA, 1751 bp, Heterodera glycines
  SCN-specific regions: Sequence locations=1-334,358-641,663-995,1017 -1751
gtttcccttaaggctggaggggatttgtccgttgggtgccaatggccggggtcgaaagatgagtacgaacttcaggacgcaattggagttggtgccactgcgactgtgtttaaggcattctgcaagtcgaagaacgaaatgtgcgccataaaaagcataaatttggaaaagtgtcagacttcggtggacgaattgtcgcatgaaatacaggcgatgtcgctgtgttcgcatccaaatgtcgtcaattactacacttcctttgtcgtcggggaggaactttgggtggtgatgcgtttgttgaactgtggttcaatgttggacatattgaagagaaaaataaaggcaattggcaaagaccaggcggcctacggagtgctcgacgaagtgataattgcgacagttcttaaggaagtcctccggggcctcgagtacttccataattctggccaaatacacagggacatcaaagcgggcaacattttgttggccaacgatgggaccgtgcaaatcgctgacttcggagtgtccggttggctggcggccagtgggggagacctttcccgacagaaagttcggcacactttcgtcggcactccctgttggatggcccccgaagtgatggagcaggtgtccggttacgatttcaaagcggacatttggagctttggcattctgtgcattgagctcgccacaggcaccgccccttaccatcgctaccccccaatgaaagtgctgatgctgacccttcagaatgacccgccttcgcttgagacgaacgccgaccgaaaggagcagtacaaagcatacgggaagagcttcagaactgtgataaaggactgtctgcagaaagacccgtccaagcggcccactgcttcggaacttctcaaatactcctttttcaaaaaggccaaggacaaaagttggctggtccattcgctgattgagaatctcggctcggctccatcaatcccaaccattcccaaaaaggttgcaagtggcaagctgaagaaggacaaggatggaaattgggagttcgaatatgacacttcggacgaggaaaattcgccggaccccgaaaatgcgaccattcagcaaagcgcaagtggggaaagaccaactgtctccagggcatcgagcgaaggcaaaggggaggaacaaatgccgccgcttcaaacactgaacttggttttgcgggttcggaaccagcaaagggaactgaacgacatcaaattcgactactctccgaatgcggacagtgtggacggaattgctcacgaactcgtcaccgccgaactcatagatggccatgatctcgtcgtagtcgcggccaaccttcagaaactgatcgacttggcccagaaaaaggcggaaagaaggacgatcactttcgctctcaattccggcgttgcatccaatgaaattcccgacgaacgttctttgaccggttttgctcagctttcactgttagattaattggttcttccatcttctacaaccatccttttttcacaacaaatccatccgttaaaccaaccgatttcgcttgacttaaggaaaattaatcaccggcggaaaagtgcgattcgtttcgctttattttgctttctttttgctgatgccttacgaattccatttatttatgataacagtgattatttcgagttcgatgtttctggcccaattgttggttatcggaaaagtcactttttgggatttagcaaccgttagctgacaaataatcgcatccaaat

SEQ ID NO: 90344 - DNA, 1191 bp, Heterodera glycines
  SCN-specific regions: Sequence locations=1-507,529-846,884-1133,1155 -1191
gaggccgtcgaaaccgtagggacggatggccaccgtacgagcccgccttcgtggcaggagccgagcgggcatcagccgacttcgtccgcgtccggcgccgcccatgcgttgcccccgtcttcctccaaccgacccatccgctcgcaacggacgccaatgaaggaaatcatcacgctggacgacccaaccgagctggacgagtttatggcccggggcgaggagcagtgcattcacgcgatgcgcgcgttcatcacgcaattctctctgcgacagaccacggtggccaccatgacgggcgtgtcgcagccgtacatctccaaactgctgaatggaaaccacagggagctgtcgctgcgctgtcgaaagaacatctactgctggtacttgaactgccgcagacaccccgagaaattggcgatgttcgtgcaagacccgtgcacgcggctggagacctctgccgagggcgagttggtcccgcaacgtcgcgagcgttacgtgttccgacccgtgcttctgcgcgttctcgagacgtacttccaaaaatgcccatttccggacatagcgaaacgcgttgagatcgcaaatgcctgcaacgcgcacttgcaggtggacaaaagaggtgtccaactgatgccgaaggaggtggtcactccacaagtaatcgccaattggttcgccaacaaacggaaggaaatgcgccgacgcatgggagggacggaagcgggacggagtcggctgaacagtttgtcggcgggccgctccaactcgccatcgtcgcccaactcagccgcacactctcgggagggccccttcgagttgcgccagaataaccaacagagtggcaacgtggacgaggcagtgctggcacattgtgagcagctgcaggcaatgccaatgtctgtccccactgcgtccaatcagcagcaaatgcttctgatcagtgatcagcccgagtcagtgccatccgcagccgacctggcccttgtgctgcccccgctggggccccctcaccacccaaactgctgcccacccgcaactccgctgctgcccccaaatgttgtgcagttctgcccttccgtggaccagcaactgctccatctgctccaggcccaacctgtggccaatcagctgctgttcctccagcaattgctggtcggcacttcgtcagcagacaacgactacctcaagcag

SEQ ID NO: 90345 - DNA, 793 bp, Heterodera glycines
  SCN-specific regions: Sequence locations=1-158,180-193,216-232,254 -433,455-793
acaatatcttttggctttattttttttataatccaagaaaaattttgaaaccatacaagctctaattgtccagtactatcctgaaaacaagctgttaatcttttttttccccttcctatcttttgtacatttctaatataaccctgcaatggtatacctgtagaagcaggagctgatgctattgtcgaaacagtaaataaagtctttttgtcctcataacgaaaaggataatactctaaaagatctttgaaagtatggatccccaactcctcttttaatagttgagccttatctaacccaataccttcaagaagcgttatttctttagataaaaaatcatccaccatgacaaaccatacctaatttttccttttctaatttatccataccttaaaatcttacctaatattaacaggtttagtttaatgaaattaaattagaatcttattattcttagttattctgtgaatttgtggaaaagaagaattaaaagccacgcaacaatagctgctatttaggtattttactgtgttttatagttaaaaatacacatgcttgtcggtaaacatagaagggaaaaaaaggaaacagttatttaataacttaagtatacattcggaataatcttgtggacaaacgtacatattaatatttaaccaatgttatccccttccagttagcttataaggcaataaaatgtggtttattagtggaaaatattttagtgtaaccaggtcttgtttggattgcgtgcttactgatgataatgaaatttgtatttttattgatttag

SEQ ID NO: 90346 - DNA, 808 bp, Heterodera glycines
  SCN-specific regions: Sequence locations=1-808
gttttccttaatatgcattaccctgtaattactttgtacgatgatgatcatcggggaccagtacggtttctatcagttggtgttgcggaagcacgcgtgcagattgcgttacattctccaccagcttaatggcggtcagttgtcattggaagaccttaaacggaacatcgaatatgcggcgcttgtgctggagacggcgtacatggacgagacacggcggatttgcgacgaggacgacgacttggcggaggtcacgccagaggcggtgccggacgaagtgcgcgaatggctgacggcgacattcactcgccaaacggtgcaatcgcggaaggaaaagccaaaattcaaatcggtggccaatgccatacggacgggcatctttttcgaaaaaatttaccgtcggacgcagtccgttttggctcccattccccacgaatatttgccatttttgcggcaagtgaacaattggaacttcgactctttcgacctcaacgaggccaccaacggaaactctctcaagtacatcggcttcgagctgttcaaccgttacgggttctttgagcggttcaaagtaaatgtccaagtgctggagaactttctgctcgcgttggaattgggctactccaagcacaacaatccctaccacaacacgatccatgcggcggatgttactcaaacttcgcattggatgctttctcagacggggctcgcgagcactctgaccgacttggaaattctgggcgtgttgttcggcgcgctcatccacgactacgagcataccggacacaccaacaactttcacatccaa

SEQ ID NO: 90347 - DNA, 1005 bp, Heterodera glycines
  SCN-specific regions: Sequence locations=1-905,927-1005
gaccccttatcaaaaattttttgagtcatttctctgctaatgtttgttgcacttccaaactgttcttctcctcggaatcctttggccacttatccagattgcattgcttccttagacataaaccccgacagtcaaacttatggaaagctcatttctgtgcttgaaatgcccaatgagggtgacgaactgaacaatttgtgttgctgttcttccgatcgtttgattgtcacctcaattggcagtggtcggatttatgttgtggacacatccgacccaaaggaattgaaattggaaaagacaattgagccttcgacgctcacttcgcttggtgtcagttgtccgggcagagtttgctgtgcctccgattcagtgattgttggcacaatgggagacgatcggatggagaacaatggcaattttctgctgttggaccgtctcactttcgaaccaatcggattttgggcagagaaagaagggcaaaaaggcacaaaatttggcggaacagatttctgcattcaaaccaaacaaaatgttttgctgagcgtcgggtggggaacgccggccaaattccgcggcggacttcggccgagagacgtgacaaacggtcattacagcaacgaagtgaatgtttgggagtggcgccaacgccgactgatccaaaccatcgctttggaggccgactgcggatggatgccaatggccgtgcgctttttgcacaacgccgacaaatgccatgcttttgtgtgcactcttctcggctcggcaatttatcatttgtggagagaggagggcgaagaatccttccggcattgtttggccgctcatattccccctaagaaagtggacggttggcagtgtcccagtttcgtgccacaatttgttcaggatttgttggtttccatgaactgggccctgcccaaaatgcccgcgtttatttccgatttggtcatttcgtccgatgatcggtttttgttctcctcgaattggcttcatggcgatgttcgc

SEQ ID NO: 90348 - DNA, 723 bp, Heterodera glycines
  SCN-specific regions: Sequence locations=1-61,91-227,257-393,423 -561,591-723
tcctatagaattggaagagccaggttcgatgaagttttggtaagccaaaaaaaatcccaacatttaaaaatctataaaaaatttaaaaatgagaattcatgcgagattttctggaaataagcttaataggacctagttaagctgtaaaaaaaatttggggcgatttgaatgagaatagaaagagccaggttcgatgaagttttggtaagcctaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagcctaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaaaatccaaacatttaaaaatctataaaaaatttaaaaatgagaattcatgcgagattttctggaaataagcttaatagggcctagttaagctgtaaaaaaaatttggagcgatttgaatgagaatagaaagagccaggttcgatgaagttttggtaagccaaaaaaaaatcc

SEQ ID NO: 90349 - DNA, 1185 bp, Heterodera glycines
  SCN-specific regions: Sequence locations=1-208,286-828,860-1185
tccactcctcctctccgaattcgctgataaaatgattattttatctttaaaactgctcacgttgcccgtcctcctctcaattttactttgcattgccaaagggcaaagcgtggaagaattgtgtgaaaagcatgaaaatgagttcaatgagttattcgtcgagaagaaaggtggtgccgtaccagaagtcttatgggaggaaagccttgaaaagaaagaggacaaagaggaggagaaggaaagactggaggagcaaaagaagacggagaaggcgaaggaaaaggatgcgaatgccaaaaatgtgtcatggctgcgcactttgctgggcaattatttgtgccaaaaattgaggaaaaaagatggagagcagaaaaagagtcaaaacgtgccgaagaaattgagttcgaaaacgcccaaagtgtctgtgccgttgatcacaaaaaaggacaccgacgacaaatcggacaaaagatatgaggcaaaatttgcggtgaaatcggaggaggaaattttcgaaaagatcagagacaaatttaacatcagtgatgagcagttgctgttgtcgctgtctgagcttgtgccgttgaatggccgcggagggagcggcggagttttttacaaaacgaaggacgacaaattcatcttgaagagtctgaacccggatcatgatgagcctgctaaaatagacgaggtgttggacaattattcgaagcatgtgcttggccagcagcccgagaagggcaagcagtccacggacagccgctccatgatgaacaccttcttcatgtacttcgaaatgaatgtttacgccaagctgaaggagggcaagggaaaagagaggaaaaagaaacttcggctgcacatgttacaatttgtggtactgaacaacgtatttgagggaatcgacgagcaaactctgctcaagttcgacatcaaaggcactttcgcgccgggcagtgccgtgcagcacgaccagaagcagaagtggtacacaggagagacgggttggcagaagagtttgtaccgcgagtacgacttcatcggcatctcccgcgaagggagagagatttccgcctttttcccggagggcattcagctgcttcctgaagcgtatagacaattggccgacggagtgaagaacgacacgagctaccttaccgagaacggagtcaatgactacagtct

SEQ ID NO: 90350 - DNA, 665 bp, Heterodera glycines
  misc_feature (651)..(651): n is a, c, g, or t
  SCN-specific regions: Sequence locations=1-615,637-665
acacggagaaggctatgactaacaatttggacgagacaaatcctttggttgaacaggcattgaacgtgatcaaaatattacacgaactttctcgctcaattagcaacttcgaccaaattattggtgttgaagtcacttttccgactcttcctgaagaatcatttcatagtacaaaattgtcgcaaaaactttgccaagaactgactgatccattagtggtttctgcaaaggcgttgcctaattggtgcaactatttggtacacaatttcccatgtcttttttcgatggacatacgaacaagttttatgaacacgacagcttttgggacctcacgggcaattgcgtatttacaaagtcgacgcgatcacttacttgaccaaaatcgttctgctacttcttcagccgcttccaacatggcaggccttcgaagagaggaccattaccctgagtacagaataggacgagttaaacatgaacggataaaagtgcaccggtcggcagaactcttcctggaaaatgccgtcaaagtgctaaaatttcatgcgttgcgaaaggccattttggagattgaatatttcggcgaagagggcactggcctcggcccaacgctcgaattcttttctttggttgctgctgagttccaacgacggnacctttgcatgtgg

SEQ ID NO: 90351 - DNA, 797 bp, Heterodera glycines
  SCN-specific regions: Sequence locations=1-218,262-302,332-362,384-797
tacgaggcgcgaatccatcaatttgcggtgaagaatttgattgcaacagcagacgttggttttcatatacgcttaggaccgctctctgactttctcggtgccaaatgttgctccttcacacctgaactattcccaggcctggtctacagaaaccaaaaccctaaaatatcgatcatagtgttttcaagcggtaaattaaacctaacaggctctagatcaaaagaagaaattgattttgtatttaatcaattttatcaaattatctgcaatttcaaatattcaccataaacgacaagaatcataataattgtcattatattttgaattattttcgtcaagtaaaggtatagactttgggaaattttgtcccaaataaatattgtttttgtctacgtatttcaatttaacaagctcaagtgggtagaatcgttcgtgtccatttctatgcttctcaatcacgcaaggattattagcgtagcgaagacaaatgcggtaccgtacataaaaatgctggtcgacggtcacattcttgaaaccattgtaagccatttgcttacgggcactttctcttgtaattccaccgtactcaaaatctttgtattcatctagttgatttttgtatgttgtctgtagagtttttcctttgaggtatttttctactttttgtatctcatccgggtgatttaagcggtcgcacaagttacgtgcggggacattcacaacagaagcaattattgtgtctaaacggaccatttttataaatgagttaatgaaaaattccttaaatactttttatc

SEQ ID NO: 90352 - DNA, 687 bp, Heterodera glycines
  SCN-specific regions: Sequence locations=1-560,594-653,678-687
gtttccgtttggttaaacgttcccattgcctttccattaaaaatgtcggcgaaagttaaaacggaggcgtcgtcgccaaaacaaatgaacgaaaaggcggaagagaatgaattgacagagcgtttggagttagactttgtcgaagagtcagtcggcgacgattgggacggaaatgccatcatggaatgcgacgacactttagccaccgcagatgaagcggaggaggagggcccactcaaaccgtcgcccgactcgccacgttcgttgtctgccccgcgttcccccgaagacgaagtggagacaattgatgaagacaccgccgtggtggtgatggatgaggcggttgtccttcacacgggggaagaggacgaaatggcggagggcgacatcgtcgaggcggaggcgccctccgtacgaccgaaaggcggcggagggccgaaaacgccgccggagagcgatttgggggcgccggctgagcataagggaggctcttcccacgacgtcagccaggagagcagcatgagagagccgtcggccaaacgccggcggcgtcgtcggcgttcgtcctcccgctcctcctcctcagcatcgtcagaatcgcattcaagaaagggcgttaatggcggcggcaaaatccgagcggaggaagtttttgagcaggacgaggtggaggaggaccgtcattcg

SEQ ID NO: 90353 - DNA, 815 bp, Heterodera glycines
  SCN-specific regions: Sequence locations=1-241,263-265,287-579,602 -634,656-815
aggaacatcaaagttctgctcacaaacccttttacattaaaatttttctcatttagatcaaaacccaaaagggccatctgtccaatcgaggcttcggtttcatccaaatggccgatttggaggcacagaagcgagtgctcaaacacaaagtttgtgtttctattgcgttttttgacttaattattttgttgcaatttcctttgcagtcccacattattggagatcgcgaatgtcaagtgaaagtcccattttcaaagaatgcgctttcctcaaaaatatttgttggtcgactccaagaaggagtcacgcccattgaattgaaaaaacgctttatggaagaagcgcaaaggatcgaccccgactcatcggtcaccgacgtttacattccgcgtcctttccgttccttcgctttcgttactttttcgacgcctatcgttgccaaggaattgattaaaattggccaggtcgacttcaaagacacctccgtcagcatttcttccgcccacagcactcgtccccaggactcgaccgttcactctgtccaccatcactcttcctttattccgccccacccacacaatttcgtccctgaagatgatagttattcgacaagtgaactgtatagtaattatggcacaaacacaaaatgggaattcgatgaaatggcgtcgatggcaatgccaaagcatcagctgatcacatcgactcccggcattcagcaaagccgaaccgcgggcccaatgttttccggttcagtacagcaacatttaaatcagccattctctgctcacaatcaacagcacccgccgattgcg

SEQ ID NO: 90354 - DNA, 991 bp, Heterodera glycines
  SCN-specific regions: Sequence locations=1-238,271-319,341-678,700-991
gccgtcgatctacggcataacggatgagacgtatcaactcatttttcaaccgattatgcgcaaagttatggaggttttccaaccgagtgccgttgttttgcagtgcggcgccgattctcttaacggagaccgactcggcccattcaatttgacgctgaagggacatggaaaatgcgtgaaatttttccgtgattgcaatttgccgttgatgttattaggcggcggcgggtacactcctcggaatgttgctcgatgttggacgtatgagacgtcgttggccgtggacattgacatatccgacgaacttccatacaacgattattttgaatattttgctccaaattatcgcctccatatcgacgcctctaatgaaaccaatcacaacacagaagagtatttaaggacggttcagaatagcgttttggagaatctcagcaatttgtctcatgttccaagcgttcaaatgcaaccaattcctcgcgatggcatgcaaatcgatgagtcagtggagcacgacagagcaaacccggacaggagacttccagccgaagtcagtgaccacatgacagcacatcctggagaattctacgaaggtgaaaatgaaggtgaagaccgcaggaacaggcaagaatacaagcggagaggagggaatacgacaggcgaaccgagcgattcgagggaggacaaacaggacaattcgaagcggatcaaaattgaaaaacaaccgaaggcagagcagcaagaagacggcgaactgcttgaggaagatgcaaacaccaactgacgatcagcaggaggaggaaaagcccttttaagcatcaattcgacttattttctcgtctgcgctttgaatttgtcgtccaccgtttcttattgtttcgacaatattattactcataccttttcacagcttatcaatagcgtacctccttcaaattccgaatcctcttacccgtttaaattgcttgggataaaaaaatccgattcaaaa

SEQ ID NO: 90355 - DNA, 1323 bp, Heterodera glycines
  SCN-specific regions: Sequence locations=1-47,69-73,97-329,351-1323
atcgttccgtcaattacattcattctctattattgttttcaacaaatattcttgcatttccatttcattgcctttaaaaaatttcaaggatggttcagagaaatttgaattgacccattctctcagaattttccaattgtttaaaatcgaatattaaagtgggtgatttgttggaaattatttcaactggtttcatgcctcgggatttgtgacacgtttctctcaattcgctcggtttattattaattaattctttcccagaatgtaaaagtgaaatttatataaatataccaacataagtaataataatcagtttatttagtttttgatttgtacattcttttgtttttctgtgtagaaaggtttgtgtgcattgcaagtgcgaccgaaacgaacacgagcccagcagcaaccaggcactgagtgtgtacgaaagactcggcctcaaaccctcgtcggacatggccaaagtgctgcagcagcgcaaactctcgccacaaaagcagcagcaaagcggcggcggtgcacaacaaccgaataataacaacaacgaagtgcaggccattggttcggtggggcacggctacgcgtgggttccaccgggcatcagcagaataaaaatcgaggaatacatgtctcaggttggcaatcactaatcgcattcggatttttaatcatttttgccgacttttttatcagctccctaatcatatgatcccgcgtctgaacagcatcggcgagaagaaccgggagaaacagttgatgatccaattgccgcgccaggacctgtccattgcgtattgcaaacacttgaagaccccgcaggagcgtcgtttatacgacgaatttgtgaatgctcgtaacgaagtggcactggacatcggctttataaattcgaatgtgccgaaagccatggagtgccgaaaatgccgaggagtcattgaacggaatgaaatggccataattgcgccaaagttgggcgagtccaccggatggcatgctgcctgttttacctgcaacacttgtgatcagttgctcgtcgacctcacttattgcgtgcgggacgagaaggtgttttgtgagcgccattttgcggagttgcacaagccgcgctgttcggcgtgcgatgagctgatttttgccggtgaatataccaaagcgatgaacaaagactggcacggtgaccacttctgttgttggcaatgcgacagccaactgacaggccaacggtacattctgcgagacgaccacccgtactgtatcaaatgctacgaagagatattcgccaatgtgtgcgacgagtgccaaaaacacattggcatc

SEQ ID NO: 90356 - DNA, 813 bp, Heterodera glycines
  SCN-specific regions: Sequence locations=1-22,45-131,164-601,623-813
cttgagagattgttacgtgatttttctttccaaatttctttgccttgaaaatgacaaaaaaatttctgttaataatcgaagcttaccacaacagaatgacactttccttcaaattgagcaatgcgttagggaaatgctgttggaaaaagaaagcagaagagatttgtttcattgttcccttcgtccggcacttggtcatttcgtcgctcttttgcttcattcttttggcaatgattccgacgttaatttacggttgagaagtggcgaatttctgtgtttgcttactcagttggattttgccgatgaatccgctgattttgttgcttttgttcttcccggggttttttcgggctgtcgtcagattctcttaaatgttctgcccaatttgcattcaattgacctcgtaaggtgcgcttgtgaactggtcaccaactccatttgcatttccttctcaaaaatcaatgtcaccgattgtttgagtgtttccgttggaaagtgcgtaaaatcgccgtcctctgaaaatgtcctcagctttcgtcgcgactccaattggctccaaacggcggcccagcgaattctcccccagatttgttcacttttgtcacatctttccgcacattccgttgactccgttcgctatgagtcagccaatattttatcaaaaattcaacgacaaattccgtcggattactttggctcttcctttgtcaaaatgacaattgatgtctcccttttgctttacagtgacacaatgccaaagacacgccatttggcacatcggataattgacgacgtacggctccaacaaaagga

SEQ ID NO: 90357 - DNA, 671 bp, Heterodera glycines
  SCN-specific regions: Sequence locations=1-671
agccatgaagtcgggctaccagcgagagctcacttaccggcgtcctgacaattcgttttccgccttcggtgagtccgatcaacatggctccacatggctgaccgcatttgtgctccgctccttcaagcaggcacaggcgtacatttttgtggacgaccgagtgctcgaggattcaattgccttcctgatttcgcaacaactggacaatggcgcttttgttgagcgtggcgaagtgcaccacaaattgatgcaaggcggcgcatcggagggcggcttcacattgactgcatatgtgctgattgcactggtggagaaccacgtgcagaataaagtgacggaattggcacgaagctatttggagtcacacctcaccgacttcaaggaggacccgtacgcgttggaggtgtgcacttacgtgctccatttgacgaacagtccgaagaagggtgacgtgctgaagatgctggaaggccttcaaatcaccggcgccacagatggcatggtccattggacgacgaaggtgtcaaacggtgccaaagatggcactggtggagcagctaaaaatggtggcggtgcggcccgggacaccaaccagtacttcttccaaccccagccggccgacgttgagatgagcgcttatgccctgctcacttacatgctgctggacaaca

SEQ ID NO: 90358 - DNA, 1090 bp, Heterodera glycines
  SCN-specific regions: Sequence locations=1-7,121-123,145-303,336 -413,437-520,542-587,610-611,633-1090
caaatatatttagtaattaattagttaattacctaattaaattaatccttttatttttaatattaatgatttaattttaactatttctttatttacatttaaatttcattatttcattaaaatttgttttgctggtaaaaatgtttaataatatcatcggctcattgccaaaaaaacaactgttcgttctttgcttttgaaatgggtgactaatgagtgatgagtgaatgcttttgccaccgccactaataaatatttactttctttccacgccaaacgaaatgtgatcagcagcagaaagagcattcattcactcactcattcattctttcattgctgctgatcattcattagccaatcattttactgctaaataattcactaataatctgtgatcattagcaaatgatgggcccattaaagaaaatatttgtttaagaaatagaatttaagtattcaaagggctaaatcgaaagatagcaaagttaggcaaaccgcactttagtcatttctatgccctttatgaataattaatttctgtgttccttagctgaatcattaattattttctctcccaattattgtccctaattaactcatcaattaatttgttttcccctttttgcccatttgtcctttccattcatttttcgtccaaaatgtcaaaagtgttgtcccccgcattccgttggcggcacctttctctgatcactttcgcccttctcatcgcggcccattctctgctcgccttccgtactcagtcggccggcgctcgtggccaatagctttgcggcggacggccggcgcgtggcgtactggtcaaactgttcgacgaagatgacgggcccgacccggacgacgagttggacactgtgtacaccgatttggacggcagattcgaagtcagcgggtccaccatggagttgaccaacattgacccggaactgcgcatttaccacgactgcaacatgcacattccgttatgtaaacgccgaatgggtgattggcatttccggacaaatacatcgccagcggaacgctggccaaaaaactgatgaatttgggcagcgtggaattggaggctgagctc

SEQ ID NO: 90359 - DNA, 744 bp, Heterodera glycines
  SCN-specific regions: Sequence locations=1-114,162-641,664-744
gtttgcgtgtaaatatcccatttcattcgcggccttttctcgccgtttcgtgcccaaatcactttttgtgtttcccttctcaaattgccaacttacaacaaaatgccaatgccatcgtttccctctgcttcttctccgtgtacttcttcctcttcttcttcccgttccgtcgatgaacatccgttgcagtcgtcctcttcgtctccgttgtcatctcctttttctgccactatgccgtccacgccttttaaacagtcaactttcggcacttcctacaaatcgacgacaaaagggcaaaatgccaaaaaagaaatgccattggcaaaagataaaaaagcagtcggaggggcggacaaagagagacaattggatgaacagagcgaattttgcggaattttttgtccgcgttcgtttggccgtgccattggcaaattcctcgacttcgttatgggttccgcgcactcttccgccaacccttcgtcttccgtctcttcttgctcatcgcccaccaattttcgggaaaagcacacgcccgactcgttggaggacaaaattgagctgatctttgaactgttggagaaaaagcccacccgattgggctacagcatccagtgggcagtgcagttgttggccaatgcaacagaagaagagaagttggagatgttgcggtgtcgtgtgctcagccgaatctgtgccttaatcacccgctacagtaacgtcgaagttgcggcgcccccgggcaca

SEQ ID NO: 90360 - DNA, 785 bp, Heterodera glycines
  SCN-specific regions: Sequence locations=1-37,59-197,219-785
gtccttctactatgtgtgagaagcgttagccatcactttgaaatttaaattgaaatttccatttttctccacccatccaattcgaatggattcgctcaatcgtgagatcaaagatcgggtgcgcgattcgcattggctcggttcgtacggcgacagtccgcacgcgacatttagcgacattgtgatgagaagttttgatgaggtgaaaaagtctgggagaaatgccagtgcctgtcgcttctatgacatgtatcacccggaaattggcattcttcgcaagtcgaagagttacagcgcattggcaccgacaaacgcaatgcgattgaaggaccgtttggtggcacccgacctaagaccttttcatccgtacaaaccgaagcggaatgaatggaagacggagcttgaaaaattgcaccatggaacacatgcaaaactgaacattgcgccgtcgccgttccttccgccattgcctcccacttcgcgccgtcccttccaagtgccggccgatgcgactcgttttgagaatttctgtatgtattggggaggtcgggcgcgtggactcgactattcggagccatttttgtacgaaccgcagagagataactacagtattatggaggacagacggtaccatcgactgtactgggctcagcatatgattcccagccaaccgtcggcacggcatggacgacaaattatgctgagtgcttattgaaagaattggagggaaaacaatgatgcgctatgcgtagatagaagacacatcaaacaccgagcactaattt

SEQ ID NO: 90361 - DNA, 872 bp, Heterodera glycines
  SCN-specific regions: Sequence locations=1-129,151-373,395-713,735-872
ggtgtcccaaggaaggccaaggactttggccttcggcttatcaagctgatcctcctgagggatttgtttcatcagcacttttgagttagagatgaattccctcaggttgaagcatccttgttgtaggaagtccttggaaaatttgtatttttctaaggcctcctgtaccgtctcgcactcgatgagtacattgtccacataaatggactccgaaatctccctggacagtggggagtcgaactgttgcaagtgatggcggagtgtcgccgccaaaatgaatggcgagctgacgacgcaacggaaccgaagaagcatgcctgccaaatctggcagaagcactgggcctcggaagaggcagctgttgaggcttgggcagcagcagaaatgaatgaatggaaatgtggaagtgagcatataatgaaaagggtgccctttttataggacgaaaatgtgagggcgggagtagtatatagccccaaaaggttgcgggttggttgcgggtgtttcccgcacgagcccgtgcctatgggaaggctgcagccctttgaagttgccgccccatcaaaaaatccacgatgggggaggggtgtttcaaaaccaaaacctattggaccactttgaagttgccgcctgaccaaatccgatttcccaaattgttgcgggtgtttttttcccgcgccgcgcagcgccgcgggaaggtcatcaatcatccacctgtcaccaaagtgacaggtgaaggaaattcaatttaacttttgcaaattttaatcttttgtttcaaaaccttttagcgttttattttctcaatcctgaaatttttttatgatgattttttcggatcctgaaattaaaaattctttttgaaaattagc

SEQ ID NO: 90362 - DNA, 1298 bp, Heterodera glycines
  SCN-specific regions: Sequence locations=1-238,260-427,450-1019,1041 -1298
gaatgttttctcacaaaagcgccgctatgtccggaaatgagcatggagcagcaggacggcctttggccactctcttccacggaccgatgccaaagccgagcgaattgcaatgccatcggagaaaacggcggactcgtaacattgagcggagaagagacagacgaatcgcagtgtacgacgccaaccgaaacactttcaccaattgtacgacgtaaaacgacggattcaaaagaaggcaccaaaatcagagaggaaaagagagcggtggaaggaacacatggaaatgtaaaagtgacggacggaattatgattggaaaaaaggggcacacaaagggcgacggagcggcaaaacaacgacgaaagggagacggacaacagagcaccgctggacagtccccggaagcacaaccaacactgtacggatgtgctcatcccaacttcaaatcccattttcgctccgtgcgcccggcctttctttcacaacaaaatgccaatcttacgtccaaacaaaaaaaatggaccatcactggatgagttacacttggccgatgggattggggccgaatgttttgctgatggaactcatggggaacggaggcgcacttctcggcatcaaattccatccgtttcaatggaaaaatcgaatctccccagcaacaaaaacacgtggcgcactccgtccagattgatctgcaatttcgaggaaagcattctcaacggacgcatcccagcaaatagtgttgtcagcggtttccgtctccaacttacggtcatcggtaacggagtgtctacggacaatcgcctttcattcccggcaagcaaacgcctgacattgccagtgcttacttacttcttcaacgatttgatgtctcaacattcgggacggtttccagtggcggttccgccttcgccattgcatttggctcgctgcgagttggcggcggagacggtccccattccgaaacggtgcacactgcaaatagtgctcttacgtccgtgcggttcggtcgttaagctgttcatggtcgcggtgaatgtgctcgacatgccttccaattcgaggacgtttattcgtcaaagggttttcagtggtgacagtgccaaaggaacgggtgaaaaggaaaggagcggaaatgaaaacaaaacgggtgggtctaccaatgttccgaatgcaaagccttgctccaattcgttgcgctttctaatccatctgaggctggcttccgattcatcgggaaaagtctatttgcatagcgacatccgaatattattttcaaataaatcaaaagatttggaag

SEQ ID NO: 90363 - DNA, 771 bp, Heterodera glycines
  SCN-specific regions: Sequence locations=1-660,725-771
aattaccattatcactcgtcgaaaattcattaaattgttttccaaatgcttagcacggcggacgatctgtccgcttcgtcctcctcctccgccgcttcgttggagagcaaagactattgggtgaaaaagtgccttgacctagccgcagctaaaaatgccgccgaggcccgtgttgaacagctgaagcaacggaacgccgagttggagttggagaacaggcaaattcgggagtccaaagtgcgcatgcaagtgcgggtggagcaggaggaggagtacatctccaacatgctgttgaagcgcatccaaaaattgaagacggacaaggaacagttggcccagaaatacgagcaggaggaggagtatctgatcaacgatttgatgcgaaaattgacacagttggaaggcgaacgggacgaattggccaatcggttgagcacggaccaaagctgggtggtggcaaatctgttgcagaaaatccgcaaattggaagccgaaatccagaacaaccacaaatctttggagcagttgcgccgcgaaaaggtggacttggagaattcgcttgagcatgaacaggaggcactgttcaacacattgggcaaacgaatggactcgctggaagcggagaagcgtcgcttgcagggtcgcctcgacgagttggaggggggcggaacggcggcgaccgttgcgacgacgacgacaacagtcgccgacggcggcggcggtgtgccgacgaatgccgcctaagcaccataaaagcacaacataaattca

SEQ ID NO: 90364 - DNA, 746 bp, Heterodera glycines
  SCN-specific regions: Sequence locations=1-14,37-132,154-231,408 -592,617-746
ccattgcttttaaagtttctcccactcgggttcatattcctcgcatatccttagcaaaaagtgccaccaacagcagcgactgttcgcctcgcggcaaaaatgccaatttgaacagcaaagggacggcccctcccccgccacgccctctctttcgttgccctcagctttgtttgttactcatcctccgtttgtgccctccacgccgcccccttcggcaccgttcccttccggcttttcctcttccccggcaccgttcccatccgacttttcttcctcttcgccgtccacttcggcaccgttcccttccggcttttcctcctccccggcaccgttcccctccggcttttcttcctcttcgccctcctcatcggcactttttccctccagcttttcttccttttcgtccttgccaatgcctctgacttttcttgaccagcttcgactttattaccaacagctacagtccgttttagcttccgcatctcttcagcaccaaatgtccactgcttcaacttttggcttgcagaattttttggctcaaactgcttttgctgctgctaccgccaccaacaaagagcactcttcgcagaaaagcgaagaggaggaggagaaaaacaattgctgtgacaaaaacaacgtgccaataattaatgacgcaaagtctgatgaaaaatcacttcagcaaaatttgaaatggcaaagccaacgaaacgacgaacagagaaaaaaagggacaaaagtgccga

SEQ ID NO: 90365 - DNA, 448 bp, Heterodera glycines
  SCN-specific regions: Sequence locations=1-77,99-378,402-448
ggtccttgaaataatgcaaggatcatcggcacgttcatttttaaaccctaagaaaaaattgcaacgaaaagaagacttggagaaggaatttgtggagagtggtgagaaagaccgggtccaagaggttgtggaacgacgacttcacgagtcggggtgggcgaaacgagtggagagcatgtgcgaggagtacatcgcgaagaagggctatgaacgcgttgaactgcaagcgatggttgacgagctgaaggatgcctcgcgtcgaattgtgccggatgaagtgaagagagaactcatgcagctgattcaggaatttgtgaacagccgaacatcgacgggcgaagggtggtgataaaagacggaaactcattaattttttaattgttttgaaagacagacttgctttcaatttcttattacgaatcgtttaaatcaaaacatttaaaaaaaa

SEQ ID NO: 90366 - DNA, 325 bp, Heterodera glycines
  SCN-specific regions: Sequence locations=1-325
ggccctaacagtgccattttatggacagtgcagcgacaaccctcatcatcagtcgtttggtggcggcacggcgccgacgagggcatcgacgggcggcggcattggcactgtttcacttggcaccgtcacgtacatttgcggcgattgccacaaggaaaacgaaatccggcccaaagacccgatccgttgccgggagtgtggttaccgtattctgtacaagaagcgcagccgcaaaatgatggtgtacgatgctcgataaagaaattcccagattggccattgatatttggtttgtgtcactgaatattgtttaagaaagaaaaaa

SEQ ID NO: 90367 - DNA, 473 bp, Heterodera glycines
  SCN-specific regions: Sequence locations=1-445
caacctttgagaattaaataattcattcatttttctatctatcttgacttagaagaagaaaatggcttcaactggctttagtgtctacgttggaaacattccatacaatactactgaggctgacatcggaagtatgtttagttcatgcggagtggtcactaatgttcgcatcgtgtacgaccgtgaaaccaaccgtccaaagggattcgcgttttgtgaatttcaagaccagcagggagctcagaatgcagtcacgaatatgaacggaattgagcttaatggacgcccattgcgtgttaattgggccaacaccaacaaatagaaggaaggtgatggatggtatacttttgttgacagaccatttcgatcataaaatcaaaataaacagtttgttctttgattaaattgtttgcttttctaagttggaataaacaatttacaaattaaaaaaaaaaaaaaaaaaaaaaaaaaaa

SEQ ID NO: 90368 - DNA, 836 bp, Heterodera glycines
  SCN-specific regions: Sequence locations=1-836
gatctttccctttctcggcagggcatccgtctgaagcttttcccttctacggccatcgtctggcgaatttgaccattgcgaccgggggatttctgtacgtcggcgatcaacgaacgtttagcaaattcccttctcgcctacgaaatggatgccgattcctttttgctattttacattaagcaaagaattgagaggggagaggacggtcttcagtggtacaatcccccctattgtggggaggacgaagaagggcacgtgccggacaattggcggacaattcaacaggccgtcctctattttgagaaggacaacagcgatgaaattgagcatcaactgattgaccaattggtccaacattcggccgtcaaattcagcgcctttaaatatctcgtggatgcttacttcggactgttgcagcggcgtattgagcgaaaagcggacaattttggttgcccttcggtaacaaatttgtgcgtgcctttcctggcgatgatcgcttttaccggactcttcgcgagacgattggccgaaatggacgcatccgcgcgagtgacggaagagcaacaagatcggagggatttccgacgcgaaatttaccaagtgtccatctacgggtcgaccatgttgcgctacaaactgtacacatttgcgaacaacgaagacagtacagcggcgtactcatgggatcgcttttgcgccgactctctccaattggttgagcacatttcatccctcaaagaacgggaaacttcgattgcccttccctcggcttctcccctcctcggcgtcgttttgtgcggaattgcagcagcggcggttgtctattttctcatcgc

SEQ ID NO: 90369 - DNA, 895 bp, Heterodera glycines
  SCN-specific regions: Sequence locations=1-798,840-895
gtcaattaagatagttgtcaaagtttcagcggagtagaaaatgagtgcaaagcctttgctcgagttgtatgtgaaggcctcagggattgacagccgacgcatcggtgcatgcttattttgccaagaattttggatggaactctacgctctttacgaagtgggctgtgttcgtgttgaggtaaaaactgtgaatgtcaattcggaaggatacaaaaagcacttttcgggagcacagccgccaataatggtggaacaagacaaaggcacggcaaatgcggacaacactgacatcgagcgacgcattttccaactttgcaacgaattccatgtgccattgttcgagaaggatccggaagtggcaaagaccatccaggatttgtacaggaacttcaaaatatttctccaagccaaaacgaatttggacaaaggcaagcagcaacccagctccattgaaggactgccgccccaagtcgcctcatcgcacagcaaattggtagaacagctggcgaatataaatcagttgttggccgagcgtggcaacacacgctaccttctcggcgagacgatgacggaatacgactgcgagttgatgccacgccttcatcacctgcgcgtggtcggggagcgactgctcggcttcaccattccgcaccaactcactcacctgtggaactatgtgctgacctcgtacagaaccgcggccttcatcgagtcgtgtcccgctgaccaggacattctccaccattacaaggagcaactaaaccttagcatcgacgtccgcgtcactttggaagctgccacaaaaacacttaccattccagaaggtgtcttaaatgatattcgtcgcattacaaatggaaactgacagaaaaagaacaaatcattactaattatc

SEQ ID NO: 90370 - DNA, 821 bp, Heterodera glycines
  SCN-specific regions: Sequence locations=1-97,136-319,370-383,405 -505,552-561,583-821
gctcctaacgcaactttgcttaccccactctccaccttatcccatttacatccgtcaagatgtcgcaaggcaagccccatctttcgatcgtcatctgcggtcacgtcgattccggcaagtcgaccaccaccggtcgtcttctcttcgagctcggtggtatccccgagcgtgagatggaaaagctccgcgctgaggccgatgccctcggcaagtcgtcgttcgcctttgccttctacatggatcgtcaaaaggaggagcgtgcccgtggtgtcaccattgcctgcaccaccaaggagttcttcaccgacaagtggcactacaccatcattgacgcccccggccatcgtgatttcatcaagaacatgatttccggcgccgcccaggccgatgttgccctcctcatggtccccgccgacggtaacttcaccaccgccatccagaagggtgaccacaaggccggtgaaatccagggccagacccgccagcacgcccgtctcctcaacctcctcggtgtcaagcagctcatcgttggtgtcaacaagatggattccgaccccgctggtccctacaagaaggagcgttacgacgaaatctcggccgagatgaaggacatgctcatcaagaccggttggaagaaggagttcgttgagcagtcggtgcccgtcatccccatctccggctggatgggcgacaacttgctcaagcagtccaccaacatgacctggtggaagggtcaggaggtcgttcaccccaacggctccaagcacaccattgtcaccctcctcaacgctctcaacgagttcgccgacctcccctcccgc

SEQ ID NO: 90371 - DNA, 838 bp, Heterodera glycines
  SCN-specific regions: Sequence locations=1-61,107-153,314-327,353 -626,652-655,682-813
gttcgtagaagggagctgcaccacctgtggttacacatcctaccacctcgagagggcggctcccgctcccccgccaccaccgccgcctccgcctccgcctgcgcccgtctacagccagtcttcctactcctcctgctccacctgcgggggcagctcctactcctcttacccgtcttcctcttactcctcttatcccgcttcttcctcttcctattcgtcctaccccgcttcttcctcttcctactcctcttaccccgcttcttcctcctcctactcgtcctacccgtcctactcctcctcttcctcctgctccacgtgcggcttgagcggctacagcaacagctggaacaacggtggcagctcgtccaacacgtggagcagcggcggctcgtccatgtcggcgggcaacggcggtggctacggctacggcggtggcagctgctcggtgtgcggaaagcgcaagtgagcgatgcgcagcgcgcgcagcgctgtttcggcacggacgcaacagcggcgagggcgcgcggacacggagaatgaactgacggaagaccattgaaattctcccaaaaatcttggacccatccccaaccacaatacccatccaatccgtcccacattttgttaggctcagaaagcacacattttaaatggcataattattttaaaaattttaatttaccaattggcacccaaaacagcaccagcacactttgtttatttaattgtttaaattaatttttgtttcaataatgttattttttgtttgtgtgatcacaattctccaccaccccaataaatgataaagattcgaaaaaaaaaaaaaaaaaaaaaaaaa

SEQ ID NO: 90372 - DNA, 635 bp, Heterodera glycines
  SCN-specific regions: Sequence locations=1-103,125-635
tgctcatttgaattgaggagcgggggaacaaactccaatattaccgcttttcagcgcttatgtcttatggaggtcggaattgaacggatggaaagcgatgagaatttggaaaatttaccaaaagtggattggacgataacaccagaaccaattgtcatccgtggagttggacacctaaccctgtttggccttaactcgcattttccaacggaatttccgagcgctctgataggaaaattggcaccggaagagtttgacgacacattgcgacgtgtgaattacgttcttcagaggaatgttagcagaaacttgcgctggttgatctgcggattgcttttttgctgctgcagcttcggtatttcgttatggccggtggtctgtctgaacagaaggactatttccgctctcgagaaaacgctggaccatgaaaatcaacaattgtacgacaaactcggcttgcattggaagttggccaggctgcccgttgagccgtccaatcgcctgacagaatatgtccttctgcttgaaacgctgccacgaattcccctttccatgccggattagcacgcgaaacttttattacccactttgggaatgataaagaagtttagatttcactgcgatgtctctttctg

SEQ ID NO: 90373 - DNA, 967 bp, Heterodera glycines
  SCN-specific regions: Sequence locations=1-457,479-967
ggtttcgttgcaggcggagcgcgaatacatcacacgacgggtgctgacttttgtggaactgaaggagacggtctgtgccggtggagatcaaggatttgtggtgattaatcaaaagggcattgatccgccgtcgttggatttgttggcacagcacggcattttggccctgcgacgtgccaagcgtcggaacatggaacggctgcagttggcctgcggcggcgaggcggtcaattcggtggacgacctgacgcccgatgtgctcggctgggcaggcagtgtttatgagcatgtgctgggcgaggacaaatacacttttgtggaggagtgcaccaatgcgttgaaagacggtgccgttttgcccggcgccggtgcatttgaaattgcgggatattgtgcactgaaaaagcttgccgacaatgtgaaagggcgtgccaaactcggcgttttggtgccgtaattctttctttctttcttaatccctttcaattattgtcatcattctcattcccaggcttttgctgaggctttgctggttattccgaaaactttggcggtcaatgccggattcgacgcccaggaggtgagggaaaagcatgaaaaaaaattatttatttactcctttcaattgccaggccattgtcaagctggtggagacgttcagtgctgctggtgagctggtcgtattggacttggagagcggagagccgtgtgttcctcaggtgtgtcatcagaaatggacggggacaaatgggtcgggccataaaaagcgaacactcattgattcccttcccccgtttagagcgtttgggacaatgtgtgcgtgaagcaggcgagtctgaacgcctgtcagaacatcgcctccaatctgctggaggtggacgaggtgatgcgtgccggcatgcgcgacttgaaggggggacagtgaaaatgaacggaacggaaatgaaggagcaacaccaataaatca

SEQ ID NO: 90374 - DNA, 718 bp, Heterodera glycines
  misc_feature (661)..(661): n is a, c, g, or t
  SCN-specific regions: Sequence locations=1-303,325-449,471-718
ttcgtaaaaggagcaggctcgctgatggctttggcaaagtgtcccttataagacagttcaaattttgggggctgagaaagcgctcttccgagcactcaaaactaaaaaggatacgccaaaatatggaataatttatcacgcgcaattggtcactcaagccggacaaaagtcaaagggaaagatagcacgaaaattggcagcaaaagtttcacttgcgacgcgagtggacgcactttgcgacgaatcattgggcaacggacagggaattgaggcgagggtgtacatagagcaggcgataaaaaaggcggacgcgcggggagggcccaaaaaacaacgcttttctggcgtgaaacaggcaccgaagggcgcgtacactttcaaaaagggggaggtgcatcattatgacgcaaagttcgacatgacgctaaaaaagggaactgaacaggccgaagaaccgcaacaggaagaacaacagagtggaaaaagcaaaaaaggggaccaaaccaaatggcgaagcgaaggagaaactggagggaggggaggaagaaacgggaaaaacacccagcaaaagggaaaaggggcaaaaagaaggtcaaattggaaaaaaaccgcaggggggagagggggaacccaaccgcgaaaaaggcaaggaaaaaaaagngcgggacccacaccgcagaaaagcaggcaggagggcccaaaaaacaaaacaacaaaa

SEQ ID NO: 90375 - DNA, 847 bp, Heterodera glycines
  SCN-specific regions: Sequence locations=1-6,31-55,128-134,175 -177,200-201,223-277,303-303,325-432,454-847
ccacttatggcacttgcaaatggcttcggttgctaactccaccaactctctctgctcacaaagcctcgcccttcctcaaaaaattcgcatttctgcccatggaaaggaagaccagcagcaaaagcggcagcaaatccctcccagcggacccgtcgaagacggagcgtataaaatctctcagcagcagcacttcgtattgcatttgccagcggagagcgcttcttttgattccacgggccaacaaaccctcgccgtcgacgcttcttcctccgattcggtccctctcttttatctcttcgaccagcagcaaaaccaccctcttttctctgctggtatctcctcgccttctgccgttcaacattcccaaacagttcctgtccaattgctcgatgtcaacgatgaaaccgttgttccggtcaatggcgctgtgattccgtccccctcattcatccagctaagcaatgacaatcgaccccttttgcaaatgtccaatggccaaaccatcgaattggtgtcggccaatgggtttcacttctcggacggagtccaaaatgtggaagaagtctcttctgaagggacttcttcctcttgcggaggctctcgactcactcacaattatccaccaacgactttgctttcgacggcaaaagtattttcgccccaacaaagtgagcctgtgtacgtgaatgagaagcagtacgcgcggattttgaaacggagggcagcgcgagcaaaattagaaatggaaggccgaattccgaaacaaagacggaaatatttgcacgaatcgcggcatcggcatgctcaaaatagggccagacgtgctggaggaaagtttgactcggga

SEQ ID NO: 90376 - DNA, 718 bp, Heterodera glycines
  SCN-specific regions: Sequence locations=1-441,463-679,702-718
gcccttggacgcctttagcattcccataaacaatggcattgtcaattttggcacttctttgcttggcgcttgcacactttggcaccggtcaggagaaaaaaactgagccattggaccacaaatggacatgtggcaccacgtggaaatatgaaaacactggacttacggtttcgtggagccttcccgagttcctcgccgaaacttcggtggatgtcgattgtccatcgcgaaagaaccgaatgaacaattgttgttttgatcatgacgattgttattcaaagcaattgggacaaacgaagtgcgacgacgttttttgtgattgcttagaaagagcaactaaaggatcatcacgctgcgaaacttatgagggaccaggcttttgtcatcttgtccgcacgtatggcgcgtcggcctaccgcgcgtcggcccccccgttttggagcagttgtggcactgtgttgaacagcgcgaaatatttgggatgtccttgcggcacgtacaaaacatgggaacgctgcggttttctgtatatgggctaccgttacctgtgctatgcgtgctgatgaatttttttttaattgaatttggcatattttcagttatggcggaatgattcaattttcatgatatgcttagataattttgtgggcttttttctatatattcatagtatatgcatatttcttatattctaaaataaacattttctggcaaaaaa

SEQ ID NO: 90377 - DNA, 756 bp, Heterodera glycines
  SCN-specific regions: Sequence locations=1-526,548-702,746-756
cttgcctctgagctttgcatccgacttttccaaccccgagcattccactctgctgtctactctccgccatgtccatgtcatcaacctctgctgcctcggcctcggccaccgacgccgaagctcaagtggaattccccattgtctgcgaaccctgtctcggtaccaacccgtacatgcgcatgacccgccagccccaaggcgcgcaatgcaaatcgtgctcgcggccgttcaccaccttccgctggtcgcccggcccgggccagcgcactcgccgcaccgaaatctgcacctcgtgcgcaaagctcaagaacgcctgccagtcgtgcatcctcgacctcgaatttggcctctcgacccgcgtacgtgacgctgtgctcgggttggattccggcgcaaacacgagcaacgatcataatcggcaatggttgttgcgggccgccgagcagaatttggcaaagacgggttcgggcatggtggattacggtaaggtcgagagtgtggcaaaggagacgatgcgcaagatggcaaaggaggcggccagtccgtatggcggcgggtcgggcgggagtaagcggccgcccatttgcagtttgtggttgaagggcaagtgtccgaggggcaaggagtgttcttatcgtcacgagctgcccaaaaacaaggaaaaactcgccgaattcctcgccaaacaccaatctacctcgcccgcctccaccccggccccactcgcgcccgcggcccccggcgcacgcgccattc

SEQ ID NO: 90378 - DNA, 476 bp, Heterodera glycines
  SCN-specific regions: Sequence locations=1-476
agccattcaaattacaagtgaccaaatgattgcgtcgaattcggctggcgcgccgtaccgcggcgatccgatggcatccgctgcactcggtttttcaaattttgtgaatggtgccctcatccgacaccctttcgttgtgctgcggcgccagtgccaagtgcatgaccacgcgacacccaaacatttgacgcccattactcttttgccggttgtggtcaacttggccgggaaagatggtactttttcgcttttggaaaggtgccattggcagcggcgttctttgggtggtttcgcatgcgtcggaatttttgattgcccagctttttaacctaccaaaatcatttgtaccccaaggcagctcagaacgcttttggcgccatgtttttctcaaaaccgcctctttcctcgcctgcactcctttcattggctcctctttcatcgaaactgtccgcagtggtggaaggttatcggatgaa

SEQ ID NO: 90379 - DNA, 703 bp, Heterodera glycines
  SCN-specific regions: Sequence locations=1-103,139-166,191-327,350 -517,539-703
gttccatattcaccttcaaaaagagcgttcctttgccgaaccccgcccccgaggttacgccgcccaagtcgcaagtgctctcggctatttgcacgccaaggatatcatttacagggatttgaagcctgagaatttgctgctggacagaaatgggcacgtcattctgacggacttcggcctgtgcaaagagcacgtcaaaatgcggcagaccaccagcactttctgcggcacccccgaatatttggcgcccgaagtgattcagaaaaagccgtacgatcggacggtcgattggtggtgtttgggctgcgttctgttcgaaatgctcttcggattgccacctttctacagtaagaatcagaatgaaatgtaccacaagacgctcacccaaccgttgtgcgttccctcgtccgcttcgactttagtgcgcaaattactcgtcgaaatactgcacaaagaccgttcggaacgattgggcgcaaaatccgattttgaggaaatacgaagccatccctttttcgcaccaatcgattgggacaaactgctaaacaaagaagtgaaggcgccgtttgtgccgaaagtgcgtgccgaaacggacactttgaacatcgcgcgcgaattcactgacattgagccgaaccctgcttctttggtgcctttgcaaacattcgtcaacagagaaacggaattcgccggattcacttac

SEQ ID NO: 90380 - DNA, 706 bp, Heterodera glycines
  SCN-specific regions: Sequence locations=1-301,324-406,428-706
gaccgtttgattatttttgtcagagagcatctgcggaatggctgacgaatttgccaagccgaaatttgacggcaaaatcttccaaaaccccgacagcttcacaacatggaaaaacccgccttcggcaggagacccgagaagttggcgggacttcattaaatggaaatgggatgcaaagagcacgaaactgcccaatttgaaagtgcttgaccagactttgccggtgttaaagcctcggttccaaacggattctcggctttcggccacttggctcggccatgccacactttttgtgcgcattgacggcatttcagtgctcacagacccagtttgggcgatgtttgccactccttcgttccttcccttcttcaaattttgcccgcgttttcgtccaccgccgtgtaaaattgaggaattgccaaagattgacattgtcctcatctcccacaaccattacgaccatttggacgtcgtcgccgtccgtgagttggcacaacactttcctcacatcatttgggttgtgccgttggggcttaagcaattggtgcaacacgagacgaactcaaaagcagtgcacgaaatgaattggggtgaccgtctggaactgcaattaaacgagagaacctttgaagtgttcagtgtgccggcacagcattggtcacagcgaaacttaattgaccgaaacacgtcattgtggagtggttgg

SEQ ID NO: 90381 - DNA, 224 bp, Heterodera glycines
  SCN-specific regions: Sequence locations=1-5,27-224
gtccaaataaggaaattctctctaacttggattttgagccatcgcgttgaaaagacagatgatgaaaaacgactgggacccattaaaaacgaagtcggacattaaacagcggctcaaccgtctcttcgggcggttcgaccagtactcagaatttgcagccaaacctcggactcctgaccatgcattaacagagcatgtaacgacacccgtaacaaatatccctc

SEQ ID NO: 90382 - DNA, 1042 bp, Heterodera glycines
  misc_feature (955)..(955): n is a, c, g, or t
  misc_feature (974)..(974): n is a, c, g, or t
  SCN-specific regions: Sequence locations=1-117,139-389,411-417,439 -1042
ctacattatacattcgcctaaaacatacttttggtcattagcaaactttcctaattatttgactatggcaaatttcggctacggccagcagcagggccaagcctaccatccccagggggccaacccataccaacaacagccgggttggaatgtgccgccaccgccccaaggacaacagccgtataatgcgcaacatttcgcggagcaaggccaggccgggatgccgaagaacgagttgggcttcaacgaccagacaattcgttcacaatttgtgcgcaaagtgttctccaccgtgggcattatgttggccgttgtcgctgtgatgagtgctttcccgttcatgcatccgcccatgatggcatttgtgcggcacaatgtcggactttatttgttgggatacatcactttcttcgtcgtttacattgcattgatctgttgcgagggcgtccgtcgatcattcccggccaatatcattttgcttggcattttgactttgtccatcggcttcatgaccatgatgatcactgcgcagtacgccgtccattccgtgttcatggctttcgccatcacttccctttcgtgcttcggcgtggcacttttcgccacaatcaccaaaagggacctgaccagtatgcttggcattgtgttcatcgccacaatgtgtttggcgttgttcggcttggttgtgatcattgtcggaatgttcaccaatgtgcgcattcttttcgttgtttacgccgcgattggggcatttctgttcatgatttggttggccattgacattcagatgggtatgggcggtcgtacctacgaaatttccccggaagagcacattttcgcgtcgattactttgtttcttgacatcattcagattttctggtttcttcttgcaatttttggagatcgcagaaactgaccttggcatcgcgacatttgcaacacataaacaaatatntgttgatgcttttcagttntacattcttatccgatatttacgcaatttaattgtgatctgaaaatattaatcacttgagaaatatat

SEQ ID NO: 90383 - DNA, 427 bp, Heterodera glycines
  misc_feature (407)..(408): n is a, c, g, or t
  SCN-specific regions: Sequence locations=1-427
gtcgttagaatggcttctgcggttaatccattaaaggcatttggacaaattggtgcgcggctcgggattcgcgagaagaagaaccaatttgtgcagaaggcgtggccatacattgaccctggcacgcattttggcaagaagaatttcggctatttggtcagtgctgtttcgtttttggttttctacaaagtctccagcaatatcaagtcgaagaaggcaatagaagcgaaacagaaattggaaatgaagccgtacgttgttcaggacgcgatgacgcgcagcggaatttaaagaaacaatgcgttctaataggcgggaggcaaagtgtcttcgaattcattagttttaaactcagaatggcgtatttgttgtaactgttcccaagagtaaagtaattctatgactannaaaaaaaaaaaaaaaaaaa

SEQ ID NO: 90384 - DNA, 484 bp, Heterodera glycines
  SCN-specific regions: Sequence locations=1-25,48-341,363-484
atcaatcatacaaagaagtgcgtgaaaaagagaaaatgagctagctatgaatgatgagaaggtatggagaggtatgtactgtactgtagactgcacacacttttgaagtgcacgtttgtgttgtgtcgctgtccttcaccaaacacaccgtttcaacctaaccaaaaaccatattaatcggttatcacgtgattaaccaacggttttgtttttgtaactgaatcacgtgactacttcttgtctccagccgttccaaccgaaccgtaccggttattttcagccgcaagtgcctgactagttgggtctcaaattttggatataaaacggagtgaatagtgaaagcccagcccaccaagtggcataatacattcaatataaactttatatagtaggccttaccaaagtatcgataagtgctatcacgaccttgcataagtttctggtagataaatccctggaatgcccattccaccagtagtagaca

SEQ ID NO: 90385 - DNA, 1139 bp, Heterodera glycines
  SCN-specific regions: Sequence locations=1-88,110-1139
ttcgttgatgactttttttctacaatacaatttttacctaatctggcagagcgatggagaaaaaaatatgaacaaaagtcaattggacccatcacaacggaagggactcgacattgatggtcactcatacggagttcatttttactcgctgcccggaatgtcgtctttgacctcattcgactggcacccgaccatcagtgatcggttggcacttttacctgtccaagaaaagccaatggcttttgcacattcgattgcctccacgaaacgaattgccataattaaacttcgtgatgacgtcaattccgtcatcggtccttccggtgacttttgcatttcggcggggccgcagctgaactttgaaaacggcgagaaattgttggccaaacccaactgcacttctgacatagacactgaaacactgttcaaacgacgggtgctcgccggctacggctacggaaattcactgaacgcattggcaacactgctcgaatattcgaagaaggccattgagagggaccaattcgcttcggatgatttacgcttttgctgggattggctttggatgcaattccaatcggcagatgctaacgaaattaagaagaattacggaaccatgttcgctggcgttaaacacattttgaaaggcacaaagtccaattcgaccatcaaacaggacgaaattacttacagaaaccgaatttttgtcaacgaaaaacgactcaaaattttgcgtatgtgcaattggcccaactgcgccgtgagggacgagtgcaaggcgcggcttgacgaaatcgcggctcaaaacggagtcttcggtatcactcgcgcggcggcgttggcacttttttcagtgcatggaatgctcagcaaagagtatttgactcatttgagcgagttcactcattcgcgcgaatttgccgaaacatggtgccgttccccctcctttgtgaccaattatcaacgaatggccgatacggtgctgaacattttgcagaagtacgacggagttcgggtaccgaactatgaaagtgtgtgcgagggactgacaggggacgattatttgctggcaattgttaagttcctcgccagacgtgacaaaatttacaatcggatttacaacgaaatcttcgaaagta

SEQ ID NO: 90386 - DNA, 797 bp, Heterodera glycines
  SCN-specific regions: Sequence locations=1-797
aattcatttgctataagagccatcccctttgattgaaagccgcctttacccatcgaatgctacacccttcaacccattgcgcgcgcaaaatctcacgcaagcagtacagcaacgcgccggacggagcggaagagtgtggcggcaacgcggacgcgcttttgcgcaaagcgagccgaaagctgtcacaactaagcgagctgggcgacttccagcagcgctgcaataccgccaccagtcgccgtcgctgttcatcgacggaatccttgctggcggcgctgaatggtcacggctctgtggtgtccgcaggcgccgactcgtccaccgccagccatcgttcatctacggacgacctgaccgtgctcgactgctccaaccttagccttggtcagttgcccattgaattgctcactgaacactctgaggaaattgagcatttgattctggacgagaacgagcttgacgagcaggccttggaggacatccctcgcctggacaagctggagacgctgagtttgaatgggaacaagatcaagaacatcggtgtgttcctgcagtatctgaagcgcaagtgcccgaacctgaagttcttgagtctgatcggaaatccgggctggccccacccaattctgaacaacaacttgcaactctaccgcacttatgctctttccgccgtccgtcttttcccctccttgcaatttcttgacaccgcccgtgtctcatcgccagcatccatcgccattttgggcgaacagtgccaacagcgccaccaccagcagccaaatgccggcaacaaaaag

SEQ ID NO: 90387 - DNA, 748 bp, Heterodera glycines
  misc_feature (2)..(3): n is a, c, g, or t
  misc_feature (213)..(213): n is a, c, g, or t
  SCN-specific regions: Sequence locations=1-647,670-748
gnnccccagagagtgattctgaaagttgttcagcagaacaggcttctactgccgatgaggttgagtcgtccagtaggaggtccagcacagataacttgggaggtgattccgactacggcgatgactcggtgtctgacacagattcggatgacgaaaatgaaaagagcaaaagttcgacgctgagagaacgcatgaaatatacggactcgaaanatacacgacggaaaaacaaatacacaaagtgacactgagacgaaaaatttgctggatgacatgggcgaggaaatggacgacgatttgtcgatattgcacgagatgaattgtcgtagtaaacagaatgggtcgtcagagttagactcaaaactctttgagctctccgatgaacagttgaattattacaccaattgctttctttttcttatgcagaaatcgcaggggttcttttctctgcaaggggcgctccaaggcaatgacagaacaattcttgacttcttccgcaaaagttccctcgacgattcaattctttccaaaatttggtctctcagcgatgtgaacgaggacggatttttgaatttgacggagtttattttggccatgcatttggtcgttttgcacaccaaaggttctgttcctatcccaagtaggctcccttcctccgtccttccccccaccactccgacacgtactttggtccatgctgaggatgattttgcagcttctctgtccaaccattccttgagcaattctt

SEQ ID NO: 90388 - DNA, 630 bp, Heterodera glycines
  SCN-specific regions: Sequence locations=1-5,27-189,211-305,328 -487,510-525,554-608
cgcccttaaaataaaatattaaaagatccgaaaaaatgccaaacaccttcaaaatccttctgattgtgcttttggccgtcgtctcattccgtctctcggcttctactggtgacaaaaaaactgctaatgatgggagtggaaacaactcatcagctgggattggtacgaagatcaaaagaattgtcaccgctggactgctcttcacttccctggcgacgggtggggcggaagcgattgggcgaagcaatgctcagggaggaaatgccgccggattggtgccatcgcatgtgaccaatcgctcaatggctccaccacctcctcctgtgcaatttgaaatgggggcaaatcgattagaaaaaatgagggcacacctacgcgaacttgctgagaaaatgccggtcaatgaatcgaagcgtctgtcaccgagtggacccgacccacatcatcattagggccatggatggatctaacggaggaagaaagaatggatgcttagttttcagattttattctatcctcttttatttattagtttttcaaaacaaatttcttccacaactttttaaactatttgttgttttgaatctttttagataaatctaaacccctaaataaattataattttataa

SEQ ID NO: 90389 - DNA, 472 bp, Heterodera glycines
  SCN-specific regions: Sequence locations=1-112,135-433,456-472
gttcataaaagcagcaatttcactattttttttttgtttgattactttctgatctgcaaaagttgagtggtgccgatcggctgctgctgtgccgtcgatatttccatgtgggcttcgtctgtctccctcttctctgggcggtgaatgccatttggttttttcgttacgcctttccttccggtgcaaatgccaccgccgagacggcacaaattcggcgctacgtttgttggtcggcgaccggcgctttgtgctgggggctccttttgacaggttggcttttattctacaacatccagcgcagctacggactgttcgaatgggcccgagaaaatcaccgccgtttttcccctgggctatgtctgattcggatgaaaaaaaacacaatgttttttctcattcttattgtatatggaattttccaaaatactgaaaattggcagcaaagcaaaaagggcaatgataaaaaaaaaaa

SEQ ID NO: 90390 - DNA, 821 bp, Heterodera glycines
  SCN-specific regions: Sequence locations=1-821
gttcaataaagtcaaaaccttcaaaatgagttcaaggattaacgtcgtcagtgtgcagttgttggagaacccggccactccgagtgaccacatcaaactcgaaattgttttcgaaatattcgaaaacattaaggaagacgtcgaatgggaattggttttcgtgggcactgatggccgagaagaacacgaccaagtgctcgactcagttctcatcggaccgattcaggagggacgacacaaatttttgtttgaggcgccacctccacaaattcacaaccttcgacccgaagattttatggatgtcactcttttactgctcaagtgcaaatatcgtgaacagcttttcatgaaaatcggttggttcgtcacgcacacttacactgacccggaactcgtcgaaaaccctccttctcagcccgtcatcgaaaagctcaagcgaacgattgtcggcgaggatgtgcgcgtgacgagttacccgatcaaatgggacgaggaggcggaacagccgatggatgacgatgaagagccaaacgccgggaatgaggtttcctacggagtggcggccattgaattaacatcgaacggcaacagtcaacaaatgaacatgtcacaacaggaacagacgccgatggcggctgttaactaagcggatgaaagttgcgagcgttaaaaggacagaacggactcgatgttttatgggtacaaaaaacggatttgatcttcaaatttgcatttatcactttaacccaatgttttgttcgacaagctcatcataaatgtatgcggcaaagccgcccaacttgaaaaaaaccaagctatcc

SEQ ID NO: 90391 - DNA, 698 bp, Heterodera glycines
  SCN-specific regions: Sequence locations=1-698
attcgttaaaaacagtttttataatgaagccagacttaaaagacccttactttatgtacaaattaattgttggccaactcttttacgatggtcatcaacaattggcactgaacttggcacaaacgcttggtctttcgctacgaccgcctcctccatctgacaaactttttcgtcttgtggcaatagctaaacaatttgtggaagatcccgagtataaagaacgggagacaatcttgcaggtcggtgggtttgagtctgctgggcttgacttggaattcgatgctgatgttgtcccgacaagccctgaaccaagtttgtacgaaactgtgtacctcaccacacacaaggccccgtgtcgggcggctgctttctctccagatggagctcttgtcgccacggcctccaatgattgttcaattaaaattttggatgtcgataaaatcatttccaggattgacgtgactctgagtgagtccggccccgacgcccatcacccggtcattcggaccctttatgaccacctcgatgaaaccacttgcgttgctttccatccccgcgagtccgtcctcctttcgggcagcaacgattttacgctgaaaatgttcgattattcaaaaactgcgggtaaaagggcaatgaaaaccatcacggaggtcaaggcgatccctgcggtcagttttcatccgagcggagagttt

SEQ ID NO: 90392 - DNA, 542 bp, Heterodera glycines
  misc_feature (8)..(8): n is a, c, g, or t
  SCN-specific regions: Sequence locations=1-153,175-433,460-542
ggtcgtanaaggcgactctgtcagttccaatgcccattcttcccccttcaaagtaatcgtcatccttcctcgcgtactacttcctccgctgctctgctgatgttcccctacaattccttctccaccgtgcgtccccactccatctcttcccaaagttcaaccactttctcctcccggaatttcacccaatcggacaccgaagcggaagaggagaagaagtttcagaagcgaatcgtccaccgaagagaagtgctgacaccgtcgagaatgaaatgggactgggacagaagagaaatgttggcctcgtgttccacgccaaagtcaagtcaagaggatttgctctgtcactttcgccttttagacaaaacttcagtgtattttcgacctaagcccagcgatgataaccaacagcaacggcatgggaataataaacagcgccaaaaacgggcaaaatgccaacagaaacagcagcaacttcaaattgacgattattttaacgcaatccgtcggccaaagcatttgcgcggagcgaaacggcacag

SEQ ID NO: 90393 - DNA, 382 bp, Heterodera glycines
  misc_feature (8)..(8): n is a, c, g, or t
  misc_feature (358)..(358): n is a, c, g, or t
  SCN-specific regions: Sequence locations=1-21,43-166,190-231,279-358
gagcctcnatataaaattcatttgattttttaaacatttttaattcccatcgttccttaaaatggcctgtgaatgttcctgctgcaaaaacaaccaatgttgtaccactaactgctgcggagattcttgttcatcatgccaatgccccaactgcgagtgccaaaagcaaaagggacagtgccaaccccaggggaagggatgctgtgcttagagaagcgaacggaaaggacggagagaggggagagggtgaagcaaagagagagagagggagagagagaaaaaagggaccacagtgatcggaatgaccaatttgtgtgccaatgataagagcaaatgacaaacataattactaattgtnaaaaaaaaaaaaaaaaaaaaaaaa

SEQ ID NO: 90394 - DNA, 287 bp, Heterodera glycines
  misc_feature (265)..(266): n is a, c, g, or t
  SCN-specific regions: Sequence locations=1-103,147-266
atcctcaaggggtttcactcacccattgccgtgtcttatttttcttaggagcgcatctctcaatctctaggctagggctcaatacatacacacctatttattgatttgtttttctttctgaatgacctcccccacccctcccgaaaattgttttttcttccgccgtcggttaacctttaccctttacacattttcccaatacttgtgacattggtacgttcaattcaacagcaatgttttttgatatcttaaatttgtcatttcnnaaaaaaaaaaaaaaaaaaaaa

SEQ ID NO: 90395 - DNA, 752 bp, Heterodera glycines
  SCN-specific regions: Sequence locations=1-671,693-752
ggtccatagaaatttttaacttttttttcctactggatcttttgcgctatcgggagtccagaggatacctttcttttttataaaaattttcgtttcatttttatttttagaaaagataaatttgacttctttacaatgactgcttcatcccgtcgtttgcaaaaggaactttccgaaatgcgtgggaacaattcgggcgctgttcgtgttcttgaggttgatgagtctaatttgcttcgctggagccttatgctttatccggaccgtgaaccatacaacaaaggtgcttttcgtgtgaatgttgattttccaactgagtacccattcaaaccgccatccgtgacattcgcaaccaaaatttaccatcctaacatcgacgataagggccaagtctgtctcggcatcattctcgcggagaattggaagccggcaacgcgtgcagagcaagtgatgaacgcgctgctgtcgctgattgccgagccggaaattgctcatccgttgcgctccgatcttgccgaggaattccaacgggacaagaagaagttcttcaaaaatgcagaagactacacgaaaaagtatgccgaacgtcgcgactgagtttgtttggacagatggagttatttgtgcatgaaagtcccgctggtatctacgaataatctctcgccactcaaattgttcaatttataaattattgtgttttgtctgtcgttgattattttgacttttttgtatcgatttaaacttgaagaaaa

SEQ ID NO: 90396 - DNA, 428 bp, Heterodera glycines
  SCN-specific regions: Sequence locations=1-395
ccactattgagattttcttgctaaatttgtgccgaataaacgcaccttgggaatattttaccggattaaataaaaaaaaagatggccgagacaattaaggatgccacccatcgcatgggccgaatgcttccggcagaggctggcccgcgttatgggctttacgcggcactggcggcaattgccggattggcctattgttaccgcgaccgtcttggatttaaaaagtgaatggacggacggcggaacggattggtcacccaccattttgatgagagagggggcaattttgaattcggattgttccaaggtccacaaattttatggccaatggtcggatcttttttcatttgatgctttttggtttcttttcactgtaaaataaatactatttcaataaaaaaaaaaaaaaaaaaaaaaaaaaaaaaaaa

SEQ ID NO: 90397 - DNA, 334 bp, Heterodera glycines
  SCN-specific regions: Sequence locations=1-334
gggcctttaggatattcggcataaatttgcgctcgtccatttgccctgagaggagaatgacgcaatttggagagcaattgacgggcgaccttaaagaagaactgcacgacgcatcaacaaatattgcaggagacaaacgaatggattgaattggctgtgttggaggaaattgtgcaccaaagggtgaagacgaaaccgaaaggcagcgaagtgatcagaacattcatcgaaagtgacaacatccgcacttttgtcgagcagggaattggcctaattgggcagtgattgtaaatttgaaaatcccgaaaaaaaagaatgcacataaaacaaagct

SEQ ID NO: 90398 - DNA, 762 bp, Heterodera glycines
  SCN-specific regions: Sequence locations=1-762
gtccataaaaggttacggaaattgtggcctatccgaaaaacaacttccataaaaaacgaaacttggcttattgtcatagagagagaattctttgctttgcttttccgatgcttcttcgtccgtgcccttctcttccgctcctttcaaatgcgctttctttcgttgtccatttgccttttcatcagcaaaagacaatttccacttcggtctttgccctcacagtgtttgaccctcgaattttcaccgagcccatcgtttctactgaggagttgaataaaccacttccgccaaatgacaagcgcaattatatgtatctgaaaccaatgttatttgaccaaactcctgttttctacagggatgaaattgtggacaaaatggtgcgcgtatttttgatggagggcaaaaaggaattgtcacgcgtaaatgttctttcggcactggaaattgtcaaacgaacgcaatacgaaaaatggcttaatgaaaaagacgagaaaagacgtgccgaaatcattttggaccccatcgaagttgcgaaccgcgccattctcaattgtcgtcctttgatgaagttggaaaagacgatcaaagccggcaccctttacttagtgccaatgccaatcagcgaaaaggtcgccattttcaaagcgataaaaacaatgcgcgacatttgccggctaaaggcgggaaagaagcgcaatgagaaaaggccacactacccgcactttaaggatgtgctcgcgtccgaattgctcgccgcgatgg

SEQ ID NO: 90399 - DNA, 1037 bp, Heterodera glycines
  misc_feature (8)..(8): n is a, c, g, or t
  misc_feature (50)..(50): n is a, c, g, or t
  SCN-specific regions: Sequence locations=1-377,399-759,800-997
cttcatanaaggtgaaaatggacgaatcacttggaaataaacggcctttnaacagcacagtcaaagaggatgattcagtttcattgtgcggaagtgtcgcaacaacggccgccggggatggctctctgttggactttgggcttgacgaagaaacattggcggtcgaatccgacacggaattcgagcgaaaattcttcgtaatgaaagagggctcttttccggggaaggtttttgctttgcctcaccccgcctcgagggaacgcgcgttgtatttgttgaatgaacatggcgaactctttgaactgctccgacttgacaatggaaagcgttcttttttcttttttgattccgtcgtggccaatggctccgttcatttgtttttccctgtccatccttttttcttggccattgaatgtctccagcggaatgcatctgaacattttttgactgcttctgaactgctcgaagatgacgactttccgtcattgaaagaattggcaaagagtgtcaaactgatcgacacactgaaaattgctgccaattttgagaatgacaattctacggattcgcccacaaaaaacttcaaattccgacacaacgaacaacgccttttcatttggctggaggaacgatttcgcattttgaaggagtccttagcagcgaattgtgatgaaaatgataattgtgccgaagatgaacaatgttttggcattttggctgattatttgccggaattggtggcgcaacggctgaaggagcgattgggcataaaaatgccaaagaataaaaaccagcagaaaacgaagaggattttggccgaaccgatcaaagggacggaggcgaaaggcgcgcggacttttaaaagaaaattaaccaaagtgttagccgaagcaagcaaagggagtcactcaatcgcctcattattcggttcaaacaaaacggacaaaaagtgatcggtggcgattcgaaaactaaccaacgattgttgctatgcccctttttattttgttttttttaatattattctatttttaaaa

SEQ ID NO: 90400 - DNA, 632 bp, Heterodera glycines
  SCN-specific regions: Sequence locations=1-632
gacggtgcaaactcaattcttcctcgaacgccaccggcactgtgctggattttgttgagaatccgacggtcaatatggggctgatgttctgcaaagggccgacgatgggcgtcaacggcagcgcatcggccgacggtgcgtcggtggcgcacaacgaaaaggaattggtggatgtgtgcaaggaatggttcctgaataaacccgactgggagaaattcgttgtcggtgcgatggtcgtctctttggttttggcctgcctcgcgttcatttggaatttggtcactttctgcgcctgcttttgccactcccacgtgatgaaaccgttgcccgggttggccggactcaccgccatgtgtttggcagtggcactcactgttttctacatgaaaaaccagcaatacatcccgatgatgaaggacaaacagttcgacaacactgaagaatttcggaagttcatccaaaaactcgacaatgatggaaaccatgtcggctattccttttacatgggctgtggcgcggccatcgtcgctttggcgaattcggtcgttggtgcctttatggtgtgtctcgctgacaaatatctctgatgcgcgcgagggttgccaacgttctgacgcattttgacttttctc

SEQ ID NO: 90401 - DNA, 637 bp, Heterodera glycines
  SCN-specific regions: Sequence locations=1-225,247-637
ggctttgaccaccgccaacacccgcacgacaatttcttctgctgatgtttcgaaggctggcaaagtgacagacaaaggcggcgattcagacgacgaagcggccgaagaatttgttccgacgggcacttttaagccgattgttccgttgccctcaaaagtcgatgtgaaaagcggcgaagaaaatgaggaggttcttttcagtgctcgttgtaaattgtttcgctacgacccaatggacaaaaagaacaaagaacggggaattggggagcttaaactgttgcacaacaaagagacgggccgttatcgctgcgtcattcgcagtgatgaccaactttgcaaattgttcgctaattttcccgtcttggccacaatgataagccgtatcactggtcagaagccgaacgttcgaactttgcagtgccgagacttcagcgaaagctccgagggaattgacgaagtgtttttgcttaaatttcgtgaccaaacgaccgctgaagaatttgctaacaaattggaggagacaggcaaaagattaggagagacgccgaaggaaaaggaagcggccgagaaagagccaagacaatgaacggagttgaaaagaaacggaaatgaaattcaattgtttccccctgttgct

SEQ ID NO: 90402 - DNA, 451 bp, Heterodera glycines
  SCN-specific regions: Sequence locations=1-26,48-286,308-321,347-424
aacactacaaataattttccgcttttaataatttcaaataattttccgctttttccaaatgttccatttgcgtttcgttgtgcttcttctgctggtaattgtcggccttttcattggccccaattttgtttctgctgattgggataaaaaggtggccggttgggacgacaagaaagtgaacaaaggctgggaggaagccgaagcaccgctcaacatccgtgcccgtcgcggcggatgggatgagcgcattttgggcggtcgtgaacaatgaatggagagaatgagtgaagaagaagaagaagaagaattcgggatggatgccaaaaaagtaaacattcattttcaattcaaactattgaacatacacaaaacaatgaatttctttcctggtcattttccaattaaataaattgaaatatttaccaaaaaaaaaaaaaaaaaaaaaaaaaaa

SEQ ID NO: 90403 - DNA, 684 bp, Heterodera glycines
  SCN-specific regions: Sequence locations=1-684
ttcgtagaatgatccctaaatttgttaatgaaatttaaatttacctttaccactaaaatcgttagatgttttttaattagccatttttgtcctgttttctattttcggcacttttagggacagtttgaatacgggggcggctgttgtacgacatgcacaagcgatgctgattgtacgggcgggaagacggcatttactcggtgctgcgcggctgtctcagcgactttttcgacttcccaccctccaacggagaggagggctgcacctgggggctgtcttcggagaatgcgctgatcgccaccagcgaaaagggcgaattggtgcaaaatgtgcgagtgggcgttaatctgtgcccggcaaaagaaggcactcaatgcaattcgttgttgagaccctccgtggaatacgcccagggcaaacagcaaacggacgcttcgacgagcgccgccggcaacgcttggccgtacagctgccgaaaatcgacatcaatggttcaatgcttacaatgctcgcgctatgattgggacggcgactgtcactggaactaccgggagtactgtaccggggcatggtgcacaaaaacaattggatatgttaacggtcgttggcttgagcagcgcggctgtgccccattcaatccgttgaacagccaaatttgcacaaaagtcgagacgaatgccgcgt

SEQ ID NO: 90404 - DNA, 665 bp, Heterodera glycines
  SCN-specific regions: Sequence locations=1-13,35-515,537-665
ggtccttagagaggttttaaattattttgtttttgataaatggcaacgacatcacaaatggcattggaaccacccattatggtcacccaagacacgggcatgaaagttactgttttcatctgtattccgggtatgcggaagaagggcggccttattgttcttctgaagcggctatttcgagtcaaatcccgggaccctttcacgctcgtttctaatgtcaagtttggacagtacatgttgacggatcagagcattagcctgctggccgaagtgtacacggacaaaacggcaatggacaaacggtccgaggaccgcaagagatacgagtggagcgttacgaaatttccgtcacaaatcaattctgaaagtgccgaattcactgtggagcaaaatggtgacaactgctacattgtgatgtcctgcatgaagacagacaattattcgactaattggaaggattttttgtctgccaatggcactctggacatgacaaaggcataattcggttaaaagtgaacggattgattgattgatttgaccatcgttttaatttaagcctatgtgtgatttcattgatggtttaaaataaattatctcatgattaatgctgattttatgaatcgaggcattgtaattatttaaaacaataaagcaattttcgatta

SEQ ID NO: 90405 - DNA, 650 bp, Heterodera glycines
  SCN-specific regions: Sequence locations=32-425,457-543,565-601,623 -650
cctcttgccgaattcggcacgagggtccttaaggttgaaatgcctttctccgctcctcgtcaagtgctcaaatatttctataaacggacaaacgcattttgggacaaatcgatgctccacaaggagcgagtcgcatatgcaaagctccggctgaagctgtacggcgcgttggtgctttccatgtggtatatgtatgaattcgccactcctccgcccgacgtgcgctttgacatacggtggttcttcagcagctcatttgccaattatgtgcagacaaagggtgccggtggcttggacattgcggatgagaccatgtacaaacagttctcattttcgaagggcagattgttggagaatgcgctcgaaacgccggagggacaagcgatgggattgtccgaaaggtttcactcatgagagggacaagcaacgaagaagaagaggaggaggaggaaaagcgacgatcacagaagaatggcactttaaaagcaaaccgagaacagtcacacattctataggccactttcatttcattttgtccaatcctatttattaaatgaaataatatttctatttttttgtttgattgccatttctctttcttcggattgtttttcatttgtttcgtctgctgatgaatgccttttttgcta

SEQ ID NO: 90406 - DNA, 644 bp, Heterodera glycines
  misc_feature (623)..(623): n is a, c, g, or t
  SCN-specific regions: Sequence locations=1-623
gttcagttaagccattctttcacttttgctcactctcatttttcactgaaaaaaaccatcgccaaaaagtaacatggaaaccaagcgcaacaactacaacaacatcgactcgttgtggagcactttgtgtgacctcggctaccaaacctcgcagggattggcctactccgtcggcatgcccaacttctcattcggcgccttcattttgctgtccgtcatgacttggtgctgctttttcatgccgcccgtggctgtgttcttccgcggctatctgcgcgacgggaacgcgtgcactgagcatgtcatttacaacatcattttgtgctttttcctgtgggtgcccggcatggtgcacgccttttggtactgcttcagcgacatgttcagcgggccgaagaaggagggcgccgggtacagcaaaaatgcctgagcagaagagcactggcgagcggacgaacgcagaaatgagcattttttgaaaaatgacgtcatcgatcttattaatttttgacacctaattaagcgataattaattatctctctcacccttttttcatcttgtaaaagtttcaccattaacctatcttttggttgagaaaaattaatgaaaaaatcaatggtcnaaaaaaaaaaaaaaaaaaaaa

SEQ ID NO: 90407 - DNA, 562 bp, Heterodera glycines
  SCN-specific regions: Sequence locations=1-44,69-317,339-518,554-562
gttcgtagaagagttccgttattcaagtgaagcaaattattagttcaagtcgaaatggctgagtctgagatggaaataccggatacgatgggcgaacgtatggaaaagcacaagaattcaggccagccgatgatgttgcaccccgaccacccggacaattgggaccctcgctatcacgaaaaggcggcgcatcttctctggtcagctccatatgatgcacgttatccacaagtacggaagcagcgtcagtgtttcgaatattatgtggatttctttcgctgcaaggagctgatgggcgaagactacaaaccgtgcaaattcttccagaatgtctacaaagacatttgcccatcattttggaccgagaaatgggatgagctccgtgaggagggacgttttcctgcgaagttcgaccgttaaattttcggcgattatttaggacacttttgatgtgatggtgacattcattgttagttgtattcattaatacaaattcgtgtgtcaataaattggcgatgtaaattaaaaaaaagaattaaaaaaaaaaaaaaaacaatcatca

SEQ ID NO: 90408 - DNA, 483 bp, Heterodera glycines
  SCN-specific regions: Sequence locations=1-51,92-413,450-483
accattagttcatgcggctgggcattttactttttgtttttcgcttttcattaaatttaattgcaaaaacaaatgccacttatttttatgtacgcggtgaattgtggtgccaaggagagccttacgttggcgccaaaatcttcctgatggaggctgacacgcttgatccggatgatttgttgggcgaagaacgatcggcgcccgacgggcgctttgaagtgcgcggaggtgagagcgaaattggcgacgaagaaccgtatttgatggttgggcacacctgtccacagcgaggtgtcccacctgacccggcctgccattttttgactcgcgttgatttgccaaatttcctcactcacattgaagtgccgccaattcatttggacggacaatacgaatttcagcatatttgtggcgaggatgatgtttaaaaaatatgaatgatggatgaataagataataaacagttcatttgcccatcttttt

SEQ ID NO: 90409 - DNA, 509 bp, Heterodera glycines
  SCN-specific regions: Sequence locations=34-333,358-434,471-474
ctctgtgccgaattcggcacgaggattttaattaaaattatccgaaaatctccatactaaaaaaatgaattctgcgacaatgttcactctgctgttgatcattggcactgttcttgcactgacaattggcatgccaacccccggcggatctgatgaaagtgtctcatcgatgcgccaaaagcgcggctacggaatgagcaacggaggcggaatgggcaatggatttggaggcggaatgggcaacggatttggaggcggaatgggcaacggatttggaggcggaatgggcaacggttttggaggcggaatgggcaatggttttggaggcggaatgggcggcggaagcggcggtggctatgggtacggtaaacgtcgctgatgaattactgtgttttacattatgacgacgacatttgatatgctcagatttatggaaatttttattcatttgtatttataaataattttaagtttaaaaaaaaaaaaaaaaaaaaaaaaaaaaaaaaaaa

SEQ ID NO: 90410 - DNA, 799 bp, Heterodera glycines
  SCN-specific regions: Sequence locations=1-300,325-386,409-426,452 -673,695-799
caccgtcaaggaggtacggggcaaagaagggcggtggaaagagccttgaggatgccacgaaggcggctggagaatttttggaggagcattggaatgcattcgagaagcgccaaacgacagcagtgcgttcgggtggctgaacagcgcattgtccggatcgctcaatcaatgcactttttggtgttcccaacaacaaacgctgaacaaacggcggttgacaaaatgggcgaagtgcaattgagcaaatgcgctgaacaaacagcgaagattgttgaccgtgttcgtgtccatcgccattcgttgtgtgctggtggtgctgctggtccttcttctttctgttgcccatcatcattttcatcgttatccatttccaatccgccgattgctcataatcataatcatcatcaacaaccgaaacaacattttcatcagcagcaacagcagcagttgtccttcatctcggccccgtgtgcgttgcattcttcgcatggcccttcaacaacaacggcaaatgccattccggcccagttgtttatgctctcaaaaaatggtcgcgaatgttccaaactccgtgagatggtctcttctctcggcgaacaattgaatgtgccgtcgacaacaaaaatttcttaaatttacctatgcttcaaactcgttaactgtctgttgatgatctgctgtttctctctcttatggaattttaaaaatttcttttttgtcttcttttttttctttattcactttgatcaaagtgctgctatgtcttttttattcgtcagttggtcaaatatttgtttca

SEQ ID NO: 90411 - DNA, 736 bp, Heterodera glycines
  SCN-specific regions: Sequence locations=1-633,655-711,733-736
ggactgtaggatgaaagaccaggcatatttggtgggagcgttggacaaagtggagaaattggctgtccgggccaatgacaaaacgaagaagttggagcacgacactttgttgaaggtcaaagagttgctggagacaaagtttgtacggcaacacgaatggaatgagaaggaaattgaagtgctcaacaaacaccttttcctcaccgcaaagccaatcgtttatcttgtgaatttgagcgaacaagacttcatcaaaaagaagaacaaatggcttccgaaaatcaaagcgtggatcgatgagaatgacccgggcgctgtattaatccccttttcgggtgcctttgagttgaagtcggttgaactggaccccgaggcgagggcccaattcttcaaagatacgggtgcttgcagcgcacttgacaagatcattaagactggctacaagaccctttgcctcgagtatttcttcacagccggcaaagacgaagtcagagcatggaccatccaaaaagggaccaaagcgccgcagggggctggacgaattcataccgattttgagaagggattcataatggccgaagtaatgaaagtggccgatttggtcgaattgggcaacgaaaatgcagtcaaaggagcggggaaatacagacaacaagggaggaactatgtggtggaagacggggacatcatcttcttcaagttcaacgctggtgctggtttgactgctgccaaaaag

SEQ ID NO: 90412 - DNA, 887 bp, Heterodera glycines
  SCN-specific regions: Sequence locations=1-177,200-777,817-887
accatagacgctggttgacggatttggcttcggccaaaaattctgtatcacaacaatgacaatctgattaccttcacacatttcgatgtggacatggctttgttggtgttttcggaggctgtcgacgcaacttcggttatgtccctaattggaacaacggcgcattcgttgcttgcgatctctccgttttccatggctcctcagtcgtccaaatggtgccgtgccaaagtttggcttgcctctggcggcatttccttttctccgtccgccggtgtttttcgtgccggcagtcctcgctttgtgaacactgattttctgaccaagtacttttcgtcgtctccaagctgtactcggacattgccaagaaaagcactcacttcgttagtgtcaatgtgcgaggaattaattgcggaggagaacaatccgtgggaagtgtcggcactgacgagtgcccgtttagcacttgacggaattacgcaggaaaccttcaaattgacggaacaaaattgcgagaaattgaagcagttcgacccgcaacgttcggcaatgtatgacgaaatgtttgacaaagtccgaattatccacgaactgaccaaaaacacttccgacacacccgagcaaagccaattggatttgcttatggaggcgaaaagcgatcggcttaatctgaatggaattggactgatcagcctgctccatcttcggcctctgtccggcttagtccaggaactcaatctgcagaacaaccgggtcacttctgatcagatcactcaactctgctcatttgctgcgctcacttccctcactttggatggcaatcccatcgacagactccctctgatcaatccccgttggttccctcgcttggaattcctttctttggctca

SEQ ID NO: 90413 - DNA, 790 bp, Heterodera glycines
  misc_feature (770)..(770): n is a, c, g, or t
  SCN-specific regions: Sequence locations=1-558,580-790
tcgtagaggcgttgaccgctcatttgttttgtgttgtgctgccagcgccgaccattcgtctcagcccttcccatcatttcaaattccattattcccgtgattgtccaaaatgatcggcggaatcctggaagatatctggacgagatttatcgacttggtggaggacatctctgatcagtacgacgattctgagcaaccaacaatcatccaccacgaaccggcaacaccaacaacaatgtttgacaactatggtccgattgagaagattgttgtggtcggcaccggcctcatgggcagtggcattgcgcaaattgcggtcgagtcgggcgtcaaagtgtgcctggtgggccgtagtcaagagaagtgtgatcagacccggctgaagatcaacacgggagtgcaaaagtcgatcaagaagcgcatggcaaatgaaactgccgaggcacaacagcagttggtcgaggcgacaatggaaagccttgagctggtgaccaacttggatgaagcgggcttgtcagatgccgacattgtcattgaggcggtggttgaaaatctgaaggtgaagcagaagctgttcacggaattggaagctaaggtcagcgagaagtgtctattggtcaccaacacttcgtcctttctgctcgaagacgtatcgtgcaaaatgggcgccgccaagcgcgagcagttcggcgggttgcatttcttcaacccggtgccggccatgaagctggtggaggtggtgcccggcaatggcaccagcgacgcggcgnacgaagtgctggccaacttt

SEQ ID NO: 90414 - DNA, 735 bp, Heterodera glycines
  SCN-specific regions: Sequence locations=1-17,39-177,201-407,429-735
gttgccccaggtgttacaattaattttttaattaatttgacaatgacctatgacgaggattacatgtcaagtgctttcttggcaaaagtggaagatgttaagccaggtgtcggcaccggaagagaggggcgtcgaattttgcgaattaatgccaaccgagaagaggcgattgaaagacagcgggtggagaagccaaagtcaaaagccgaacttgaaagggacagactaatggagggactaaacaatccgatccgagcggagtcaaaaggctttcaattgttggccaaaatgggctacaaagagggcatgcgtatgggaaggagcgcagcggacgaacagcagatggacagtcggacgaaggagcccattctgatccaactcaggattgatcggtcgggcgtagggatggacgagcaccgaaaggagaagcagagggatttgtgtgaagcgcacatggagcgaatgaagcgacaggcggacaatgaggaagaattggccatcgatttccgaagacgcaaaagggcagcaatggaaatgaagcaactgatctcggagatccaaaaactgagaaagacgtgccaagagatggacatgcgaatgggcaaaacaattccagacgaattttggttttggccgatttattcgaacaataatgaattggtcgacatggtggaagtggtcgacaaatcaaaccaatcgatggatgaaaacaaacggacaaaacgagagccttca

SEQ ID NO: 90415 - DNA, 1019 bp, Heterodera glycines
  SCN-specific regions: Sequence locations=1-316,339-381,408-783,805 -906,949-1019
tcctcaaaagcttcaattggccaacaaataccgtcgaccggtgctttcattgcggaggatgtggacggcgaggcacttaccacgctggtgttgaaccgtttgaaagttggtcttcaagtgtgcgctgtgaaggcgcccggctttggcgacaaccgaaagaacacgctgaaggacatggcggtttcaactggtggcactgtgtttggtgaggaagcatcgctgatcaaacttgaggacatccaaattcaggactttggcgaggccgatgaagtcacggtgaccaaggatgacacgctgattttgcgcggcaaaggctctcaggaggacgttgagaaacgcattgcatcaatccaggatgaattggatgcttccacatcggactacgaaaaggaaaagctgaatgaacgtctcgccaagctgtccactggtgttgcactgctcaagattggaggtgccagcgaagtggaagtcaacgagaagaaggaccgtgtgacggacgctctgtgcgcaactcgtgcagcggttgaggagggaattgtgcccggtggtggtgttgcattgcttcgcgccttgaaaaagttggacacactgaaaccggacaatgatgaccagaagagcggcatcaaaatcgtccaaaaggcgattcgccagccaatttccaccataatcgccaatgcagggcttgagccctcggccattgtggagaaagtgttggccaatgcggagaccaactacggctacgatgccatgaatgacaaatttgtcaacatgttggaagcgggcatcattgacccaacaaaggtcgtccggacggcgttgcaggacgcggccggcgtggcctcgttgatggcgacgacggagtgcgttgtcaccgaaatcccgaaggaagagccgccgatgccagccggtggtggaatgggtggcatgggcggtggaatgggtggagggatgttctgagacctctcatttgtcattgttttattgttacgttttttcactttaataaaattttgacattg

SEQ ID NO: 90416 - DNA, 387 bp, Heterodera glycines
  SCN-specific regions: Sequence locations=1-28,50-192,214-234,256 -283,305-387
aatccctctgactaataatgtcgctgcttttttcgcttttcagttctctcgtgtcggatttgttgaagggtctgatgaaattattacttttcttcgagcagtgggcagggcagtgccaatatggtgccgagaaaacagtgaccttcgtgggcgtgtcactccgctcatttgtatgtccatcgaacaaccgttgggtgagcattttagaaagaagagagctgaaaacccgacgaaataatcttctcattttttcaattgtattgctgctttggacatttcagtctttttgctacgattcctttcaaatatcaaaattgtcacccaaaattctcaaacataaactgttttcaaactgcacactaacccaaataaactaaaagaattgtc

SEQ ID NO: 90417 - DNA, 1158 bp, Heterodera glycines
  SCN-specific regions: Sequence locations=1-125,147-308,330-800,822 -922,947-1094,1118-1134,1156-1158
ctctattacaaattcacaaaattctcctgcttattgtgtgcttgcctatgaccacggggatggtgtgttgcgcgagataattgaccatcttggtctcttggaaagtggcgggcttggagcccagcaaaagaaaattggttccgaaactttgccatgccacacgctccatttggacacaaagtattacacatgcgatgtgcctttgctcagttgtcactcatttgtgcgtctcaaatcaatttgtgcagctgaacgacgtagcaatttgtcagtgttcgctgtgctcttttgtgtcactcggcaacagttgacagaagactttctggcattggtatcacaatactcggccagtttggagaaggcggaagtgaaggcacttgttttgcgtgatgatcaaactgaagaagcaaccacctcaatgaacaccaatgatgaagtgttgaacaaatttgctctgtcacgacgcatcgaaatcatcaaaatcggacggaaaacgacaaatgttgtggacgatgatgaggaggagggcttggttggcattccgcgaattgtggaatccattgaaactgtctgttggccgaacatgaaactgaagccgaacccggtgaagcagcgcgagcatcccactcgtcttgaaaaatacatcaactccgaggcgtgcgctgatgacactgcggtttttgacatgttcccccattgtgctgatgattttgctccgggaattgcatctcacagagtcaatcaaatgccaccggagaaggataaagcggccaacattgagccgacgggttccgattaccctgacagtgaagatgaaatggcaattttggaatggtttgacaagccgatcagcgaagacattttgaacctttctaacattccaccgccacaaaacaaaatcaccaatctgcaaccggctcgcgaaaatgatgatgatgatttggatatcaatgcatatatctgcaaaaacatgaacgagttacgcatcggcaacacccaacggcccttaatggcgcgagtcgatgtcaacgagggaatcacttacgaccttttgaaggccatttcctcttcatgcaacaacaacaaacggggcgatagtaataaataattgtttttgctcaatttccatttgcctttttgtgttttaaatttttactt

SEQ ID NO: 90418 - DNA, 1074 bp, Heterodera glycines
  SCN-specific regions: Sequence locations=1-1074
ttctttataagaaagtgcatttgcgccatttgattttaaatattctgctgaaaacaatgtcaaacattcatactctcggcggtgacgacgataacaaatctcgacaaaggtccaactcaagtgacgatgaaaacagcgatgaggggaggcagggcttttttgttggcggaagtgatcacagtggacaggaagtgctggggccgaaccgcaacgaaaacatttctgctgaccatttctttgatgcaattcggcgggctggagcggaacgaattacgcaggaacagaacgaggcactgaacatgccgagacaaaccggcggaggtgctggccagtcgcaggtggcatttcgactgggcggacacggaatggagagcgaacgaatcggagggacgtcggcgaccgcggggggtaccactcgccagcaggctccggttgttgttcgtctcgtgttttggaacaatggctttaccgttgacgatgggccgctccgacaatttcaagacccacagaaccgggaatttcttcaggccgttgtgacaaagcgtattcctgctgagctgacaatggctgcgccgggccgtgaaattgacttgcgaatcgaaaagaaaggcacggaatatgaacagccaaagacgaaggcattctcgggccagggaaaccaactcggcacaatcacgccgaacgtgggagggtcggcggacgttgtttttgttgatgcgccgccgaagctttcggcagaggaaactgccaaattggtggaacaagctcaggccgaactgaaggtggatgacaatttgccaaccactcgcattcaaattcgaattccggacacggcacggcccatcgtcgcgcgccttaaccaagggcacacagtgaatcagctgcgcattttcattgtcactgccgacccgagtttggcctaccgtcccttccgccttatgacttcgtaccccactcaaccgattgacgacgagggactcagcgtcaaagacgccggactgctcaatgcgacggtgttggtcaaatttgaatgaatgagtgcctgacgaatgattgaattaccaacttcaacgg

SEQ ID NO: 90419 - DNA, 387 bp, Heterodera glycines
  SCN-specific regions: Sequence locations=1-160,184-387
cttcaatcgctcataactccgtttatatagaactttgaggttctccacagtgttcgaaactcacaggtgccaacgcgccgaacacgcctgagaaatcggccacggcgcctgaaaaatgaaggctccgcgccgacttggccgcaaaaaattgactcccccctaaaaaaaaaaaaaataatttttctgttagatgagttttttaaatttcgacgcacggcaccggattctcacttttcactgaatgcgccgtgatatataggcaaaaagtcaatttgcccactaaaaaatcttctatggcccctaaaaatcgagcttcatgggccacatgactccttaaactcgaaagttagtttcgaacactggttttaaaagtggttcaattggttt

SEQ ID NO: 90420 - DNA, 742 bp, Heterodera glycines
  SCN-specific regions: Sequence locations=1-19,44-46,77-77,151-742
cgcatagatgtttcggcaattatttgaagcaaagtcattcactcctcctatttgctgggatgcacaaagacgagacaggctctggtcatcgatccagtgatcgaaacggttgagagggatgcctcattagtccacgagttgggactcgaccttaaatatgtggtcaacacacacatccatgcagaccatgtgacgggttctggcgaactcaagcgcaacaaatactttccaaaagcaatttcgattttatctggaaaagcgggtggaagggctgatttgcttgtcaaacactccgatttaattcgttggggggatggactcgaattggaagtcagagaaacgcccggacacacaaatggctgtgttactttagtatgccattccaaccaaatggcattcactggcgatgctcttttgatcagaggctgaggaaggactgactttcagcatggaaacgctcggactcttttccgatctgtgaaatcgcaaattttcactcttccccccgattatcttatctatccggcgcatgattatgccggcagaatggtttcatcggtttgggaagaaaagaaattcaatccccgtcttacaaaatcggaggaagaatttgcggcgataatggaaaaccttgggttgccttatcccaaacaaatcgagaaatctgagccggccaatttgctttgtggaatttccgaattgatggacgatgcgttgagaaggaaagtttttggagaaaaga

SEQ ID NO: 90421 - DNA, 630 bp, Heterodera glycines
  SCN-specific regions: Sequence locations=1-630
gccatataaggaaaccttttcatccattccccttcaatgatctcctttcgtcattcggtcaacaaatgtttgctgccacaaattacaaatcggttgacttccaatttgtccgccatgtgtctttcaacggctgcagctgacaataaagttgtttcaaaatatgacgactatcagaaggaaatgcgtcttaagcaaatcgaacgcgcttttgacgaggcgatgcctaaactgttgcacggctcctacaacaatttgatggcgttcctcgacacgaattccttccgttttgaagacaaagtttggctctttgagtcagatagcattcacaagacggtttttcgcatggcaaaagtccgtttgtatttggccttcaaatctccgcacaatcgttttgagacattgggcacacatatttgcctcgacgagaatttggtgacattaatttggcagctttcctggccaaaagatgcaaagtctgcctatctattgtctccaaagtcactggctgccaacttttctgctacgtttaccggcggccctcgctcccaaattggacgcattgagcacaaattggccacgagtgagtcttctgatcgcccgccctccaacgcgacaacccaaaatggccga

SEQ ID NO: 90422 - DNA, 648 bp, Heterodera glycines
  SCN-specific regions: Sequence locations=1-14,36-648
gtcctttaaggctgtttcttcatgtatccaccgaaagacagcgacagcaacttcttcccgaatcgaatgttgagtgtggacagaagccggagcagcagctcccatctcgtcggtctcaatgctgctctgcaaggctgccgttcggacattccgttcatgttgcagcgtgtctcattttccaaggacatcaaattgcatcggatgcttcgctatctgcgcgcttgcttcgtccgtgacatccgtgaacacaaccgtggcttcaacaatgggacccaacaaaccacaaaatgccaaccggagatgatcgaccaaacgaatggcgtgttgaacaagcgaagctggctggagcagaacgcctactttgccgagaacaattgcttctacccattctacggccaagcagtgttttacgcatcgtttggccagcacagtgagggacgggtggtgtgctgcagcgatggacgcattgatgaggaagagagcttcaaggaaaattgcaagaaaatgacggatcacatttacgcagccaaagctggatggcgcaagggaaaggatgcccaatgaaggaacgaaccgacgatgattgatgatgatgtgattgatgaatgtcaatttctatgcatattcatttagcaaaatattgcggtt

SEQ ID NO: 90423 - DNA, 806 bp, Heterodera glycines
  SCN-specific regions: Sequence locations=1-398,420-806
taaaaataattggaacattgagcggtattcaaaagtggtgcggtgtaaaaggcataatggaattattttacacccaaagtgatcaaagacaaacgaatgaatggattagaattctttctctctcttcgatcagctgaagatgaatcttgtcggcaccgacgcattggcgtcaaaagaatagccgccgccctgcgccaagcgctttgacctctccaaattttcctctctcgtgcaaatttccatcaaatggttaagctttgcaactcgtgcctcgccaattcgttgctgatcagaaatgctgaccaaaagaggcgaattgcgggtattcatttctgaaattgttaattaaagttttcaatcagtcaaagaatgacaaaggaccttccaatgtgtgtttgaacaaaacaaacacattcagacatggtttattgtcgccttggtcgtccaatggtgtagaaaatgcctcaaggtcagtctcttcctaaaaatgccgaattaattgaaaaggatatttctgtgctttttttgcgttgaataaacacacctcaaaatggtggtgctcttccgagtcggtggtttccgatgcaagggaaaggatgtcgcccggtgctccctctgtctgatcgtccatgcttttgttggtgctcgacttccttcgcgtcctccgttcttttcgctcatttcgttcgtgctccaatgccatcagatattgcgagttctcttgaaatttgacgtttctcttttgctaagggtttcctcaatgtgctcaccttcgtccacatcgtcgtctgagtctttcaactctc

SEQ ID NO: 90424 - DNA, 941 bp, Heterodera glycines
  SCN-specific regions: Sequence locations=1-232,301-530,552-850,872-941
cacttatgaaagtactcaatgacccgtaaaaggaatcgtttaaaacgtaaaagcaaaagtgttgccgattattccggatctaacggatttgtcccagcgaatggcggtggcgcagtgcagaaaaaccgaccggaccggcgacaaattctgttttggaggagcccgttcaggacactgctgtatttcgtgttggaacttgtgcacatcgtttgggatttcggcggaagattgttcgtccttcgctttctcctcccctttctgctcgccttcggctcccttctcttccttttcttcgtccccggtgcgcacagttcgtatgtgaggcatttcgagaagaaacttctttggtgtttctattggctcggattgggcgttctctcctcaattggacttggcacgggtcttcacacatttctcctttatttgggaccgcacatcgcccgagtgactctcgccgccttcgagtgcaattctttggactttcccgaaccgccttatcccgacgatgtcacttgttccacagatgcgatgggtcattcttcgttggttacgctttggacaatcattgcgaaggtgcgcttggagtcactcatgtggggcgcgggcaccgcactgggcgaattgccgccctttttcatggcgagagcggcgcgactgtcgggacacgagccggacagcgaggaatatcgagaattcatcgcaattgtcgaacgcgatgcgactaatcaaatgaatttgatggaacggataaaactttggatggaaagggccgtgacgcggatgggctttcctgccattttgttgttcgcttccatccccaatccgttcttcgacttggctggcatcacttgtggtcactttctcatccctttttggacatttttcggcgcgactttaatcggaaaggcactcgtaaaaatgcacatgcagatgttgttcgt

SEQ ID NO: 90425 - DNA, 803 bp, Heterodera glycines
  SCN-specific regions: Sequence locations=1-450,472-708,730-759,781-803
ttcatacatttttcatttattcgcctgttttgtgaatgactacttttttgtccttttctgttgaccttgaacagttggaaaaggagatccaggcgaaagaagccgcttctaaaagggacaatgtgacggacacaaaagtgcagcccgacttaaaagggaacattggcagcggaacttcggcacaaacaaaacggaagagcaatgtggtgggattggaggaggacttcgacacgttggacgagccaatttgggaaacaattaatcgggacttgaaaatactgtacggaaagttctcgcaagtgcttttcccggccaagagtgaacaaaatgtgctgaccgactgggacttgtggggccctctgttcatttgtgttgccctttcgatacttttgcaaggcgcggacagaggggcgcaattcacgcaaatattctccttggccttcttcgttcctttttccaagctttgtgtgtcattggctattgccttttgccgtacgttttcgcgtccgttgccatcaaaagtctgtcgcttcttttctggcacaaatcttccgccaatttgcttcttcgtgcacttgccactgtttctggtttcgcttgggctctctacgcttcaactttgtttttggccggctccgaaccaccgaaccgacggtttctgttctattatccgcttgtgctgttttactttgtcttttcttggcttgtcatttcttttgcgtaatatttttgctgaagaattacctaagtttttgttggtattaaaatattatttattaacatatcataattagaattagtgt

SEQ ID NO: 90426 - DNA, 936 bp, Heterodera glycines
  SCN-specific regions: Sequence locations=1-856,878-883,905-913
gccatgaggcgttatttggacaccgaaaaggccgttgaggaatttggacttcgggaggatttaagagctgctttggagaatttcctagtcgagtccgacattcgttctgaccattctctgttcactttcctccacaatctcctcccttacattatgcttctcaatgtcattcttcttatacccgcggcgctgttttttctccgctcgacagtttccactcgaaaattggtcacatttcttttgctgagcactttttgttggtcatgttacgcaacttacatgcgaaaataccaggaaattttggctgaacgttttctgcgcactgacgctgtgtttcgtcgagggggaggcgtttgttctcctcaaggcttgttaagcgaggcgtttgatgtgatgctaagttatgtgagaataaaacaaaagagcgagtgtctgaaggcgtatgaggacgaactaattgctcccctctggcaagtcgacccgttgcaggtgatcgccgaagtgttgtccaactttttcctgggcggtcttcccgcttccggcacccatctgaaccttttcttcaataatttcttcgtcgacacgccctttcatttggcattggtcaaaatgcttttcgccattgcctttccgttggccattgcttatgccatttatttatatgcaaattgctacacacgaaaacagcaaaagaactcagaaaaagaacagcgacggattaagccaaaagagacgacgaggacagcgataagcagaagcaacagccaagcggaacttattgtgagcagtgtttagtcggaaacatcgcaaaactcaaagtgatttgacaagttacaaaacattgttgactgatctcaacccattttagtcattttttattgacatttttaaaaatttataaattctgttttataaaaaaaaaaaaaaaaaaaaaaa

SEQ ID NO: 90427 - DNA, 618 bp, Heterodera glycines
  SCN-specific regions: Sequence locations=1-56,78-108,130-618
tccatgatatggttagccatgccaaaaatggacatgaccttccccttccataccagtgagttcattctcctcaaagaatggcttcctcagagtattttcgcttatctcttttctttgcttgctgtgctcgccctttcggtggcttatgaattgctgcgtgtgttcagagccatccttttccaaatcgctgaaagacgtcagagtgaagagtgttgttcgccggtggcgagtgctgccccatcctccggtgccattaccgcctcctcctcatccgtcgccgcctgcaactgcttgtctccccaactcttttacaatgtcccccaatggtccttctcctcccaattggtctcccatttccatctcttccaatctctgctccatttcattcagttttttttgggtttctctctgatgcttgttgccatgacttacaatgtgcccatctttgtcgccctcctcttgggccattcgctcggttactttctcaccgcccctctctatcgccatggattggctgaagaaaatcggactggcggagattgctgctgttcataaacttcactttttgtttgcataaattcattagcaattaagttagagcgttttaatggtccaaaa

SEQ ID NO: 90428 - DNA, 928 bp, Heterodera glycines
  SCN-specific regions: Sequence locations=1-613,635-707,730-928
caccttagagcattaattcccacttatgttctgctattttctcatttttatcttttgctcgttttggcaaagggattcgaaggctacactttcagttgtttggacgggtgcgaatgtgacactgatgacgaggccatccattgtcacaatcgtcccgatcggcactttgtccaattgcccccgtcgcgtctccgcggtttcactgtgctcgcgctcacccgcaataacatcgatgtgctgcccagcgaagaagtactgctcgagaaactgcccgacctgaaggccgttgacgtcgaagggaatgaacatttcgactgttccacgctcgaccattatcggacattgatggtgatgagcgattgcggaaagactcccgaacaattggaggccgaccgggccaaactgccgacggacacacagccaaatgaggattgcgacttcgaatgcgtggcgaaccgacgcagtcgcgagttgcgcgagtacgtcaaacacttgtgggagatggtcaaagagaaggtgagccgactggccaagaagcacggattggacaaagtggtggacgacgtgggcaatttcttcaacgacgtgggcgaacgcatctccaacatcaaactgaagaagaagaaatgagacggacggaaggaacaaaagagaaaaacaccaaaaaaaattggaaaggaaattgaaagattgccatttaaatcgacgagttcagaacttcctgtccattttgcttcgttatctctaaatcattaacacaaatctcccccatccaatcccatcataacgagttcatttctttttttcttgccttaactttttatataaatctcttgcattttaatttgtgatttcaatttcatatgcattcataatcctgtaaaatatgcataatgtgtcattcgagctcaaataaattctttctttt

SEQ ID NO: 90429 - DNA, 616 bp, Heterodera glycines
  SCN-specific regions: Sequence locations=1-159,182-616
atcaaaacacccaacaacttgcacaaattgccttcctttgcttctaatccgtcccagcggtgatcagagcctcgagaagtttggtggacattagcattctgacaacagaagaaaagggtgaggaattgacggacaaaacaatgctacatctgaacacggaattcacatggaaacggcagaaattcaaagtgatgttgccccttccgagcaaaccgcaggaaaaggaggcggaagcgacatgcaacacagtgcaacaggacagaaaatattacacggaatgtgccattgtgcgaataatgaaatccaggaaagtgatgaagcacggtgcactcgtggaataggtcataaagcagtcgcagctgagatttgttcccgatgttcagttcatcaaaaagaacatcgaatcgctgattgacaaatactacctacaacgaacagaccaaaacgacgaatacgaatacatttcttaagtgcaatattgaaaatctaacaagatatttccattatgattgtcctcccttttaacttgtccagccggagattagtccatttcctctaagccaaacaattgctaatgctcaaaatattcgatgatgaagagaaagaaaacccacta

SEQ ID NO: 90430 - DNA, 1258 bp, Heterodera glycines
  SCN-specific regions: Sequence locations=1-77,99-710,732-1258
attctttcgtatacctaattcctttttaaccacactgtctcggttcttataatttgttagtttgtttgcccttattgtcctcttttcccctccttttccctatttccgttgggcgaatgcttcatttcattcaatttagcagatggctttccatcaataatgttttaggaagatggggacaaactttgcttgggttttgcttatgctcggcgagggaaaaagaatgcatgggaagggagtggaagagcggcagagattgccttgggcatggcaatggaatggccagagggaataatgggcggctcttctcttttgttgggccgtgcctttttgagaatttggtaaaatgccgggaagaaaagagagtgtttaacggaggcaatgagagagttttcatctcaccataaaaacattctatgcccaaaaggatggaattttcatcttagatttctctcccatcaaaattaaatcagaaaaaatctgaaaaagtcgtagtttcttctgttcgaatggatcgtctctcgtggtatcagacgggcgagtcgatggaggaaattctctgccaagcgggcagtgttggcatttacgacggggacctcaaacagacgtcgttcgaacagggcaccgcttcactgacttatcagcgaatcatttgggccgattcgactgatccggattgtcgccttgttcttcaccattcgatggtccacaaaatagaaaaacagcacaaaacaatgtttggacgtggcggcaaaatcattgtgacggtaaaacccgtgacgcctggccacgcgcaagggccaatcgcggcgagcggcacaaattcactgcgattcgtcttcagaaatgggggcgaggaggaattttacaaacgttttcttgatgcgctcaacaagcaaatgtggcagcgcacttcgtccacttcaagctccgccagttcgtcgcgaaacagtgcccagcagacgcaaacgatcgtcggaagtgccggcggaacggtcgcacctccgcggagtgttggcattttgggcattgaaaagcgactggctgaacaacaccaacggacacatgaacacatcagcgaggcttttgaagacatgagcaaactgatggagcaggccagggaaatggtcgtgttgtcgaagaatatcaccgaaagattgcgacaaaaaaagggcgaaataacggaggacgagactgtccaacttaagtcttatttgctctcgttgggtgttaatgaccccgtcacaaagtcatcttt

SEQ ID NO: 90431 - DNA, 800 bp, Heterodera glycines
  SCN-specific regions: Sequence locations=1-572,594-800
cctaattaaggcttttcacctgctgatctcattgccgatgtgcgcttccgctgctctttccgcttttgcttttttggatgattctgaggccgaaatcgactgggacgaacgatgtccaattgtttattccgaggattacaacatctcctttttcggcattgagaagtgtcaccccttcgactccaataaatggggcaatgtcttccgctttttgatagcaagtggtgccctcgtcgaaagtgccgtcctccgaccaatcgaagccaaaaaggagcatcttttgctggtccactccaaaaaataccttcgctcgctgaatggccgcttcactttgactcgcattttggaagtgggcctcgtcctcctttttcccatttgcctaatcgaccgtcgcatccttcgtccaatgcgaattcaaacgggaggaacggtgttagccgcgagagtcagcctaattaggggctgggccattaacatcggtggcggctttcaccacgcctcagagggaaaaggcggcggattttgcgtttatgctgacgtcactttggcaattaaacttttgttcgctaatgaattgatcaaaagtgcaatgatcgttgatgttgatgctcatcagggaaatggccatgagactgattttgcctctgacagtcgcgtgtatatcctcgaccttttcaacgcgtccatttaccccggtgactccgatgcactgaagtccgtttcgcgcgctgttccgctcccttttggcgctgaggatgatttttacctccgtcgactcgaaatggaattggacgccgcct

SEQ ID NO: 90432 - DNA, 844 bp, Heterodera glycines
  SCN-specific regions: Sequence locations=1-584,607-715,744-844
caactttgagtccataaaatcttccaaatttactctaaaaatgccgttgagccctcgcattggccacaacccgtcgtaccatgttgtcaaggaggtggagatcattcgtgaagtgatcacctccggtgggccaaccattcaacacgataaaatcattcatctgctcacttcgccaaataatgcccagcgccaagaactgctccacaactaccgtactaagtacggtggtgctgatctggcccaagcgctgaaggaaaagttgccgccaagtgaagtggcgaccaacagcctgtatttggcactgttggacacaccggctgagcatgacgccaaatacttggccaaggcgatgaagggattgggcaccaacgaagacatgcttattgagattttggtgacccgcagcaatgcccaactgcgtgccatcaaggcggcctaccagaagttgtacggtcatgggttggagaaggacctggcggccgagacaagcggcagctttaagactctgctgctcgacttggtcgaagcgaaccgggatgagtcgtaccgtactgatctggccaaggcgaagacggatgccgagaaactttacaaagccggggaaggcaaatggggcactgacgaagatgcgttcatcaaagtgttggccaaccaaaacttgagtcagcttcagctgatgttcaacgagtatgaaaagcttggcaagaagcacaccattgaacaggcaatcaaagctgaattcagtggagacgagctcagtgctctgttggcaattgtcagctttgtgcgcaatgggccaattggcgaaatggcggaaatgctgcacaaaagtttgacgaaaggt

SEQ ID NO: 90433 - DNA, 374 bp, Heterodera glycines
  SCN-specific regions: Sequence locations=1-347
gaccttacttacttctatcaaaatgcaaaacgacgcgggagatttcgttgatttatatgtcccgaggaaatgttcgtcgtcttctcgaatcatttcggctaaagaccacgcttctattcaattggaggttgtcgaggtggaccaggcgactgggcgaatgattaccggcaaaacgacgaagtacgccatttgtggaaagttgcgcttcatgggcgagtcggatgattgcattctgcgcttggctcagagggatggaataattccgcaaaatttgtgaacgttgattcttcacagggatgcggcgttcttttgttgattttgttgcctgcagaatgataaacactgttaaaaaaaaaaaaaaaaaaaaaaaaaaa

SEQ ID NO: 90434 - DNA, 322 bp, Heterodera glycines
  SCN-specific regions: Sequence locations=1-3,47-322
acatttagccagaaaaccattgtttttcttaatatttctccatcatatttattcgtcatatggcgtacgcaaattacggctacggatcctatggctatggtggtgaagatttttccgctggtgcccataatccgcgctaccattatgcggctgcccaaaacgcaggctttgatctgaagaccgatgatggacttccgaggaccatatatgttggaaatcttgacgtgtccgtaaccgaggacttcatcgccactttatttggccaaatcggaccagtcaccaagaccaaagtgatcttcgattcgggctctgagccttttaa

SEQ ID NO: 90435 - DNA, 1124 bp, Heterodera glycines
  SCN-specific regions: Sequence locations=1-380,402-1030,1052 -1053,1076-1124
gtctttagctgatcagtgatcactgtcatatagagatacagtgatattttcgtttgttatgagtccgattgaccctgacaaaatggcattgctaaagcgccttttccccgtcctcggcaaacaccttcgcaagggcgactgtggcaaaatcggagtgatcggcggttcgcccgactacaccggtgcgccttatttcgcttcgatcaccccaatgaaaatcggtgccgatttggcctttgtttacgcccattccgacgctgctccggtgatcaaaagttacagtccggaactgatcgtttaccccagcaccgatttcgccacgaatagacacagcattgagcggttggacgcgctggtgttcgggccggggcttggccgacagaaacacacacaaaatttgctggcggacgtcgtaaatttcgtcaggagcaaacaaaatctttgtttggtcattgacgcggacggtctgttcttcgtcaaagaatgttcgcaactgttcaaagggtgcacagacaaagtgatcattacgccaaaccacagagaatttgttcggctttatacccaaatgttccctaaccagcagaagggagaggacacggacgaattgaaaattcaatgcgaaatggcggaacaattggcaaagcatttggaagtgactgtgatgagaaagggagagattgacataatctccaacggttccgccgcccaaacgcgaattgtccaagcggaaacttcgatgcgccgttgcggtggccaaggcgacattctcagcggcgcgacggcacttttcgcattttgggcaaggaaagcctcagatgccgacatttattcctccgagcatttgctggacggggcggaagccgcttcgcttttggtgcgcaacgcatcgctacggacctttcagtctgtcggccgatcgatgaacgctgccgacgtcattgaccacattgtgcccgttgtccgcgacattgactcggaactttcagcaaaagctgcgacaattacaacacgttgatttgtgtacgaaatcttttcaaaatttatttactttcctttaataaattctttttattttgactattgtgacccgatttatgcaaaaataaaaaagtttgctgtccaaa

SEQ ID NO: 90436 - DNA, 680 bp, Heterodera glycines
  SCN-specific regions: Sequence locations=1-680
cccgttagagattaaatgagcgacgatttgcgcaaagaattggagggactgaatttgtgcgctgggagaggccgacgacagcgggcgacagtcgtcaccgagtcgatgatcgacgacttttgtaaaattgtctataaggcgatgctcgtcacgcccgagggatacctttacacgtcggacattgcgaataatatttatgatgacattggcatcgacccgtacagaagggccttggacctcggcttcaattcgttcaacgccttcttacattcggaacacatgaaaaagtacatcgaaattgactcgacgggaaacgttctcagttaccatgctattttaacgccggagttgctcctcacaattggtcacattcagagggagcggcagacttttttgagtatgaagcgcatttacccctcgcgtcgtacaaatggattcaatcaatcgcaagaaatgggtcctttgcagtttttgaaggagcgcatgcaaaagagggaattacaagcgcaaatgggtggacagacgcaagaggaagagactcaatcggaaacggtgcaggaaccgtcgtttgtgatgaatgagggccaatacggaatcgaagaagagttttttgaagagattggcgaaaatgagcagttgggactcgaccggatcaaatgggttcagaacgattccgacga

SEQ ID NO: 90437 - DNA, 570 bp, Heterodera glycines
  SCN-specific regions: Sequence locations=1-48,70-525,547-570
actccttacataggtgttatatttttgttttatttttatttttctacttaaagaattaaatgttttcaaccaaaatcattgtgcgctccttatcaagcagtgcccgaatgtcccaatcgcatctcggtgacttcggtggcggtgccggcaaaggcggcggtagtggcggtgccgtgcgcgacgcgggcggaaccttcggaaaaatggaggcggcgcgtgaggaggagtacttccataaacttaagcaacaacagctcaagctgcttaagctacagctcaagcgcgagcaggaccaccacgaggagcaagccaagcaccaccatgacgtggtggaacgccacaagaagcgcattcaagaactggaagaagaggcgaaggacgacgcaaaatccaaatgaagggatggcaaagaattagaagaatcggatgttttatgagtcctctaccctaggcgaaaaatgacaagactttaatgctcatgacccgtttgtgaaggtgatatcaaaatagtaaaactcggaataattcatttcaataattttatcaaggttcaaaatacaatgaaaaatc

SEQ ID NO: 90438 - DNA, 347 bp, Heterodera glycines
  misc_feature (325)..(325): n is a, c, g, or t
  misc_feature (327)..(328): n is a, c, g, or t
  SCN-specific regions: Sequence locations=1-235,260-295,317-347
gttcattaaaggaattcctttgttttcgttctttcttttcatttgcacagaacgacggattggaaaatgatcaccgatatgcaattgggtatcatggccaatgttctcggcgtctccattttcattttggtcattttctaccattacatcgtcgccaaccaaaagaaacagtcgccgcagtgagcgaaagaagcgaagaaaacgccgaagaaagtcaaatgattggatgggttatgattaattaattaatttatgtattaattgagagggacggcgcataaatttgtaattgattcattgtaaagagaaaacaaagttaattacncnnaaaaaaaaaaaaaaaaaaa

SEQ ID NO: 90439 - DNA, 652 bp, Heterodera glycines
  misc_feature (634)..(634): n is a, c, g, or t
  SCN-specific regions: Sequence locations=1-603,625-630
atctttcaggtctcgttgtgagtgattcgtctgacaaggaccacaaatatagacaaaagtggtcctttgttggtcgaacttctgcagaattcacttttaatcagaagagggcaaaaagtgaccgttgcaaattacacaatagtgccggacgagaaaagcaaaatcggtgaatatctacgtgaatattccaccaaagttgactgcattttgaccagcggcggaacagggttctcaaaaagggatgtgacgcccgaagcgaccaaagaagtcattgagagggaatgcccaggaatcgctgtggcacttctgaagaaagggcttgacattacgccattcgctgctctcacccgtctcaccgcgggaattgctgccaattgtctgattatcaatttgccgggaagcccaaaagcagtgagagagggatttgaagtgattgagccgattctgagccatgcgattgccattgtgaagggggatgagagcgaaacttcagttttgcacaagagaacggctttataagacagaagagactgtctgtcgataagcatttgatatcctatgtatgtgagaggcaattttaaactttacttcattactatgtaccattttgaaaaataaatttttaaggtgaaanaaaaaaaaaaaaaaaaaa

SEQ ID NO: 90440 - DNA, 935 bp, Heterodera glycines
  SCN-specific regions: Sequence locations=1-935
attcgtttatatataaatgaacgagaaaccgtcacatcttttcattttcccatcgaaatacgaatcttctctgtttctctctcacatatccacaaaattgttccccaatgctgcaagctcatcagtaccaacttcagcaaggtcatcgtcgcgtttctgctcgcagcattttggcccatttcggtttcgaattctcgaacgactaccgacttggctgcggacattacagtaaagtgtacaaaggctatttcaaggaagcgcaacgcacttttgccatcaaagtcaccgacttggaaagcgtttccgagaagttcaagcaaaagtttctgccacgtgagctggaagtttggcgggaattggaccacccgaacctcgtctacttgtacaacgatttccagtggagcgactatcagttcgtagtgatggaattggctgttggtggtgacttgctttcgttcctccaaaaatgtggccccgtcagcgaaacgacctgtcacaattggatgctccaaattgttgctgctttggattatctccaccgtaagggaatcgctcatcgcgatctgaagctgaaaaacgtccttctttgtgaaaacggcgtcatcaaagtcactgactacggattctctaaacaaagttctgatttgtcttcaacattttgcgggtcgcgttcctattcgtcaccggagattttgcttggcatcgcttatgacatgttcaaatcggacatttggtcattaggcgtcaccgcgttcatcatgatcacaaacacaatgcctttccatgaagacttgcccaaccagcaaatcgttgactcgcagcggaagcgccgttacaaatacccgtcatggcttaacattacgaagcaatgccgcactgccatcgatgccttgctgacttaccaacccgcttttcgtccgaacatttccgaatgt

SEQ ID NO: 90441 - DNA, 684 bp, Heterodera glycines
  SCN-specific regions: Sequence locations=1-523,545-613,649-684
gtcaattaagccattctttttattttacaaaaaaattgtatccgacttaaaatggctggttgtttggatgcgctcccacatcaggcacacttcgactgggataccaaacggaacacatattcagccgttgcatctgggtttctgttctttttggcttggtggcttatgattgacacagcggtcactgcgcaaaaagcacattggacaaattggtattttgcgcttactgtggcctgcaccattgcgatgtttatggttaattctgtctccaacagcgcaatccaaggcaattaccttgacgagggagtcctcggagtgaaaggtgctcgcctttggcttatgttcggttttatcggatcgttcgcctgtattgtggccggcgtttgggtcatgttcggtgacttcgtacttaaagaaggacaaaatgacaattggccgggaatcgcgctttttctccacacattctttatttttgtggcttcattggtttacaaatttggacgcaccgaagaattgtgggagtgaaaaagaaaagaaggaagacgtcttcagaccatttcgactttttccctgtaaacgatgtactcttgtaatttcccattgatttccaacttttacacttgtcaaattttctttaatcaaggaatgacattcaaattagttctgcataaaacaatttctttg

SEQ ID NO: 90442 - DNA, 774 bp, Heterodera glycines
  SCN-specific regions: Sequence locations=1-509,531-774
ctccagtcaacggttttaatccgccatttgttgctcaaatccccttcgcatgacctttgttttgtggtcccttcgtccttttccgatccgtgtccctttttcggcgattaccaatgccccgagggctttcactgtgcatttgacaaatgccaagatgagcaggggatggagccaccgggcgattgtgccaaaatcagatgtggcaaggaatcggagtgtcggcaaggcaaatgcgttctttatgtggggcgaccgtgcggaaggaatgttttggtggcggagggattggcccgtgcggtggtatccgattgtgggccccaaggcaaatgcattggcgggcgatgtgccattgacagatgtgcggacacagtctgtgaggagatgagcgagctttgccgggatgggatgtgcatgcaattgtcctccatgttctgcttctcgcccttcgattgcggccctccgtcacttttcgagtgccatcaaaacaaatgccaacggcgtcgcgacacaattgttccagttttttcaccatcggcacaaaaatgtgaccccggagaaactctcagcggtgataaatgtgtgactcaggaaggatgtgctcaattggtttgctcatccggccaaagctgtttcaatggcttttgcgtcccgacaagcaattccaattgcgctaattccggtgaatgtgccgaaatgaatatttgtcgcgaaggaccctgtgtggcggacatttgcaaagcaaatggtggcaaatgtctgccggagaatgcctgc

SEQ ID NO: 90443 - DNA, 995 bp, Heterodera glycines
  SCN-specific regions: Sequence locations=1-666,688-973
atgccatccgcgcacggcgggcccacctttttgctgtggcatcgtgaatacctcaaacgcatggaaatcgctctccgtgccatcgacccatcggtggccatcccattttgggactcggcaatggaccagcgactgcccaatccggccgactccgtcatttggagcagttcgttcatgggcgcactttcggccgccggtacggtggcggacggccccgtcgccggttggattacgcccagcggtggtccgattcgacgcagtctcggcacccgtgggggaaatctgttgaccgaacaggaagtggccagtctgatcggacagccccaaattgagaacgttttggcatttacgtcgagggcacggagcggcgcctgtacgcaaccgacgccaaacccgctcagtgtgctcgagttcatccacaacggagtgcacgcctgggttggaggggacatgttgccgttgaccacctcgccacaggaccccgttttcttccttcaccattccttcattgattacatttgggaacagtggcgactgctccaccaaaatcggcagcagcgcgagacgcaatttccgcccgactcgcaaattgtgccgtgcgctggctcccagaattacctgctcagtgcgacaatgttcccttttcaagaccccgtcgtgctcaaccgagctgggttgagcaactcctacacggacagtctgtacacttacgcgccgaggcccacctgccgtgccgcaggcgactgtcgttcgcgttacttgttctgtgacacgaccagcggccgtccattgtgcacttcccggattaaacccggcggcaattgtgcctcatttgtgcaaaacgctgaccagccctgtttcgcctccacttgtgtgaatgggttttgccaagcggcgggcggtgccgccgttgcagcgcaaccgcagcagcagcaaaggattgtccgctcgactgtttctgttccgaatgggacggcgccagcagcagcggcagt

SEQ ID NO: 90444 - DNA, 604 bp, Heterodera glycines
  SCN-specific regions: Sequence locations=1-173,195-604
ctcctgtaagtcaattgattttggacgaggcccggctttttctttcaatggacgacagcttcctttggggactgaacattctgagcatcttcttgccaacttccctcagtccggcgcaacacgatgaatttggcgctaaactgagtgaataaattgtggttttgttgtgcagcccaggcatggaactgaaagctttcgtgcgtgcttttccatactcggtgctcgactttttgccagacgtgttgatggcttgtttattgcatttcaaagaaaaaataaaaatgatcatttataattaattaatggtttgtttgtcctccttccaattgtaccaccatttcctcatccttccgttccaataaagcttcatatgctcgccatgaaacacaacaccaacaaaagtgaacaaacaaaggccgagaccaagttgagggccaaaccgataaaaattcatgtattggtctctgaataaaacagaatttggacgtgatttgttaatctattcgtttacgcatccaatcaacgaccatactcagtttcttaggtcaaacattttccttacttgatcaaggcctacattcttggcatcaataaaagcttaggt

SEQ ID NO: 90445 - DNA, 687 bp, Heterodera glycines
  SCN-specific regions: Sequence locations=1-137,212-212,411-442,466-687
cacccatcgacaaatgacacaggctatgatggttattcgtgaaaccagcgagaaaatcaacttgacccggacaatccaagacagagcggctaaactgtacaaggaggtcctcgagtcgaaagccctccgcggaaagaacaacgaggcacaggcggccgcttgcctttacatcgcatgtcgtcaagagggggttcccagaacgttcaaggaaatttgtgcggtgtcaaaagtgtcgaagaaggaaattggacgctgtttcaagctcatccagaagaccatggagaccaacttggaccacataaccagtgccgatttcatgtcccgtttctgtggcaatctcagcctgccttaccccgtccaagtcgctgccactcgaattgcgaaaaaatctgttgaacatgacctcgttgctggtcggagtccaatttccatcgccgccgccgcaatttatatggcatcgcaagcgagcaatgacaaacgcacggcgaaagagatcggtgaaattgccggcgctgccgaagtgaccgttcggcaaacgtaccgtctcctcctgcccaaggcttttggagctgtttccgcctgactttcgcttcgagacgcccatagatcagttgcccacttcctgaaaaggcgcaatttgggcttttcttttgaatgcgtgtcaattcgttcattttttccgttcat

SEQ ID NO: 90446 - DNA, 496 bp, Heterodera glycines
  SCN-specific regions: Sequence locations=1-13,35-458
gacctaaaactccccatccttttttgcactgtttttgtgacatttcctgcttaaatgcttttcaaacgttttgttgtccccgttgcgacgcgttctgtgcgcgcggtgcatttgcccggcactcccggcatttacaacaccaaacccgtggaaatccccaattgggagccggcaacaccgaccggcccaatccgtgacggatggccgaaccaccttgcgcctttcatgcaaatcaaaagttggcgttggttcatcggcgcttttctttatttggcgagcggattcggcattccgttctttgctgccgagttccaactcaagaagcaaaaccaatgagctgagggagaggaagacgatggttagatgaagtgatgttattgcaaaaagatcagttacagacagccgtatttcaaatgtatgtttaatgttaggaaaaacgaataaaaacaaggcataataaaaaaaaaaaaaaaaaaaaaaaaaaaaaaaaaaaaaa

SEQ ID NO: 90447 - DNA, 471 bp, Heterodera glycines
  SCN-specific regions: Sequence locations=33-437,461-471
ttttttttttttttttttttttttttttttttcaaattttcattcttttacttttgcttatcaaattggcaatgactgatcagcagaattcaattgtcgggggatggacagagcaaaatgtgaacgacgaaaaaatcaaggcaatgaaaaggaaatttggctaactgttcataaatgccaattacaaattcaaatgtccgttcgcttctgctcaattctctcgctttgttcagtctctcgcttctcgctcagtggccaaaataaactccgagtcaaacgatcgcttcagtcttttccccttggaggttctcagtgccaagtcacaagtcgtggcgggcattcagtaccaattgcgcattaaggccgaaaggtcgaactgttcgaagaatgtaagtgaaagggcaaattcagcaacccacgttctagagttcccttccaataataaatatttttattttttctattaaggac

SEQ ID NO: 90448 - DNA, 700 bp, Heterodera glycines
  SCN-specific regions: Sequence locations=1-66,88-700
gttcctttaaagggacaattggctatggtcatcgatcaatcgctgctttgattggttaattaattcaaaaaataaattgttttctgtctgtttgatgaatttcttcggtcgaaagggcaaaaagggccccgtcgttgggaaggagggcaaagagaagggggagagaccgtcacatcgtcggctgcgcgttttgggcgtccctttggcccaggcgctgcgcaacgacccaagccacgacggagtgccggtgcccgcggtggtgcgcgagtgcctcgacttcatttcgctctatggccttcaggtggagggcgttttccgcgtgtcgtccccaaagtcgcggctcgacgaattggaacggatggcgaacgaaggcaggacagacgaaattgtgttccaagatgcgcacgaagcagcgggccttttgaaacgctttttacgccaattgccggagaatgttttaaccactcaactcaaaggacgattcgaaaacgaagcgaatgtttgccgatgcgtcgccctctgtcgctgttctgcggtcattaaactcaaagaattgcttctccaattgccccccgaaaattttcatcttttggcctttgttttccgaaatgttcaattggctatccaaaaggagagtgccaacaaaatgaatttgcctgccatgggtgttctcctccatacgattttggaaatgccaaga

SEQ ID NO: 90449 - DNA, 854 bp, Heterodera glycines
  SCN-specific regions: Sequence locations=1-854
aagccattggcaaggcggccattccgcttccatgccccgagtcgtcgttgatgaagaaactgactgtgcaccccgacattatggacattgtgagggagttggacgacaaatgccttcgatctattgaagattcttattttgacagaatgggtcaaggcccaacctatcacactgacgaaaatgcccaacgtcctgaacttctcgacgagaatggccatcgttacgtcggcctcttcaaccaagcgatgacttgctatctcaattcgctgattcaaacattgtacatgacccctgagtttagaaataaagtttacagttggaaattcgtcgacacgccgacgaatgaggacaataaaaacattccttaccaattgcaaagactgttcttgttgctgcagaccagtgagaaagcgtcgctggagaccaaggagttgaccaccagttttggatgggtgtcaaacgaagcgtttgaacagcacgacgtacaggaactgtgccggattatgttcgatgcattgcagcaacgatggcgcaaaacggagaacgacgaatcggctgtccataaactttacaaaggcactatggaagactatgtgaaatgtttgcattgcaaaagagaaaatgtgcgaaaggacgactttttggatttgtctttggccgtcagaccgttcggcgccagcgaatcgtttaaatccatcgaggaggctttgagtgcgtttattaaacccgaaatactcaacggaaacaaccaataccaatgcgaagtgtgcgcatcaccgcaagacgctgagaagggcttgcgcatcgtcgaatttccgtatttgttgaccattcaattgaaacggttcgacttt

SEQ ID NO: 90450 - DNA, 766 bp, Heterodera glycines
  SCN-specific regions: Sequence locations=1-636,659-766
agcatcatcatattcgtaatttgcggcattcattagcatgttttcgctttgttatcgccgcgcgattcgcaaaagcctcgcaaatcctcagacaattgaagtgtcgtcttttcatttttctcgtgttcttgaacagaatttggacgccgcaagcaaaagggacgaaaagggggaggaagtgccattatggaaagacccgtacaaacatgcaatgccggaacaaaagaatactttttcggaatttcgagaggccaatgtgcattgggaatacgttcgacgactgctgccgcgccgtttgattccagaaataccgcaaaatgccgctgagggcgtaacaccgagcggatggagggcaccaccggaaaaagcaccgaaccttccctattacatcagaagaaaggccaaccatttgcctagcatttttttggaacggcgacgcgacgaactgaacccaaagacaatggacttcgaatatgtggaattggtcattctgacgggcatcgacggcgacgtatttgcgtgcgagagggaccttcgcgcgtattgtgaaaagcgattgggccacccaatcgccacccacgtcgacgaactcaaaggaaagatcaaaataagcggcgccgatcgcaccatcgccgagcagttcgtctacgactatgaaacggagttcagtctgtgcagaggataaggaacagatcgaatggagaagcacaaacactgttttggcattttgtttattgagcaaactatatataaacaatgcatgaaa

SEQ ID NO: 90451 - DNA, 653 bp, Heterodera glycines
  SCN-specific regions: Sequence locations=1-384,406-420,444-653
ccactattacccatcaccgctggagttgctccgtccgccatgcgacaacaacacggcccgggccaaaaacgtgtgtcacgcgttccaatcataattatccctgccggtgcaagttcactcatcacaatttacaatgcgcaggaaattttgcaggatttgcgttacgtaagcacagaagaaaaaaagcaatttagcagtaaacgagagaatgagctgttactgcaaatcccaaagaatggcgtcactgttccgtaccgagtcgtagacaatccaacacgattgaaggacgaggaatgggaccgagtggtcgcagtgtttgtgcagggtccggcctggcaatttaaaaattggaaatggaatggcaatccggttgagatatttgccaacattgctgcgtttcacttgcaattcgacgaacttccaaccgatccaaatgtgaaaaagtggagtgtgcatgtgttgaaattgtcctgtacgaaaaggcatttggaccgggcggagctgcacaaattttgggaaatgctcgacaggcacatttcgaagagcaacaaaagggaatggctcagatattagcgaagtcggcacattacatttgaaaatttacaaacgattttttgtttgagttttttttgtataataatttaccaacttcc

SEQ ID NO: 90452 - DNA, 794 bp, Heterodera glycines
  SCN-specific regions: Sequence locations=1-124,147-794
gtccgttatctcgcaatttttgcaaaaatgaataatgcgatggactcggtccccgcgcggattgtcataattgggacaagtaaaatgcgcctttccgaaagattcaacaaattgcaaaaggctcccccgcctcctcttcctcaagctcagcaacagaaagtgtttttgaagagggagggtatcaatggggtcgcaattggccccgtaatttcacggcctcgggttattgatgaacgggacagaccagataatcggattcaaagcagcaaatcttttcttcacgacgattacatggacaatgatttatatggcgattttgtggagccgttccttcgacggcctcaaatgggtggttttcgcagtgcaaatttatacgagggatttcaaccggcgccagacccactgaagttgacattggatgcctatgatcagtattcgcggttccgtccgtctcatcgccggtccattcattctcgcataactgaaacgtcaatgagccgttttcggaatttgcctgtctatgatgagtccgaagacgcactttacggagattatgatgagccgccacgatcaagaatgtacaaccaaaacgactacaacagacgaccgattcaccagcggctcagtttcaagccaatgaggctttccggttacgattttctgcgtcgtcctctccatcgccatacgacgcaattcaaacggcctttttacaaccgcggaagtcatttcagtttcaacagatggcgcacgaacgattggaatcggaggggtgcgtcgatgccttttggacgccg

SEQ ID NO: 90453 - DNA, 894 bp, Heterodera glycines
  SCN-specific regions: Sequence locations=1-7,29-894
gtcccattaaggttaattaaatcaaatggcttcgtccgattctgactcttcttcgttcgcattccctcagaattcgaagtgcggcgccacggcgagcggacagaaaacaacggccaatgcttcgtcctctctggcgatgcgagtgcagcggaaagtgttgtccaaattgtccaagcggggaatggtgcgacttttgggcgacaatcgtttgattgctttgatggacgcattgtacgaaatgctcagagaattttatgactcaaagaccgctgaaaaggttgtgaaaaacgggatcaaacttatcgtcaaagtggggttgctctgtcgggagaacaaattgagcgaagaacagcagcgccttttgtcagcggtcgaaagtgaatttggccgattggcgctgaccattcaatcgtttcgtaaagtccaattctcttacaatcggacatttctgctctcttctatcgacgcaattcatcggtcaattctcaaaatcgtcgagcaaacgcttagcgaaaagtcagccaaacgggtggagaatgtattcggccatttttccaacggtgaattcctcgattttgttttcacttcgtccggcgctattcacactgaaatggtgcgacaatttgctgcggaattggacaatttgttggccattggaacggaagaggatggcggagagacggcgagggatgaaaatagcacaccgtagggagagacgaacagacggagggaaatgtcaaaacgaatgactctttaaaagaccagcgaatgtgagctggcaaaatgtatcattttttgtttgctctgtctgcattaaaactttatctgtatcttattttttgcacacaataaaggaaattgagacgtcataacgaattccatttggaacaacag

SEQ ID NO: 90454 - DNA, 821 bp, Heterodera glycines
  SCN-specific regions: Sequence locations=1-143,165-759,787-789
gaacgcattaagagacggcaaatccataatataatgaagtttcatttcaacggaggccttgactgtcccgaatggatactgtcgcaaattccagaaattgcaaaaactgacacaaaaatgttgcaaacacttggcagcacaatcattgaaatggccaaagtcaaacagacggaatggcatgagacggacatcaaaaaattttgcttcgctgaaatgagcgttgatggtctcagggcattgaaggccaaaactgctgcattgtgtttcatttttgagaagacaaccaaaaatgattgttcatgcaaagatttggagaaggaactgctccaacttgggctgccctccgaccatgtcagtgtactggttgaactctacaattcaaacagggccgcattgtgtgacagtttggcagggcctgcaatcaaagccccttcactaacagtggtgtgcaaagagcaggttccaacggctgccgacccgtcagtgaaaagtgactattttcgcttggacacaacaagttcggacgggtcaacagcaaccctgctcatccaccgagatgagttggtacagttgagaacctgcatggaagatgccgtgaaagtgctcgagtcgttggtggtcaacaaagaatgatgcccgcttattggagacacgccccatgtccaatttttcaatttgtgacttgccacttaaactaaagcatggcacttacaactagtgccattccaaattctgccattcatttcttccgcgcagcacattttatttaatttaaaatattttattgtcaaaaaaaaaaaaaaaaaaaaaaaaaaaaaaaa

SEQ ID NO: 90455 - DNA, 652 bp, Heterodera glycines
  SCN-specific regions: Sequence locations=1-334,356-441,463-652
ggccctttggatgttgagtgccatgctccgacaccctctacttcgccctcaaatgtgaatgaacccgaaatactagccaatttggcagcttttgaatccaattttgtttccgtcatctctgaacaactcggcacggacattttgccatccagcagcagtgccgtcgctttgcatgtctcttcccttattcgtaacgtcctgcgattggctcggaagttccaacggagtgcccgacggaaatggctttcttcggaggacgtcgaggcggcgttggcttattacggacacacctcacttatcggctatgaaggcgttgacgacgttaaatttcgacatgttgagaaaatgggcagggatgtcttcgttagggaagaccccgagttggacttgaacgcggtgataaacacaccgccgcctaaattgacacttgaggtcactgtcaaagcccattggttggccatcaacggcgttcagcctgccgtacccgaaaatccgttgccaccaacgccgaaggatgcacttccgttggccaatgaggaggactccgcgagcacttccgcagggccgaccagcaggacgctgttgctgaaccaatacgcgaagagcatgcgcaagacggagcaagtgcagatcaagtcgaccaccacacact

SEQ ID NO: 90456 - DNA, 591 bp, Heterodera glycines
  SCN-specific regions: Sequence locations=1-37,59-385,408-503,534-591
gttccctttaaaatccaaatctttcaaccaaatctcttttcgtcaaaatgctttctccattcacctacgatccgttcaatcgccgttcgttgtggcctatgaccactattgttggcaacgtcctttcgccattccgccaattggagcgcgaactcgaccacttcttcgacgggatgcagcccatgcttcgtgaccatgttgctcagttgaacgtctcgaacaagggcgacttcacttacaaggtcgatgtcagcggcttccgccccgaggagatcaacgtggaggtggttggcaatgagtttattgtcaatggggagcaccgcgagcagaacgacagcgagttcgtccaccgtcagttcttgcgccgtgtgctcattccggagggcatccaaaaggagagcatcaagtgcgagctggacggcggtcgtttgctcatcagcggaaccaaaacggctggcaaaggcggacgtaccattccaattgaaatgaagaaggcggccgtggaacagcagaaagaggaggagaagaagcagtaggaaaaaagacggcggaagtggagacggaccgatcagtcgaatgatccattgacat

SEQ ID NO: 90457 - DNA, 1327 bp, Heterodera glycines
  SCN-specific regions: Sequence locations=1-663,685-948,970-1327
tgcaccttctatcagacatactgtagcaaactgaagccgtacctgacgcagaacctggactttgtgcagcagagattggccaactcagcggccgatgacccctattggcaaggggtaaagcgggcctatctgcaaatgaccggcgtttggcatggctttagcgatgcgcagtttaacgtgtccattgacttttcactaaacccaattttgatgcttaatgcgcatggcgatttctacgagttggagaccaaattcaacagaagcaaagacccgcgagacgaagccactggcggaagatgctcgggactggtcaaaattgcgcctaacaatgccgacattctgttctcccaagtcacaatgtgcggctttgaaagccttcttcgtgtgctaaaactgtacaaatttggttacgaccgcgcactgtaccctggccacacgactaccatatccagctacccaggcctattgtattcagccgacgattttgcactgatgagctccggattggctatccttgagacgacaatgaaaattttcaacaacacacttttgaacgaaataaaaccagacggagtgcttcattgttgggtacgagcaattgttgccaatcaaatggcacggacagcgcgcgagtggtgccacattttcaagcggttcaattcgggcacgtacaacaaccagtggctgatcgttgactacaacaagttcaaaccgtacaccgaattgcctgaccatggcctattttatgtgctcgagcaaatgcccacaattgttctataccaggacatgacccagtggctaaaacagaatgggtattttgccagctacaacatcccattcttcaagaagaccagcctaattagtggctttgagcaaaaaggcaacgaattttattggttcagctggaaaagttgtccacgcgcaaaaatttttgccagggaccaacacaaagtggtggacttggacagtctgaccaaactgatgcgttataacgattacacccgcgacccgtacagccgttgcaattgcacgcctccgtacactgcagaggcggcaatttctgcccgaggcgatttgaacccggcaaatggcaccttcgaaatacccggcatgggacacgtcaaccacgcggcacttgattataaaggcaccggctacaaaatgttcaaaaaattgcaattccgcgcatggagcggaccaacttatgacgatgtgcccgtgtttgattggcttgaaagcgacttggcacctacggtaaagcattacggtcacccattacggtgggaatttttgccagtggaatacgaatgggagacggtgctgaatt

SEQ ID NO: 90458 - DNA, 270 bp, Heterodera glycines
  SCN-specific regions: Sequence locations=1-156,180-207,247-248
gcaccttgtagtgccatgcaaattggcgatcaattagtggaaatcgacggcgaaagttgcattgggatgagtcacgagcgagccattggcatgatcaaggagaggcaatgcgtgaggctcacattgagccgacaaaagctgtaacatttgccggacaaagaaagaaaggatggatgaatcgacgaatcatcaatcacgcgaacactcaattttaataataatttatataaataaatcattaattttcgaaaaaaaaaaaaaaaaaaaaaa

SEQ ID NO: 90459 - DNA, 469 bp, Heterodera glycines
  SCN-specific regions: Sequence locations=1-156,178-208,237-318,340 -380,402-422,445-447
aaccatttcagcttttcaacaacaaccccaacacacgtattctaccatggctgactccactggcaacgctgcattcatcaaggccgccgatgaggccaagactctgtcgtaccagccgtccaacgacgagctcctcgagctgtacgcgctcttcaagcagggcaccgtgggcgacaacgacacccctcgtcccggcatgtttgacatcaagggcaaggcaaagtgggatgcctggaccgccaagaagggcaccaccaaggaggatgcccagcaaaagtacattgaccttgtcgaggccctcaagaagaagtaagtctgttgtatcataaaaatatgcttgtgatggctgcacctggctgcacactggctgtactcgtcgcgagtgaccgagtgagtgagtgagttcttgttgtttgtatgtgatgaatgcatttctttattttgttgaaaaaaaaaaaaaaaaaaaaaa

SEQ ID NO: 90460 - DNA, 624 bp, Heterodera glycines
  SCN-specific regions: Sequence locations=1-624
gttcatatttaccatattcctcagttgattatgaacaaaatatttgccaacgattctaaggctgtttttgaggatgatatgcatatcggcgaagccttcgatgaagttttcaaacagatatacgagcaggaaaacgagatgccattcgacagatctagagaaatctggaaagaagttgaacattctgaaaaaacgcttgtccatgaaaccaatcatttgttgaaaaatcaaggtcttcaaaattccatcgaaaccgaaatgaaaatgctcaaggatgctgaggcttctttggatgctttgaagaaacgtgaattggagttggttcgccattacaaagacaaacaaagcaaaatcctgtcttcgctggaccatgttgagcatttaacccagatggttgacactgacatcgaaaacgaccagaaaacattgaatgacatcttgaggagctatgaagatgagctgcaagagatgaagaacttaattatggcgaaaaaacgattgctttccgactaaactagaacgtgtgtcattcattgatccttactttcattgtgtcctcattgtataacgtaaactgaatcaatgcgggtaaatatgcttagattgaggtcataaaaggtttcc

SEQ ID NO: 90461 - DNA, 470 bp, Heterodera glycines
  SCN-specific regions: Sequence locations=1-376,401-404,428-470
actctccacttctatgcgtccagtcactttgttgatggacttggcaataagcttaagaccgccgtaaataagggtcttccggtgttcgtcactgagtacggtacatgcgaagcgtctggcaacggtaatctgaactccggctcaatgtcaagctggtggagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattgttttttga

SEQ ID NO: 90462 - DNA, 800 bp, Heterodera glycines
  SCN-specific regions: Sequence locations=1-84,106-763,785-800
ttttggagaaggacttgtggatttttttcgtccattagaactcatccaaattctgttggcctgcccacaatcatgcacatgtctcaagaataattttggcatacatttggaaggattttttgagtctctgtgcgtcatccgatgcaaatttggcgaactgttaatgaacaatgggtgggaaacaaaatttgatccccgaacactgatttgtgcctatgaaacgttcaacatcgtggcactgatcactaagagaattgaacaacctcgtcgcaacagtcaaggcgaagaaattggtgtaaatgaagcagagcgggggttatccctgacagatcgaattttgtacaatgaaatgaaatggttcgcaactgtcctcaacgagcgcactccttccttctccatcattcagatgtttcttcgctgcctcagtctccacctgtgcgcttctcagctgagtgccgtggtccttaacgaaacggcctctttgctgaacgaacttcgatatcggctggaaaatgtgtacgacgcgcgtccagtgatgtcggcactcaaaaaatgtgtgaatcatttgaacgaggcattggaggggtgcgaagagcgcgaccaagcagaaagaataattgagcacaaagtcagaccgatggaggaatattttgaggcggaggaacggggcgacacgacgcaaatggcagcggaagagaacgacgcttaccacgagattgatgacggagaattataaacactcgtcaaaatgcgtctaactttttcccaaatttttcataagaaatttattcattatgacc

SEQ ID NO: 90463 - DNA, 520 bp, Heterodera glycines
  SCN-specific regions: Sequence locations=1-520
cttgcgaccgacgaatttgtctgttgccttagatcaccaaattcgtgagggaacactcagcgaaatgaagcagcagtcggtggattcgttcattccctcgagcaattcgctgcaaatttgcgggggctgtgaaatgcgaattgaggaaaggcattcgctttgtgtgcatcgcccgcgacattttgcaaatttcgacagagaaacggaggccgaatactggcacgagaattgcctaaaatgttgccaatgcgagcggcgattgggcacgggggagaaacgttttgtaagggacggacgcgtttattgtcgcgaagaccattcgaaatctttcggcacttcgtcgtgccagcctaactgcgcccgctgtgccattccaatcgaaccggccgaactcgtcttccgcagcggactgttcaacgtgttccacacgcactgcttcaaatgttcgtgctgcggaaatgcacttgcaaaaggcgaccaatacaccaacacggggggagcactcatctgtcaacgcgac

SEQ ID NO: 90464 - DNA, 775 bp, Heterodera glycines
  SCN-specific regions: Sequence locations=1-30,52-148,175-775
tctcaattcagtaacatcggctaataattttgaaatgtccgcttgcatctgtccgctgtgtgatacgtcgcttgcggcgggcttggccaagtaggcaaagtgccaacacattggccatggcccgtgtccttctgcccatgtcagcaagcatggcttttgcccatttttcaattgcgcaatgccgacgacggaggacgaagtgttgctcattacgcacaccgagggaaaacaatccaacaattttgctggcctgaaagatgccaaaaatgtacgcgaagtgatcgatgtgatcctccaacatttgcccgggtctccggcaatgtgcggaagcgaaggacggcgaattggagaaaacggcggacatttttgaacgtttgaccgaaaatgcgccgccgggcgcaaatggtgccgaaatggccgcggcacgaaaaagcgcgtgggacgaattggtggcatttctatggaaggcatctccctacattctcttcgtcactttcgctttgatttgctggtgtttcgtgccttcgctcgtcgctggcagtacaatgctcgagggcgtaataatgtaaaatattttagaatagattggaaatgtcgtttttcttcttgtcggacctctgattaacctgtgccggggtatagcattcgctacaatgttcgagatctccttggttgactgcgatgagtttggaggctaagatgtgcgcgtatcagacatggccttacaaataaaatcgctcggaggtgctacgtatcgactgctgcgatcccagcg

SEQ ID NO: 90465 - DNA, 452 bp, Heterodera glycines
  misc_feature (181)..(181): n is a, c, g, or t
  SCN-specific regions: Sequence locations=1-452
aaaccaaacaaatcatctttttttttgccgtccctgtgccaatgtcggtccctgccaaactcattttgctgctggtagctgcttcgttagttgcggactttgtcttgggtatggacgaacaaaacggagctgccgctggaaaatcttcgaaaacaccgacagatccaaacgataaattgcncgaaaaacacagtaaaaatcgaatgcaccgatgaagctcacaaatacaaagaagatagaccaagacaagcttaagggggtgagcaaagaaatcaaatttggcgacactccaccagcagcagccactggtgtaccatcgaaaaagccgaattcaaacaaaaatcagagaggagggagctgaagacaggcaaagaacaagcagtaccacaaccgattgactgatttgaaacggattttgatcaaaagcttttttggcgaaatttttgggaaaa

SEQ ID NO: 90466 - DNA, 557 bp, Heterodera glycines
  misc_feature (532)..(532): n is a, c, g, or t
  misc_feature (535)..(536): n is a, c, g, or t
  SCN-specific regions: Sequence locations=1-5,28-397,420-507,532-536
gcaacaggaacaatgctttgtttaatgtgggaaacttttccatttttgtcttggacaacgccaattgctatgtttgacacgtgccttgttgcgatcgagtcgcattttgattttggatgaagcaacggcttcggtcgacatggaaactgatgcgcttgtccaggaaacaattcgtcgtgagttcagcgattacaccgttctgacaattgctcataggcttgagacaattcttgacagtgaccgtgtcatggtccttcaacaaggaaaagtggaggaattcgattctcccaaagatttgtcggatgatttgaactcggcattctctgccatgttagccggcgccaaacttaccaaatcccatgaaaacgcataatgactgacagaacttatcgtactgaaattttcaaaatttcccaaaagttcacatttgcataatttatcttctctcatctgattacttgcaacaatctctatttgttttctttgaattgttaattttttttaatagctttaaaaaataaaagttgaagcngcnnaaaaaaaaaaaaaaaaaaaaa

SEQ ID NO: 90467 - DNA, 635 bp, Heterodera glycines
  misc_feature (612)..(612): n is a, c, g, or t
  SCN-specific regions: Sequence locations=1-321,343-582,607-635
cacaaatgttgaaaaacccgtgggctcaatcgccgactacgaccctttggctgccgaaaagcagcaacagaaggccccagccgctggcgctgcggcgcctaaagcgaatgggggcggtttcactgtgaaggcattgtacgattacacggccgcggacaaagacgaagtcagcttcaaggagggcgacgtcattgtgaactgccaaaaagtggacgacggatggatgacagggacagtgcagaggaccttactctggggaatgctaccggcaaattacgtggaacaagtcaaacagcccgtgggacagtttaaattgaaatgaaggatttttagtcctttttgttagcgtccgtccgattgtttcatttcttttctctttaccgattttcttttgtggcctttgatttttcagtttttctttaaacaaatgtgccagaatgttcgtcagcaatatttatttctgtttagcactcttagcaatcattttcattgtaagcatttattttctcaaattcacagttatgtatggttttaatttttgtcacatggctgctaatttcctttttatcgtaaccaagtatttgcttcgttcaataaaaattttctgtttcnggaaaaccacaaaaaacaaaaaa

SEQ ID NO: 90468 - DNA, 566 bp, Heterodera glycines
  SCN-specific regions: Sequence locations=1-473,496-537
tacgacgagttggacgaactgaacaaaaatggggcggacggaacgcgcgcgaaattggaatattcgatgcgcgacgcattcggcggattggacgcgcaaacattggacgcgcacattcaaaaggcgaaacggaacggcacagtgttcgacgcattgatacggcacaaccacgtgatgtacgaggcgaacaacaattggcgactgaacgccattcgcaacgtgctgttcacctttgtgccttggaatttgttgactacaaaatgtttgagcagtgtttggccaacgacgccaacaccaatgaccaaattcccgcggcaattccgttggccatcggcggtttcgctgtcccatttttggtcacattgtcttcaattctaaccttacttttgccattttgacttggtttctgatcggctattcctttttaaatattattgtttaatgagattaatttcactaattgctcaaagaagaaattaggacaaaaataaataggaattatttaacccataaattttatttataaatgctaatattaaaaaaaaaaaaaaaaaaaaaaaaaaaaa

SEQ ID NO: 90469 - DNA, 539 bp, Heterodera glycines
  SCN-specific regions: Sequence locations=1-515,537-539
tgtcggcaccgcttatgtgacgcggggcggcacagtgatacgaccggacgaattggagcgggcgatgcgcaagtcgggggtggagtcgtcggcggacactttgtcgcccgcttcatcaagtgccgaattgtcttcgcgtttgctcaatgcgaaccccgtttggtcggtgtattcgtcctccaacccgtattcctactggccctaccgctaccttaccgatccgaattcgcacgaggtgttttggcacgacgtgcacagccaattctcggcattgcgccgcctcgatttgttcggcaagcacaaacccccagtggattacatggccaacaaccatttctggacttacccctacccgtattgggctcgtcaccggggatatctcttcgactatgcaaatccgtcgttttactcgaaggaattcgatttgcattactacgaacattgattgaccggcggaaaaacaatggcggagcataccgtagcatactgtagagaaacgcatttatagaacaagcaacgcgaaataataataataaaaa

SEQ ID NO: 90470 - DNA, 971 bp, Heterodera glycines
  SCN-specific regions: Sequence locations=1-447,469-512,534-971
cgcagcgggactcaacgcggttcagctgtacatcccatggaacttccacgagcaggaaatcggaagattcaattttggaggcgaccggaacatttctcgattcatacgcatagctaaacaaaatgagctgtacgttctgatcagaatggggccctatgtttgtgctgagctcgaattcgggggacttccatggtggctgatcaaagaccaggccaaagtcaggctcagatcatcggagacaacttaccttcgccatgtccaccgttggctcgccgcccttttgtccgttcttcggccgttactgtacaaaaacggaggtcccattctgatggttcagttggaaaaggaatacggaagtgtgtccgtttgcgaccacgattacatgcgatggcttcgcgacttcgtcagagaaacactcggcgaagacgtcgtattgtacacaaccgatggacccactgagaaaatgctcagctgcggagccatcgaaagcactttcgccactgtcgactttggcactcaacagacagaagcaaacgtaaaggaaatgttcgaattgcagcgcaaatactccaaaggaggtcctcccgtcaattccgagttttacaccacgtggttttccatgtggggcgaaaaatcgatggttcgccaggaaatcggtcctgttctgaaaacaatggattacatgtgggcggaaaacgcttcgttcagtctgtacatgattcatggagggacgagctttggtttttggagcggaagagaaacgaatgggcctgtgatcacttcgtacgattacgctgcccccattgatgaagcgggtcaaatcaccccactttacggagccattcgaaattggatcggcgccaaaaaggattggtccaatccgccgttgccactgcccaagaacagaactggcgtttccatccaaaatgtttttgccgttaaattgggcgatttcatcgctctgaccaatt

SEQ ID NO: 90471 - DNA, 538 bp, Heterodera glycines
  SCN-specific regions: Sequence locations=1-185,207-538
aaggcacaagttgccatttttactacgtattattttatttgttgatgaataatgtcttctcgaagaaatgaatatctcgatgcgaagatttatgttggtggtttacctgaggatgcaacttctgaagagttggacgatgcgtttcatcgctttggacgcatacgaaaaatctgggttgctcgtcgtcctcctggctttgcttttgtcgagtttgaggatgcacgagacgctgaagatgctgtgcgtgcactcgacggaacgaggatttgtggcgtcaaggcccgcgtagagctttctcatgggaacggaagagggggcggacgcggttttcgaggcggagggggacgttatgacgaccgttatggtcgtgatcgttatgaccgtgatcgcgaccgtcgttatcgttcaaggtcgcgttctcgcactcctcgccgttcccgaagccgctctcctccgcttcgtgagcgcagccgatctccgagctacagccgtcgttctcgctctcgttaaaggaaagaaatgctcgatgatgctatca

SEQ ID NO: 90472 - DNA, 433 bp, Heterodera glycines
  SCN-specific regions: Sequence locations=1-279,301-313,335-370,392 -409,431-433
tcagcagtgtgccctccttgataatgctcggcattttcgttgccactttcttttcatcgatgagcaatttaatcggcgcctcgcgcgtactcactcgatttgcacaggacaaacttttcggcgctttgctcagaccggcgaccatcgaagtgggctccaaacggaatcccatcatttccgtcattatctcgtggatttgtgtcgtgatggttttgatgatcggagcgatgaatcgaatcgccaaattatcattcccaacaaacacaggaataattagcggaaaaatgtaaaagaaaagctgtgcgatgattaagggaattgtgaaagaaaaacgttttattccgtaatgagtcatttgggcgaaaaattgagtttatttttgtattgttttggatcaaaaaaatttatatgaaaacaaacaaaggaaaaattc

SEQ ID NO: 90473 - DNA, 393 bp, Heterodera glycines
  SCN-specific regions: Sequence locations=1-263,285-335,372-372
aactgtgaaataaaatatgcgtcaccaatttccaattatttttgccctttttctcattttaccaattttaattggaaagacggagtgccaaagtgacttttgggcctctctttcccagcctttggtttccgtgggcagtgatgcgaaaatgccactgaaggacttcggcatggacttcagcagactgaacgattacagctcattgtttggacgaagaaagaaaagggcgcactgattgtaagactaaaaggaaaggacgaaggaagacgaaacaaaacaaaacgggcccaattattacactaattagacaattaattaattacacatgttgtacgtaaataaaattattattgtaataaatttcattttttcaaaaaaaaaaaaaaaaaaaaa

SEQ ID NO: 90474 - DNA, 135 bp, Heterodera glycines
  misc_feature (99)..(99): n is a, c, g, or t
  SCN-specific regions: Sequence locations=1-49,71-135
atcagaaggagcaaaaattggaatgatcagagagacaataaaagaagtgatcaaaagcaggaggaggagagaaggtgatcaaaaaagagataaggaganaaggagaaaaaaaggaatgatcagagagggcaaaaa

SEQ ID NO: 90475 - DNA, 1060 bp, Heterodera glycines
  SCN-specific regions: Sequence locations=1-2,26-386,419-791,813-1060
aatttcttcatttcctttcttttcaattccaaaatcaatcctcctgtttcccagcgtcgctggtatgagcaaaaaaaaaaagatcgttccgtacttctcgagggttggaattccgtgctgaacgaatgttttctgccgttattcaatcagaaaatgaatatggccgagtcggccgacagcaaacagttcagacagttgcgcggccttttgttcggtcgattttcggagagtggccgttgcgatgtcattgttgctcaagcaaagagcgagaaccacttactctgacgacaataggtaaatgtgcgacatgaggcggagattatgcgtcaaattgagcgattggaggaggaaatcatccatctgagggccattcttcagacttagcgatattggaatatttttaaatattcattatatggatccactctttaaaatggtctctaaatggaaatgacaatccaaatatatttccgcttttgccaatttcctttcatttatcttttcaaattgcataatgtctcctttccctccgagtgccaccgatatcttcagtcttctggatgccattgacaaattaaaacatttaaagcggactggttgggttctcgtcggcatttcggagcccgaaacagtcgcttcccatatgtatccgatggcaactttggcaatgactttgtcggcgcaccgaactgatttggacgtcaacaaatgcattcgaatggcattggtccacgacataggcgaagcgattattggggatattaccccccactgcggcgtatcgaatgaagaaaaattcaaaattgaaaaagaggctgttgagactatttcgaattggttgcccgaaacggtgggcgacgaatggaaaaacctatggagagaatacgacgagggaaaaagtgcggaagcaaaggcagtgaaacaattggacaaattggtaaatggatatgttggcccaagccttttcctacgaagaaaggctctccatcgatttgactgagttttttgatgcgacttcgaatgccttctccgaagagccctttgcaagttgggcagctca

SEQ ID NO: 90476 - DNA, 425 bp, Heterodera glycines
  SCN-specific regions: Sequence locations=1-425
caaacaaagatgagattatcaaagttctccgtgaagaaattgatgagcagcaccgagtgcacggaacgcgtgtcaaagtgtggcgtgaacgcattgacagcctcgagcaaatgctgatttcacagcaagagcgtgcggaggtcaataattgcggctgataagtggtcacaaaatgggcagatgaaggaggaaggaattaaaaacagagaaaagcaacagtccgaaaaagttctcttcatctgcgagaagtgtctgaatgccttcccccgatatggatatttatatgcgcattattcaaattgtaactgatcgttgcgtatcgcaaattctttgtcaaattataattattcacgtagagaaaaaaaagaacaatgtaaaatcaaacgtttgtgcttccacatcattgaataaattaaagtaaaagc

SEQ ID NO: 90477 - DNA, 384 bp, Heterodera glycines
  SCN-specific regions: Sequence locations=1-29,51-327,356-384
ggacaattcaatggccgtattttcaacaataaattgaacaatttgggattccccactttcatcacttttgcgcaattaatggacccaagcagaggattttatgacaaagacggggacaaagtgacattggccgttgatgtcgctgtgaagagcaaaaagggacgaagcgcaaattatcggatgagtaaaagtcatcatatttggtaattattcactgaattatcaaaattgtgttcattttaacattctttcactcccgaaattcatttcctcaacactttttactctcaggttccctgtctcttctgaagatatcagattattatccaccatttttgttttgctttttgattattaaatgactacatttcaaaaaaaaaaaaa

SEQ ID NO: 90478 - DNA, 542 bp, Heterodera glycines
  SCN-specific regions: Sequence locations=1-77,99-123,147-216,250-542
actgactaatcattccattttcatgtcaattacatattaaccataaaaaccgaaaatgtcgatggttttcattcctatgttcaccctttaaaatttaccaaatcttacaacattaaacttctattttaatttaaagtaattaactgttattatacccatgtactaataataattagtcaaaaaatttaattgtttaaaccacttttgaattagtggaataaaaatataataattagttttaaaattaatccgatgaagctgtgggtggaggacacgacggatgaggaccttttcccgcactttgacatcgtggcagatcagatccatgccgtcatccaagaccgtggtgccgttctggtgcactgcgtcgccggcgtttcccgatccgccgccatctgcttggcctatctgctcaagtatcggactcggtctctgagagccgcctaccatttgatgtgctcaaagcgtccgatggtccgtcccaatcttagcttttggcgccagctcatccactacgagcaggtcactcgctcaatttgcca

SEQ ID NO: 90479 - DNA, 419 bp, Heterodera glycines
  SCN-specific regions: Sequence locations=1-2,27-84,146-419
ctaatttactattttaattgcttttttaattccaaaaaaccctaaataaaatgaaaaatttctcactgatttttgccgtgattttgttggccaccatcatcaccatgaacatgttcatgatggcaaatggccaatgtggaggtgcgtgtactcctaatggtgacggatgtgacaatgatgggtcatgtttcttaggttgcattcggcttggcgatgagtgttgttgcgtggcccgatctccaactgcctgagaaggacacgttcaaatgggatgaatgaagcgagttgaatgccgttgaacagatagaaaattacaaaagaaattgctagaattaaattggatatgatgttagttttgaaaaatggatagaaaattacctaaattcctagaattatatatgaataaatgacaatttctc

SEQ ID NO: 90480 - DNA, 521 bp, Heterodera glycines
  SCN-specific regions: Sequence locations=1-195,217-521
ctatcacaacggaaactcggaaccgcgtggattcggtcacattggcattgctgtgcccgacgtggactcggcttgcgcgcggtttgagcaattgggcgtaaagtttgtcaaaaaaccgaacgaggggcgcatgaggggcttggcattcatcacggacccggacggctattggattgagatcttcaatccaaacaacatgtgaaaaacgaacccaaaagattgagaattggattttcccattggcgaagcaatcaatttcgaaaaatcacaatagagcctgggtacgacgagcgtggtgttggaaaagtattcgttgaattccaatctaaagaagaatgccagaaagctcaggccgcattgactggacgcaaatttgatagccgagtagtggtcacgagttacttcgaccccgatttataccatcgcagacaattctgagacattggacggagagaaggatgatggtattaccaaacgatcatgttgggaagtttcggactcattttattttgtgtacgaat

SEQ ID NO: 90481 - DNA, 701 bp, Heterodera glycines
  SCN-specific regions: Sequence locations=1-57,79-257,279-647,671-681
gttcattgagctgaaaacacagctcaaattcgtcggtttcggcaagtacttctctttcaaagcacttagttggtatttccaatcatttttgatcggcattgacactttggtcgtcggaattcgcagccgtaaaaaatgttcaacgaacgaccctcgacaatgagattggctttgaatattccgtcgagctcggggttcggatccacaggtgccgctgtgtcgggctcgcctccctcgggtccgtccgctgtattcttttcctttttattaaattgttttgttccaataaaaagtttattcattttcatgcggaaactaaaatttgcgggcgatgagtaattttaatgagcgaattgaaattgacgaaatcggatgccatcggcaaagaatgcaaaacaaaatggaaagtggcgaattgttcaccttcgcttttggcgcctttgccatcgctttgattgccctcgtcattatttattacaaatgcatcgaccgaccgccaaaaaaacgattttattaaatgggcacaaaagagagaaaattgaagaaaaagccgacgaacagaaaaaaggaaaagcgacgagcaaagaaagaaagaaaaagcaaagtgaaattggaaatcaaaagaatcaaatgccatttttgttaaaatattttgaatatgttattaaatactatttaattaaaaaaaaaaaaaaaaaaaa

SEQ ID NO: 90482 - DNA, 311 bp, Heterodera glycines
  misc_feature (288)..(291): n is a, c, g, or t
  misc_feature (293)..(296): n is a, c, g, or t
  misc_feature (298)..(298): n is a, c, g, or t
  SCN-specific regions: Sequence locations=1-264,286-311
tgtacaacagcaaaaaccaatgcgtggacagtgtggtgctaatggacgaagtcaactcgagggaccaatttgaggaggtcgaacggcaccagctgagcttcatggaacaggttctgcaactgaaagtgcttttcaacttgttgccaaaagatgcgcgttttcgtgagaggaatttgatggtggaagtgttcacacggctcaaacctttcctttgattttattttcgttttccatttcaaaattttttgtttttctttgttcgtcattaaaaagaaagttgtgaaaaannnnannnnanaaaaaaaaaaaaa

SEQ ID NO: 90483 - DNA, 540 bp, Heterodera glycines
  misc_feature (530)..(531): n is a, c, g, or t
  misc_feature (533)..(533): n is a, c, g, or t
  SCN-specific regions: Sequence locations=1-411,433-540
ctcattgctggtaaaagtgccaatgcctcgtcttctctcttccttcgcctttttcgttttgtcaattatttgttcgattgtcttcttcgaacccatccatggccaggacgtgtgtcgacatcagggcaaagagtaccgaaatggggacgaatggattgtttccaactctttcattatgaattgcatcgtccattacaaccgatgggaaacaaagatcatcgcctgtctgtcaatgttaggcgagagaatccccgtaaacggacagatcagtgatcagcacggagtgtggaaatgcgagcagaagccgaacggaagcacacgattggtgcagcagaagcagtgaagggaggaaaagtgatcagtgatgggagagacgaagcaaagcattgattggcagaggaaaagccatcacagcaaatcaaagactgttccacacactttttaataccctgttaattactcactaattaatgtccattttgaccctggaaaaattagtaaatgcattggttgcttcaaaaaaaaaaaannanaaaaaaa

SEQ ID NO: 90484 - DNA, 339 bp, Heterodera glycines
  misc_feature (270)..(270): n is a, c, g, or t
  SCN-specific regions: Sequence locations=1-98,120-270
cccctcgcctccatgtatttctacggatatatgctctattttgtgttgtggccagtacttttccactccgttttgcgtccgatgataaaaaagacggcctaatggaagaagggatcattcgtccgtttagtctttttgattcgattgaaaatctccctttaaacaattgaaatttcgtcgtaattgttcattattggtgttaatttcttaattaagcctcaaatttgtttcctttttatggtaataatcgtttaaagcactgtttggtcnaaaaaaaaaaaaaaaaaaaaagaggaaaaaaaaaaaaaaaaaaaaaaaaaaaaaaaaaaaaaaaaaaaa

SEQ ID NO: 90485 - DNA, 443 bp, Heterodera glycines
  SCN-specific regions: Sequence locations=1-88,118-338,360-443
aataaaattatcccttttcccgtccgacaaattgtgaaattaaaaaaacaaaaataaatgacgactcaacaacgaatatttgggaatcagctgctttttctttgcatttttcttattggagttgttttttttcctcttttctgctgctgttgcaaatggtgctcatttagttgactcaagcgttgatcaaattggtcgtgcacagcacaatcataacggcgacataaacatacgcagaggaattgaacgcttcaacgacaatcggatggcacaaaatgaattggactttttgcacatctgaccagcgaaacgccaccagcacacaaagattaagacgcattaaacactaattacaaaaattgattttttacttccgttatttatttttccttcattttattttcacatgaccggaaaagtgtaataaacaaataaatgtaaaa

SEQ ID NO: 90486 - DNA, 559 bp, Heterodera glycines
  SCN-specific regions: Sequence locations=1-428,450-533
cgaacatttcgtttccttctcccttgtttgagtcattctctaagataagatcattagcttaacaaaatgcccggcttcgtaccgccagtccaatcaaagtgcccaaaatgtgggaaatcggtttatgcagcggaaaaaatggttgctggcggatatgactggcacaaattctgcttcaagtgcgaaatgtgtaacaaattgctggacagcactaacgcgtgtccccacgaggctcaattgtattgcaaacagtgccatgggagaaagtacgggccaaagggcgttggcttcggaattggggcgggctgtctgacgacggacagcggggagaagttcggcaacaaacgcgtcgagaaccgaccccttatggccgaggcgttcaccgctccgatcaatccgcaacaacaatgaaaaatggacggacatgcgaaggaagggaaggaagagcacggacactcccatcgattgaattaccaaataaatttaaaatacaagcgaattgttgtattaagacaataaaagtgtaaagcgggaaaaaaaaaaaaaaaaaaaaaaaaaa

SEQ ID NO: 90487 - DNA, 506 bp, Heterodera glycines
  SCN-specific regions: Sequence locations=1-443
caaaatatgctcaaaaaggcaatcaaaagcggattgccggtgtttgtcactgagagcggcgccggctcaggcggaagcaatgcgcccgttaatttgccagtaatgaaccaatggtggtcccttttggagcagctcaaaatatcccaaatcatttgggcagtgcgcggagagggaaatttacaaaatccgctgaataaaaacacggcacccgcaaacattggacagaattgggcactaacggaatacggaaatgtggtgaagaatgtgttcacgaagaacgcaaagccgattgggtgttaaggggagagaatgaaaggaaaggaaacgaattacgaaaaagggacgaaaggaaaagccaaagggacgatggaaattaacagaaatgagctaattacaataacaaatgtcacattaacgcatcaagaaataaaaatagccaattgaaaaaaaaaaaaaaaaaaaaaaaaaaaaaaaaaaaaaaaaatttttttttttaaaaaaaaaaa

SEQ ID NO: 90488 - DNA, 492 bp, Heterodera glycines
  misc_feature (400)..(401): n is a, c, g, or t
  SCN-specific regions: Sequence locations=1-13,163-311,354-368,390-426
ctcacccgtttcccttctcccttttcctccgtttccttttcattccttttcctcctctttttctttctcttccgtttcccttcttccttttcctccggttccatttcattccatttcttcctctttttctttctcttccgtttcccttcttcttctgcttctgtccgtgtctctttgctccgcgggggtcttcgctccgctgcgtatgaagcgccaattcgattggtttggcaattcgatgggtgcgcgtggcgccggcttcggaggcggatgggtgttcggcagaagacgaaccgttaaaggcgccaaccaattaataaaataataatgcacaataataataatatttatttcatttgcccccaattccccattttcaaatgaataaattatatattcnnaaaatttttttttcccacccccccgaagaaaaaaaaaaaaaaaaaaaaaaaaaaaaaacgacaaaaaaaaaaaaaaaaaaaaaacaaaaaa

SEQ ID NO: 90489 - DNA, 661 bp, Heterodera glycines
  SCN-specific regions: Sequence locations=1-365,387-661
ccctaccgtcaattccctaccagccaattccctaccgccaattccctactaaggcatttgatttccataccaaaagtgttgaatattgataaacattgagattaaaacacacaagaaaatttattcactgccttttagacagctcgtcaagagctttcggatgataccaaatttatcaagattcgatcgttttaaaaaagttagaagtgtcaaatctctcaaaatacggatagaggaaataaagccggaatattttacagaaatgacttcgacttctgctgatatttcaagtgattttgatcagacgaatcaaaaacaaaaaccaacaaatccctcaaaaaacaaaaatgtctcctttccgcttcctgatgatgttgctggttgcgctggtcgctgccatggccatgggcagtggtgttgaggccgctgcgccagccaaaggaaaagcgccggcggcagcagcaaaagctgctccggccaagggagccaagaagccctaggcaggcaccagcagcaggtgtagcagaacaactgcggacatgtgtgaagaatgatttagaatagatgaatgttgatgaaaaattcggtgattgttttttagaaagaacaaaggcattggaaattttttgggttttgcggaagtaaagaattcattcaaaaa

SEQ ID NO: 90490 - DNA, 410 bp, Heterodera glycines
  SCN-specific regions: Sequence locations=1-410
cctgcattgctacgtacgaaacggacggacaagcccaattggcccgtgaacggcttcacaacgtcgtatggcccgtggcgagcgatttggcactttgtgtggaattttcaactgaggaaaagctgaaccgacgaaaggcggaagaagagcaggaagcatcggcgaacaattcggcactcggcggaggattgggattgacaattgtggtggataacaggggccgtgggcctgaaactgtgcccaactcgggtcccacggtgctcattcagcacgacaaaaagcgacaaaaggacgcggaaaatagaaaaagaaaagttgaggaattggaaaagtcacagaaaactctcgacgaagtgttcaagaagacaaagactctgccggccatttactttttgcctttgtctgacgaa

SEQ ID NO: 90491 - DNA, 740 bp, Heterodera glycines
  SCN-specific regions: Sequence locations=1-21,43-287,309-740
attatttaatattggctaaatatatttcttctattttaaattcaaaaatcatcaaatatattgggcgagaatgagggtcccgttctctcgcttttgcttgaatgtacagttttgttcggaaacgaataatgcgggatttccgcaggggattcccttaccgcgatttcttaattccattttccgcttctgcatacgtttttaatttattccagcttcttttcttgaaaagcagtcaatgaatttgcgcaagaagactaaggtcgaaccaatagaagatgagattcctgagaatgagcagcaaataaacatctctacccgttcacataactcttcttataactctgatcgtgtcaatgaaaatgatttggttaaatcgctgtctcaatgtcttctggcaaacgtttctaaacgagggtttgttcgtgatgccgacattggagaaatgttctcagaccgaagagaacgcgagttgcgagcgaatgttctgaagaagagtgagaaattgctgatggatgttcttggataccgattagatcgagatgaggaagggaagcgtttttacctctcgacaaatttatgtaaaggcattgcaatggctatggagatatctgacgacacacaccgaggacttaacgaattcgcagatgaagatgcgtttgaggaagaatcaactcaaactgaacaatttacaaattgtcttcttgaaatggcgttaatgttcattttcatgtcgaagcgac

SEQ ID NO: 90492 - DNA, 388 bp, Heterodera glycines
  SCN-specific regions: Sequence locations=1-24,46-181,204-271,293 -343,367-388
cactttcatcggcaattcaacagccattcaggagctttttaaaagggtcactgagcagtttaacgcaatgttccgccgaaaggcttttctccattggtacacgggggaaggcatggaggagatcgaattcacagaagcggagtcgaacattggcgatctgatcagcgaatatcagcagtatcaggacgccactgctgacgaagacgtaatggaagaagaaaaaagcgaaacggaaggagaaaaagcggacgaagcgaattgagggaggacaattcatttcatttgtcaatttaacattggacaaaatgccaatgaaaactgtgccgatcatttcgtcactgagaattaattttaaaataatataatggaaatcttgaaaaaaaaaaaa

SEQ ID NO: 90493 - DNA, 513 bp, Heterodera glycines
  SCN-specific regions: Sequence locations=1-89,118-193,215-337,360 -445,501-513
atttacgcattaccggaggacatcgttgaggtggattgatgatggatcacgggtttacgcattaccggaggacatcgttgaggtcaaatccaaaatggtgatgacggtgttcgcgtgtatgatggcccttgactttatgccgaatatgaaggaagtgaccaacggaaattgactgactgtgaggcacaattacaataataaattaatttattttccctgttattctgttttattacgttgttcattcccggcttttgaatcgttgctcttttccggatctttctttccgaattttcaaagatatcctttcccctcgcgtattaaattattcgcttttaatttgctttatttgttttgctctttcgtacgttgtttctctgaagcgctcaaagcgtacaattttccctcatcgtcagctattacatatgtattacgaataccgatgaaaatattattgaaaattatatttatttaaataacagaaatataaaaggaaaatgttattaaaaaaaa

SEQ ID NO: 90494 - DNA, 525 bp, Heterodera glycines
  SCN-specific regions: Sequence locations=1-307,329-491,518-525
tgagcccaccgagcaaacttctgaagcaaatgaacaaaacatcggttggaaggggaggagggaaaacttcgaccgatgcgaccactgagacgtcggaggacgacgaatgctttgaaggtacgcatagcgtcagtatgcattcaatgaggcaacgcgtcctgcaaagaatggaagatgagcatttattcgacagctattcatttgtcggattgtcagaattagacgacgaattggagaaatgtgcggatgacccggatgagcaagtgcgtcttatcgagagtcgaatgcgcgaactgagtgaaatttttcacaaatacaaaggaaaattggcggatttggagaaagagcataagaaacgatcacggcaagagaagaaacggaaaatgatgacggataaataattgaataacgacgagaaatcattttcttttcaattttattcacatgaaaattaatacactttgactttgcaatttatttgtccatcactctttttaaaaataattaaataaaaaatgatttcct

SEQ ID NO: 90495 - DNA, 683 bp, Heterodera glycines
  SCN-specific regions: Sequence locations=1-226,248-683
agagtaattaaagttctgcttcttcacacccagagaactgatggcaaattcattcatgcaaattatcattgttccttcataatatttgagcaaatctaatacatattatcttaaaatttatgcatttttaaattcgaaaatgggacagaaggaatcccgtcatgcgtttgtcaattgtgccttgataaggcgagaagaatttgaagacaaaattcaggaactcaacaaaaaatgtgctgagtgttttgaagaaagtactttaaatatgctctttgctacaaaatccacagaagaacgagggattttatggcagcgttctgtcagaattcactgctttacggttttcgatgaaaaaatttaccgaaaggtctacagtctttttcagtttttgaaattctacgaatcattcatccaaattttggaagcatcggaggcatctaaacaccgtgaaaactccctaaacaataaggatttaatgagcatgtcgatatttaagggaaagttgttgtgaatattctgaagacggaaggtgcataatttgttttgactctttccccgactccgttttgccttgtgcccatgcttattgttcaaaatgtgtcgacccttttcctgctgtccaccaaccttgttgtccgttgtgtcggcacccgctcaaaagggatggccaagaccaaacatgg

SEQ ID NO: 90496 - DNA, 232 bp, Heterodera glycines
  misc_feature (199)..(200): n is a, c, g, or t
  SCN-specific regions: Sequence locations=1-68,90-195
cgctcgtcctccgcctcgggcgattaatgtggtggcgaacaaagaatggatggatggaagggttttgattgctttggttgaaatgatcgcttatggaacgattaatttgttatttttcatcagttcaatcccttcaaaggtattgagtctcaaggcgcttttttgcctgcttttggttaataaatttcatttctgaaannaaaaaaaaaaaaaaaaaaaaaaaaaagaagaa

SEQ ID NO: 90497 - DNA, 499 bp, Heterodera glycines
  SCN-specific regions: Sequence locations=1-187,281-386,411-499
aattaattattcacaaattaatcacacactcattaccacttccatcatttggccttttttaaaacaaaaaaaaaatgagaaatcttcttctcgcagcgttggcaattgcggtaatgcttttgtgttgtgcggaagccgttccaatggaaaacgaaaatcaacttgttcgccataagcgttggggttacggttacggtggtggttggggcggcggatggggccgcggcggatggggcggtggatggggtggccgcggatggggcggcggctacggttacggatggggccgatgatgatcagactgatcagagacagctacttgagcaaagatcgcattaaacgacaattcaagttcactgaaatttactcattttttatgttcaacgaattaaaatattaattaattttttgtttgtgaatattccaacctctctgcatcaatgcaccaatcatcattctttgcattttaaaaatttatctacataaaaataatcactgg

SEQ ID NO: 90498 - DNA, 327 bp, Heterodera glycines
  SCN-specific regions: Sequence locations=1-191,213-218,245-271,293-327
ttcccttattgcctccatctttgaacaaattcaaacgtccaatgactgaaagttattttggagagagacaatccgggaaaagagacggggcggacagagtgacaggcgatggagaagaaaccgtggcatgtcaatcctcgactcaccaagaataatattaaacggaaaaacaaaccaatttaatgttctaaaatttgtcatgtactttcatcattccttcactttcattttattttgtcaccattatcaggcttattcctacatcagtggttcgtgtaaatgatctcatggattatttgtacatctgaaaaaaagtgatttgaaaaa

SEQ ID NO: 90499 - DNA, 513 bp, Heterodera glycines
  SCN-specific regions: Sequence locations=1-388,410-513
caacaattacaacgtgatcaagtcgggaaacgtgaaaatgacgacaacaaatccaaattatgacaagccgctttgcttgaatgggctcagtcaatacgaggcgttgccctcctcgttgtgcaatctcaatttatgcaatttcatcggccgcaatttgtgcgaattgttgcaacagccaggcaatcacacggtgcgcgagatggagcagaaagcggcttggaatgccacagttgtcatgcccgattcaccaagaatattcggcatcccttttgtggacctttttgctggagagttcaattttgaatttctgttggaaacggagggcaaagagattgcgcatttggaagtgccgacgaatttggcatttgtgccaatcggaatgcaaaatgaggaggacgaagacggagaagggcaatgttagcaaaaaaaaaataaacgaaaattattgtaaagcgttgaattatttactagaattaatgtgttgataaatgaattttttgaccaaaaaaaaaa

SEQ ID NO: 90500 - DNA, 550 bp, Heterodera glycines
  SCN-specific regions: Sequence locations=1-550
aatttatcggatggcttacgattatttggacagattgggcaaagtggacggcctcgactttgacgcgttcactaggcaattattcgaccgatggttcggcgcgtacacgcgctgcggcacatgcaaaaatggcaaatgcagcagacacgggggaccgttgggaagttcagggtgggagcacgtgttcagcggagagtggcgaggagaaattgtggacggacaccacagttgggtgaggttttacctgcaggagaaggcgggagacatcgaataccacggatattacgtgaaaccacggcacggccaattcattggcaccattcagtacaaatggaagcagtacttgaaaaggatcggcggtttcatgataggcacgtcgccagcttttgacttttctctgctcaccgtttgcattttgactgaaccgggcgaccggaagtgcaaattccaactgaaagaaactcctatgttcgtctcctccttcctcgaggattgtgtcatcgacggatccttcagacacaacttttgcattgcgaccgcttatccgggc

SEQ ID NO: 90501 - DNA, 587 bp, Heterodera glycines
  SCN-specific regions: Sequence locations=1-391,413-587
aagacattgtttgtatggcaaacatttgtgtacaaaaacaggaattcactgaagcgaccagtgggcctggcctcaccttcgtggctgcgaaatttgatggcattcttggcatgggattttcggaaatttctgtccaaaaattgccgaccgtgttcgacaacatggtcacgcaacagaaagtgccggagccggtgttcgcattttggcttaaccgtgacccgacctctgaatttggtggtgagatcaccattggcggcactgatcagcgacgatttgtggccccaatcacttacacaccggtcacacacaaagcctactggcaattcaagatggattcgatcagtggaggtaatggcaaacttgcgtgccaaaatgggtgccaagccattgcggacaccggcacctccctgcttgctgggcccaaaaatgacattgaaaagattcagaaacacattggagcaattccgctcttccatggcgagtatatgatatcatgtgaacgtattcccacactgcccgatgtgacgatcaacatcggtgggcaggcgtacacgttgaaaggccaagactatgtgctgaaaatgaca

SEQ ID NO: 90502 - DNA, 462 bp, Heterodera glycines
  SCN-specific regions: Sequence locations=1-239,261-462
aattagtgatgtacatccgagagttagaatctccagatgagcactccctggttttattcaatccgcttcgttcttgctttcgtcctactagagatgaattgttttcggcaattgcctgtcagcgacgctctatcgttcgtctgaacactgaaagggcccgatttgtgcgtcagaacggggctttgctacggatgatcgtgcgattgacaggtggcatcccgccaaattttaatcatgctcattttgctgctgctgcacagccggcggtcaatgtgactgcggttatcaccaatgccaatcccaatggacagaattataaccgccttcagcgtttgcatgcggaattatcggagaccattgaccgttttacggaggaaaattcccttttgggatatatgaacgatcaattgacggaacaacttgaacctctgacagaagtgcctccgaatgcgaattttaatc

SEQ ID NO: 90503 - DNA, 246 bp, Heterodera glycines
  SCN-specific regions: Sequence locations=1-246
agtggtgagagaattaactttcccatcatccccaactcatcatcgctgaatgtattgactaactggtttttctacgtaaatcgttacagcgaatgtctcaacattatctccaactcagcatagagatcactaattgccgtgttcatctactatatccgatccatttgttttttcatttcattaaaacataaaatgtacataatttttgtttcaattaaaattgaggtttagaaaaaaaaaaaaaaa

SEQ ID NO: 90504 - DNA, 794 bp, Heterodera glycines
  SCN-specific regions: Sequence locations=1-6,29-419,441-794
ttaattaattgaataaaaattatttcatcaatgtcctttttactttttgtgactattgcttttgccaatttggcaccaaatgcttttggccagcaatggccaaaagcaacaagtgatgaaacggtttcggcaaccatcaaagtgtcgggcggcaccaaagactttggctacaaacgattgaccgcctcttcggcgttgggcaccggtgatcagtcggagggccaaaaagcgctgatccgtgccgaaaagggcgcagtgatcaaaaatttgatcatcggccaaaacggggcggacggcattcactgctatgacgggtgcacgctgcaaaatgtgtggtgggagaaggtgggcgaagacgcggccactttccggagcagcagcggatgcaaggagtacaattttcttgtgaccggcggcggtgtgaaaaatgccaaggacaaagtgttccaaatgaacggcggtggcacgttgacaatcaaagattttgtggccgaaaacattggcaaattggcgcgctcatgtggcaactgcaaatcgcaatgccaaaagcgcaaattcgtggtggagaatgtcaaagtgactgggctgaaaacgctattgtgtggcctcaacgagaattatggcgacgtggcgaccatcaaaaatgtgcaagtcagcggaccatcgaagaaagtgtgtgccgaatttgagggcaacgacaagcaaaaggagccgccgatgctgcgcagtttcgacgtcgggtcgagcggagacggcaaaaattgcataatttcgagcaccacaagcggctgatc

SEQ ID NO: 90505 - DNA, 97 bp, Heterodera glycines
  SCN-specific regions: Sequence locations=1-97
atttattctcacaaaagcagtttttgtatgattggaatcaaacacttttgcttgactttatcatgtaatttgattccaaaaataaacaaatacgtca

SEQ ID NO: 90506 - DNA, 485 bp, Heterodera glycines
  SCN-specific regions: Sequence locations=1-110,136-312,334-485
aaaaaattaattgcgaaaagctgaaaattaaaatggacggactaaaaaataaaagagcaatatggtaaatatatgtattggtaagctgtgtgtgtgtgcgctaaataatatgttgtttttgttgttgctgctttatgacatacatattgagattaattaaaggaaaaagtcaaaattatcgattgatcgctgctatggttaataatcaataaattatcgatcgattgattggcgctcatctgtcagttcatgaacattgagtgcacaaactgttcaaaatcgagcgcattttcaatggtacggccggacgccgcgtccacgtagggcttcatgcgctgtttgcagtattgcgcttgttcctgggtcaaattcgcgaacagttcttccgcgaacacataggggcggtactctttgctgagtgcgcggaatgccatctcaatttcgtcactggaccgcacattctccgtctccttgttgatcatgaa

SEQ ID NO: 90507 - DNA, 512 bp, Heterodera glycines
  SCN-specific regions: Sequence locations=1-17,40-282,305-512
ctctcgcttgtcactcaaaaatgaatgttaaaggtggtggtatctctcaagtgaatgattccacttctgatgaaatgaggctcttcagaggaggtcttagacatgctggccaaaccccaagcagattgatctacgacactacttcatgcattagaaactatcacgataagtacagctacgaaagaggtttcattgcccactctcgttcaccatccaatcaataccttaacttccacttcatgtacggaggtttcaagaagttcgccctcgagagacacgtttaccagaactggtacagaaagaacattagaaactggtggctccctgctatcatctgctacactgctggttgcctcaccatgagaatgtacgacaatgctgcttatgactatttctatttctctgattaaaagccttggatacacgcgatggttcataaagcttatggaaaaggtctatggtttctatatatgagaaaatagtagattgacttaaagcaaaaacgcttcaaa

SEQ ID NO: 90508 - DNA, 383 bp, Heterodera glycines
  SCN-specific regions: Sequence locations=1-281,304-347,369-383
ttcgctgttctgttgatcctttccctccaaattgcggagatcattgccaaaaagcccaaatattgtggtgaacgctttgccaaaatgcgggataaggtttgtcgctggcccggcgaacagcagccgtgtcttcaactgcaccacagcatcaaagagcgtgttcgtacgaagtgctgtgcggagggctgctccctggaggaaatgaaggaggaaatgtgctgcatgacggacgcatgcctacggaggtgctacccgggaaaaggctaccgactgggctccgtttactgaatttggcacaaagggccaacagataaaatgacaaagatgaaattcacggcactatccagaaatcatttcttaacaagaaaggctatatccaaaaa

SEQ ID NO: 90509 - DNA, 509 bp, Heterodera glycines
  SCN-specific regions: Sequence locations=1-361,385-509
tttctccatgctgtgttcgatgagccttgaatggtttttcagctcgtctatccgattctgccagcctttgccaaacccgcgtggaatcacccagcagggccaaaaacggtgttcttttggtcccccacaataaaatgggtcctcgtcggcgctggactctctgatctagctcggcctgcaaataagctgagcatttaccagaacaccgccctaatggccaccggaatgatttggacccgttactgttttgtgatagtgcctaagaattactacttggccagcgtcaacttctttgtcggatgtaccggactcgctcagatattgcggattgcgcactatcagtacattcattctgaggaaacaagcaaatgaatgatgagaatggatggacctcttaaatagattgtcttctcatgcgtgttttttgcgggttaacggctcaaaactcggtttttctgatcaaatagtattggttatttagtatgttgtgatcgtaaaatttgtattgg

SEQ ID NO: 90510 - DNA, 497 bp, Heterodera glycines
  SCN-specific regions: Sequence locations=1-48,70-171,194-234,256 -469,493-497
gctgaaaacacagctcaaattcgtcggtttcggcaagtacttctctttcaaagcacttagttggtatttccaatcatttttgatcggcattgacactttggtcgtcggaattcgagacgacaattttaagctgactcatgttgaatattacccacttgagaatttgcaaagttttttcaagaaaagtgggttcgacacgaacaaatgtctgctcttcctgcaccgttttctctctactgtcaaaaatgagctcaacggagtgccagaagggtcaattttagtgacggagcgtctcaaaaacaccgaccagttcgtgttcactaccatcgatgttgaggatgagatgggacaagcggagtatgcggtgatcagcaaagaattccgtgaccacaactggacccattgaaacttttttgcacttgaatcattgtattccatggttttcaaattcaaatttttttgcgattcgtaaaatgcttttttagttttcaataaac

SEQ ID NO: 90511 - DNA, 484 bp, Heterodera glycines
  SCN-specific regions: Sequence locations=1-207,229-302,324-484
gccaaaaaacgaattcaaagcgttggatgccttcgctttgtccgctcacttaaggccgggccgtcatcgatgcgattgtcaggcgcgtctccattctttggtgcgcaattgcattggctgtggacgcattgtttgtgcccaggagggaagcggacggtgcttttactgcggccgtttggtgtgcacgagggaggaaaagacgataattgagaggaaggacggtgagggtttgcgactgttgagatgccttttgaacgacttgcaagcggactacttcagtttggagcataatccatacttgacagcagccgaaagagaggcaattggcaatcggaaggaggaattgagacagctcagtttgagtgtcaaaaggaatattctcgtcgatttggacatttctaacggagcaatgcatcagcaaaagcaaaaacccatcgaaacggtggacgaccccatcctccaggcgattctcctcaattcggcg

SEQ ID NO: 90512 - DNA, 539 bp, Heterodera glycines
  SCN-specific regions: Sequence locations=1-539
cggtctccccacaaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgcccc

SEQ ID NO: 90513 - DNA, 572 bp, Heterodera glycines
  SCN-specific regions: Sequence locations=1-329,353-377,399-572
acaatttcttctttctcgatatttttccgtctcaaatttggcaatgcaaaaaattcgagtcgccaatccggtggtggatttggatggagacgaaatgacgaggataatttgggctggcatcaaagagaagctgatcctgccctatctcgacatcgacatcaaatattacgacttgagcatcgaaaatcgagacgccactgacgatgaagtgacagtggacgcagcggaagccatcaaaaaaatacaatgtgggcataaaatgtgcgacaattacggcggacgaggcgcgcgtgaaagaatttggccttaaaaaaatgtggttgagtccgaacggaacaatccgaaacattctcggggggacagtgttccgtgagccgatcatttgcaagaacattccccgagttgtgcccgggtggaagaaggaaattgtgatcggacgccacgcatttggtgaccaatacaaagcgacggatattgtggtgccgaaggggtccaaatttgaaataaacatcattaaaagtgacggaccagttgagagggactcggtgttcaactttgccgatacgggcggt

SEQ ID NO: 90514 - DNA, 480 bp, Heterodera glycines
  SCN-specific regions: Sequence locations=1-302,324-480
attttccttttcagccctttgactttctgtgtccctccctattccattttctgtgccgtcggctgtcagtgctgccaattcaaccacgcggatgaccacctcttctcaatgccagtgctcgagtttctgctatgaaaattgaatgctttcctattgggttcgacgatggcgtttcaaaattcctgagataaagaaaccaaaatgcgaacgaattagcaaagaacggcgtcaaacaatcaaatgtatcagtccgaacacaaaagtcagcttatatgagcggacaggactattcattgaatttggtttaccaacaatttttgtttgaagaagcacaacgatttcaaggacattttcctactccttgtcatttcccgcaatgtaatcggaagcccagcagatgcccaactccgtcgctgctgctccttgcgccccaacccgttcacaacaatcacttcctccaatcagaataagaaaagcaca

SEQ ID NO: 90515 - DNA, 545 bp, Heterodera glycines
  SCN-specific regions: Sequence locations=1-40,80-545
cgggtgaatgcacaccaaatgcacaatctgtgcatggcaaacgacagagaggggaggaggaggaagaagaggtggaagtgatctcggcaaaaagtttagttcgaagttcggctttaacgcagaggacattggcggaggtcgagagtatccccgaagagctttcaatggcttcacattcggcgaaatccttgccaaactcctccgtttccaccatgtcatctgggaaggggatggtggtcgccgtggaacccgtcgctgaacaccagcaacaacaacagacggacgattcgattgcggaagaagtgttttcggaggacatcgtttccaccttcaaaccgtcggagaagtcgctgcactccattctgtcattgcgtagcaattcgatgagcaccagtgcgcgggacagcatgggcaaactgaggagggactcggccagcgaagcgctgctcaaactgagaacgatgaattgcgtgccggagctgagaagtcctcgcgagtccaaaagtccacccaaacccctgaggtcgccacgtggcattgaccgt

SEQ ID NO: 90516 - DNA, 556 bp, Heterodera glycines
  SCN-specific regions: Sequence locations=1-505,553-556
ctctacgaattccaagcactaaacccgggcgaactcgactttaaggagggccaaatcattcagctcgattcgcaaattgacgagcattggtttgagggcacagtggacggccggaccggctttttccccatcacttacgtggaggtgatcgtaccaatcccttcttcttccacgacggcacaacaataaactttgtagaacaccgaacagatgacacaaactgtgctttgggatggtcaacagaacaagtcaaacaaactcacctaaatttgctaataattccttaattttcactgtttgtttttcgacccgagattctcttcttacaatagaaaatggcaaatttctaaaccattaacttctcagataatttgttttatttcttttcctatttctgaaattatgtccgcggagattgttatagctaatcaatctaattgtaaagccatttattcgagcgaccgttacttataattcatcctatgacactttcatcaacattcacataatttcaattataaaatttaataaaaaaataaagaaaataaaattgaaa

SEQ ID NO: 90517 - DNA, 562 bp, Heterodera glycines
  SCN-specific regions: Sequence locations=1-123,145-340,362-562
aattaattggaaatccaattcaatttttgagtataaaatgaactgctccttcttcctctgtctcttcactgttcagctgattctgctcaatttcgcagtcgaaggaagagaagacgatgaactgaagagaaagaaacgcaacacggacgtggacgtgctcggcctggtaaatattcacgcgccgtcgcgaaagaatgtgaacgtcgacgttggcggagaagaaagagaccgaaatgacaaattggtcaatgtgaatgtgcagggacacaggaaaaatgtgaacgtcgacgtgggaggagggcattataatgagggaaaagtcgtaaaatacgaaagggacggagagaggggaagggaagtgaacgtggacgtacgagtgccgaaagtgaaggtggatgtggaccgagaagacggatatccgaagaagaagcgagtccatctgaaggtgctggacaaactgaggaaatacgacagcgaagaaagcggcgaacggagacggcaccgcgtggtcaaaatcgaacgggacgggggacgacggcacaaaacggtgtacatcgagagg

SEQ ID NO: 90518 - DNA, 492 bp, Heterodera glycines
  SCN-specific regions: Sequence locations=1-492
gtttcatctccgccgattgttggctttcggtgttcgatttgctcccaccttctcaacttggcctcggaattgcgctgatcagccaccgatttgacttttacatcgacgaacacttcaagactcgcaaatggacattgaaatctataccgcaacatttgtgccttggaattgtacgccaaatttttccgccgtttgcgtaaattcgtcccgtcaattctcaacgatttccatcaattcactttctctttttctatgccgacaatttcttgatcgaatttccggccgatgacaatgccatggcatcggatggacaagcggtggcaaaatggcttttcactccacgtccggacaatgtgccgaagctgttcaaatgctggttgtgtaaagatgatccaaattggcgtcgaaaattgaagcgttcaaagcggcatttgccaatgcttcttaccacgccaatttcattgtcgtcaagtgacgacgactgtcttctga

SEQ ID NO: 90519 - DNA, 791 bp, Heterodera glycines
  SCN-specific regions: Sequence locations=1-24,46-103,170-284,307 -408,439-506,529-791
tttatgagtcgtttttcggcatttgggatagaatttttatttcatgaaaaaaaaaattcttgaaatttttttcagcaataaaaattctgttactaatttatcatgaaatttttgagaaaatcgcttaaaaattttcaaaaatatttatcttgaaattttattataaaaagtgctatatccattccttttaccgtagcccataccgtaacccgtgattacggtgctgttgcactcataacctatgttctctatatcctgtaaattttgtccaggctggttcctctccctgtcctccatgctttgcattccaatctatgccatttatttgtgggtggtcaccgatggcaccgtgtcggagaaattcaaaaaactgtttcgacccgacgtgaatttggtgccaaaatcggacaaagaccgggaggaggagaaggaactgaaaagggcggcaaaattggccggcgttggcaccgccaaatgaacggcacggcacgaaaccgggcaaccataagataaatgatgatgatgatctcggcaaatgcatagaatggaggggcatagatgaatttgtggttaaattttgtaaattcccggatttccaacccccacaaaaaaaaaactggggcataattcgaataataatacttattttcctaggctacgcctgattttcaatttatttgtacccttacttatgtagaagaattttatttttgaaaacgcctccctcaaagccattgtttctggaatttttgattttaaatttgtttaaaaaattttcaaatgaaataaaa

SEQ ID NO: 90520 - DNA, 536 bp, Heterodera glycines
  SCN-specific regions: Sequence locations=1-28,50-344,387-536
ctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttacatttatcgtggcgactttttccatgactcaaagaatgagccgcatgtggaggagcaattagttgccgcaatttatgatctgatctccaagtacaaagttgatctgtacgaaattgtcatttttgtgtccaagagtccatgctttcaccaggattgtgagcccaaatgtgaggtggtggacgaatgcaaatgcaataaagcttgtgctaaactgttgggattgcttttgtcaaaggtgcgcaaggagttgagcaaagtggatgtgcgaatgacagtcaaatttctgtatccgcatttgaaccgtg

SEQ ID NO: 90521 - DNA, 554 bp, Heterodera glycines
  SCN-specific regions: Sequence locations=1-336,358-363,385-554
tggttttccccaacctcatgtgcccagcgatcacattccgatcatgtcgcaatatgccgtcattccaccaaacttccagagatctttgccgcccattcaccattacggaggctccgcacattccggtggttttggtgcgatcggacggtaacgacggcaattttacaacacatgtgacagttttcatttttaaacgttgtcaattatgtaaattcatctcttatcactcataaaccaaaagacatgttttatgtatgtttgttgatgatgctcttccacacagactaatggtattgacacgttttgtgtacatactttttcttctttcctcgattctttctcctcaacagaataatatatataaaacagttaattaggagatggttgatgggttgggatttattgtaactccgagaaatttttgccatctcaaaagaatccgtttttcttatcccctcctcatcttcttctgctgctgatcgtactcaaagtccattcacctcatatgtgttccattcgtttgtgcttttccatgtaaaaaacggatgataatt

SEQ ID NO: 90522 - DNA, 553 bp, Heterodera glycines
  SCN-specific regions: Sequence locations=1-503,525-532
gttttttaaattgtctttagttccatccgatgaagaaatgccacattttgtgcattcgatgagcggcggattggtgctgataaacgcaaccgaaacgatggacggcacttacgaatgcgcgacggaagaaagtgcaaatggaaaagtgccattggccatttactcactgagagtggacggcgctgactgcgcccgtcccaaaagtgtggaacagttccgatcggctcaaagggagtggtgccgtcggatggacacttataggagcaatttgtcaaaatgggaaagcattcgcgatgccaatggacaaggcaaaggcctttgtgacacaaatgccgaaacggaaaggaggacggactcggggaattttgttgcctaactttggcattttcacacccacaaaatcagaggcttaaattggccctaagacaaacccaaggcaaaacattccatcgtaattctctacttccgattgctcactcatttattatctttctacgcctttcttttgtctgtgtttttaattattttgtgcataaatatgcttttcagaaaa

SEQ ID NO: 90523 - DNA, 552 bp, Heterodera glycines
  SCN-specific regions: Sequence locations=1-238,261-552
tcgcttttcactaaaatttacaaattctgctgtaactcaaaaagctttattccttcctggatatagcatatattttgtatgagtgcgcctaacaacagtccctcgagcatttcttctacaggaacaaacggaattcgtataacacgacagaggagcagtgctcgcattaattggctgaccgaactcaccacgcgcgattcaactccagttacaaccacccaaacttcaaaggatttttctgaaatcagcaaacatttagcgctcgttgaggacgaagacaatattaaaaggattcaagcaaaacgagaaaaagaagcccacgaacgcgcgttggcttttgtcaagaatcagttattgaactcgcggaaagacgactggctccatcaaccaatcgaagaattgcttggctacgcaccgaaatactaacggaatggcgaagcaatgctttgttactgttggcagtacgcgttttgacgctttggtcgaatctctgttccgtagcgatgttctcgatgctttaaagaaactgaaagttgaatgtgtgacaattca

SEQ ID NO: 90524 - DNA, 375 bp, Heterodera glycines
  SCN-specific regions: Sequence locations=1-103,125-249,278-375
agcaaattccatctcgaaaattcaattaattccattctaaaatggcttcatcatcgattaaattggtttcggtttcaatgtttctgctcgtcctttgcattggcatggccattgagcagacccaagcttattatggctggggtggctacggctatgtctatccttacggattttatggcaaacggcaagccggttttggcccatccgaaaatgctggcacttttggtggcggtggagaaggaaattccaacggaggaggaagaagaggaggaggaccatcatcaccaaacaatttttgagagaaaaaaggaattacaaaaccaaaattgagcttttcccattttgtaattgatgatcaatcggataaaaaaagtg

SEQ ID NO: 90525 - DNA, 464 bp, Heterodera glycines
  SCN-specific regions: Sequence locations=1-79,114-336,358-408
tgtgaaataaaatatgcgtcaccaatttccaattatttttgccctttttctcattttaccaattttaattggaaaggtaatttcaaattaattttaaatgttgaaaaatgcaattttgaaaatgtttctgccgataattgcatttgcttcagacggagtgccaaagtgacttttgggcctctctttcccagcctttggtttccgtgggcagtgatgcgaaaatgccactgaaggacttcggcatggacttcagcagactgaacgattacagctcattgtttggacgaagaaagaaaagggcgcactgattgtaagactaaaaggaaaggacgaaggaagacgaaacaaaacaaaacgggcccaattattacactaattagacaattaattaattacacatgttgtacgtaaataaaattattattgtaataaatttcattttttcaaaaaaaaaaaaaaaaaaa

SEQ ID NO: 90526 - DNA, 362 bp, Heterodera glycines
  SCN-specific regions: Sequence locations=1-1,24-246,278-362
ccaaaatcattcattaactaatcaatcaattggtcagtccctctcacaatgctcttctccactccaatgccactctttctcgtctcttctgtctttctcttcgtttttcttctcgtcgccatgtttttggccaatccgtccgatgcgcggcctcaatttggctcatttgccgattcgatgaccagcggaacgattttgagtaatatgtggggaaaaaagcgatgagaagcggccaacagcagacggagaaagaaagaaaattaaagaaaactgaagagaacaattggaaataatcaacaattaataaataattgttaattttgtataatcaatcatcaattataaatggttggtaattaaaa

SEQ ID NO: 90527 - DNA, 498 bp, Heterodera glycines
  SCN-specific regions: Sequence locations=1-222,246-352,410-451,478-498
aattaatttaattggcttttttctctcttaaatgcgctcccttctgttcctcgctttcgtggcacttttcgtcgtcaaatgttcggccgatgagtcaatgcaaaatgatgaaaatgatgagcaattccctcccggaccaccgccaagcaatgaaatgtcggaagaatcaaacgatcgccgcaagcgaagccctttcttcaactttttcgggggcttcaaaaagggaggacgaggaggacggcaaaaaggggaaaagccgaacggagtgccgcccacgggaagtccacccgcggagcgggagaagcgtagcctgagcagaggaaatgccaaaatgggaggacgaggaccaatggggggacgaggaggacaaaagggaggaagaggaggacaaaagggaggaagaggaggacggccaaagggacccccgccgacttcgcccgccccaacggaataaaaagaggagaaaaaagatgaagcaaaagaagcgattagtttgaa

SEQ ID NO: 90528 - DNA, 528 bp, Heterodera glycines
  SCN-specific regions: Sequence locations=1-182,206-528
tgaggtttgatttgagcatgatcttagtaactgccacgctagcaagtgatagtacacccggtactcacgtcttagacaattcagacgtagggttcctcagtaacggcaacgccaattgtacactgtttgaaagatgggctagttacgtgggtaacatgaacagcgtgtctattatggattgtgtggccgcagctaggcagggagatatgggacaagacattcccaatacggcccttggtctattcaagtggtgtacggcgtgtttcggcaagagcgtcggacctggccacagtgcgggaacagctacggcaggcaggaagttagcagacgccgcgtacgctgatgaagcagccatcaatgagcatcgcgtcggcaaacacttattgaagcgcgtgcacctgacacccaggagtgtggttaaacagctcgtggcaacgacagtcaggggcacatggaaaatgtacgtagtatgtgtgtccgcagtgtttgatctggacgacccgaacgggtcttggaactggcgacaag

SEQ ID NO: 90529 - DNA, 443 bp, Heterodera glycines
  SCN-specific regions: Sequence locations=1-73,128-263,285-331,409-443
gacggaagaagtctttgaggtggattgaatccggtgatcttttcattccccaattttgtgctatatgttggttttaaaaaccagtgttgttatttattattttttgtctgtttgtctctctcttaaatcccaaatgctttttgtcatggaatgaaattgttgatcaccaccaataaattattacttctttccaattttgtggtggagatcaaaagtggtggaccaaagtaattgtacctcgatcccactcgcccccaaatttcttttccattttggccctttttaccgtatgattcatttatgtttagttttcttgctcaagtcaaactgattctcggttccattttcgctttgttttcactgttgtgccaatttttgttattgttttgtgtcttcgtttttgccttttatcaaaagccagccatggacagtaaaaaagtata

SEQ ID NO: 90530 - DNA, 512 bp, Heterodera glycines
  SCN-specific regions: Sequence locations=1-512
ccatccatcgggcggcgggtccacaattgttggaggaatgccgaacactgaaagggtgcgaagtcggcgaagcgaagatcacaaaagcgtataatttgatgccaaacatcaaagctatcattcacaccgtcgggcctcaaattgggactgaagtgtcggacgaacagtgccgacagttgcgcgactgctacgccaactcgctaagcctggctcgcgacaacaaattgagatccatcgcttttccatgcatttcgaccggagtttacaacttcccaaaaaaggaagcctctgaaattgcgattaaaactgtgagagattggctgaccgaaggccaaaacaatgaaaagctcgacactgtgattttctgcgtgttcggcgatgatgaccttggattttacgaaaaaaacattcctcaatttatcctatgaagattcaattgaaagaagggatgaaaaactcagtaaaataatttattactagtaattttctaaaataaaattctgaatttctta

SEQ ID NO: 90531 - DNA, 414 bp, Heterodera glycines
  SCN-specific regions: Sequence locations=1-378
caacgaaaactgacgggaatggtgcgggacggagtcaattcggcctcgcgctattactactcacaaatatgcgacgcgaacaaacaaaacgtaatagacatccttttgggacaacagagaacagcggaataacgcagaaaggcacaacccacttcaaaatgttgtaattattccaattttttactattttgccctcattccaaagatattttcattctgtaagatacttgtgttaattatggcaaatgctttatctgtgcctgtgatactttcccgataaaccgtcattttgtggccagttgctatcagctttaacctttcatttaaaacatgttctctttgttttgtcttgcataattgccaaagtataaatggtggaaagaaaaaaaaaaaaaaaaaaaaaaaaaaaaaaaa

SEQ ID NO: 90532 - DNA, 587 bp, Heterodera glycines
  SCN-specific regions: Sequence locations=1-587
tctttgagcaaagggagcctcggagtggagggattggccggattactaatggacacggcgaaaaaaagtacaaaagtgccgtacgaagagaaaacggacgaatcgacgcaaaaagggcagacgcaaattgggacatcaaacgaaggcgacgaaggggcgaaggaaggcaaaacgaacggacgaagcataagtgggaagaagacgacagccaaggaacattatttgtccaaatcgagatacatgccagggctaagaagcaacggctcgtccagtctctcggcgggcatcaatcgaaaggcaatcgcacaaccgtcgcaacagagcggcgccaaacaaacgacgggcggcggaatcctttcgtcggttcaggttacgtcccttcttttggtgcgcctcgccaacaaccgccgaatgccaattcaaatgcgaactcactgggcaattcgtcgtcctcaatttcaatcggtggcggaccggcggacaatgccaaaacaaacaacgccttctcaaccatcggaggacggacgaattgggcggcaaaatatcagcgaaaaaaaaaaaaaaaaaactcgagactagttctctct

SEQ ID NO: 90533 - DNA, 301 bp, Heterodera glycines
  SCN-specific regions: Sequence locations=1-301
aaaatgacatcaatttatgctattggaatccgaatgtacagtatccggatagacggattggccaatgcgagccatctcaatataccaagttagaatattcgaacgtgaagatagagaagaaccggaactgaaactgagaaacgacgaagctgcaaaaccatttgctttagacaccggcacaaaaagctgttaagaaacgccgaccttatttaaaaaagagacaatataatcttacattcaccttggaattttgaagaacccagtataggaatgaataattaaaatttcaaattgttaaaaa

SEQ ID NO: 90534 - DNA, 538 bp, Heterodera glycines
  SCN-specific regions: Sequence locations=1-538
caccaaaaagaccctgaagtttcttggagaaatgacgcaactgagggtgtgctgggcaagctcaccacgacgatgggcccttgtttctgcaaaggaacagcttacttaatacattcgttcctcaacgcttcacacacgggaggtatcgcactgattcagtcgatatgtcgccaaattgaccaaaaaaaagtctcccatcacaaccagcgagtgtgaaaaatttgaatcaaatcttttcggttccaccatcaaaatggctatcgaattaaccggggatgatgtcatgtgcgagctggttgctggaccatggtcaatgtctacttttttcctttttttaaagtagtgaccgacaaatggggttttggaatttttttaaattgaacggcgccgatcactaaattgagaaaaatcagtattaacaaaaagaatttaagtgaccagccatcaaacattacggtcgacaacacaatgccattcacttgctcattctgtcagttgctccacaaaaaagcctcaactattgctcacaacttcgtca

SEQ ID NO: 90535 - DNA, 476 bp, Heterodera glycines
  SCN-specific regions: Sequence locations=1-105,135-404,427-476
ccattttcaccgataagaagggacaaatgcgttgatgaaatggatgatggagagattgttggtgataatcaaaatgacagcggtggtgataatgaatgtgatcggagagcgattgtcagccagcagcagaaatcgaaagaattttcgtcagtgcaagcggaagaaagtgagggaaacgacgacgacgcttttgtgcctgagccaatgactccgcctcgtccgaccaccccggcagactgtgagacgggcattccttcaccaaagacgccgccaccggtcgcttcctcccacccgacacgcatcaaagaagttatcgaaatgcgggagaatgaacggaccgtgcgcttgttggacattataacactggattgtgacgatgaatggtgatgctccctatttcatacattgttttccaaacattttcatacggttatgcttatttgtcgacatttctattttttcggaaattgatgctg

SEQ ID NO: 90536 - DNA, 534 bp, Heterodera glycines
  SCN-specific regions: Sequence locations=1-167,189-534
aattacgaattggcaactgctttgcttcgtcgtgccactacgcctccaccagtgcgtcgtgacagttactttgatgattcggccaaagtgcaaaaccgcgtgttccgatccctgaagttgtggtcgttgtacgccgacattgaagagtcgatgggctcactggaaagttgcaaggcaatttatgagcggatgttggagttgcgaattgcaacaccacaaatcgtgataaattatgcactgtttttggaggacaaccaatactttgaggatgctttcaaggcgttcgagaagggaattgggcttttccggtggccgctcgtatttgacatttggaacgtttatctgaccaaattcatccaacgatatggtggcaaaaagctggaaagagctcgcgatttgtttgagcaatgcttggacaaatgcccacccaaatatgccaaaaatatttatctgctttacgcaaaactggaggaagagcatggattggcacggcacgccatggatatttacaatcgggcaaacggagcagtcgaa

SEQ ID NO: 90537 - DNA, 558 bp, Heterodera glycines
  SCN-specific regions: Sequence locations=1-147,169-314,342-558
tacacaatcatcgtttccgccactgcttcggatgctgcgccgctgcagtttttggccccctattctggcgccgccatgggcgagttttttcgcgataacggcaaacacgcgttgattatctacgacgatctctccaaacaagcggtcgcttaccgtcaaatgtctctgctgttgcgccgtccacccggtcgtgaagcttacccaggtgatgtcttctacctccactcgcgtctgctcgaacgtgcggccaaaatgaatgagactcatggcggcggctcaatgaccgctctgccgatcattgagacacaggcaggggatgtgtccgcctacattcctacaaacgttatctccatcaccgatggccaaatcttccttgaaaccgagttgttctacaagggagttcgtcctgcgattaacgttgggctttccgtgtcacgtgtgggttccgcagcacagacaaagtcgatgaagcaggtcgccggttcgatgaagctcgagcttgctcaataccgcgaagtggcagcctttgcccagttcggatccgacttggatgcctcc

SEQ ID NO: 90538 - DNA, 533 bp, Heterodera glycines
  misc_feature (499)..(499): n is a, c, g, or t
  SCN-specific regions: Sequence locations=1-137,163-183,205-458,481-533
ccatttattgtctgttacttttagcccagaatttagttaagcaaaaccaagttttcacttgataccataataaactgagattgtcattgtttgaacgcgtgaactcgaacattgtttaaaatgatcatttctctggaatttttcagttatatattttttgtttattaaagtctcgtaaaattgccaaaacaattcttttcatgtttaagtccattcttcgcaaccgaaacgaacggtcgccaattaacaacgaagaattgcagaaaatgtgcaaaagagatattgtggagtttcttcctactccgaaggagattttgggtgatttcgttttcgagaggagcgccgggaacaacagagagaaaaggaagccgaggaaagggaggccaatgtcagcgtggaaaagtaggaaaatggacttgtcgagcagtgacgaggagagaatttaattcgcgaaatatttattgtatttgtttttgttatcacccattttgcaattacngaaaaccataccaatgaatacaccaaataaaact

SEQ ID NO: 90539 - DNA, 532 bp, Heterodera glycines
  SCN-specific regions: Sequence locations=1-433,456-532
gtctgatcgtttggcgactgatcgcgcgttcattgggctgcttttcaaaaaagttggaacgaaagttgacgatagagcccaaagataacaacgaagacgaaattgaaactgagacgagggcaagccgagaaacactttccacggagtcggacgaaggaaatgatgaactgttgcagttcccagtttggtttctgatcgcggtgaccatcatctggatcctgctctgcgcttatttgtttcttctctgggaggatacgtgggattacggtctttccctctatttcgtgctagtctccttcctcaccattggattcggcgatgtgatcccctccaagcccgattacatcattctcgtcggcattatgattctgatcggattggccctcgtttccactgttctaaccatcatacagaagcaaattcacgcgttggcagacaatatgaaaagcacaatcgacaaggattaccaagcagcattagaagaattggacgaggaccaaatcgaacccatcgatgggcagagaaaggaaat

SEQ ID NO: 90540 - DNA, 394 bp, Heterodera glycines
  SCN-specific regions: Sequence locations=1-351,373-394
ccaaacaactccatggccaattactgttcatttaaaaaattttcccgatgaactcattcgatgtcggacgaaagaaacgctaaaattttgctttttgcaatctctgaaagaggcgtgccaactcaaacttggttctaacattgctgcgtcgatgactaaggatgagcatggtcgactatttgacggcttatgcaacgacagatttaacgacttttggatggtcaacgacaaactgatgggactccgttcatcatcaggcgaagaacagtttagcactattcccgcccgattttatgaggtgctaatttattgagccaaatttacttggaatgatcttttggaccgatactcatgatatacaatttatcttttcgtctagtcattaattttttac

SEQ ID NO: 90541 - DNA, 322 bp, Heterodera glycines
  misc_feature (284)..(290): n is a, c, g, or t
  SCN-specific regions: Sequence locations=1-232,260-290
ccgttctttaggcaattgctaattatgccgggcacatgtcgttcaatttggtgacgcaaaaggtggacgagcggagaatggcaccgcaagcaccgctgtttaacaaattcaacggacacaatttgaaacagcaggacacaatgttttttgcatttgtttgcagttgtccctttgcgttgaaaagcatgcgtgacccaacgatgagttcttgcccatgaacacattcttaaagaattaattttaattttaaaattttattgggtaaataaatgcattaccaatcnnnnnnnaaaaaaaaaaaaaaaaaaaaaaaaaataaaaa

SEQ ID NO: 90542 - DNA, 532 bp, Heterodera glycines
  SCN-specific regions: Sequence locations=1-532
gccatccatcgggcggcgggtccacagttgttggaggaatgccgaacactgaaagggtgcgaagtcggcgaagcgaagatcacaaaagcgtataatttgatgccaaacatcaaagctatcattcacaccgtcgggcctcaaattgggactgaagtgtcggacgaacagtgccgacagttgcgcgactgctacgccaactcgctaagcctggctcgcgacaacaaattgagatccatcgtaacttacaaggggttttccttctactcgtattttaggcttttccatgcatttcgaccggagtttacaacttcccaaaaaaggaagcctctgaaattgcgattaaaactgtgagagattggctgaccgaaggccaaaacaatgaaaagctcgacactgtgattttctgcgtgttcggcgatgatgaccttggattttacgaaaaaaacattcctcaatttatcctatgaagattcaattgaaagaagggatgaaaaactcagtaaaataatttattactagtaattgtctaaaa

SEQ ID NO: 90543 - DNA, 556 bp, Heterodera glycines
  SCN-specific regions: Sequence locations=1-556
cggcgacaatgggatgtacctgaacatcattttgggctccaacctgaacatcaccttgcccagtccggacgagcgttaccgctacaaaaaggagtacgagtcgttcaagctgtccgtcgcttttgtcattctcgcagtgtttttcgtcgtcatttggctgcctccgactctacgcccattggacgccctttgcaactttctgttggtttggtactactgcactttgaccattcgcgagtccattcttcgcctgaacgggtcgcgcatcaaaggatggtgggtgttgcaccattacatcacctgcgttctgtgctgcatcactttgacgtggagcggcggcgactgctacgagcacatgcgtccgacctttgttgtgctcgtgtgctatgtgagcagtgtgcagataatccagtacaaataccaaacgggctgtttgcgcagactccatgccttgggacagcgtcactcaatggacattaccgttgaaggtttcagcaattggatgttcaaaggattgacatttcttatgccctttctgatcatcggatattttctc

SEQ ID NO: 90544 - DNA, 532 bp, Heterodera glycines
  SCN-specific regions: Sequence locations=1-46,120-179,201-213,239 -262,331-351,394-410,513-532
taccctaaaaaaaataaaaaaacaaatttctaaagacttctcttggtattataaaaaaaaataatttttaattttttaataaattattaaaaaaaataaaaaaaaaaaataaaaaaaaacattcatcctcgaatccattaaaaaaactaattaatttgctaccttagaccaatcacgctaaaggtgcctttaaaattaataatcaagaggcagtttaaaaaaattaaaaaaaaaattaccaattattctaaaaaaaaactttaagaaaaaaaaaattaataaaaaaaattagaaaaataaaaaaaattaaaaaaaataataatagaaaaattttttttttcttaataaattaaaaaaaaaataaaaaaaattaaaaaaaaataaaaaaaaaaactttaaactttcaaaacattttttcaaaaataaaaaaaattttctattataattttaacttataattttaaaaattttttaattttaaatttaaattataattaattaaaaataaaaaacttaccctgaaatacaaaac

SEQ ID NO: 90545 - DNA, 526 bp, Heterodera glycines
  SCN-specific regions: Sequence locations=1-251,273-418,440-526
ctgcgcggtggttacgtccagtttgacaacattgacccgacggtgtacgtccatttcaagaaaatgatctccgccaaactgtgctccaccgtcctgggacaggtggccatggactgtgtggttgaccatccgaagccgggcgacccgtcctacgaccagtggcttaaggaaaaaaacggctgtgctcgactcgttgcacaagcgtgcacagctggtcaccaaggcgtacaaccaagtggagggtgtgcactgtcaacaggtgcagggcgccatgtatgcatttccacgctttttgctgcccgacaaagcaattgcggaggcaaaggccagcggagtgcagcccgactttttctacgtgaagcagctgcttgaggaaactggggtttgtgtcgtgcccggctccgggtttggccagcgtcctggcactttccatttccgcaccaccattttgccgcccattgacattttcgaggacatgctcaaccgtttcggcgccttccacaaacgctttttggccaagtacaaa

SEQ ID NO: 90546 - DNA, 539 bp, Heterodera glycines
  SCN-specific regions: Sequence locations=1-539
gaggaaaatcaacgaaaatagtgaactccactcgaagttattcgacgttgaaaggcgttttgacgaagctgtgacggcattcactcgtcggattgatgaattggagaaggaaaatgacgccctgaaaagtctcgtttccattccattcgatgccgaacagcgaaaagaatttggcgaatcggaaaacactgccccggggcaaacacttcagcagacggaggcaaattcggaggagaaaaatgcgccgtcggcggttgtgccgaagaccgactcggccgatgaccttttgggctgttcctctgcttttgcgaatgaatccgccgatttatgcagcagaaaaccatcggcaattgcaaaagacgaagcggtggaggaaatggcagccgaaaaatattccacggagagaattgccaccctcggagaatcgctgcggcacgcaaaaggacgtgcgacctattacaagcaggaatgtgaggaattgctcagaaaggcaatctgtgaccagcagcgcatcgaagcattggagcagaacattttcg

SEQ ID NO: 90547 - DNA, 547 bp, Heterodera glycines
  SCN-specific regions: Sequence locations=22-547
taaattctttctttttaaaaatgctttccgctgctttttttatgcctttgtttttcattgccattggccaattcctccaaatttctgatgccattgactgtttttcttgcgcatcgccggcacttcacaaccaatgggaggcaactggacttcccgaaattccgccgcccgaccgtttcgcgttccacgcgtgcgatgggacgggcactgactataaaccgtgtgccgatgtttgcatggaaatgcttgttgctgctggcaatgagtacggtgttgtgcgcgggtgcatgtccgacttttaccatggtcaaacaacgtcgacaaacactgacaagtgttactttggtggatacccacacaatgtgaccatttacgacccaaccaatggtgccaagacgtacagtcagctgtacgtgggcgtgcgctactgctccaccgtgaatggcgcgtgcaacaacaaattcatgccaaagaaagaagcggccgaaggaagcgggcttttgccgaaacattttgtcgtcagacccaacaaatgccaacaacggct

SEQ ID NO: 90548 - DNA, 519 bp, Heterodera glycines
  SCN-specific regions: Sequence locations=1-8,51-68,96-519
atataattatcaaaaatgaaactattctcaatgtttcttctcctgactttggcattcgccgcttttgctgagagcagcagcagtagcagcagcgaatcgtccgaatcatcggaggaatgttcttcagaagaaggcaatcccggcacagaaccggagacgacaactgttgttgattcagacgaaaattgcaacgcgacatcagatagtccaaacgacgagtcatctcctgtgccatcgtcggacagtccaaatgacgagtcatctcctgtgccatcgtcggacagtccaaatgacgagtcatcgcctgtgccatcgtcggacagtccaaatgatgagtcatcgcctgtgccatcgtcggacagtccaaatgatgagtcatcgcctgtgccatcgtcagacagtccaaatgacgagtcatcgtctgtgccatcgtcggacagtccaaatgatgagtcatcgcctgtgccatcgtcagacagtccaaatgacgagtcatcgtctgcgccatcgtcggacagt

SEQ ID NO: 90549 - DNA, 500 bp, Heterodera glycines
  misc_feature (484)..(484): n is a, c, g, or t
  SCN-specific regions: Sequence locations=1-356,378-439,478-478
tagattaaccccctcctcgtttggctatgatgatgatgatctgttcgacattggcactgctcagtccgttgcagtcaccggcattttgacgtgcaacggacggccaagtggcggcacaaaagtgaaactgtacgacgtggacacttttgacccggacgatttgatggccgaaggctttacggacgaaaagggacactttctgctggagggattcgaaatggaaataagcgacatcgacccaaagctgaacatttaccataattgtaacgacgaacactttccatgtctgcagaagttctccattgaggtccccgacaattacataaccgaaggaaaacgaccacaaaagatttttgacattgggaaattgaatttggaaggcaaattctcgggccaacatcgagattgtattaattaatcggacattttgttgaatcccatttaatttataaatttatcaaatacaaattaaattttgaaaaanaaaaaaaaaaaaaaaa

SEQ ID NO: 90550 - DNA, 492 bp, Heterodera glycines
  SCN-specific regions: Sequence locations=1-492
tcactgtcgcccaaagttggcacttttgtttgcgggaagaaatgctcaaaaataaggttggcccgttttcttctcaaatggtgtactgcttgaagttgttgctgctgcgcgctttctgagtcctgccggatgccaaactccgcgtcaaagtcgggaaatttagggaatatgggcttcgccgttgccattggccgatggttttctgccccgctgggccgaccgacctgatcctctgtttccgcttgcctccttgggccaattgcggtggggccaaataacggaagcaaatgtgcgtgctgttgctgacgttgaactcgttgcagcactgcacttcgccatcggaaggagcctgccaaaaaatgttcatcgaattactcaattcgctcgcaaatggcaccaaagattggcacacgaaacgccttttgattctaatgaatgcatttcatcatccccaaaaaaattctacaaatagaaattactcccaaaaaattc

SEQ ID NO: 90551 - DNA, 474 bp, Heterodera glycines
  SCN-specific regions: Sequence locations=1-325,347-408,431-441,463-474
caaatcacgtgatggatgtctcggtcataaactattgccctaaaaatgcgacgactatcgtattagcacataatccaagtgccgccaggaaaatttttgagttttcgcaatcaaatgaccatcctgttgatttgattttgtcaggacacactcacaatgcccagtatttggttctgatgcctttcgcttacttcatcctcccttatctctatggcctctatgtgttgtcggatggcgcgactaaattatttgtttcggccggcactctcttccaaaatgcgccgatgaaaattccgtttatgtcggaaatttggtctattgaaattgaacccagaaaacaatgatagatctctattttgcgaaatttacttcaaattagtttattttacaattcggtaaaaatgtatcaaatttatatttatttttttatctcattatcaatgtaaagaaatatgcaaataaacatgaattata

SEQ ID NO: 90552 - DNA, 547 bp, Heterodera glycines
  SCN-specific regions: Sequence locations=1-106,128-158,184-268,291 -321,370-381,404-547
taacctatgcgtttggactcagcgacaattatcaggtcacgtttcagatcaaacatgtgaagttgtggtaatgcttctcgttctttccgtcaacctgtcaagcgaaagcaaataaaatattgtaaaattgggtagcgccgatgcatatattgaaattcattaaaaatccaattattaaatttgtccatcaaaattttggcgaaacaatataagccctgaattttacacattttcctgtggcggtatcaattttaacaattgcaaaatctgatgctcgacgttcatttttattttcctaactctttattaattctattttcttctctctcactctcttgctttctctctctctcctctcacttctttctcgttgatctcagtctttctctttctctttgtttttattttgtttcggcataatatttcggattgagcacgagaaacggcagcagcctcatgttgaaggagaaaagaccaagaaaaaggatggttgttccgaggcgattgtgcatcaggaaattacatcactcactggagtgcaggtgac

SEQ ID NO: 90553 - DNA, 1048 bp, Heterodera glycines
  SCN-specific regions: Sequence locations=1-666,688-1048
caaaaaagccttattgtactccggattactaatttatggaaaacgatcaacaacaatctccggaagaccaaatttcagcggaagcggcaatcaatttgttggccgttaccaccactcaccagcacatttttgggggcagaaatggtgcactttttgtggaaatacggcgaattgcggagcaacaactggaacacgcgttggcaccagtcgatgttgctggcggaaaatgggagctgtttgtgaaggacggcgaactgcgcatgtacagccgcgagttggaagtggagaatggcattgcggctgacccgttgaaagcgcttcatgtcattgatggtgtgtcggctcacgaattcatcgacctgttctttcgacctgaactcaaaaaggaatgggatgatactcttgaactgggtaaagttgtggagactctttcgccgcacactgccgtcatccatcaaatccatcgccgggtttggcctgccgcacaacgcgagtcacttttttggtcccaacggttgaatgtgttgtcggaatgcagctctgtgactgaccatgtgccgggtgaacttcttggcgcttggatggtatgcaaccaatcggtggaacgcgacgatgttccgctttccgacccatccgcggtccgtgtccgtctcacaattgcgatgttatgccgcacagtgttgaagcccggggcggacagaacgaagccccgtgaacaaatcacacgggaggacatccgttgcaaaatcacttatgtggcacaaattcacccgggcggttgggtgcccaaaattgggattcgtcaaatctacaagcgtgaatatcccaaatttctgcgctccttcagcaaatatgtgctggacaaagcgaacggtacggcattggcacttccgttgtgaatggacaaatgattttgatggcattgtgtaaacagtcaaattatgccaacccgagaaaaagtactgaattccatttcaaatttctgtgccttctttatctcgcttattcgttttcattttatattgcttttgatgtaaaaataattttt

SEQ ID NO: 90554 - DNA, 782 bp, Heterodera glycines
  SCN-specific regions: Sequence locations=1-782
cgtaatcacgcggtggcggcatccttttcatcgattacgacattcatttaccgtagcaatttatgtcaatgaactcgctgaatatgggcaaagaagtggccaaacggtggatgggcatcaacaacagaagaatggcgcccttttccctttcgcccgtcgaccgaatgcgtcaaagtgtgttccgagttcgaagtcgtcttgcggtcaatttgttgtcggaagggttggccacctttctgctgctgctggtcggcaatggcattggggcacaacacattttgggaggggggaagctggacaattacatgcaggtgtgcttcggctggggcatgctaatcgctcttttggtgttcgccacttaccacacatccggtggccatttgaacccggccgtgtccctcgccttcgttagccttggcaaattgccattcgcccattttttgctgtattccctcgtccaaactgtcggcgccttttttggctccgccctttgcttacacatctacagagaatccttcgagaaattcgacgcgggcattcgaacggtgggagggcccagcggaacagacacaattatctgttccttcccggacgaacacatcggacatttaccagcttttgtggatgaaattgtcgggactgggctgctcctcctttttgccatgcgctgatcggtcccgcgaatcaaccgccaaaatgggtgcctccgatccggtttggggttgcaatcgttccgacaactccctccttcggctgaatgccgccctctccgaacaatgggg

SEQ ID NO: 90555 - DNA, 816 bp, Heterodera glycines
  SCN-specific regions: Sequence locations=1-152,174-498,521-624,647-816
gtaattctacgtgtgtggttttttatgaatttaacctcactcatttgcttctttgactttttgccctgaaaaaatgagtcaaatttaaaagttgttttcggtcaatcatgatgagatacctatatatgaaattatgctcaaaagcaacattctttgtgttgaagtttttaaagttaaattttgttgccgaatggacattggcaactgttgcatttgcctgggcgggttcggcgttgcacagatgggcgtgctgccgtgcctgcacactttccaccactcatgcattcagcgcgcactgggccaaaatgcgcagtgtccgctttgccgtcggcacgccatcgacacgcaaattgtgagaccgaaatacgaaggaagctgccgcgaggcgggcgatttgccaagaaaggccatgcgtgccgcgttagctttttacgaccgcaccgttcgccaccgcttcgccgatggttcgtcgggaggcgaagcacagcgcgaggaattgaaactttgtctcaattcattggtcagcactttggagagcgctgacgcggagagagaggcgaaatgggaacggctgaagcaatttttgagggtgtgcggaacggccgcaatttttgccgttttggcatttctgttcactttgtattggccgttgatctcttctctggcggttggcgttgtgcgcaccgtttggactctgatcagttctctgcgcgatctgttggtcgcccattggcccgatttgctcttcggcggtttgctcctcagcactttcgtcgacatggaatcctccgactcgcagcaacagcaggcggaaac

SEQ ID NO: 90556 - DNA, 485 bp, Heterodera glycines
  SCN-specific regions: Sequence locations=32-51,73-140,173-441,465-485
tgagacaggttagttttaccctactgatgacctcaccgcaatggtaattgagcttagtacgagaggaaccgctcattcacataattggtttttgcggctgtccgaccgggcagtgccgcgaagctaccatgtgctggataatggctgaacgcctctaagtcagaatccatgccagaacgcggtgataccacccgcacgtatagatggactttttggaggctgttaaggacaagtttaacaaactgctcactgcttgaagaacaaattgggaaccatttacggcaatctcttatttaattcgatatttttttttgaacattttccgtctcataatcagattttgtccgttttgtctgttccttgcccatttctcatcaatttattgtgcattattcgtttgtcgttctaacattttttaaacatacgagattcttcgttttcaaaattaaaatttattttaaaaagcataaataaatgaatgctaa

SEQ ID NO: 90557 - DNA, 555 bp, Heterodera glycines
  SCN-specific regions: Sequence locations=1-555
catactcagccgaatgaattgccgcaactgtcgccgcaggacataacaatgcattcgaaaatcattcaccagaaccagtgggatggtgagaggagtgtgatcatcacctgcagttttacgcctggctctgtctctctgacttcttaccgtctgacgcctagcggctatgaatgggggcgaaataacactgacaaaggcaataaccctaaaggttatttgccgtcccattacgaaaaagtgcaaatgcttctttccgaccgctttttgggctactttatggttccgtcggcgggtgtttggaattacaatttcatgggtgttcgacatgatgcaaatatgcagtatgatgtttgtttatcggctccaaaggagttttaccatgaggatcatcgcccacttcatttccacaatttcaatgtgttcgaagatccactcggtgtatccacagccgacagagaggatatatttgagtgaataatcaaagatggatgggactgacaatcagtgtgacaactgtcatatttattttcattctttgcagtttgtaccaccatt

SEQ ID NO: 90558 - DNA, 688 bp, Heterodera glycines
  SCN-specific regions: Sequence locations=1-137,159-688
caaagagccacggccattgtcaaaggtccgcgggagggcgcggcacagcgcaaacactcgcggcatttgcttttcactctcggaaatattcactttcctttccaatcgcttgtctcatttcgattcaaagtttctttttgggatgaaattgctgaaatccctcccttaatttaaagaaagagtcggtactgaaaaagacattttcagttgaagcgggcgacagtttgaccaatgccattctgggcattttgccccaacaatcggccgacaacgccgaggctgacagcactgggaacggaccaatgcattcagcggaacatcaccagcacgagacggaccagcaacagcagatgatctcttcagggacgggtgccgcgtcggtggaaggaaatgccatcgccgcgggggttcggcgccattctctgctgggaccgattccaatacgttcacagcaacagcaatccgtcgaaggccaacagtcgaccattggccagccgatggtgcgcaatttgccacctgcgactgttcgcactgcgaattttgcgcaaaatcatccgcaatcgctcgtcaattcgcagcatccgaccgtggccaacaattgccattccgagcagcacttcgccggtcgcaagaggcgggcattccctcccgccgccgcagtcgtcggcactgccgctgaacggcttct

SEQ ID NO: 90559 - DNA, 669 bp, Heterodera glycines
  SCN-specific regions: Sequence locations=1-328,350-534,556-669
tccaattccgtccccaaaacgatgggtttttctcggaagatgaacagcaaaaatgggtcaaagaacatattggagaggctgagataatttacacgatgggaccaataaaagtggacgcatcgcttttggtagttgccaaagcgttaaaagcagtggtgaccatatctgcgggccatgaaaacatcgacaccgtggaatgtgccagaaggggcatccgaatgggctttggcggtgccattctcactgaagcaactgccgaaacggcgatggcacttttacttacggtttcacgccgccttgtcgaagcagtacaaatagccaaagaaggaaaatggccgaacaattggtcaccaaagttttgtgttgggaaagcattggaagggtcgacggttggtatttttggaatggggcgcattggacgaagcattgccgataaactaagcgcatttcgcccgcttgaaatcatttatcacaaccgtaaagccaattctgaatatggtcggattgatggaagattaaacgattttgctaattaaatgaattatgttaattaatcagagggtcgcttccgttatgtgccatttgaagaactcatcgaaagaagcgactttttgattctgtcggcgagtgtcaatgatcagacgaagggactgttcgacaaagaaaagt

SEQ ID NO: 90560 - DNA, 519 bp, Heterodera glycines
  misc_feature (499)..(499): n is a, c, g, or t
  SCN-specific regions: Sequence locations=1-7,30-54,76-326,350-495
cccatcattttaaaatattccccaaaatgcgtgttctcccccttctcttttctgccctcctcctcctctctgttggcctttgctttgcccagtttgatcagtctccgtccgctgctctgaatcatgtgcgggccaaaagaggctacaagccgtggaagaagcaatccttctcctcttcttcaagcgaaatgtacagaaggagaagacccagtggtaacggtcattacagggattacaacggctacggtagcaatggatactatcgacgaaaacccggcattttagaacgggcgctgggaaaaattacgcggagctattaacggacgagcagaagaagagaagcaaaaagccaaacaatgggcgtaacacttttaattgatcaaacgatattacagtatccaacaccaaaattacagtaaccaaacatccaatggaacgaatgactcatttaattcagcaaatttgctggaattgccgataaagaaacttagcaataaanaaaaaaaaaaaaaaaaaaaa

SEQ ID NO: 90561 - DNA, 537 bp, Heterodera glycines
  SCN-specific regions: Sequence locations=1-337,430-537
accgtggcaccggcacaatgttcggcgccggtccgccatccgcccaaccgtcggacattgttaaatttcccactgtgactgttgttgaggcggcaaagaatgaacacgacgatgctgtggagccaattcccacctcgttgggcactgaacagccggcggcaccacccgctcagcccacgccagctgcggcaacacctcaagttcaagcagcgggtgcagctgtggctccctcccaaactgagcaccagcaggagaagaaggagcagtccgccgatgagttggttgaggtggacgcaccgccgcagccgattgtgccacaacagaacaatcagccggcgcaaccacagcaacaacagccgcagcagcagcaacaggaggagatgaccaagacggagcaggaacaaccgcagctgaaccagcaacagcagccatccccgcccggcatttcgccattccaacagaaatggttcccggaagtgccgtccgtgtttctccaggttgatgacccaaacggtggcaacgccggtggcactgacg

SEQ ID NO: 90562 - DNA, 953 bp, Heterodera glycines
  SCN-specific regions: Sequence locations=1-92,114-114,136-200,223 -406,435-519,542-953
aaaagataagcacaaagagttaaccagcagaggaacaagaactcatggtaaataaaaataaaggaatcaaaaaattatatagctatctaactataaataggaaaatttaaatggaatacaaattaattaatttttgacagtaatccggtggcctttccgccgctaacgtctctaccgtttgccataataatcgtagttcccttcaaggaatttcctacttcaactttcccaatgtatcattaccaatatcgcatcatagtaattggtgattcgactgtcggaaaaagcagcttacttcgttatttcactgaaggcaaaaatgctgaaataagtgatccgacagttggagttgatttttacgctcgaatgattgagatcaaaccaaattatcgcatcaaattgcaactatgggacacagccgggcaggaaaagtttcgttcgataacaaggtcgtattatcgaaattccgtcggagttattgtcgtctacgatatcacgaacagacgcacttttgagcatgttgttgattggatgactgaagcagaggcaaatttaggagggcctgaccctgcgcaattggtttttttactggtcggacacaaagcagacttagaggagcagcgcgaggttctctacgaggagggcgaatactttgcaaagcacagacgaattaaattcattgaaacatcggctctgacgggagaaaatgttaatgaggcatttttgattgtatcgcgggagatcaacgccagattcgaaactggtgcactgcgcatatgcgacggttgggatggaatcaaaagtggactgttgcggacgcaatccatcactctatcagacattcaagagacaacgaaagaaaattctcagtgttattgctgataaaaaagttgccttcatttttacacttaaaccgctggcaatgtacaaacagcataaaacttattcctttt

SEQ ID NO: 90563 - DNA, 511 bp, Heterodera glycines
  SCN-specific regions: Sequence locations=1-50,72-144,166-281,303 -375,397-511
acggggacaacgacggacggagggggaggaggaacaacgacaatcagttcagaagcggaagagggagggacagcaccagcggagacggagacggaactgtacgacgcagaattggtggaacggaaagtcagagagatcgaaggcaaatggaaggtggaggtggagaagtcggaaaacgaaaacaaggagaagctgaagcggacgacgtggaaatggaaggggggcaaatccacggggacaacgacggacggagggggaggaggaacaacgacaatcagttcagaagcggaagagggagggacagcaccagcggagacggagacggaactgtacgacgcagaattggtggaacggaaagtcagagagatcgaaggcaaatggaaggtggaggtggagaagttggaaaacgaaaaggaaatattggaaagaaatatacgcgaattggaggaaaagcttgcccaaatggacagaggcgatcaaagggcaaaggaagagattgaggacaccaaaa

SEQ ID NO: 90564 - DNA, 620 bp, Heterodera glycines
  SCN-specific regions: Sequence locations=1-33,60-66,90-188,210 -536,559-590
gtggcattttccacaatgctaaaaagacctttttggtgtgggttaatgaagaggaccatttgcgcattatctccatgcagaaagggggcgatgttggcaacgttttgaaacgattgatccgcggtgtgaaaggtatcgagaagcaagttccatttgcgcgtgatgatcgactcggctatctgacgttttgcccctccaatctgggcacgaccatccgtgctagtgtgcacatccgtttgcctaaaataagcgcaaagcctgaattcaaaaagatctgcgaggacctcaagttgcaagttcgcggcattcacggagaacactcggaaagtgaaggcggggtttacgacgtgtcgaacaaggctcggcttggacttaccgaatttgaggcggtcaagcaaatgtatgacggtgttaagaaactcattgaacttgagaaggcgtcgaagtgaatgaattaaatatctatatccatttgacgcctcgtaattgcattgctttaatcacaatattgtatttttgtataggtctatagggtcagaaaatgtattgcattatgaaattgtatggacaagtaaaatggttaattgactaaaaaaaaaaaaaaaaaaaaaaaaaaaaaa

SEQ ID NO: 90565 - DNA, 338 bp, Heterodera glycines
  misc_feature (329)..(330): n is a, c, g, or t
  SCN-specific regions: Sequence locations=1-338
ggggaagggaaatgtcggaaaaagcgaaggacaaaaggacgacgtatccctcgccattctcacaaaacaactcattcattctgctgaatacgtgtatcatctgtcccctgtcccccctcccttttttgacttttccattcgtcgctttgtctttttttcgttttttaattttgacttttccgctttttgttttccttacttttcgcccatttttcagcttcgcattttctcgaattcgttcgcaaattttgtttgttttttcaccaatctgcatgcactttctgtcaatctcttgccggaagcaaataaataataaaatttgtcgatannaaaaaaaa

SEQ ID NO: 90566 - DNA, 387 bp, Heterodera glycines
  misc_feature (338)..(341): n is a, c, g, or t
  misc_feature (344)..(344): n is a, c, g, or t
  SCN-specific regions: Sequence locations=1-139,194-215,237-334
ccgtgaaagtgatcagctgaaacagcattctcagctgaaggaactgatcggacaaaatcattgaattgcgaaattggccactctttcgttattttgatatttcattttttttacctttggccattctcagaaaatacccaaaatttaattgatttaatcaaaaagtaaaattaaaaactaaaataaaaaaaaacaattctttcattgtttttcctcaaaatgtttttaattaattctttgctaaatgttcctattcaatcaattcttcctcctcaaaaatgtttaccttttctcacaattttgatcactttttcgataaaagcgaagtttggttaaannnnaanaaaaaaaaaaaaaaaaaaaaaaaaaaaaaaaaaaaaaaaaaaa

SEQ ID NO: 90567 - DNA, 434 bp, Heterodera glycines
  SCN-specific regions: Sequence locations=1-19,41-134,252-366
attaaaaaaagtaaatcctctttaaaaatgaaactttcaataattttattgctttccttggccttttgtgcgttaatcatcgatgcatatccatcgggaaatggtaaagatcttgaagctgacaacgaaaaaacggaagtgaaggaagagaagatggaaaaaagagaagcggaagtggaggaagggaagaaggaaaagaaagcagcagaagaggaggtagggaacaaggaaaagagagacacggaggaggaaatgacagcagcggcggaggtgatgattagaagccatagctaaaaagaagaagcataatatggaactaagaaaagaacgagcacacaatgcttttagtcgcttattttttgctgcatttaaaatgttaaattttaaaaataaaaataaatttttttgaattttcaaaaaaaagaaaaaaaaaa

SEQ ID NO: 90568 - DNA, 552 bp, Heterodera glycines
  SCN-specific regions: Sequence locations=1-50,72-552
aaaaataattgttcagccaaaagccctaaaatgagtacacgtgaagaaattcaagcagtttgtgtgcagtccttaaaacagttgaaaatcggtgtgggtgaagaggagttgcagaatgggaaggacttttacaaattttttttcaccaactatccaacccttcgcgtgtattttaagggagcagaaaaatacgaagcggaggatgtgcaaaagtcggaacgttttgaaaaacaaggacaacgtattcttgttgccatgcatttgattgccaatgtctacagcaatgagatgcttttcaatgcgtatgtgcgcgagaccgtgaatcgtcatcgccagttcaaaatggagccatcattatggaaggcattttggacagtttggaccggctttctggaaacaaaagttgatctgacggaacaggccaagtcggcctggatgtcattgggtgaggattttgccaaggaagcgcttgcacatttgaaacgccttggcatcccgcattgattcaacaaattaatgaactccgaataatgtcccaccaattattaaaca

SEQ ID NO: 90569 - DNA, 579 bp, Heterodera glycines
  SCN-specific regions: Sequence locations=1-346,368-433,478-503
gacgagtgctgcgagcagtgtgttcaacgacgcgtcctccgtcagcagcggagggattgtcgagcgtttgtggggcgacacggagactcccgaagagggggccgggacttcgtcgccagagactttggcgacgatggcgatggaattccgcagagacattgtcatgggtgccattgttcgtctgatacttcgcgctttttgcgattttgtgcgtgtgcagaaattttcacgacacggttttgagcagctccaagttgactttgcttatgtccgtcaaaagctttggtatttcgtggccgatgagcacatgttgaacacgtgcattgaggacattgtcacggctgcggtgaaccaatgtgcccagcccaaattgttggatccatcggtagttaggagaatttgtgaagaaatgcagtgatctatttgtatgtacaattaaaattaaattaattaattgttcactttgttttttattttgcttacattaaagttgacaaggatttaaaaaaaaaaaaaaaaaaaaaaaaaaaaaaaaaaaaaaaaaaagaaaaaaaaaaaaaaaaaaaaaaaaaaaaaaag

SEQ ID NO: 90570 - DNA, 199 bp, Heterodera glycines
  SCN-specific regions: Sequence locations=1-122,193-199
caaatgcaaaataacacaaacatcaaatagaaataactaactcatggtcctttcttttttaatataattttaatgccttttcattttgcaagtattttcctgtgataaattttttatgttcgaaaaaaaaaaaaaaaaaaaaaaaaaaaaaaaaaaaaaaaaaataaaaaaaaaaaaaaaaaaaaaaaaaaattaaaaa

SEQ ID NO: 90571 - DNA, 203 bp, Heterodera glycines
  misc_feature (177)..(177): n is a, c, g, or t
  SCN-specific regions: Sequence locations=1-148,176-178
gcgccgacaaaacattttgatgatgcaacttaggaaaatcagcagacaaaaccgggaaatgagggaggtcattgcgaaataccagcagattcccaacctcttgcaagcaataaagtcagtattttatttaccaacaaatttcataaacaaatttaaaattaaaataatttaaattcntaaaaaaaaaaaaaaaaaaaaaaaaa

SEQ ID NO: 90572 - DNA, 831 bp, Heterodera glycines
  SCN-specific regions: Sequence locations=1-121,189-639,663-831
tgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctatgagtctcgctcgccattttttattctgccgttttttctgcaattggtgcgccagtcgaaccgagcacaaaagaaagggaaaagcatggtgttgctgctcactatttgaaggcggaagatgaaaaattggaaaagattaaacaaatgttggaagaacaatcgccaaaaatgtcgcccaagggaaaacaaatcgccacaaaatttgttgaaattttgctcaacaaaaaattgacatacgaagaatttcggaaggaaattttaaaacttgacaacgaaacggacgcgaaaacgaacgacgaatttgcaaaatcggaatttgcaaagcaaatgagtttaattgagaaacacagttaaaaatgatgaaaatgaattcaaaatcattaaatgtttatttaaaatttcattgtgattattagaagtccgggaaaattaaaaatattcgttaattttcataattttaatttggcatttacactgttgattgacctcagctcgactttacattatacaatattttaatccatgttcaatgtgcttacccattcatcatagattaccgtaatttgaaaa

SEQ ID NO: 90573 - DNA, 948 bp, Heterodera glycines
  SCN-specific regions: Sequence locations=1-168,216-361,393-631,654-948
atgaattttttgattttaaattatttttcattgggtattaatttcaaaatattcaaaatggatttaaatttattcatttaaacattttttaatctgctggtaaagtccctgaaaaagatacatttagtgtggaattttagaaataaaaactgtgagaaatgagaaatgattaaatttaagaaaaataaattcttgaaaatttattttaaatttttggttccattttttgggattttttttattgtcaaggaattccgtgtttttcgtgcctagcctggacctgaattttttcatatttgacctgggcctgcatttcctggataaacatacaagtccagtaaaatccaaattcaagcattgcattttattttactaaaattttttaaaatttagcctttcaaagcattcaaatgggctgttatagctgcgttgacaaatggatgtgttgttgcggctttcacatgacagccgctgcactggtaattgcatggatttggctaatttctgccatctctatggtgccatccgtgttaatttcaatatattatcaagcatttaattggtttgcctttgtttcgatgattttgttattcgctcaaagtgttccaataattgagggcgaaatgagtggcaaaagaacacatcaaatgtacttgccattcttggtcattagttgtatccaattggcattcacaatgattggaggagttgtgatgttctttacgctggaccaaatgcgtcaacaaatgggcgggtattcaactggaataattctcggctatttgtttggacttctgttgccgctgttcattttcttctggtgctactccatcgtttttcgagcctacaaatttgtgaaggaaaaaaatgacgagaaaaaccggcacaacgccaagaaggacattcaaatttgatggtgtagagaatttgttaattaaatgttttcta

SEQ ID NO: 90574 - DNA, 862 bp, Heterodera glycines
  SCN-specific regions: Sequence locations=1-587,609-799,821-862
atcacaacatttggtgcaacaatttgaccaaacgatgttaagcgaaaccgtgaaaatcggatttatcggagccgggaaaatggcacaggcattggcgagaggacttatcaattcggggcgttatccagcagagaatttgatggcgagttgtccaaagacagatgagtcactattggagcaatgcaaaaaattggggattggaacgacgagtgacaacacgagaatcgctcgagagaatgacgtcatcattttggcggtcaaaccgatgaatattagcaaagtgacgtccgaaattgcacccaatttccgaagggagcatttgctaatttcaattgccttagggattacacttcgctacatcgaacaacttttgccttcaaagtcccgcgttgttcgcgtgatgccgaatacccccgccgttgtcggggccggtgcctcggcttattccatgggctcggcgtgccaagatggcgactcaaaagtggtccaagatttgttctccaccgttggatattctgttgaggtgcccgaaattcacttggacccaatcaccggattaagcggcagcggaccatcttatggcttttcaatgatcgaagggttggcggacggaggcgtaaaaatgggccttccgcgagaattgtccttaaagttggccgccatgtctctctacggcgctgcgaaaatgtttctcgagacgggggagcacccggccgtcctcaaagaggcggtgcagagcccgggtgggtcgaccagtgtcgacatccacgaattggagaagggcggcatgcgcgggttgctgatcaacgcggtggaggcggcctctgagcgctcccggcgaacgggcgaagcggcgctgccc

SEQ ID NO: 90575 - DNA, 667 bp, Heterodera glycines
  SCN-specific regions: Sequence locations=1-129,151-667
tcaaacatatttcacgcgttgcccgaatggcaaaggaggaattcggtttcgagcaggttttggtttggaatgacatgttcgagaaaatccctgttgcgctgctggaggaatataaactcggctctctgattgtccccgttgtttgggggtataagactgacgtggctcggccagggtatttccccgacggactttttgaacgtttcagccaagtttttgacaacatttattttgccggtgccttcaaaggcgccgacggaatttcccaacaattcgtgcacattgagcgatacatgcaaaatttgcgttcttaccaaaagctttaccatcagaatgaaatgtatttgaaagaccgcttgactgggcttattttgacgggatggcaaaggtattcccacactacgcctttgtgtgaacttctccccgccggcattccatcgttggcacggcaagcgatttttgtttcgcaatggatgaacaaaagagaagaacggaccgaccaattcatgcaggagtttctgaactgttccggacgtcactcgacttcggccaccaaatttgtccgcaaaggattcacttttccattcgtctttgaattcaaattctgcgattgtcaattccccgggtgttgaactttacagtgagattgaagaactgaatttgttgc

SEQ ID NO: 90576 - DNA, 513 bp, Heterodera glycines
  SCN-specific regions: Sequence locations=1-221,243-513
cttcagctcacttacttcaggaaccaaggttctttttcgctgacttacgaggcgtccatcacgcgtttattccgtgagggtcgcacggaaacgattcgctcgtgtactaacgaatcgtgtgattttgtcagggcgatgttggacccccagcagaagaatgaggaacgtttgcgcttacttcgactcgcggcagaacgccaccagaatttgacacgggatgcgatgtgtgggaagggcgtggacaggcatcttttcgccttgtacgttgtcatgcgccatttggaagagagttcaccgttcttcgacaagattttcccgcctcaatatttgctgtcaacttcacaaaccccactcaaccaattcgattccgagcaggaaggcatttccatggcacagaaattgaagctggtgagtgctggcggcggtcatggccgttatttaacagtcgcggcgatgttccgcgggcgaatgtcaatgcgcgaagtggacgatcaaatgatgtcggtgcagaac

SEQ ID NO: 90577 - DNA, 409 bp, Heterodera glycines
  SCN-specific regions: Sequence locations=1-30,54-210,232-409
ttaatcaactgttgttgtattggtaattgacccctctccgcccccgtccccttaagagaggtcagcggcaacaagaagtgcacttgcactaaaaattgctaatcaattgtttgcggtgtttttaaaaaaatgagcagcggtgccgatagaatttttcgacatatcgttaatcgattttcaccaaaaattgctattttatgggcgttcgcaaaaatttcgcgttattttttggaatttttgtgagattggatgtggaggggtatcaacaacaacaaaaaaaccgagatttttagctgctatttctctttaaaatttcaagtgcggataggtcttggggttgatagtcttgttggtctaactaacaatgaatgttatgggaaagtcaaaacgggtggaaaggcacattttt

SEQ ID NO: 90578 - DNA, 745 bp, Heterodera glycines
  SCN-specific regions: Sequence locations=1-745
ccaggttcctttgctttccctctccatttgcaattccacttgcaatgagcagtttgcccaatttgaaccatttgcacgtgtcggatgcctatcggtcgtcaactttgtacaaataccgaagagattgggatttgttggactcggccatctccgaccattctcatcgtggtcccggcttccattgggtggatcgtcgctttcgagcccgtcgctttatgaacaccgacccaattcccgactcgctcgggttggactaccccaacttctggtcccgttacaaatggtactccgactatttggagccgcgtcattggcgtcgtcatcgagacccaaattatgaccgtcccctttggaactcgtggaaaccgtacattttggacggaaagaatcagaagcaagccatcgacatgtaccggcaaggactcgtctcttttgcctatttggacaagaattggataacaccgtgggcgttgggtcggaaggaaaaagactgggccgacatttacccaccggccggaaagtacggctcacgccggtacatgtactcatgggcatgaacaaaggcggaaaacgggcagaaagaacggatggacggattgagaagagaagtggcgtcggaaaaagggaccgatcggaggaaaatttggcaaagtgatcactgatcagtcagccattctttggacgatgtgacaaaatgtagacagacacaagtggtgattaagtgactaaccatatttacccgtcg

SEQ ID NO: 90579 - DNA, 492 bp, Heterodera glycines
  SCN-specific regions: Sequence locations=1-70,106-299,384-492
gttgtaaaattttgttaaataccacgagggttggcaaaaatctggatataaaatcgcaaaaatgtggccataaaatcctttaaatttaaaaccaagataaaaactatttttttatttcgtgcctttcacaccctcccagtgtccaggaaaaaaataatggattgctgccatataattaattgccaaccatataaatcacatttttttaaagaggaaatggaccgcgacgatgataagacagtggaacgcgcggtccgcgagtcaccaatcgttgtttcggaatccagcgccacggatggtaaaattttcaaatcttttaaatttttgaaaattttcaaaaattatacaaaaaatgtttgaaaatttctaacattaattttatacaaacagaggatgattctgctgccgtttcggcttacaacaaaaacaaccgcccggcaagttttactgaaatttatggaaatgaactgaaaggcataaaattgcaattca

SEQ ID NO: 90580 - DNA, 574 bp, Heterodera glycines
  SCN-specific regions: Sequence locations=1-526,549-574
gtttaatggataatagcgttgcttcgtctgctggagattcgccgtatgatacgccgctcgaaccatttttggtcaacgggccgatgagtctttctcagttcgtccaaacaatggaggaccatcataagcagtgtgttcgtaagctgtatgctggaaaacaccgtggctatctgctaatgcctgtcgaactccctaatccaaatgatccaaatggggatcgttttagtggccaggggcatgttttgatggaggatttggtgtggcaactgagaggcaaaacacgcaacgcaacccatgggattattatgttctacgtaatcagaaatttataacctttactttatgaaattgtatccaaggtgcaatacgcgaattggacgctgtataacgtcaaatataacttttagtggattcatagtgcgatccggtcgatgaacaacactccaattgctgatggctgagtaaaagtgtattttctcaaattaacatcgaatgttattaaatccccaaattatgttttttgcgcttttattattgatcattttcaatatgcaaataaagtgtgagacgctga

SEQ ID NO: 90581 - DNA, 544 bp, Heterodera glycines
  SCN-specific regions: Sequence locations=1-3,26-384,419-544
tactaattattttaataaaaataaacaatcgtttatttttaccgtcacccggcggtgatcgaggcgaatggatgatggaatgtgaccgactgctgcgcatcaatgccgtcgatgcgtctgagaaggaagcggcattcgcaggaaaacggctcacacgtctcatcaggccgcggatggaccagcgtcgccggctcttccgctgctccggcgtcgtcgcttccgcgagtggcgtcgtctcctcgtctttgcgcttcacaatgcgcgttggtccgaacggtgttgtgacggatggttgtacagtgatggtattgtacaatcgggaggaggtcgatacggtgcggatacggtatgatagtggtggtggtccgggagaggaggaataactaaaatatatactaattattttaataaaaataaacaatcgtttatttttaccgtcacccggcggtgatcgaggcgaatggatgatggaatgtgaccgactgctgcgcatcttccgtcgctgccgcttctccaaccaacgggcaaacagtgccgtacaaaa

SEQ ID NO: 90582 - DNA, 328 bp, Heterodera glycines
  misc_feature (322)..(322): n is a, c, g, or t
  SCN-specific regions: Sequence locations=1-249,280-328
caaatcacttggcactgctccaccaacgacattggccatgtgtttgtgttggaagagcaaaccctttaaagcgaaagacgacaattgcattttaaaaagcgatgggcggagatcaaacggagacggccaaaattaattttcaattcccatttcaatgcattcattcatttctattttctttaatattttgcaacaaaagttcaaattagcaaaattgtttgcccattccttttcttctttttaatggcgtaatttattaattttcaaatatttatttttggccaaataataagcgatcgatggtttcaaaaaaaaaaaaaanaaaaaa

SEQ ID NO: 90583 - DNA, 552 bp, Heterodera glycines
  SCN-specific regions: Sequence locations=1-5,28-319,344-386,408-552
tttgcattttcccctttaaatttcttatggtcctttcggatcgaatggctcttcgtattgtcaatgttttgctgttcgccgtcacttattttgcttggttttgtgcatttatcgcagcctttcacaattccaatgcttttttgagtgcttctcaaagtgattagtccgtccgttcgttgttcgatggctccgctggtcgtcgttcacactgaacctctcctcgaagaattccgtgctcccttttgttccgccgctaatttctggcgctttttgtcgatttttttctcgatttccttatcacttttgctatgttttgcaagccaggccagaaaaaatgaaatctctaaggattttaagcttttagggtctttggcgtcggtccaacacttttcttgagaagccaaatgtccaattcaatgaacacactttgttcacctttgaatcactctcacaaaatgagaaaaaaatatttttttggagtccaatggccaaagtgaatgaaaatgtgacagatcaatttgagttacttgtgccaataattgaaactattca

SEQ ID NO: 90584 - DNA, 468 bp, Heterodera glycines
  SCN-specific regions: Sequence locations=1-146,168-345,368-468
ccgttcggtcccttttggcgttacgcaggcacacattttgtgggcgaagaatattttggggtgaagacgggcggattcgacacgcaaagggagacaatcagagaaaaatgggcgacggaattccccgcccattcttcgcctgtcctcgctttttcttctgcccccgccgcttttcccgtccgccccgaccaccgtttcatccagcgattcgtccagtggaatgatcgaattaagcaaaaagcgattgaatttgcctcccgcaactttggccacggaaaggcattcgttggcattcatttgagaaatggcagagattgggaaaatgtgtgccaatttctccgggaagaaaatgtaatgggaaaacgacaactgtttgccagtggccaatgcacggggccggaagaagagaatgggccattgacggcggacgcatgcgacccgtcgatggacatcattttggaggaggtc

SEQ ID NO: 90585 - DNA, 61 bp, Heterodera glycines
  SCN-specific regions: Sequence locations=1-61
tttattattgtatttgcttagtgcgtaaaatgtagatataataaatttgaactgctaaaaa

SEQ ID NO: 90586 - DNA, 710 bp, Heterodera glycines
  SCN-specific regions: Sequence locations=1-100,122-181,206-246,275 -502,524-572,599-626,662-710
aaatttattatggctgccgctaaagctgggataacaaaatatgaattggcaagtagttttaatctttttttattaatcgaatttctaccaaatattttctcatttacaacttatttttaaagacaaaattatgtgtacgctgctactaaaagattttttaatgcttctggaaaatatttccgttttttcatattttaaataaattgtcatttcaatggagtgattattatccatttaccaaattaggaaaaacttttaatttgaataaatatttgtcccagttttgacaatagttggacaaaacatatttggcccatccccaatttccacaaaatccctaaattgccgtattcccacagatcgcgagagggcattttactttttacattactaattacaaaaaataccgtagtccattggaatttaaattattaattttcttagattggcgtctcatcactaagttttctcgccgtttttgtggcaattttgattttgcttgtacaaatgctttttcacaaagccaaaatgcaaacagaggaagctgaatgtgtgcacattgaccatcagttgcaacagaagaagaagaagaatgagagattttaaggaataaaaaaagcaaaaagaaaaaaattaataaaaaaaaattaaattaaaatttctctttgtacaatacatttttcggttattaaaatgtcgtgttttaaaaa

SEQ ID NO: 90587 - DNA, 406 bp, Heterodera glycines
  SCN-specific regions: Sequence locations=1-406
actctccacttctatgcgtccagtcactttgttgatggacttggcaataagcttaagaccgccgtaaacaagggtaatcatatgatactgtatcgtccaaaaccattactgtttgcaaccgtactttaaggtcttccggtgttcgtcactgagtacggtacatgcgaagcgtctggcaacggtaatctgaactccggctcaatgtcaagctggttggagcctgttggaccaactgaaaatttcgtacgtcaattggtcaatcactgacaaaagcgaagcttgtgcagcgctcactggcggaacatcggctgccaatgttggcacttcctcccgctggacgcagtctggcaatatggtagcttcgcaacacaagaaaaaatccaccggtttgtctgaccaattaaac

SEQ ID NO: 90588 - DNA, 401 bp, Heterodera glycines
  SCN-specific regions: Sequence locations=1-28,50-181,204-293,375-401
ctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcgccagacagtacaaaccataaaaaagaccataaaaatgagcatccaaagtatgaagcagaacttatatatgagcaaggtaacctacagaaccatgctaccggtaacacatttattcagcaatcacaaaatttttatctaaaattaacatgaaaattagaaaattttataaatatatttaattattttatataacatatatatttatcagaatggcataacagtaaaatttctg

SEQ ID NO: 90589 - DNA, 540 bp, Heterodera glycines
  SCN-specific regions: Sequence locations=1-540
aattaaaacggttcaatgtttacggggggaaaaatcgtcttgatgtgaggccgaagccaagagtggatttgactcaatacacaatgaagaaggagtccatcatttacgatttgaatgggatcattgagcatatcggtggtgggattaattttggacattacatttgtgcaatgcgcggattcaaagggaattggttcaaatttgacgattctgagagaagacgcgtaagtctgaatgatgttgtgcaaaacatggacccttacattctcttctacacaaagatttctccctctcccatcaaccaacaacctcatcagcgacgatcctttggtggatttgctccttcgacacctaagcaagctcggctcaacagtttcccttcccacaacggagggacgtcccttcctaagcggttcaacaacacatttcatcgctcgttcattagttgacttagaagatctctcccccttcgttcctccactatctgtccatgttatttatcatttgttgtttcgaaaatgaactcctctttccattttt

SEQ ID NO: 90590 - DNA, 68 bp, Heterodera glycines
  SCN-specific regions: Sequence locations=1-42
gtttatatggttccacatttattgttgattttgatgtttgttgataataaatgttttaatttgaaaaa

SEQ ID NO: 90591 - DNA, 354 bp, Heterodera glycines
  SCN-specific regions: Sequence locations=1-71,113-261,304-318,340-354
ttcgttcattccttccattttcctgtgtcctaaaccttcatcaattaaaaacaatgcctttcctccgctcgcttcttctcccttccgttttgcttcttcttcttctgcttctgtccgtgtctctttgctccgcgggggtcttcgctccgctgcgtatgaagcgccaattcgattggtttggcaattcgatgggtgcgcgtggcgccggcttcggaggcggatgggtgttcggcagaagatgaaccgttaaaggcgccaaccaattaataaaataataatgcacaataataataatatttatttcatttgcccccgattccccattttcaaatgaataaattatatattcaaaaa

SEQ ID NO: 90592 - DNA, 598 bp, Heterodera glycines
  SCN-specific regions: Sequence locations=1-193,215-598
tttaaataaaaatttccttggaccgacaaaaatggcaaaattcgttgccattgctcttctctcgctgaccattgtttcgatggcacttgcaaaaactggcaaaagtcaaacggcagacgaagttgagggatttcgcaatatgaacatcggcgacaacaataaggttgacgccggaaaggagcccgcggctgataaagcaaccaaaaagggaaaagctcagaaagccggaacgaaaccggcggcggccactaatgagcccgcggctgctaaaggaactaaaaatggaaaagccccgaaaaccaaagcgaagcaagaggtggccactaatgagcccgcggctgctaatgaatggaacgaccaattgatgggcatgagcgttgagaaatttaacgaggagcttgctgtgttgttgccaaaagccaacacttttatggaaaatgctttgagcttcatcaatgaacaaatggaaaaaaatggtattgcaactggcgctgccggggactcgtgctcgaccgggatcccggccaactaggagaccaatgccacaggacggcaccggaggagggaagaaaggatgacgagctctttggatgatgaa

SEQ ID NO: 90593 - DNA, 466 bp, Heterodera glycines
  SCN-specific regions: Sequence locations=1-242,276-307,329-351,384-466
cgtagtgaataaagccgaggctcattcaaaccaattaggtaattagctgacaattagccatcaacaaattggggccaaaaaacgaggatgccatccaaacgcatcactgtgccgctgtttctgctgttgactgtgctcgtcttggcactccgtgcctcggagacaaagattaaggcgatggaggagaaagtgatggaggaacaggacaagaaagaaaatgctgagatgaaaaaatttttgagagaacagaaaaaggaggagcagaaggggacaaacataatcggacaaaaagttggaccaaaacgtaattttggaggttttttgttttgagaactttaagcttttcacatataccaattctgtttttattttacaaaattttgtctacaaaactcacaaaattgttacgcactgtttatgtaaagttagcattactttttttaatgtagtaaagattgttgcctgt

SEQ ID NO: 90594 - DNA, 325 bp, Heterodera glycines
  misc_feature (320)..(320): n is a, c, g, or t
  SCN-specific regions: Sequence locations=74-85,152-266
ggaagggaagaaggaaaagaaagcagcagaagaggaggtagggaagaaggaaaagagaggaagtggaggcggaacatggggcaacggaggaagaggaaacggaggaggaggacacggaggaggaggacatggaggaggacacggaggaggaaatgacagcagcggcggaggtgatgattagaagccatagctaaaaagaagaagcataatatggaactaagaaaagaacgagcacacaatgcttttagtcgcttattttttgctgcatttaaaatgttaaattttaaaaataaaaataaatttttgtattttttaaaaanaaaaa

SEQ ID NO: 90595 - DNA, 519 bp, Heterodera glycines
  SCN-specific regions: Sequence locations=1-9,31-488,510-519
atttttaagccaaatatttaaaatggaaaatatcgaaattacgcacgaatggagcggccaacaatgggattggcccctgcagcataatgacggggtggtgaaggttcacaacactccggaaaaatgggaagttgggttggacgtggcattcttcacgccaaacgaaattgaggtgaaagtggtcgcggaccatctgaacatccattgcaaacacgaggctcggagcgatgtgcacggctcagtgagtcgagagattaaccgctcgtataaattgccgaacgatgtgaacacaggcacaatcaaatcgcatttgactcagaacggcgttcttcgcgtctctgcgcagaaaaaatgagaggaaatggcgaaccatggaagaagagaagagacaaagtgttctgtttcacaaccaataataatcctgtttatttactttgctttttactttgtaatttatcgccgtttcgcgaataattaaaaattgcgtccaaaaaacaaggagcccctggacaaactggt

SEQ ID NO: 90596 - DNA, 746 bp, Heterodera glycines
  SCN-specific regions: Sequence locations=1-147,175-746
gacctaaaaacggcaaaattttttattttttgttgcaaaattccgtaaaaagaaagatgagttttcagggcggcactgcgtgtatgccggattccagagatcactacataaaaatagagcaccattcctaacctttcattttgatgattaaaataattattcatttatttagaagcgatttactagcaaatttgcgcaatgaatggccaaattattaattcggacgaattaaagattgttttcacacataaggcgcttcatactttgattgcatattattcggacgtcgcagtaccaactggaacaacagttaacagggacggatgtgggctgacaaaacggcgattcttgtgcccgtcggtcaagaccaaagaacagatgatcttcgagatagatttccgaatttcggcgacaattggcgaaaaaattatgtttggtaaaaaacatgacggttcaaccgatgatcttcgcgaggcaacgaggatgatcttagacatggtaaacagcggaatgttttacgacgaattgggcctgcgcgaatttactgttgccccaccaggaccggcactgaaaaacaaattggacaaatttgtggaccggaaattgaatgaatgtgtggcacgaggggagaaattagtgaataacaaaaaggacgaagtgaaagacctggccgagcatttggaggcaagcgacgggtggcacttgaacgaggaacagatccatcaattcttcaaacgcagaaacgc

SEQ ID NO: 90597 - DNA, 566 bp, Heterodera glycines
  SCN-specific regions: Sequence locations=1-566
acgaccattggtacggcgaaagggcgcggatgatcaacgggacggacgcggaactgtttggaccgaatttgatggatgcgccgaaattgcaaatattcattggccaactttgccgttccttcgatttggaagttcgtcagcccgctctcaccgccggtctccccgtcttccgatacgcccaacccgactcggcgttggacatcgctgtgcagcggtcgcaaggcttttgcaacccgaattccccgcttttcttcaacgagagcgtccaaccggttggctgtgctccgtccggtcttctcgacatgtcctcctgtttccccggctctccccccattttcttttcggcctcccattttcgaaatgcccacgcggcccttcgccattccctcgcgggaaatttctcgtccccaacagattcggatgatctcagcttttttgacattgaaccgattgttggggcagtggtcggagtgcagcagcgctatcagctcaatttgggaatgcaacgagggaatttcaggatgaccaaaaatatgagcaatttggtcgtccccatggtttggctc

SEQ ID NO: 90598 - DNA, 1187 bp, Heterodera glycines
  SCN-specific regions: Sequence locations=1-537,559-1017,1147-1187
tcaaatgtgccgactccaagcaactcatctgctcgctcgactctttctgcttcttgcgctttgcactgctctcgttagctctctcactgctgttgccccgccattcggccaattgtccgtttccggcaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggacgagggcggctatctgagtgacgcgaacacggcttacaatctgatggtggcagtgatcgaagcggccatttccaatggcatttacgtgatcgtcgattggcatgcccacaatccacatccggacgaagcggtcaaattcttcacccgaattgctcaagcgtacggctcctaccctcacattttgtacgaggatttcaacgagccgctgagcgtttcgtggaccgatgtgctggtgccataccacaaaaaggtcattgctgccatccgagctattgacaagaaaaatgtgatcattctcggcactccaacatggtcccaagacgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaagatttcatacgccaactgggcaatctccgacaaaagtgaggcctgctcagcactgagccccggtacaactgctgccaatgtcggtgtttcgtcccgttggacatcctccggaaatatggttgcttcgtactacaagaaaaaatccaccggcgtaagctgtagcggctcaagttccggcagctcttcgggctcgagttctggctcttccggttcaagttccggcagctcttccggctcaagttccggcagctcttccggctcaagttcgggctcctctggttcgagctcagggtccagctcgggttcgggatccgccagcatctctgtagtcccatccaacacgtggaatggcg

SEQ ID NO: 90599 - DNA, 513 bp, Heterodera glycines
  SCN-specific regions: Sequence locations=1-232,259-513
ttctctctctctctcccattggaattattcattgagatgggtttttcaaaaactatcgctttcctttcgcttttggcacttttttgcgcaacaattgctgaagaaaatggggcgacagaaggcacagaagcggaggcgacgacagtgccaacactcaccgcagcggcggagggaggcaaagggggcgaagaggaagtgaccacggcgaagccgacggagacgagcgaaacggcacgggaggagggggaggagaagcacaaggcgaacgaggggaaagcgattgagggaagtggaaccagatcgttgttgcaaaaagtcacctgtatgttgttcggctttttcccatttcgcgccggctgtccgggcaaaaacgatataaaagcggagtcatcatcacatgtgagcagcacaattatgataattgaggaaaaagaggacagcgaatcggacgaacaaatggacggcgctggaggggacgaggagaaaggtgccgcaagggacaaccaaatggaa

SEQ ID NO: 90600 - DNA, 892 bp, Heterodera glycines
  SCN-specific regions: Sequence locations=1-202,226-657,679-735,757-892
ccgcgtgttggacagttctgaggccgactgcatatttttggttggcggtgatggcactttgagtagggcactcgtcggattgagccaaaacagtgcgccattgccaattggtttattccctggtggtcgaaaaaacattgcattttggagaatttttcaatcaaaaaaccagagcagaggtatattactatacatacaaagcgaatttcatttttgttttcttttcttgattcgatggatttgaatgaccaagactcaaaatcagtgcgaatgttttgcgaaagtgcaatggcactgattgagggtgaaaatcgactcgtttatccagtcaaatgctcaataactgaagaaatgaatgactcgccttccgaccatcaaacggtcaacactcccaacactttttggctgctttccgacctttgtgcgggatggttcgaacattgtgaacaaaaggcacccaaactttggtggtgggggcctctgcgctacaaatttgtgtatttttgggaatttttaaagcgaaaaccaatccctttggaccttcgaatttcttacgaagagttttgccccggttgtaatcgttgcgtgacgcccgtaaaacagaaaaacttgacaactttgtggtcatttttctctcatcttctgtggtcatctcctaacgacagcacaaaaatcaaagtaaattcggactttgcgttggttgaaaatccaaactgtggccagagacgggaggccaatgtcagtggtgccaatgttcgtctgaacgtcgaacagaccgaaaatggcagcaaactcaaactgcgagttggcggcgcgggggacgcattcggacgatgggcggcaatgcgtttcggatggaattccgtgggagtcgcaaacggagagagtaaac

SEQ ID NO: 90601 - DNA, 416 bp, Heterodera glycines
  SCN-specific regions: Sequence locations=1-141,163-364,388-416
gtttcactggcgaacacgcaattgcccgccgagaagatgaagtgtttggtggagcattcgctccgagattatcttatggtctctctgctggccaatttggccaagactcagttggccctgcaggaaaaagtcacttcctcgtaaagttttgaccagtcaaaccgttgcggaaagagggaaagcgaaccaataaacgtgattcgagattattgctttgtgtccattctgtcattgttttgttactccattttcgttattcgcagaactgttatcagaaattcatgtatcatatatcatcattttgacaaaaattgcctaaggacaaaccgccaaaaaccccactaatttaaaaattttgccgatattttcccttgtaaaaactgaagagtcgatctcgagttaaaaagcattttgac

SEQ ID NO: 90602 - DNA, 529 bp, Heterodera glycines
  SCN-specific regions: Sequence locations=1-529
tgccaatgatgcagaggttttgacttcgctcattcaggaacttgcggattctttaaaaatgcctaatggaccaaaactcaacgccgaccatttgcgaattttccttaaagatggagcaacacgagcgctaattgctactgcaacgaaagatggcgaaacgaccgtggcgggttatgccatttattttatcgctccatcgactgagtttggaaaagtcttttttctcgaggatttgtacatccgtccggacttccgtcgccaaaaattaggatctcagttcatgaccgaattaaagaagttttctaacgaaatggcttgtgatgtgtttcaatggaatgtgcttgccaataacgttaacgcaattcgcttttacacttcgttgggtgctcgtaaccttacgaacgtcgatggggagacgggcttctcgtgttggcgcattgagtccaaccaatttgaagcaatcatacgcaattctaaggagtgtttgccgcatattaaatttgctgttttttcgctggacgctgaaaac

SEQ ID NO: 90603 - DNA, 400 bp, Heterodera glycines
  misc_feature (355)..(355): n is a, c, g, or t
  misc_feature (357)..(358): n is a, c, g, or t
  SCN-specific regions: Sequence locations=1-208,231-279,304-348
ttcctttctgcgccaacgccccccgtcccttccggcgacgattctctccaagtctctccacaccaaaccgtttcttctcactccgactgtcaccaaattcagcaaacgcaattggaagaacattcgactaataaggagcaattggcgcattttggagcatttgaggagatgcaagacctttctctctccggcgatgacttcaccgatgaatttggcttgtttttcagtgccttttgtccaaattcgtcgtctaattggacacaaaattgtaacaaacaataatttattttctttcattcattttcgaaaattgttttcactgtaaattacgatatgattaacaatgttaaaaaanannaaaaaaaaaaaaaaaaaaaaaaaaaaaaaaaaaaaaaaaaaa

SEQ ID NO: 90604 - DNA, 557 bp, Heterodera glycines
  SCN-specific regions: Sequence locations=1-46,73-109,168-306,328-557
tacaacaccaaagcgaacagtgtgggaccaatggaaggacactgacaaatgaagaagaaaagacgcaaaaaatgagcaaaatatgcaacagtgaaaactaattcagtgcataataataaatattataacaaataataattcatttaaaaatatttttataaattaaagtgaaaaaaagaagagtttaattattcgtggacactttcaaattgcaaatagacaaaaaagtgaagaagttaattgagaccatttaatcccttagaaaggttaaaatgactaaatgctctcctaattttcaattgccaaaagtgactaaattcaattattttgagtcaaatttttattttttgcccacctgataataggccacccttttctgtcccctcatttcgtgttcaattggaattgattcgtccgtacttaaaatttggaagcatctataaggaaaattacatggaaaattaccgcaggtaataagtgctttcgacaaggcaataatcgtgcgcatattgaacccatccggcacggaattcagctttggcaaaacaatttatggc

SEQ ID NO: 90605 - DNA, 361 bp, Heterodera glycines
  misc_feature (324)..(324): n is a, c, g, or t
  SCN-specific regions: Sequence locations=1-317
ttttatggaggcggtatgcaaaatttacgaggaacatctgaagaagctgaaccccgacgtcccctgcatacagtacgacatatccgcactgttcaagttcatcgaccgattggctgatttgagctgcatggtgttggacaaaagtgtatatgtgccaaagggcgaggatttcatcaaagagcagattttcattttgctccgtggccaagcggcgtcgaacgcggcgaagaagtgcccggctgaaggatcgctctgatttttgatcgcattccttttatttgtaattaactttcatacaaataaaagtacaattctttaaaaaanaaaaaaaaaaaaaaaaaaaaaaaaaaaaaaaaaaaaa

SEQ ID NO: 90606 - DNA, 89 bp, Heterodera glycines
  SCN-specific regions: Sequence locations=1-40,76-89
cattagcgaagaacggacttcacaattaatattgtcagggtttttattctttggaaattttatgtaaataaatttgatgaatggaaaaa

SEQ ID NO: 90607 - DNA, 414 bp, Heterodera glycines
  SCN-specific regions: Sequence locations=1-414
atttttcagttgcaattcagatttgacgaccaatacccattctcatcgccagaagttatgtttatgggtgaaaacattccggcgcatccccacgtgtactccaacgggcacatttgcctgtcaattctcagtgacgattggacacccgctctcagcgtctcttccgtttgtttgtccattcagtcgatgctgtccagttgcaaagagaagaaacggccgccagacaacgacttatacgtgcggacttgcagcaaaaacccgaacaaaacgcgttggtggttccacgatgacaaagtttgaacggatgattcgccctttcttttcttctcaccgatgatcaaatgactattgctttttattttaaaagaaatgcgatgcgtttctctttttttgtgcattttatttcaatttttt

SEQ ID NO: 90608 - DNA, 425 bp, Heterodera glycines
  SCN-specific regions: Sequence locations=1-425
acgactgctccgcctgccgtcgcttatcagcgcgttgctggcgttctcgccgtccttgctgaactgctgcaaccaattaaggtcaaagacacacacattgagggcatcacaacggagcccaacccgaatttgaacgcattggaagggggcggggacagcgacgggggaggcgactcgaacggagccgaaggcaatggcgaagaagccggaggaccaatgaaaggcagctcttccggtggtttcaaatccgctggcgctccgcatgttcgtggcggatcgtttatgcgtggcggtcgtggaggaagcgggccgcctggaggtcgtggtggaatggccaatcgtggcggttttggaagcggccgtggacgtgggacgcctggcggaagtcgcggtggtggcagccgaggaggcggacagaggggctt

SEQ ID NO: 90609 - DNA, 640 bp, Heterodera glycines
  SCN-specific regions: Sequence locations=1-576,598-617
ctttggcattttgtttctataattattcaattctctaaaaaaagtagctaaaattgatgaaatcgtcctgagccttgttctcccatttcaattttgtgatactttgacgcgtttctgtcaagggatgaccatctataacctctatttcttcaaccggcacggcgtttgtttggcctacaaagaatggtgccgtgaaaaaaagtcgggcatttcaccggacgaagagcttaaactcgtaaatggcatgttgctttcgttgcgttctttctcgcataaattggcaactcgggcggaccaagtgccaatgatttcctgcttccgaacttcgtcctacaaaatgaattacatggagacggccactggacttaaaatgatattgaacactgaccctgacgccgtttcaattcccgaacttctacagtccatcttttgcgtgtttgttgagactgttctcaaaaacccattcgtggacacatccaaaagaatcgactcagaactgttcaacaaaagggtcgacgaattggtgcgggctcatttttgtttcacataaaatacatattcgatttagcacaaattgcttttatttccattgacttttttctgcataaaatttcgacaaaaaaaaaaaaaaaaaaaaaaa

SEQ ID NO: 90610 - DNA, 486 bp, Heterodera glycines
  SCN-specific regions: Sequence locations=1-30,52-313,397-486
ctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttactttcaaagtttgttgtttttttatatgagcaaggtaacatacagaaccatgctaccggtaacacatttattcagcaatcataaaatttttatctaaaattaacatgaaaattagaaaattttataaatatatttaattattttatataacatatatatttatcagaatggcataacattttactcaaataaaagtaaaatttctgttatttttttttgtttcgctccaaatgtgtccatgaccaaaatggcg

SEQ ID NO: 90611 - DNA, 1264 bp, Heterodera glycines
  SCN-specific regions: Sequence locations=1-422,444-640,662-767,789 -1229,1251-1264
tgccgagggcgacgttttccgaggcttacaggtggtcgaattcgcatgcaatgcggcgagtttgctgttgggcgaacatttgccaaacatagccaaagacatggaaacgtacagcttgcgactgccattgggcgtaacggccggcatttgcccgttcaatttccccgcaatgattcctctttggatgttccctttggcactggtttctggcaacacgatgcttatgaagccgtctgagcaagaccctggcgcgacaatgatgctaatggagttggccaaggaggccggcattccggacggttgtgtcaacgtcatccacggcacacgatccgctgtcactttcatttgcgaacagcccgacatcaaagcaatttcttttgttggcagtgaccaggccggcaaatacatttacgagcacgggtctaagtttgggaaaagagttcagtcgaatatgggcgctaagaatcacggagtcatccttcctgacgcgaaccgagaacacacgttgaatcaggtcgctgccgcggcattcggtgctgcggggcaacgatgtatggcactctctacggccatttttgtgggtgatgcgcgcggatgggtttctgatttggtggaacgagcccggaaattgcgcgtccgcccgggatgggaggcggagacggacattgggccggtgatttcacaaaaagcgaaggagcgcatttgcgagttggtcgaatcggcgctggaagaaggagccgatgtgccattggatggcaccaatgtgacagtgaaaggctttgagaagggaaactttgtcggaccgacggtgatcactggagtaaagcccgaaatgctctgttataaggaagaaatctttgggcccgttttgtgtgtgctcgaaacggaaacacttgacgaagcgatggatttgataaacaaaaatccctacggaaatggcactgcccttttcactcggtcgggaattgccgcgcaccgtttcgtctcggagattgatgtgggccaagtgggcataaatgtgccaatccctgtgccacttccgatgttctctttcaccggttcgcgtggaagttttcttggcgatgcaaatttctatggaaaggctggtcttaatttctacacccaaattcgaactgtgacccagttgtggcgttctgaggatgcctcgacagaagccaaaccacaactatcttttccacaattcaaatagtgccattttatgcattttaagacagacactgttttatcctctttaattccttaa

SEQ ID NO: 90612 - DNA, 168 bp, Heterodera glycines
  SCN-specific regions: Sequence locations=1-168
caaattggcacgcactcatttcacttaaccgaccggtagcaataattcacaccccgggatttcgataacaatcacaaaaaatagaaaaaaacaacaaataatttaggttaatttatgtaaaaaaaattaacttttgcgaagataaaaaaaagtttaatgaaaaaaaaa

SEQ ID NO: 90613 - DNA, 477 bp, Heterodera glycines
  SCN-specific regions: Sequence locations=1-38,60-354,377-449,471-477
tcaaactactctctctcactaactgttgcacatcccaattttatttcttccttagtaagtagtattggtgcacaatgcgcacttttctgttcatagctgtagtcgggttggtgttggctgtcatcatggagagagtaaatgcgactgggaataattcgccgacaaagggacaaactccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggcacggcaacaacaaatcgccaacgacgccgcacagtacaaaacgggaaacagaacttataattgagaaaggaaaaccgtcgccagacagtccaaaccataaaaatgaccatgaaaatgagattagtaacctacagaaccgtgctaccggacaatcgc

SEQ ID NO: 90614 - DNA, 555 bp, Heterodera glycines
  SCN-specific regions: Sequence locations=1-555
gcgggtagtgaacgccaagccaaaataaatgccactggcgaccgactaaaggaggcgtcgaagatcaatttgtccctctcgacgcttggcaatgtgattagtgcgttggcggacgcgaaagtccgcacattccgtaccgaaattcgaagctgaatcgcattttgcaagaattgctgggcggcactgcaggcccaactgttggagcagagcaaccgttgggcaaagacgacaaaataaatgtgagcttgaacgcgttcgtcgggagttggcaatggagacgcgcttcagaacacagcaagcagaacagtgcgacattgaggagcagtacagcacactgcaggaggagtcccaggggatgggcaaatggttgagaaaggggggcaattttaaaaaagaatataatttctccacattttcccgttaaacggtgcaatggatccaacggcaactactaacaataatcaaaggtgccgcaagatgaacagaaatataaaatatcagaaataaaagacactctttaacaatgcgagccatacatacgtcaattttgtttta

SEQ ID NO: 90615 - DNA, 250 bp, Heterodera glycines; identical to SEQ ID NO: 65261
  SCN-specific regions: Sequence locations=1-250

SEQ ID NO: 90616 - DNA, 513 bp, Heterodera glycines
  SCN-specific regions: Sequence locations=1-513
gaatttcgagttgccattgaaaagggcgacgcggcaaagtttgacggattgttgcgcgagagtccacgctttctcgtcaacacatccaacgatttgcccacaattttgcacattggcatgcgctgcaatgccatgcacatcgcctgccgttcctcaaatgttcacgctgtccgacaaatgttggcccttgttcaaagtggcgaatggttgcgcgatgcgtatgggacggatgcatgtgttaaggaacgcagtgataatttgctggacgctctgctgaatacgccagacaaaattgagaacaacacgccgttgcactacgcatgtcgacaattgtgcgagcccatctttagagaattgattggacacgaacagtgccatcgaagtccggtgaacagtcacaacgagcggcccatcgacgtgttgggacgggggacgcgaggcagcggcggtgcgggtcggcaagagaacaaaaaggtctttgatcggatgtacgttgcgctggagggcagtctg

SEQ ID NO: 90617 - DNA, 286 bp, Heterodera glycines
  SCN-specific regions: Sequence locations=1-214,283-286
ttaattgagtcaagactctcgagccaagggtgtaacactacagaatgatggtctatcccccatccgaactgatcgacatccttctggccaacagccgaggcggattggaacgaaatgtgaacaatgccgaccgcgcacagcaattgttaaaacgttgcagtggaatttcagcttaaagaataaaaatgatttaaacggacgaatgaagacactgaaaataattaaaaaattcatattaaatatttaaataatttcattaattttttgataaatttaaaaaaactaa

SEQ ID NO: 90618 - DNA, 531 bp, Heterodera glycines
  SCN-specific regions: Sequence locations=1-429,451-531
gcaccgatttgctggcggatccgcgcagcaaattggctgattggtttcgcccgggcactaatcgcccgcgtgggttttgcgttatttggcaaatcaagtgttaattgatatgctaattttcctttctgttaagcaattcctaccgacaaaggggggaatctctttttggacagagaccccaaaatgttccgtcatatcattggttatctccgcctgaaaaaggagcgatgcgccgcctctttggcacttccagcaaagccagacgatttggccaaactaatcggcgaatgtgaggcgcttaatttggtcgaattgcgcgaattggcgttggaaatgcttcaaaaatacgtcagaacggaggaacagcattatgtcacttcgtacgttcaaatggcactgcgcgactacgaagcgtggcaatttgagcaggaacagaagaacgaaaacggaacggacgacggagaaaagccgaagagatcggaatttgacgaatgggtggaataaaagaggagaagacaaacgagagaaaga

SEQ ID NO: 90619 - DNA, 504 bp, Heterodera glycines
  SCN-specific regions: Sequence locations=1-5,38-107,134-177,200-504
taagcattttaaatttaaatttatttaagaattaaatggatttaagagtgttttttaaatagttaatcgatttccaagagtttttttatatgctattttagaatatattaaactaaaataattcattttgaaagacggaaaatcaattagatcttattttacaaattccgataaaaacttactcaaaaatggaatgaaactgagaaagtgtgggttggcaaaaggcaaaaaaaaaattcaaatgcgatcggaattcaatttgctgattgccgaattttttgagagtgtcggcattatccctggtgtataccgaaaaggtgaagcccgtaacattttttacacaaatactatacattaaattaataatggcaaatatttaaattttattgaaggttaattgcattaatttaaaaataattttccaaaaaaaaatgaacggctacagcattctgtgtgtcatgctgctcgtcgagctggtgtcatgctgccaattgtcaatgggtc

SEQ ID NO: 90620 - DNA, 376 bp, Heterodera glycines
  SCN-specific regions: Sequence locations=1-35,57-253,275-300,323-376
ttgcttgtctgtaaaaccattcagtttcaaatcgtattttaattccaaaaatcaacaaattcacctcccatttttacaaaatgtcccccctccgtttcttcgtcgccctttttctgatcactttggcaattttggccgggacccacggcactgttgagaactcagtggatggtgggccaaacatggcatcgccgattatccgtgaacgccgttggggccatggcggcggaggccattggggctgaagaaaatggtgggagagataatggaaaatggagaacggaagaagcgataaacgatgaaaaacaagaaaaaataatttgtggtagaagaaaaaatgctgaactcttaggtcgaataaagtttcaatgaaaaa

SEQ ID NO: 90621 - DNA, 448 bp, Heterodera glycines
  SCN-specific regions: Sequence locations=1-448
agttttgtttaacaaggaccaattgctggcccaaatggaatatttccttgtgtgaaccgaccgggtatcaagtgcgacatggacgccgcatacattgcagcggaggcgatagtttgtttcatcgaagacgccggccaaacctacgtggaattttccttcgaaagacggtgccccgttcaacagagaaaatgggctcaaccggatgccgaacaagctgaatgccgacggtactttgcctatttacttcatggcccgcaaaaaatggagactccaaaaactgggaagtgaacccttaatgatttcagttttgatttctagtctttttaagacaattatattgtctcattttgtgtcatattaatgttatatgtccattccatgctgtaatgttgttgccgaatctggtgtcgtttcgagcgcggttttcacgaccattcggatgtggaga

SEQ ID NO: 90622 - DNA, 355 bp, Heterodera glycines
  SCN-specific regions: Sequence locations=1-104,126-355
aggggcgtacggcgcagtaggaaaagcgacggatgacgcggcatttacaaccggcgcattgcgacggacctttccgatgttttgccaatttcaattttaaaatcgcttacattcccttttcctttcaaatgatttgtttatcttttttgattctaattttttgctttctctcttcctgaaaagcttttttcctttacggatttttgattttttttttacctgatgaaaagtttattttgtgctggcaaacaaacagatggatattattgtaaatttaatgctacttttaagcattgcattcgttcaggtcttttctttaattaaaaatgaattggataaataattattgtgtaaa

SEQ ID NO: 90623 - DNA, 528 bp, Heterodera glycines
  SCN-specific regions: Sequence locations=1-11,33-528
taccgtccaatcaggggatgaatcaattagcactcccacgaaaagctaaaaaaacgaacaaaacaaatgccattgtgccagttcaaaatgcggcctcatttggcgaccgaggatatataccatcgagtgaaatcatactaaaaacaaaacaaaaacgaagaccagaagcatcagctgaggaatacatcaaattcgtaaaaaatgccgtaaattcgctcaacaaaagtgacaatgtacatttcttaacaaatggcttctcattggtaggaaaaaatgctcagcaggaactacaaagatatcatatttatccaaggaatagactaatgattggaggacttatggaattaattgcgaacagaaaaatgaaaagcgccgatgaactggaatatatggtgcttgaaaaagtgcacatgatggaggtggagctaaatggcgggcgattgcaattggagcctttgggtgtcacatttgtaactggtgtgcagatttatataaatctacaaacaatggagcaacagtttgcttctg

SEQ ID NO: 90624 - DNA, 751 bp, Heterodera glycines
  SCN-specific regions: Sequence locations=1-72,114-121,143-497,519-751
agcgaagagctgatcgtcatggaacactttgtagagctgaaggataaaacaatagcagtatacccataaaagtaaaattatgaaatttttaataaattttaatatgaataattgtgacaagtcttactttttgatgaatttcgaaattgtcggcccgaagaaggggagttaatggaaattcgatttggtggcaacagcgaagtcttgtgcctttcgttgcgtccaaaatatccattcgacgaaccattgtccgctcggtgtacagccaccgaatcgtccatggacactgacgccagcatttgagagtccggtgaccaggagattccggtcacatcaccgtcatgtcgtatcggacttcgaaacgcccttgcccaattctccttgttcggcggaatgtccatttcggggtcggcgtcacgttgtcggacagtcgccggctcttccagcatttgcacttcgcattccaaaacttcttgttccaatttccatacaaaaagaaagccgtccgcatccccagaagcgatataagttccatttggcgaaaatcgaacaatatttgttgttccccggtggccttcaatgttggctaagaattcgactgacagctgattttggggaactgcgattgatctcttcccagcattgttctgttcaacttctttttgcttcctttcatcttctaattccacctttttagcttcagcttcgcaatttttcgttccgttttccttctccttatcatccagaaaca

SEQ ID NO: 90625 - DNA, 553 bp, Heterodera glycines
  SCN-specific regions: Sequence locations=1-184,207-214,237-244,266 -340,362-553
aaaaaccgaaacgggtcaactccgtctggccaactccgtcttggggccaactccgtctcgccaactccgtcttggggccaactccgtctgagccaactccgtctcgccaactccgtctggccaactccgtcttagtgcctaaggggccaactccgtctcagataaaaaaaaaatataagaaatttttcaacgaattttaaaatacatccctaagaaattaaaaattttctcaaaaactcatccgttaaatctacttatttattttcatgataagaattattcattaaaatagtgtatgacctaacattttaaagtaccattaatattttagcactgcgaaaatggaaaatgctgaaattaaatctcaacgagaaaataaaaaactcgaacacaaatgtcatcgcacaaaaaatcaccaccggcattaaacgacgtgccgctgaaacgatggaaacgccagcagcaatcagggcacacacgcttaagcaaattccaacgccagtaatggcgaacattccgacaaagaacgcgacaaaaaaattatgaagcgagt

SEQ ID NO: 90626 - DNA, 177 bp, Heterodera glycines
  SCN-specific regions: Sequence locations=1-53,75-177
attgctgagaatgccaaatagcgaattggcgtaattttacgcgctatttcaaaaaatacactggtaatgccttttttgtatggtttattatgagcctccataactcgcatgcatttccaactaatccgaacattttgttatctaaaaaaagattttgaaaaggagaaaaaaaaaaaa

SEQ ID NO: 90627 - DNA, 608 bp, Heterodera glycines
  SCN-specific regions: Sequence locations=1-560,582-584
acaccaattttgagcctaacagaacatacacattgactggaatatatgaacaaagcacaaaaattgacccgccacagttcgaaacaaactttgtgattatgcacaaatccgagcaaacgcggcaaataatgaaatgggctttgctttgtgccgccgagcccgactgtatggtgccaattggacagacgaaggcgtgcatttacacggcaactgctccaaatttgacttgccatcgacaggatcagggtctgatggaaattctccgctacaacatggaatatcgacaagaaattgagaacccatcatttttgacccaactgaaccctgcccacccgcgcagttcaaacagaccgttgcaatcgtcgggaatcagcggattttttgatttgctccgtggtaagcattttggcggttctcaaagtgaatggcttcaaagagttcaatgttgctgatgaacatcatcattatcttttgttttttattcatttcgtataaatttgggcataaatggaaaatcgttaaatgattgccaatttgggaaattaacatttaaataagattttttcattttgtctccatttgttaaaaaaaaaaaaaaaaaaaaaaaa

SEQ ID NO: 90628 - DNA, 531 bp, Heterodera glycines
  SCN-specific regions: Sequence locations=1-49,77-96,118-286,316 -316,446-446,521-531
aagagaggcgcgaatgcaatcggtttcagatgttccgctgaatctgaccaaggaggaaatgcaaatggccaaagaacgttttaaccagttggacaaggacaaaaagggacacattacggtcaatgacatccgccgacactttcgggaacacaacaacaaaattgacgagcgtttgctgcacgagttgttgaacgaggtcgacctgaacaagaacggcgagttggagttggctgagttcttccagctttatagcggactgaaaagtggtcaaatcactcagaatcgtttggtccgttatttggacgaattgggcggcgaaaaggacaaaacaaagcccgtgttggatgtggtcaggtccggtggaggattttgagcttttcaccctcgtgataacctcggatggatgttttttctcgtgcattttatttgtacgcccataggactgcccacttaatcctttaaaattattgtttcatttaagcccatcaattaattaattacagtatttttgtgcttcttatttgtcctgtt

SEQ ID NO: 90629 - DNA, 502 bp, Heterodera glycines
  SCN-specific regions: Sequence locations=1-502
tgtgccgactccaagcaactcatctgctcgctcgactctttctgctttttgcgctttgcactgctttcgttagctctctcactgctgttgccccgccattcggccaattgtccgtttccgacaccaatttggtcggcgccaacggacaacccgtacagctgatcggcaactcactgttctggcaccaatggtacccgcagttttggaacgctgacacagtgaaggcactcaaatgcaattggaatgccaatgtcatccggggggccatgggcgtggatgtggcatcacagaacccaatcaaagactaccaaaatctgatgtacactctccacttttacgcgtccagtcacttcacgaatgatcttggtgccaagctcaaaacagccgtgaacaacggtttgcctgtgttcgtcactgagtacggcacatgcgaagcgtcgggcaacggcaacttgaacactgactcgatgtccagctggtggactctgctggacagcttgaa

SEQ ID NO: 90630 - DNA, 811 bp, Heterodera glycines
  SCN-specific regions: Sequence locations=1-480,502-784,807-811
ggacctccgtgaagggatggcccttcagaatgtccaggcccgtgctcggatggtcctcgcctatttgcacgcgcaactgacgctgaccaaagagcggcggaaagggtctttgttgatcttgggcgcctcaaatgtcgacgaaagtttggttggctatgtcaccaaatacgattgttcctctgccgacattaacccaattggtgctacctcaaaggatgatttacgtgagtttctgtgccatgcgaatgctaatcataaattcccacacttacaaagtgtcatccattcggtgccaaccgctgaattgcgtccactgaaggacggccaaattgtgcagacggacgaagccgaaatcgggctcacctatcgggaattgtccacttttggcaaattacgtcgtccaggctgttccgggccgtacagaatgttccaagaactcgtccacatttggcatcccgcgcgcagctatgacgaaatagcggacaaagtgcgcattttcttccgccgttatgctatgaatcggcacaaggcgacagttgcaacacccgcttaccatgccaacacttacagcaacgaggaacaccgaaatgaccatcggtcgtttctttacccggacatggcccaccaattccatcgcatttcggaattggtggaaatgttgaagaagcgcgaccaaacattgcaacagaaaaacagtaatggccaaagaacaaccgctgactgactgactgatcaattcagttttggcctgctttttcattttttcgaattcccaccgaaatcattcatcaaaaacaactcaaattgaaga

SEQ ID NO: 90631 - DNA, 493 bp, Heterodera glycines
  SCN-specific regions: Sequence locations=1-30,52-183,206-493
ctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcgccagacagtacaaaccataaaaaagaccataaaaatgagcatccaaagtatgaagcagaacttatatatgagcaaggaaaaccgtcgccagacagtccaaagtatgattccccaattttagccggttcatctggcagtccgaaaaaaggaaaatcgccgaatgccgatccgaaaaaagctgcttcacaccttgtgccagtaacaccagggaaagtatgatgagcaaaggtaaccaacagaaccatgctaccggttgccaaattttgtaatcattagtcttaaaatggtgaagaaactgtgtggaacgatgatgccaaccatg

SEQ ID NO: 90632 - DNA, 291 bp, Heterodera glycines
  misc_feature (252)..(252): n is a, c, g, or t
  SCN-specific regions: Sequence locations=1-160,183-245
caaagctgcgtgaagtcggcctgcaaaagcacttgcggcgacaatttgtcggaaccgaagtgcacggaatgttacgacaaaccgcacgaatgtgcgccaaaataacagaggacggaatgccaaaacttgaaatggaaacgaatgacaattaattgaggatgaggaaaaggaaaaggagcaaattaatcggaattaaatttaattatttttcgtattttaatttgtggaattcaaagaaaatgattaaacaanaaaaaaaaaaaaaaaaaaaaaaaaaaaaaaaaaaaaaaa

SEQ ID NO: 90633 - DNA, 542 bp, Heterodera glycines
  misc_feature (495)..(495): n is a, c, g, or t
  SCN-specific regions: Sequence locations=1-271,293-542
ttctgcaagaaacggtgtccagaaacgtaccgtctcgccatcaaatagtgttggctcttctaacgggagtgggtctgtctcgtctaaattccaaagccaagatttgatcagcgaactgtccgatcgactaagcaagcggaaaatgactgtggaagcttcgtcaaatgcaaatggcaccccaaatcaaccgaattcacagactcttcccgtgaacaatgcgaaaggctcagcgaatccttatggaagaattcccagtgtttcgtcgttgtccagccaagatgatgccaccgccggcggagggactccggcgacagcgggcgcagcctccgctgctcaagactcacaattaacttgcgaaacggtggtgaaaggcccaacacaattaacttgcgaaccgatggtgaaaggcccaacttcatcagctcataatgacattgccaattccgaggctcgaccaaaggcgacgactacgagcagcgatttcgagcggatganaggcgaactcctggaactgttctcgaacgaactgcagaacctcaagc

SEQ ID NO: 90634 - DNA, 334 bp, Heterodera glycines
  SCN-specific regions: Sequence locations=1-54,78-334
ttaggacaattaattgcaaatttttacattcatttcaggaatactttgtacgacagtgaaatttttcagttgcaattcagatttgacgaccaatacccattctcatcgccagaagtatgtgcgatttgaagaaccaattatttataaattttcaaatcactcacaataagtccttttttgccctttaggttatgtttatgggtgaaaacattccggtgcatccccacgtgtactccaacgggcacatttgcctgtcaattctcagtgacgattggacacccgtaactttggcagttcacaaaatgaccgacaatcctcaaactggcactctttt

SEQ ID NO: 90635 - DNA, 661 bp, Heterodera glycines
  SCN-specific regions: Sequence locations=1-121,152-661
ttgtgactctactataattccgtccgtccctttccttttaacttccaccaaatgcccctcgtgcacaattgcatcgctggcactcgccattccctcttaattgttttgggcctcattatgataatggccaattgtggacaagcgatgcggcagcaggcggtggccgtacgtggccaactccgttgtgggaacagacccgcctcgggggtcaaagtgaagttgtgggacgaggacgacgggcccgaccccgacgacgtgcttgacgaggcgtttaccgactcttctggctccttccaaatgagagggtcgacacgcgaactgacaaacattgaccccgtgctgaagatttatcacgactgtgacgatgggataatgccaggacaacgcaaagtgaaactgcgcatccccagccaatacatcacaaacggagggttggccagacgaacttttgaagtcggagtacttaatttggagacagtctttgctggggaggaaagggacttcatttgaacatggaggggaagaagaactggcgaaatgaaagctgatttattatcacatacagtataaccagccattccatttggtattctttgtataccacattcgtattcagcaaaagaatgtagaaacaataataaactatacaatttgtcaaaaa

SEQ ID NO: 90636 - DNA, 706 bp, Heterodera glycines
  SCN-specific regions: Sequence locations=1-668,690-706
agaatcagaaagggaaaggaagcgatcaaatagcgaccgatcaaagagggagcgatcagaaagaatggactgatcaaagagggatcttcataaattgtgaaccggggctagcagaatattacgatcaatccactatcaaatttgggtttaaaccttgtcaatcgcaaaagacattttccattgacccaaattatttgccgctgtttaacggaaatttgcttcaaatgatggaaatggaacggaagcaaagggatagaagtgccgatgaccatgactttgtcacggtgcaaacaattcgacacattttggagaacaacagagaagctgaaaacattgtttttgttacacacatgcaaaacagtggccttctgctcgaactgatgggcgccgaatgggcggcggttggccaagcaacgattagtaaattggtcaaatacgaagagaatgtcggcatcggtaaaccgtcggatgtgttgcaacaatttcggttggaatacgccagcggagtcacccatttgaccgaacgcaaagatttgcgcccgcgctgattttaaaccgaatgaatgcctttcggattgaggcatttgattgatgatgatgattgtggaaggtgaggctcaaaacgatgtgtaggaaatttgttattcttcagtttgttatcgtttcataggtattttggtataaacttttgaaaaaaaaaacaaaa

SEQ ID NO: 90637 - DNA, 942 bp, Heterodera glycines
  SCN-specific regions: Sequence locations=1-36,71-942
tttgtcttttgctcgattttcctttactagctgtgattctgattttacagactttctttttctcgccatttcttcatggactccgaaaatgcgttgcaatcattcaaagaattcaccggtccaattttgtgttgaattgatcgttttccaatttaattctcttaggctgcactgacgatgacagcgcacgtcggctgttgtccaaatgcgcatggaatttggagagagccattgactttttcttctcgggacgaagggaagagggggatggggaagtgatgtgggacgagcagcagccgatgacgagccaaggaacacgacgacgaatttcgctaattactattaatgacttcaaattagcgttcttccatccttccattccctttgcaggtgtattactctctcttcacttcactgctttctgtttttctcgcaaagacgagcatcaacggattgttgcacaggggtcgcatgttcatcttctcccactcccatctgaaagtgttcctccccattcccgacgatgggtcccccatcgggttgtcaattgctcgacattggggcccgtgacggcgcagtgacggcgaaggtcacttccatttgtgttgttgaagcatccaaagtgatggagtggcggttggccaggcgcggcttcaccgttctgccgatggacaagtggcaacggagtggaccatattcgttgataacggcactgaatctgctcgaccgacaccatgacccaaaaaaattgctgaattctttgcacgaattggccatcgagcacaattgtcccattttactttctgtcgtgctccctattcgacaatttgtcgaattcgacgataaaattgtctccgctggaagaaaacttccggcttcagacattccaacggaaggaacgaccttcgaagcccaagtgaattcgattatccaaattggagc

SEQ ID NO: 90638 - DNA, 918 bp, Heterodera glycines
  SCN-specific regions: Sequence locations=1-918
gcaaactatctgaaaaacccttacaaactctgcggagattattacttccagccttgcacgtttgttttccgttgtgatatttgttgggcaattgtgactaatttaggcaggacgttttggagccaactatgctgtcatacaaaatgagctggattttggacaaagttaagaagaaccgttcaaaaccaccatctacgattttcatcattcgcgatggtgttagtgagggaatggttccgaacgttagttggactggaagaatcacgacggattgtaaaagtgtgctttagaacattcacgacgaatttccttcctatgtgaaggcgtgtaagaaatatgacccgaattgggagcccaaattcgtctattgcatcgtcgacaagaatcacaacaaacgtttcttcgttaaggggcagcaacaagtcgagaacactgctccaggggcggttattgattcgaaagtggtacgcgtcgacatccacgagttttggatgcagtcacatgttccgctcaaggggacatcaaaaatgccacaatacatttttcccgtcaatgatcccaaggccaacaacaacgaattgcagggtttcttgcttgctctctgctgcagctggcaaattgttacgctggctccggctttgccaactcctgttcgtcaggctaaagaattggctaagcgtggtcgtgccaattttggggaattgaagcgcactccacaatatatcccgcgcgccgagaaccagcaaatcgactaccagcagttgaacagacgcctctgctacaatggacatattttcgcggacactcgctttaatgcatgaaggatgggatgatctcgggtaatttggtttgatttgatctgacataatcttgatccatgcctttcgacaacttttatttattctttcacacttaatt

SEQ ID NO: 90639 - DNA, 602 bp, Heterodera glycines
  misc_feature (572)..(572): n is a, c, g, or t
  misc_feature (577)..(577): n is a, c, g, or t
  SCN-specific regions: Sequence locations=1-99,129-575
attcaaactcatcaaattcactcaacatcatcaccaaccgtgaacattatgctgaggattgctctactgatctccattttggcactgtttggtgattgcatggacaagggaaaaagaaaattaggaggaataagtattaatgagccaagtgaatatagaaccaaagaaaaagaagccatcgcaacaagcagggcatggcaaagaaaatagcaaaaatctcgattgagtgcaaattggaactggacgaggaaaagtacgtggagtcgttctgtcccgcgatgatgaccgttgtctccaagtggtgttcaggcgccacattcgccgaaattctagaaacgtccgatatattcgagggcagtataatcagatgcatgcgacgtcttgaagaattactgcaagaaatggtgaacgcagcccggtccatgggtgaccggccactggaacaaaagtttgagcaggcccgatctctgcttaagagggacatcgttttctcagcgtcactttatctctaatttgcgatcctttttttgttaatacatttaacatgttgcgcaaaaataaatattcattantttanaaaaaaaaaaaaaaaaaaaaaaaaa

SEQ ID NO: 90640 - DNA, 214 bp, Heterodera glycines
  misc_feature (176)..(176): n is a, c, g, or t
  SCN-specific regions: Sequence locations=1-143,173-174,210-214
cgggggagtctccggccggcggttttcaagaggcttttgagcccggcgttggcccattcaaaccggcgggacgaaggcgacgagcgacggcacaattagcgagacaaatcaattgaaaaattgggatattaaaacccgaattgtaaaatacaataataaaaattaaaaaattgtanaaaaaaaaaaaaaaaaaaaaaaaaaaaaaaaaattgta

SEQ ID NO: 90641 - DNA, 547 bp, Heterodera glycines
  SCN-specific regions: Sequence locations=1-158,180-547
gttcgtgctcattccgctgttacccggcttcgagggcgacatcggcgccacttcgtattcggcgctgctcgccgtgctccactggacaatgctttccatcgccaagggcgaccactcgctcatccaaaatctgcagagggcgggcgttgaaaatgtgcagaattacatcactttttgttcacttcgaacgcattctcaactctacggcaaatcggtcaccgagttggtttacatccactcaaaactgatgattgtggacgatgtgcacacaatcatcggaagtgcgaacatcaacgaccgttctcaggcggggaaccgcgactcggaggtctgtttgctgatcaccgatcacgaatttgtcgacggccgaatgaatggccaaccgttccgtgcgggcaaattcgcgtcctctctccgaatgcgactgatgcgtgaacacttgggtctgttggagcaatcgcttccgaagacttcgccggagagagcagccgaaattgacgtcatcgatccgacatgtccatctttttacgaggaccaatggtgtcaa

SEQ ID NO: 90642 - DNA, 306 bp, Heterodera glycines
  SCN-specific regions: Sequence locations=1-248,270-306
tttcttttattttcataaatgaaatcgtttattctcgctgttcttttctcatttctcttcatggctttaatgatgccacttgtcagttcagaggaatcggaaacaaaaatgaaatcgccgattatggaaaaacatggtaacggaggcgacagactaagcgattatctgttgaaactgtgaagattcacgccgtggattgtattgctttgaggatgacgaatccaaaacgatttatccgtttgatacaacaattattgaatgactttcatttgtaatcgattaaaagtaataaatgacttggaaaaa

SEQ ID NO: 90643 - DNA, 586 bp, Heterodera glycines
  SCN-specific regions: Sequence locations=1-90,112-391,421-586
ttactatgaagacgcggacggactgaacggaaatttgagctacggagggacgaaagggcgcaaagaatgggaagaaaacgccgacccgcactcatccgatttgtctttgtataatattgccgacgggaacaagagcagttcgggcatctccagctgttgtacgacttcttcgagaagctgtgagccgccagagaccaatcgctttgtgttggccaaaaaacaaagacatttcaaagcgggggatgaagctgacccaaaaatgccaactcatcgggcacagttcccttttatgccgagacattccgaacagatcgaactgcaaaaaggtgacgcaattcgcattttggagaagtacgaagaccactggtgccatggaatcaatttacggagcggaaaaaagggaattttccccgaggcccatgtcgtggagattgaccttgtggatgaaatttgccgaagtgttcttccggatggcactaatcatgccaacaaaatcgaacgggacaccttttacttgaccatgttggcctccattgagggcgcccatcacaggggaaacgatgtggtaatgcaggcaattaacaag

SEQ ID NO: 90644 - DNA, 511 bp, Heterodera glycines
  SCN-specific regions: Sequence locations=1-282,305-511
aatttatcggatggcttacgattatctggacagattgggtgagttgggaaggaaagcacggcgaaatcgccaaatttggtgtattcacgatatccgatggggacaagtttaacccgaattattaacagttgctaaacaacccaaacagtgcggacatttccaatttaaataattaaatcttttcataaaccctaaattaccatcaaatcacttgtgaaacaatccaattgtcatcaaaggtaattttcctcaaaagtccggcccagaatctgctgaagtccctctgaatttgagtcattttctttctcgaccctaaggcaaagtggacggcctcgactttgacgcgttcactaggcaattattcgaccgatggttcggcgcgtacacgcgctgcggcacatgcaaaaatggcaaatgcagcagacacgggggaccgttgggaagttcagggtgggagcacgtgttcagcggagagtggcgaggagaaattgtggacggacaccacagttgg

SEQ ID NO: 90645 - DNA, 544 bp, Heterodera glycines
  misc_feature (538)..(538): n is a, c, g, or t
  SCN-specific regions: Sequence locations=1-544
aggggatcataaattaaaaaaaatgtttttttcttcaaaatccgttcttctccttttagtggtaatcgcattggacacttttacttcttcgcaacctattggagagggaaatggaaatgctgacaaagcagtaaagaagaagtcctcttcaaaaggcagagttgggactgtcgccaaaggagtttttactggaacattattggctacgacaggatcctttgcccaagtggcagatgcgcgacccgtagtgcagatcaatcatgttattgctaccccgtcggtgccaccaccgccatccgcccgaatgacacctcccgtgcaagaaagcgcaatgcgtcgtagagccaatgtggtgagaaaagatggcgtgccggatccaaatgctccgtctactggctttgaagtacctcctctgcctcccggcggctttaaccgcagcgcctcatgcggtacaaatggcgatggtacgccgatgggcccgtgcggttacgttcctattggcacgacgggcctgccagatgagtacaaagtgaatgangacgaa

SEQ ID NO: 90646 - DNA, 740 bp, Heterodera glycines
  SCN-specific regions: Sequence locations=1-740
atcatgtcagattcggcagcaaatatgaaaagggctttcgtcgagagggatgaaaatgaaaatcgcattttgccaatcccgaacggaccttgcgctgctcatttattgaatttggctgtacaggaggcgttcaagagagatgaatcaatcagcagtttattggccaaaactcgtcatattgttggccgtttcaaacacagtaacactgccttcagcgaattgaaaaaaattcaaaaattactcgatgccccttctcatactcttttgcagatggtatatgtccggtggaacagtgcgcttacaatgtgtgagaggctgacagaacaaaggacggcaatcacacaatatgcagtcgacaacaacgaattcgagcttttattgaagaatgatgagtgggagcaaattgaagagctggttggggtattgaaatgtgctgaagaagcaacaaaaaggttcaccgcagagccaatttcatttgtcattcctcaagcaagagcattacatgatgagttgtacgaaatgaaaattgttaaccggactgtggagacaatcagaacaaccctttattttgcggtcgagcgacgcttttttgggctagcgaatttgaaggaatatgcgctagcgactttttttgatgtgcgattcaaggacaaagtgctgactgaaaattccgcaacttttcgcgctcgagtcactgtctggatcaaaaatgaattgaaggaatgggaaaatgataatga

SEQ ID NO: 90647 - DNA, 485 bp, Heterodera glycines
  SCN-specific regions: Sequence locations=1-485
gtactattccaaaacaacacacattgggcccagcaccgaaatggagaaaaggaaacgtgccgaacggctattcgccacttccggcggcagcaatatcgtttttgaggatgggacgctgcagacgcaagtttaagaggaatgtcgaccaccaaccgaacgaaggcattcaaattccattcacttttgcttgttcaaacaaaagctttaataaatggaggacgttgggtttcggttttaatgttttaaatttaagtcctccattcgatgtccatttattttttgtattcagcagaaattcctctcctactgctatttcacttttcatattatatgtatgagcaattttgtctgttttggcccccaaacactcgtttccttcagaaagtcactttgtcagtctctcacagtcagtatgtgacgtcattcgttgtgtgtacttatacctaacaatggttttatgttgataatcaatcagtatcgatact

SEQ ID NO: 90648 - DNA, 480 bp, Heterodera glycines
  misc_feature (455)..(455): n is a, c, g, or t
  SCN-specific regions: Sequence locations=22-395,418-433
taatttaatttttttttttttgcttcccttcgtcacaaatttaactttcgtttcgtttccttttccaaaatgaattggtgcgccgttttgtgctttttgcttctcatcgaagtcgcctttgtgccaattgtgaacagtgcgccacttgagcgggaaaaacggctgactgccagccaattgggcaaaggcgccgtcgtcggtgccggcgtcggcttagtcggcgccgcactttacgccggcggcaaaaagttttggaacaaccgaaaagcaaatgctgcggcagccgacgcaggcggagccgacgcggccaatttaaaaacaaagggccgaaaatgaaaggatgccaaagaaagacagaaaacggagagaattttaaatgaaatttatgaaaggacagataaaattttaaaggtgcaaaagttgagaatgttttaaaataagaaataaaaaaatanaaagaaaaaaaaaaaaaaaaaaaaa

SEQ ID NO: 90649 - DNA, 925 bp, Heterodera glycines
  misc_feature (422)..(422): n is a, c, g, or t
  misc_feature (743)..(743): n is a, c, g, or t
  SCN-specific regions: Sequence locations=1-925
ttcggccgttttctgttggatgttattgggcgttgtgggttttcattggatttggacacttttgacgaggaaaacatttttgtgaagcaggcgcgaacaatttttgactttacgcggaagggacaaaaattgcgaatgattctcggggtgtttttcccatgcgtctcacttttatacgaaaatatcactggcaaatcattcgcttttgccatggatgaagagtttttcatggaaatgatgagcgacctttacgaaaagcgccgtgccgaccccgaggcaaaagaaaaatacgccgacattttccaacttttgatgaatgcggtggacgacgaggaatttacaatttcagcagacgacgccgaaataattcacagcgaattgagaagcaatgagcagcagcagaaacaacaggggaaagcatnctgaccaggaaaccgaacttttcgcgcaaagtttcatcattttaattgccggtttcgaaaccactggcgccactctttcatttgccgcttatatgttggcgattgagtcagaaattcaagaaaaactcagagaggaagtgatcgacgtgctgggagagaatgaaatgatcacttacgagcatttgaaacgaatgaattacctccgcgcctttgtccaagaaacgctccgaatgtttccggtggcgcccaagatgaaccgcgtgtgcaactccgactgtgtcataaacggcgtgccattcgaaaggggcgatttgataactntgccaatttacgtcattcagcacgacgaaacctttttcccagaccccttcaaatttgaccccacgagattgttgccggagtgaaaagcggaaattgattcgttggcatttttaacttttgggcttggccctcgcaattgcattggcatgccgtgtgccgagttccaaatgcaaggtgccgtg

SEQ ID NO: 90650 - DNA, 788 bp, Heterodera glycines
  SCN-specific regions: Sequence locations=1-76,99-272,298-788
ttttccataatccgtttttgtttttgctttttcccgaacgatcattgatcaaattaatacacttttagtattaactaaggcaatgtcatctgattttggaaaccctctgaagaagttcaaactcgtgtttcttggtgaacaaagcgttggaaagacttctcttatcaccagatttatgtatgacagctttgacaatacgtaccaggccacaattgggatagattttctgagcaaaactatgtatcttgaggacagaacggtcagacttcaactttgggatactgctggtcaagaacgctttcgttcgctcattccgtcgtacattagggactccacagttgctgttgttgtttacgacattacaaatgcgaattcctttcatcaaacgtccaaatggattgacgacgtgcgcaccgaacggggcagtgacgtcatcatcatgctcgtgggcaataaaactgatctcgcggacaaaagacaagtttcaacggaagagggcgagcagaaggcgaaggagctgaatgtgatgttcatcgagacatcggcaaaggctggttacaacgtgaagcagcttttccgacgaattgccagcgcacttcccggcattgaggtggaaaaggctgcggacgcaaaacaagtcgttgacattggcccgattaagccccgtcagattgtcactgaagagggttcctgttggtgttaatatgtgactttgtgttctgttgggttcccgttaattattgtcgttatttattcacattgtattaaatttctcgaatttaaaaaaa

SEQ ID NO: 90651 - DNA, 549 bp, Heterodera glycines
  SCN-specific regions: Sequence locations=1-82,104-549
accgagtctcagaaagcgcttgaggatttggacaaagtgcagacggaacttgacactttaaatgaaacagccagcgacgaaatattaaaagtcgagcagaaatacaatcagatgcgaaagcccttcttcgaaaaacggacacacttcatcaaacagataccaaatttttgggtgacagtgttcataaaccatccacaaatcagcaatatcctcgaggaagaagaggaagaatgcttgcactatttgacgaaagtcgagattgaggaaaatgaagacatcaaggccggttataagttgaaattttctttcgacccaaatccattcttcgagaactctgaaatagtcaaagaattcaattggactgcagcagaaccgaacagtgtgacaactgaaatcaaatggaagcaaggaaaaaataaattggctaatgggactggaagcgaggaacaaaccttcttcaagtggctttgccagaacattgaacccgtttctgatgaaattgccgaggtgatcaaagacgacatttggccaaatccgctgcaatatttt

SEQ ID NO: 90652 - DNA, 510 bp, Heterodera glycines
  SCN-specific regions: Sequence locations=1-46,68-255,277-461,505-510
tggcatttagaaaccagtaaacaaaatgcgaacccaaagcattttctcaattttcttccttctgcttatatttgaagtgatcaactcattcccatcaaagtcgagtgaaagcggcgaaccgcctgcaaatggagcagaagtggcgcaaagtcgcaagaaacgtcaggccgaagaagtgaccactgaagagccaccatcagaaacaaacgatgccgaaggtgccgaggatcaccaatctgcggcagcgggaaatggaaaagcaccaaaaaataagggcaaaaagaacaagagcgacagcagcgactcgtcaagttcgtcgagttcgtcgagcgaaagtgacgagaagaagaagctgaagaagaagaacaagcactgagcatcggtcgactcactaatgaggccgcttaattggattggggtcattagcgaagagtggactgtcacaattaatgttgtcaaaattgtaaagcttttattctttgatgggaataaattttattagtggaaaaa

SEQ ID NO: 90653 - DNA, 639 bp, Heterodera glycines
  SCN-specific regions: Sequence locations=1-32,54-92,115-639
gagtttcgaagccccagagaaagagttcgacattttgaaaaaagcttggcctagacttggttccatgttggactggacaaaaatccagttcaggaaaaacccggccccccggggtccgggtccaaccaagcctgggacccaagtccaggtcgaaaactgtactaagaaccgtttgacaagattgtttgctttttcgaaaataattggtttgcatgcattatcacttttgtaatccaagtgcgcttaaggccttccaatgtttgtgactgagtacggttgctactcggctgacggcaatgaaaaagcaaatttggaagagttgaaaaagtggatggaacttttggacggctatggcatttcctacgccgcgtggcacgtggcagacattggcgaacagtcgtccatactgacaaagacttccgaagtgaacaacatctgtgacccggcccatttgaccaactacggaaaagccatcattaacaaattgaaatcgcaaaacaatggtgtgaaatgcagtggttaaccaaccaattccaatgaatcggcggatgttatcgaaaatgtattcaaaagttgaatattcaaaaaagtttactaacccaattattgttagtaatttcggtgtcaataattgtaatt

SEQ ID NO: 90654 - DNA, 406 bp, Heterodera glycines
  SCN-specific regions: Sequence locations=1-406
gggagaggcaactgatttcgctgcttcggttggctttgtccaacccgcgaattattctcatcgacgaggccaccgcgcacatggacgagaacaatcacaagctgatcagtcaattaatcgcgaggatgggctgtacggtgttggccattttacatcggacgaccggactggcggaatttgactggatcatcgaaatgagcaacggacaaatcgcaaggcaaggacatccgtcggagttctttgaaagcgaggcacaataaacaaacattttagatctttttttcatttttctaattttttcattctttcaattctttttattgtaatgatttgttggtcctaaaatgggtgtatttatttcattcttaaaattttggaatgattcatgggaataatgccactcgac

SEQ ID NO: 90655 - DNA, 564 bp, Heterodera glycines
  misc_feature (391)..(391): n is a, c, g, or t
  SCN-specific regions: Sequence locations=1-564
cgttgttcgtcaattcaattagtgcagttagcgaacggaatatggagtatgtggtgcagttccgcttccaacaagaatggcttgacgatcggttggcctacagcagactcggtgacgagcgcagctttgcccacctttttgtggcacgtgatcagacaatttggatcccggatagcttttttcaaaacgaacgaagtggccattatcatatgcttgaccaggaaaatcgttttgttaaaattcgtgcggatggtcgagtcacttacaaccggcggctgacactgaccttggcctgcaacatgaacttgctcagatatccgatggacgtgcagtcgtgtctgatcgatttcgccagctatgcctacacaaccaatgacatcatttacaagtngggaccaagtgggcgtggagatcgctccgaccgctaacggagcattgccaaactttgaaattgcctcgctggaaaataacacatgtgactcggtgacaaacactggcacttattcttgtctgagagtgaatttgagtctccgtcgcgtgttctctttcttcctcctccagctg

SEQ ID NO: 90656 - DNA, 534 bp, Heterodera glycines
  SCN-specific regions: Sequence locations=1-64,86-88,112-319,386-462
ggaccaaacagaacgaacgaaccgaacactctcaacccaaccgcttctcttggcccatcctcacaaaatgtcttctcttcagcctctctttttcgccgctctctttttggcagtcttttgtctctgcgccattgcaatgccggcacagcccgaagggccaatgttcgaaggcgggcaacatcaagccgaggcggggcgtgccaaacgttggagtccgtattactacggcgcatacggcggatggggcggcgcttacccttacgcctcgtcgtactacggccacgcttacccgtactattcgggatattggtggtgaaagacggacggacggacgaacaaatcggaaggacgaaaagaaaggaatgaacgaaagacggatgaatgacgagaaaagcacaatttaatcttacaacgcaaagaaatgccaacgaacgttcgcgcgaaataaattcttttgcattgaaaaaaaaaaaaaaaaaaaaaaaaaaattatataaaaaaaaaaaaaaaaaaaaaaaaaaaaaaaaaaaaaaa

SEQ ID NO: 90657 - DNA, 504 bp, Heterodera glycines
  SCN-specific regions: Sequence locations=1-504
atgttacaaaaatcttgagttaaaattacgggattttgtataggctcaccctaaatcatctcgtcttttttacttcaagcggcaatgacccaatcgccccgtcctgcttatgtcagttctttgctgttgctcttccccatctttttgcttccctatgccgtcatatttttcatcgtcctttccttctttttgttcctccattttcgtaaccttccttcacctgcgaacaatgtggccaatttcttccgcggttttcacctcggagggcatcccgcaagtcccacaaatgctccccaaaatacaattgcttctttcaaacaggcactggcggaaggcctcaatttccttgagttcgacatcggtctaacggctgacggagtgcctgttctaatgcatgaccacactttggagagaacgaccaatatgacgggccttcttcgggactacaatttcccagacttagtcgctcaatgcgattgtggggcaaagttcaagcgggtgagc

SEQ ID NO: 90658 - DNA, 447 bp, Heterodera glycines
  SCN-specific regions: Sequence locations=1-412,435-447
ttttcttataattgggggttttctttctattggctattttgaggcttcaacatcgaaacacttgagttcatgggttggaaattgaactgttgggatgttggcggtcaaaaaagtctccgtacgtattggcgtaattattttgaacgaactgacgctgtgatttgggtggttgatgcttgcgatgtctgtcggttggatgactgtttcaatgaattgcattcactgatcaacgaggaatgtctgcatggagttactctcttagtactcgcaaacaaacgcgatttacccggctcgataaatgctcatgaaatagaaaagattctccggttggaaaagataaaacaccactggcgcgtatatgaaacgagcgcttacactggccacggactgctcgaatctctggaatggatggttcaagatgtaaattcaagggttctcgtcccggat

SEQ ID NO: 90659 - DNA, 343 bp, Heterodera glycines
  SCN-specific regions: Sequence locations=1-99,121-247,272-290,312-343
aacaacaacttacatcccgaaattcaattaattccattctaaaatggcttcatcattgattaaattgctttcactgtttctgctcgtcctttgcattggcatggccattgagcagacccaagcttattatggctggggtggctacggctatggctatccctacgggttttatggcaaacggcaagccggttttggtccatccggaaatgttggaatttttggtggcggtggagaaggaaatgctaacggaggaggagaaggaagaggagggccatcgtcaccaaacaatttttgagagagaaaaacaattaccaaaaatggagatattcttgatttccaaaac

SEQ ID NO: 90660 - DNA, 523 bp, Heterodera glycines
  SCN-specific regions: Sequence locations=1-523
attggaagtgctttcgcttgacaaatgcgacttaaaagagttggaggaggacatttttgagaatttaacatctctccgtgccctgtccctctctggcaatcccttggaccgaatccccgctgctctctctccgctccattcgctgacgcacctcgccatgtcgtccaccaatctcaaggagttaaaggagggcgactttcaaaagacagtgcctgggctggagaaactttacatgcgaaaaatgaaatatttgtggaaaattggagaaaacactttcaacggactggcaaatttgaagttcatcgatttttccacctcggccaaattgcgtttattggagccaaatgttttcgggaaggacccgccacagaatttaagcgaattgcacttacagcagtgcaatttcagcactttgagtgccaaaactttgcctcaaatttattggaagagtttggacgtgttaaaactgaacggaaatccttttttgtgcgattgcaaattgaaatggatggtggacatgaaa

SEQ ID NO: 90661 - DNA, 388 bp, Heterodera glycines
  SCN-specific regions: Sequence locations=1-32,60-319,341-388
ttttctgtgtcaaattttcttaaaatgccatctttttcgtctgtttttgtcctttttgccatcgtcgttatttcgctgggaaaggaacagcaaaagggggacgaactgagggcgaaacgacaaatttgccaaggcttttccgcccaatacggcgcatgcattgcacagaaatactcacagtgtgtttggtgtaacgatgcggattacagagggccacaccgatgcgatgagaaatcatcgatgaaaggctgtgttcaaattgtgcagtgaaatcggcacaattaatgacggaacggaggaaatggaacaattaattagcgaaaggaaaaacacaaaagcatcatttattgtttctcgacacgtattggcatagattattgtctgtcca

SEQ ID NO: 90662 - DNA, 532 bp, Heterodera glycines
  SCN-specific regions: Sequence locations=1-532
tcacacacgcattacttcagttgtacgctgctttacctgttcttgggtgccaattccaagcacattcaggagcagatcactcggtaaagagtggcttttataagacctaaaagtcagtcctcacagtcccgatttaaatgtgatttaaattgtctcacaatttgttgtggtaatctctccccccaccctcttcgtattttccgtccctgtagatagataacttttacacatttaaaacaatatagaagggggttttaccatgcaagacgaatttttaattttttgtttttccatagtattctttttgaacgtttggttgctctccgtccgcacccgtggggtttgttgatcacattcatcgaactgatccgcaaccagcgttacggcttttggaagcacgaatttgtttattgtgccacagaaattgaacgtttgttcctcagcgttgctaattcttgcagtgtaagcggcccgaaagtcatcactcaaacgggatttaaattattgctttaatatattttatcaatgacgc

SEQ ID NO: 90663 - DNA, 497 bp, Heterodera glycines
  SCN-specific regions: Sequence locations=1-438,471-497
ccggcagtggcttcaaccaatgccatcatagcgggaagctgtgctcttgaggcattgaaactggcatcaaacatctcatgttctctgaacaattacttgaacttcgctaacgtggaaggtatctgtttcaacgttgttgcattggaacgtgatcccgaatgtttggtctgcggtcagaaatctgtccaaatgtattccgtgcgcgaggactgtacactctcaggctttttagatgacttgaaagacaaataccaactccagaatccttccattcgagcgggtagcactttcctgtatgaaatcaacactcttatgccagaaatggagacagcaagtcggaagaatttgtgtaaaacgctcaaggaacttcatgtcaccgaggatagcgaactgcttgtagcggatgaagcattaacgagatctattgtttttcggatcaaatattccaaataaattttattcgaatgtccgataaaatatctctgaaaaaaaaaaaa

SEQ ID NO: 90664 - DNA, 333 bp, Heterodera glycines
  misc_feature (317)..(320): n is a, c, g, or t
  misc_feature (324)..(326): n is a, c, g, or t
  SCN-specific regions: Sequence locations=1-254,317-333
attgctgctgttgcgcaagggtttaaggttttcgtcgacggagcgtccgtttgcgacttcacttttcgtgcttcagctccgccaccaacagaagcaaaccgactgacaattgttggtgatgttggggtacaaaaattcatttttcgtaaccaaaaaaaattaattttctcagttcatacaattggaaaaacttttcactttcgaatttggttagatcatccaattccctgctttgttttatgcacattgtgacattttcgggtacttatttattaaagtgaatttgtaattagataaaaaggcagtgataaaatgcnnnnaatnnnaaaaaaa

SEQ ID NO: 90665 - DNA, 400 bp, Heterodera glycines
  SCN-specific regions: Sequence locations=1-2,27-150,172-212,234-376
tcattaattaaattaaatatatttttgccatgtcttctctgctgctctccatcttcccaattgtgtttttggtctgttgcaatgcaatgccaaatttcccgtgctgcccgggcagtcagcaagtggttgctgtgatgtccaaatacattgacactttctcttctgctgctgactagtctacagtatgctcaaccgctaaaagtactgtggatggaataaaaaatgaactgtcctctcgcggcggatgccaaaacggaggagaagcgcagattgtggatggaatcgatcgacagctgaagaacattgcgaaaatggaaatcaattatgaggacgagtgcccgtacaatttgggctttgcccgtgccatgttcgacttggccgctgctgctgctggccatgc

SEQ ID NO: 90666 - DNA, 504 bp, Heterodera glycines
  SCN-specific regions: Sequence locations=1-504
gttgtggcacaaataatcttgatgttgtggaagagaagacattttcgctcataccagttcgccactttggtcggtctttggctaatcccttttatggtgtcacttaaaaatggctggtggcgattcattctttcctggactgtgttcacttcttcaatattttacgtttggcggagggtcaatcagccggcaatttccggatcaactcccaggctcgtctacaaatactttttgttcatgcataaactcagttacatttttggtattgtcggttacttttcactcgtctttactgtcattggaataaattcggtgttcggaattagcagtaatctgagcttggattttggcgtgcatttgttgttttatggcctttattacggtgtgcttggacgtgatttggcacattctctgaccgacagattggcctgcaaaatcgggtattttactcatgacggattgccaaaacgggttctcgagtcggatatgtgcgccgtctgcggg

SEQ ID NO: 90667 - DNA, 517 bp, Heterodera glycines
  SCN-specific regions: Sequence locations=1-24,47-274,296-361,383-517
gaacgaaggccgaattccaaactgaaggtaaatttggaaaataaatgctgttccccatttataccgtttcaaatactcgcggtgccacaaaggaaaggtcggaccgccgtgggcggacggcattttgtcaatgccgctgtggagaaaggcgaagcgatcgtactcggagcagccgttgtacagatgcttcagtttcaagagagcggaatgctttaagggtggtaagaggttttgaaatttcacaattaaatttaattgcttacgaatcggtcccgttgctcatcactgagcattcggtattccatgcgcaatgccttcccataacttttcccattgattgagcactgagcaggcgaagaggaaattcctgaaattggaattgaattagaatttaaccattaattagcttagttaaacaattgtatttgtttattattaccatcaacatatgagcagaagcaagtgaggttaagacaagcgagcttttcggcctgtaatttggcgggggtttctcatc

SEQ ID NO: 90668 - DNA, 649 bp, Heterodera glycines
  SCN-specific regions: Sequence locations=1-47,69-649
tttcggcctaaaccacaaaactaattaacattaagctggaagcaaacaaaggaatttaaataaatgaaagacattgccactgaagaaagtattgcacagaggcggcttaacctaaaagcgaatttcatgcggcagctacaaattcggcgtggtgttcttcccagcgaaattcccccggttggagtcgccacaaacgcagtgcccacaatgggaagaaagtttcgaaagcctttggaaagtcgctttccaccagccaaaccccgttttggccttggaatgacagccgccgatttcgaagacaaaacggacaactgttcttcattagccaaagggccttcactgacagaaacaaatgccccaaaaggaaggaatgttcgtccaaaagcaattaactgttacatcaatccgtcgcaatccgtctccacttggccaacttcgaatgacacggactccgatggacaaagtccctctccgacgagttcggcttccgtcacgtctttcggttcttcgctgaccaccgccactgatcccctcgtcgcgcaacacgtggaccaaaatgggaccatctttttccccacttcctccactccgtcggaccatggacaaagttacgacgagacgccggcttcttcagtgctcactttcgact

SEQ ID NO: 90669 - DNA, 749 bp, Heterodera glycines
  SCN-specific regions: Sequence locations=1-588,610-749
aatgataaaatatcttatccaattatattattaatcttatttcaaataaatattgtcgctttagtcaagcggtggtcgcttgtactgccgaagacccgcaagcgcaactcgtcagtatttgggatgaggccgaaaatcggcttatttcacaaattattacccggccgcttgcacgttcacttcagacctataatttggcatcaccaattttcaacactttttggatcggtcttcgccgtgtccttgtcggaaatcgctaccaaagcacatggacaaacggttcggcagcaatatttggcaatgttcccgaaattacaactgctgcgtcaagaaacacatcgccatgggcagcaggacaaccctcgggcaccaacaaatacactgacccaaccggcgcaaaagaggagtgcgtgcacatgctaaatgcagaaggccgatggaacgacgcgcgctgcgaaattcaaatgacaggcgcgatttgcaaaaaagcagctcagtcggttggaagcagcggcacggtcgtgtcgagtgccgtcgttttcccgtcttcggccttcgatttgtgcaatccgagtgtttcgcaatgcaatggttttggatggaccatttccagtggcaaatgctacaaagtgatcgagggactgatgaatgggactcaagcggtggtcgcttgtactgccgaagacccgcaagcgcaactcgtcagtatttgggatgaggccgaaaatcggcttatttcacaaattatt

SEQ ID NO: 90670 - DNA, 569 bp, Heterodera glycines
  SCN-specific regions: Sequence locations=1-45,67-569
ttcattttcaaactactctctctcactaactgttgcacatcccaattttatttcttccttagtaagtagtattggtgcacaatgcgcacttttctgttcatagctgtagtcgggttggtgttggctgtcatcatggagagtgtaaatgcgactgggaataattcgccgacaaagggacaaactccgcctggcagtccgaaaggtgggcacggcagcaacaaatcgccaacgacgccgcacagtgccggttcgccacacggcacgcagcatggtaaccaacagaaccatgctaccggacaaacgccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggcacggcaacaacaaatcgccaacgacgccgcacagtgccggttcgccacacggcacgcagcatggtaaccaacagaaaaatgctaccggacaaacgccgcctggcagtccgaaaggtgggca

SEQ ID NO: 90671 - DNA, 555 bp, Heterodera glycines
  SCN-specific regions: Sequence locations=1-555
ctgcaaaaatatttgccatttttattgaaagaaatttcaagagaggaggggaggcgacaatttttgttccttcatgcgttgaaagaggtgattaacagcgaatgcggagaatgtggcactgtcggagacgctgacgaaatattcaaaaagggcgttgaacaaatttgggagcttttgatgaaatactgcgactcggctgaggagagcatcagaaatgtcgtcgccgagtgcatcggtcggcttatcatggtcaacccgcaaaaatacgtcgaagaacttttgcgacattctgccgattcacaagcaaatgttcgtgccactgttgtcacagctttgcgttttattatcgttgagcagcctcggcccgtcgatgattttcttcgtccggttattggcaaatttttggccacagttagagactcggatatgactgtgcgccgtgtggcaatcgttacgctgaattcggtggcacataacaaaccaaaattgatcaaagaatgtctcccaaatttgctaccggccctttatgaagagactaaggtcaagcaggaactt

SEQ ID NO: 90672 - DNA, 88 bp, Heterodera glycines
  SCN-specific regions: Sequence locations=1-39,83-88
ttagcgaagagtggactgtcacaattaatgttgtcaaaattgtaaagcttttattctttgatgggaataaattttattagtggaaaaa

SEQ ID NO: 90673 - DNA, 589 bp, Heterodera glycines
  SCN-specific regions: Sequence locations=1-72,94-476,513-589
aaaaaataagctaatttgcgtttggagcccaaaattgaatctctgtgtgctgttaataatccgctcctgctctgattatttacaaatttggtgatatttgtcattttctcaaattttcaatgagcggttacgtcggcatcaaattttgccccgaatgcaataacatgctttacccgcgtgaagacaaacaaaatcggcagcttatgtacgtttgtcggaattgtgagcacagcgaaccggcggacaatccgtgcatttatgtgaacaaactgactcacgaagtcgatgagctgacacaaattgtggcagatgttattcacgacccgactctgcccaagacggaggagcacccgtgccccaaatgcaaaaacgccgagtcggtgttcttccaggcgcagtcgcggcgagcggaggaagaaatgcgtttgtattacgtgtgcactaactcacagtgtactcatcggtggaccgactgaacgaacggaaaagaaaaaagggacagcggacggtctgagtcctttttctgtttcgatctcagcgaattgcgacggcggaacatttctattcaccaaataaacttaaagccgaa

SEQ ID NO: 90674 - DNA, 594 bp, Heterodera glycines
  SCN-specific regions: Sequence locations=1-104,190-330,395-408,468 -468,491-530
gctccattttttcctaactgaaaaaaaactaggtaaataattaaaattatgcttatatgaaaaacagaggaaaaagcaaccaaagattttaaatctctttgtattaaacaaattaaagaacaaaaaaaaagtccaataatagcaataaacaaaaaaaaaaaagaattactaaataaaaaactaattaaaaatcgactaaaaccatgaaccccaaattttaataaaatcccagctaataatatactagcaacagtagaagcttcaacatgtattttaggtaatcaaaaatgtaaaaaaaaaactggaaattttattaaaaaaaccaaaaccataaaaaaaaatatttttttatttaataaagaatcaaaataaactagaaatttaataaaatttaggttaaaatcatttaaaaaaataaaaagaaaaaaaataacccaaaaaaaaagaataaaaaaataaaaaaaaaatagaaataattttttcaatttggactccaaaaaataaagtcaaaaaaactaccgggattatagaaaagtcaaaaataataaaaaaaaaaataaaccttaaaataaaaaaaaaaaaaaccttaaaaaa

SEQ ID NO: 90675 - DNA, 168 bp, Heterodera glycines
  SCN-specific regions: Sequence locations=1-168
gaatgtcagtgaactcggaatggtcacacagggcggcaaagtggtgtgggcaaaatacgctcaagtgactaaccatcccgagaacgacggatgcatcaacgctgtccttttgttgtagagcgaccttttttgttatttttttctttttaaaaagaatttgtttaaaaa

SEQ ID NO: 90676 - DNA, 552 bp, Heterodera glycines
  SCN-specific regions: Sequence locations=1-375,397-409,431-552
ggcattggctgtgtgccgttgtacaatttgatggaggacgcggccaccgccgagaacagccgcacccaattgtggcaatgggcgcgccatgaagcgcgccttgaggatggacgtacagttgatcctcagctggtcaaaatgacaatcgcttctgaaactgagcggcgcctcgtccgtgccggctctgtggtcaatcgcatcccggaggcctcggaactgctcgagaaattcgtgttggagcccgagttgagcgactttctcacattggatgcttacgacaagctcgtctcggaaggcaagtgaacaacgaacgggggacggacacttctgtaaaatctaagtgaaacagcgtcaaaatacctaaaaaaaactttctttctaaaaattcctcaaattgccataggcaataaattgattttaaatattttcctaattgatcatttattttatcagaaattcattcactttttattttattattattacgtctttttcttatttcgttctcctcaatataagcagttttcataataaattatctaacttaaaaaa

SEQ ID NO: 90677 - DNA, 184 bp, Heterodera glycines
  SCN-specific regions: Sequence locations=1-7,39-111
agatacggccacattccttattatttattttttgatttcattataccctctatcactttactctgtgagaaaaatttaattgtttgctaaatttttggcaagacttccttgaaaaaataaataaaacaaacgaaaaaaaaaaaaaaaaaaaaaaaaaaaaaaaaaaaaggaaaaaaaataaaaa

SEQ ID NO: 90678 - DNA, 359 bp, Heterodera glycines
  SCN-specific regions: Sequence locations=1-203,225-306,342-359
tacagtccatgcagtaccgtatcatggcccaattattcaccgtagtgtcgctggttgttggcacgatgtatttgtcgagtaaagacagcgcaaaatgagagggacagaagagagagagagagacaaaaatgaaaacaaataaatgcatttacagtacctattgttttaaggtagtcaatcgtttactgtagattctgattgctctttttaattgtctatttatttgcattaaaacagaggaccaccaaaccgtagataattagtgttgtaaaagtgctaatttaaggaattcgtagctgtacactagaattcaatttttgtttttaaaattttaattatgttcataaaaaatgtcgaag

SEQ ID NO: 90679 - DNA, 407 bp, Heterodera glycines
  SCN-specific regions: Sequence locations=1-322,344-380,402-407
atcatccaccaacattcactttcgatcggaatgttttggaacaaaatgaattggacggcgatgacgaaagggcgaaaaaatgaaagattatctcctttcgattgatggacggagatcgattgatcactcggtatggagtagtgatcaatcgatttaccaatcgattgatcactcattttgatccgttggattaaatcgaaaggatttaacggacaaaacattaaaatgaccagcacagaaaaaagaccgaataattaatgaactgggctttgtctggtcacatcgttcgaatttgtgctttgatctcagccgccagatgacataaattaaaccggggaaaaaagcgattctttcaaaaaatttccatgtgtcgttttttgctcaagaaaataaataaaaatcgtttc

SEQ ID NO: 90680 - DNA, 474 bp, Heterodera glycines
  SCN-specific regions: Sequence locations=1-175,257-280,302-474
aatgtggaaagaggactcggaagcgtcagaagattctcacccgctgctgtggcgtcccgaaatactcaaaaaacagcgtttttaatcctgttgttttaattttgcattatacatgtttttaattataaatgaacaaacccaaaaattacaaacgcacaaataaataaatatggacaaagaaaaaaaaaaaaaaaaaaaaaaaaaaaaaaaaaaccaaaaaaaaaaaaaaaaaaaaaaaaaaaaaaaaaaaaaaaaacaccacaaccctgtgccctccgccttgttaccactgctttattagaaataggggacccttcttaaggacccaagctaagtaacgcgggcatgctacgccatagtccttctataggggcacctaaattcaatcctcgggccgtcgttttacaacaacgggacggggaaaacccggtcggcacccaactatatccccctccagcacacccccctttcgca

SEQ ID NO: 90681 - DNA, 484 bp, Heterodera glycines
  SCN-specific regions: Sequence locations=1-67,89-134,156-328,477-484
cctcgttttcttcaattttacactcgacctgtaattttcaattttgaaatgttcacgaagctcttcttcgctgttctgcttcttctttccgtgctcctctcatttgagcatccttcccaaattgccgtggccaatgcttttccttcggaagtcaacggccgaatgaatgagcacaggcgaatcaaacgcctcagctgcaccaacgacaaatgtttcaagaattgtgcaacggaaccgggctcgcagaaggaatgcgcgagtatttgcgaatgcaattttagcagcgggtcgattaaggcaaaacaaaatgattgaaacaaatgatggagaaagaaaagtgaaatggggagaaaaaggagcgaaaagtggtaggaaaaggaacgaaaagagggaagaaaaggagcgaaaaaaggtagaaaagggagcggaacgatggagaaaaaggagcggaatgagggagaaaaaggagcgaaaagcgaatgag

SEQ ID NO: 90682 - DNA, 505 bp, Heterodera glycines
  SCN-specific regions: Sequence locations=1-125,154-294,316-427,449-505
caagttttttacaaccacttattgccaatttaatttcttgcagatttaaagccatccattgcctgccggttctcggcacagcaaagcactaatacggtgtttgactcacttcaaaaaaataattcattacccaaaagttttttacaaccacttattgccaatataatttcttgcagatttaaagctatccattgcctgccggttctcggcacagcaaagcactaatacggtgtttgactcacttcaaaaaataattcaacacccaaaagttttttacaaccacatattgccaatctaatttcttgcagattgaaagccatccattgcctgccggttctcggcacagcaaagcactaatagggtgtttgactcacttcaaaaaaataattcaatacccaaaagttttttacaaccacatattgccaatctaatttcttgcagattgaaagccatccattgcctgccggttctcggcacagcaaagcactaatagggtgtttgactc

SEQ ID NO: 90683 - DNA, 350 bp, Heterodera glycines
  SCN-specific regions: Sequence locations=1-181,208-350
cagcgctcagttagcggcggagatgcggcgcagtcgcggatggacaaatgggtaccgaatcggacagtgacaaaaggccaaaacgaaacgaaaaaaaagacacttcggcaacgccataaaaaaacaaaggcgcatcgaacagttgaaaagccaggcaattagcggaaagcaaacaattaattaatggctaattttgttttttgtaaatacccatccaaaacaacccccggggcattcgttcttcactcatttatttgtttaacggcgcattgaatctcagtgattttaaacacataatttatttctcacgaattgaaatgataaagtcggtttgatacccaaaaaaaaaa

SEQ ID NO: 90684 - DNA, 875 bp, Heterodera glycines
  SCN-specific regions: Sequence locations=1-428,452-563,585-617,650-875
agtgcggaagaaatcgcacgaaaaattggaaaagtaagggcgaaaaggggatggaggagaagccatttaccaaataaagcacaatcacaaaaaacacatttcaataatcagaaccgtcgaccctccggcgacgtcgtcgtcctttcgcttcattggggcggcaattggggctacgaaatatcgaagacggagagagactttgctcatcagctgatcgacagtgggacggtggacattttgtacggtcactcatcacatcacccgaaagcgattgaggcgcataaagggaaattgattctttacggatgcggtgactttctcaatgactacgagggcatttcgggccataatgaattccatgacgagctcactttgatgtacttcccagttgtcgatggcaaaaatggcataattattcggttagatgctgtgccaatgaaaataaacaaaatgcgcctgaaccgtgcaaatgccgaggattctttatggctttatcggacgatggcacgcgaatgtgccaaattcggtgtccgcgtacaacgcgatgagaagacaaatgttttatcatttctttggtgaaacgaaaggcaatcagtttcatttggatatgaatattctaattttatttaattaattaatttattttttacgactatttattaaacgatggaattattctatttattcaaaggcattatcatttcacccttttgtcatttttctccattataaatttacagcttttgccttttctaatgcccagaaatgtaacggtccaacaaattttggtaggcgaagtgaaaacggcgaacgatgctcaatttgtgagtgcgaattgttcagtcacctttggtggaagagaaaacgagcaacga

SEQ ID NO: 90685 - DNA, 121 bp, Heterodera glycines
  misc_feature (97)..(99): n is a, c, g, or t
  misc_feature (101)..(103): n is a, c, g, or t
  SCN-specific regions: Sequence locations=1-43,65-87
atgttataatgatacattattgaaactgtttaaaattgtgtcaaaaattattttttcttcaaatttttgttgtcgtaaacttaattgtttttttatnnnannnaaaaaaaaaaaaaaaaaa

SEQ ID NO: 90686 - DNA, 490 bp, Heterodera glycines
  SCN-specific regions: Sequence locations=1-87,109-490
tgatgaacaaaatttatgccaccattcatttcttattgcttttgactgtcattgctaacaaatcgactaactgtgctacaaatggtcaaggaactcaaactgttaaaacagcagatgcaacccatgatgaagctggaaaaatttcgcgtgattcatcatcaagttccgatgaagatgactcaacaactgcagcctcaaaaatgctactgaatgaagcaaataacgctttctccaaagataatgatgagccgattaaccagcagcagaaaatgaggcctgaagctaattttagcgttaaatatcttcccccgagactgaacgctgcacaaattgacaacattgcacaacaagcatcatccatgatcacattacgcacattaaaacatgtgaaagaagttttttcaaaatttgcgccagattcatggctggaagcactggaagatattccactgccgactattcgctgcactgtcaaagtgagcgccaaagt

SEQ ID NO: 90687 - DNA, 396 bp, Heterodera glycines
  SCN-specific regions: Sequence locations=1-396
acagaaattaacacgactcattgtcacttttgcagagattccctcattcgtccgtcccttctcacttcccaggacttggattggtttttacattacagaccatcgataagaaatacctaaaatatatgtttaatctactaaattgattgcatcatcctcttttacagaaatttacttctttttttagtagaatattaccacatatgttttggtcattcttttataaccaatggcttcgtttctcccagcaaaagtttcatttgcttttgcacgatgaaaggctttttctgtttttggccgattttatgttggcttctgcgctgattacatttgtgactttcacattttttggaatgcgtgcttcttacggaagatatgcagctttgtctttctttt

SEQ ID NO: 90688 - DNA, 562 bp, Heterodera glycines
  misc_feature (70)..(70): n is a, c, g, or t
  misc_feature (172)..(172): n is a, c, g, or t
  SCN-specific regions: Sequence locations=1-499,552-562
tctgctgagattcccccggcaaaaagtgcgattaatggcaatgataatgcaaaaagaaaacacaaattancggaccaccgaccgaccaaagacaaagcaaaacaatcgccgcattctttgctttccatttaattccaatttagttcaacaaaatttgaatggataccgctgngaaagacaatcaaatgccgagcagcggtcgcttgggagccgaaaaagccattggttatcgaacaaatcgaagtggcgccgccaaaagagggcgaagttcggattaagataatgttcacggccatctgtcacaccgatgtttttcaagtcagtggcattaatccaaacgtcaaatttccaacgattgtcggccacgagggtgccggcgtggtcgaatcggttgggccgggcgttgaaagtgttcgggccggcgatcatgtcattccaatgccgttgtgccagtgccggaagtgcgaggagtgcgctgacccgaggacaaatctttgccaaaaatttttatatttgtaaaaatagtattttttaaattaattaatttaattgtcataaaaaa

SEQ ID NO: 90689 - DNA, 589 bp, Heterodera glycines
  SCN-specific regions: Sequence locations=1-154,181-250,272-589
ttttattatttctgataaattttgagaatggagaaaaacaccgaaagcctttccaagttggatcctagcgaaactttgggaaccgatgccctcttacaattgatggaactgatcaaactgaggcctaaacagaagcagggggaagtcgagtcggaaaaaagggaaatggaaaaaccaattgcggactttcaccaccgcaaaacggatcagataaacccggacagcagtgaactgaagaaggaactgcgtgaaaaagggaaattggaaagttacggacgaatcactgatgaaaagggggaggagaaagattcttggggccatgcgcttcagaaggaattggacgaaaaggtgcgaaaattcagagagctcaaccgaaagaaatgaacgagaatttaattgattttaccggcattttcactttttcacaatgttagaaatttatagcattattcattttgtttgattcgttcattcggcacaacaactcaaaaccagaaaatccagggattatgccacacagaaaattgttattaatataacactttaatatccaattttgtttcctatgacgaataaagctctgactgtg

SEQ ID NO: 90690 - DNA, 480 bp, Heterodera glycines
  SCN-specific regions: Sequence locations=1-95,117-480
tttgtacgctttgttcgatgggcatgccgggcgacgtgcggctgattattgtgccgagcatttcgctcgattgttcgttgctgttttcaagaaatgtgggaaaatttctatgaaacattattttttatatatacagatgtgcccccaaagagtgctatgtcagtattcgagaaatccattcgtaaagtatttgtcgatacttataagggtatcgatgatggtttccttgttgaagcaagacgacagaaaccaacgctgaaagatggtacaacggcgacaaccatttttttattggataaaacgctttactgtgctaatattggcgactcgaaggctattgtttgtcgacacaaatctgaaaagagcacaaatattccgctgcaaatcactgtggaccacaaccctcttgttttgacgaacgaatgcgtattcaaaagtccggcggaacagtcaaggatggccgagtttttggcattttag

SEQ ID NO: 90691 - DNA, 610 bp, Heterodera glycines
  SCN-specific regions: Sequence locations=1-51,73-450,474-610
ggacttcattttcaaactactctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgacaaagggaaaacagtcgctagacagtccaaaccatgaaaaagaccataaaaatgagcatgaaaagtatgaagcagcttactttcaaaaaaaaccgtcgccagacagtccaaagtatgattccccaattttagccggttcatctggcagtccgaaaaaaggaaaatcgccacatgccgatccgaaaaaagctgcttcacaccttgtgccagtaacaccagggaaagtatgatgagcaagccttaaaatggtgaagaaactgtgtggaacgatgatgccaaccatgaacaaacccaaagctgttgtagtagatgtagaaaaaaaactgtggtatcatcacgctattattgttgtgtaaaaaacgatccgtttttacctcttttcgggaaaaaaaactgcaaaaaattcacaaaaaaaaaaaaatctcacattgtgca

SEQ ID NO: 90692 - DNA, 544 bp, Heterodera glycines
  SCN-specific regions: Sequence locations=1-544
aacatttccgaagcatttcccatgaccgattcaatcggcggcatttgccgaagtcacctgtgccgcagtcagtcggccacaaatgtgcccgaaagttgggccgaccgcccgtatccgaagatgacgcgggtccattccacgacggacatcgcacagcgatacgcggagatcaattcgcccacgagatactggcccaaaaacaagccctattactggccgatgaccagcaacttgtgcaacatcgtctccaattacaacttttacccattgttccgttcttattggccttcctatcgcagttatttgttggacaccaattgggacaatcgccgcttcgaccgtttccaatttttgccacccgattcttattatagctattggccaatgtcctgcagttatcactattggtaccattatccatatttcaaacgatggtatctcggaggcctcggtggagtttcgcaattccacaaacaatgaaagtgaaaacggatgtatagcacagaaacacaatgacgcgtaccgtaccctttaccgtagttcg

SEQ ID NO: 90693 - DNA, 171 bp, Heterodera glycines
  SCN-specific regions: Sequence locations=1-124,147-171
gatgtgctcgcgtccgaattgctcgccgcgatggaaaacgaaggactgaccattcaggcgaagcaggagctgcacaaaatgtgcgagcagaacagaagttactcgagcatgaagaaattctgactgtttttctttgttttgtgatttggtctaaatttgatccgttaaaaa

SEQ ID NO: 90694 - DNA, 402 bp, Heterodera glycines
  SCN-specific regions: Sequence locations=1-30,53-120,146-301,323-402
tattttcagcattactctcacaatggcgtcaaaaattaaaccattaatttgtccgtcgatattaaatactgatctgtcagatttggctgatgaggtgaagctgttctaatagcatattataatattcattatgtgaaattcaaatgctttgctttagtgtcgaagacttatggccgctggtgcggattatttgcatttggatattatggacggtaaacggacaaaagcaacaaaaagactcgaaaattaactccctattaaagggcaaacaattgcgacttatttgagtcctttgccatcatttcccttccctcgcattctttcgttttgctttaggccatttcgtgccgaatttgacgttcggacatccgctcattgaatgtctgaggaataaactgggaa

SEQ ID NO: 90695 - DNA, 674 bp, Heterodera glycines
  SCN-specific regions: Sequence locations=1-173,195-204,227-348,383-674
aataaaaaatcgaaaaaatgaaaaatttccttacatttttggcttttttcttaatagtgccatgtttcaaggctgacaatgagaaaaacaaagcggcaccacgagtgtttgctgaacatccggggccaaaattggtggacgaaaccacgcgatggagcaaatgccaagcggaccaaaacctgaccatttatgacttcgaagtggaaacacttgacggcaaattcaccaacttggagaagtacaaaggacaaattgtactgctaattaatgtggcaacattttgcgcgtttacccaacaatatttggacttcaatccaatgctggagcgtaaccgtgccaacggcgtcccattgacaattttggcatttccatgcaaccaattccatttgcaagagccggccgagaaccatgaaattctcaacggggttatgcatgttcggcccggagacgggtggaaaccgcactccaacctgcacatccatggcaaattggaggtgaacggcgccaacgcacatccgttgttcgactttttgcgcgactcgtgccctcaaacggtccctgtgcttgggatcaaggaatcaatgttctataatccgatcacggtcagtgacatcacttggaattttgaaaagtttatgatcgacgctaacgggattcctcgttttcgtattcac

SEQ ID NO: 90696 - DNA, 134 bp, Heterodera glycines
  SCN-specific regions: Sequence locations=1-54,76-111,133-134
ggttcaatgtttacggagggaatctccgaaggggtgataatccgaaagatattcataaatgaattaaaaataaattaacaaggaaatacgaaataacgttcaatgaaataataaaattcacttttatttaaaaa

SEQ ID NO: 90697 - DNA, 657 bp, Heterodera glycines
  SCN-specific regions: Sequence locations=1-53,75-206,229-459,483-657
ggacacttcattttcaaactactctctctcactaattgttgcacattccccaattttatttcttccttagtaagtagtattggtgcacaatgcgcacttttctgttcatagccgtagtcgggttgatgttggccgtcatcttggagaatgtaaatgcgactgggaaaaattcgccgtcaaagggaaaaccgtcgccagacagtacaaaccataaaaaagaccataaaaatgagcatccaaagtatgaagcagaacttatatatgagcaaggaaaaccgtcgccagacagtccaaagtatgattccccaattttagccggttcatctggcagtccgaaaaaaggaaaatcgccgaatgccgatccgaaaaaagctgcttcacaccttgtgccagtaacaccagggaaagtatgatgagcaaagtcttaaaatggtgaagaaactgtgtggaacgatgatgccaaccatgaacaaacccaaagctgttgtagtagatgtagaaaaaaaactgtggtatcatcacgcttttattgttgtgtaaaaaacgatccgtttttacctcttttcgggaaaaaaaactggaaaaaattcacaaaaaaaaaatctcacattgtgcacccttttctatcatttgtggagtaaagaattttctggaaaa

SEQ ID NO: 90698 - DNA, 723 bp, Heterodera glycines
  SCN-specific regions: Sequence locations=1-695,719-723
gcattgttgtgatcggcttcaaaccgttgcatttgctgaaggattcgcatcggatgggcgccgccgtttttgtctatcccatcgaatcggtaatctccggcagttccgccctttaccgtgcccttctgaagcgctgtatggacaaacaattgtttgtcctcgtccgttatacgcataaaacgaacactcctccaaagctttgtgcgctcgtcccccaatcggccgaccgaattccgagtggttgtgtgagcagttccatccgaatggatggtcactctcatcagatgcattttttagacactcgcgcgcgaatatttctacgacggctttcatttggttgaaattcccttcgcggaaaagtcgcgatcgatggaaaagcgccttctaccgccagatggcggaattgggacatggcaattggccaatccggaccaagtggaggcggccaagcagttcgtcaaaaaattgaccaacaccaaattctctccggacgattttgcaaatcccgtgcttcaacagcattacaaagctgtcgaaatggtagcattggatttgccatttgacagcgaacagttcaaaaaagaggcagcggaaaatgacaaattaattccgtacttcaaaaatccaacttttgagcagagagttgccaaagaattggaagaattcgcagggatttgtgagacaattgcagaaacaagggagaaagggaagaggaaaagtgca

SEQ ID NO: 90699 - DNA, 867 bp, Heterodera glycines
  SCN-specific regions: Sequence locations=1-486,508-808,830-867
cggaaaacaatttcactgacaacacaacgtgggacagccgacttttggactgcggctcgatgatgacgcggtccatttcgcctcttaagggccaatcggcaatgttcaggggcgggtcaactgtaccaatgcttcaatgccgtgccgtggacattcacacgtcctcaccgctggcggggctgggacagcgcgcaattgccgtaatggacgacggggactttggcagtgtggacgacgtgcagcagaaataccgcaggacgggaagtgccggcacaaacattctctaccgtatccgtcgagaagagcttgcccaaggcaaacatccgacagttcgtcaaatggcccgcgcttttgaatcatttgaaaaactccaacaaaaggggaacagcagtgaggagccaaaacggaaaagaataaaaccgacaaagggcggactattcggactgttgggcaagtcgagttcgatggaagtcagctcaatgtcggaaaagaatttgaaaactccaaaggcatttcgaaagggcgaacacgtgcccagtgaaaaaatgcccggttcaaacgaacggacccgcggaggcggcggcagtccttccccgtttccgtcgtcgtcgcttccgcgcggggggcgcaatccgttcaaagggatcagttcgcgcatcgtggaacgcgtgcgcaggtcgctgtcgcgcagtaaaaagaatttaagccgcgatggaggacaaagtcgggacggaacgccctcacagaacaccatcggcataaaagcaggtggggaagtaagagaagaagtggactgatcagtgaggaacaaaaatggggaaggaaaagattgatcaatggagggatggggataagtgaactgatcag

SEQ ID NO: 90700 - DNA, 531 bp, Heterodera glycines
  misc_feature (324)..(324): n is a, c, g, or t
  SCN-specific regions: Sequence locations=1-44,66-159,278-289,369-483
ggaccattcaatttaattatacccaattaaaaaaagtaaatcctctttaaaaatgaaactttcaataattttattgctttccttggccttttgtgcgttaatcatcgatgcatatccatcgggaaatggtaaagatcttgaagctgacaacgaaaaaacggaagtgaaggaagagaagatggaaaaaagagaagcggaagtggaggaagggaagaaggaaaagaaagcagcagaagaggaggtagggaagaaggaaaagagaggaagtggaggtggaacatggggcaacggaggaagaggaaacgaagaaggaaacggaggagngaggacacggaggaggaggacatggaggaggacacggaggaggaaatgacagcagcggcggaggtgatgattagaagccatagctaaaaagaaggagcataatatggaactaagaaaagaacgagcacaaaatgcttttagtcgcttattttttgctgcatttaaaatgttaaattttaaaaataaaaataaatttttgtattttta

SEQ ID NO: 90701 - DNA, 736 bp, Heterodera glycines
  SCN-specific regions: Sequence locations=1-736
atttgaaccgggcaatgcttacaatccgcaagttgtgtgtgaggcgaaggtcaaaggacagcgtttgtttgattggtgcgagacggaagagcggaagaaacggatcaatgggcagattgacctggtccaggctgaaattgaagcagtgactcgtctacggcgttccttgcccaataaatccggtgttgattttgaacgcatcgaacatcgtcttcagtcgaatggaaacggtccaacgtggaggacaatgccgaaggggacattagcaaatatggcgaactgtgtttctcactttcgaaggaccattcatccgtcgcttttgctgttcctgttcaaaaagcaatgcattgacccattctgtcgctgaacgggtggttggcctcctctcctggcatgatcgtgaacaaatttccggcctctttttgacattgaacaaactttttggacgccatttcatgcgccgttctgttgctgcccgcttacaacaccgttcatcacaaacgaccctcaatgttcaaacagtgaatgaagaaggactgggcgaagccattgacattgattgttcgccaattaccaaccccgtgccgtccacttcccgtgcccatgctcaaattgattgcaatgccggactcttgggaattttgaaccgattggaccgtttgagcgaaacagtcgaggcgatgcgcacttaccagttctcgttgctgacgactcaaaaactgaacgaatgggacat

SEQ ID NO: 90702 - DNA, 209 bp, Heterodera glycines
  SCN-specific regions: Sequence locations=1-115,140-209
ggcagtgagaacaagcggagaaatggggagatggacggagagtgctttgtggacaaaatgagtggcaaatgggatagtagccaacaataaattcttttgctgtgtaaaaggtgttcgttttcaaaatctgcctcattttatttgcctactgtatgtatttaccccttctttctgctgttacggtgtgttttgttgtgtattttgttttt

SEQ ID NO: 90703 - DNA, 56 bp, Heterodera glycines
  SCN-specific regions: Sequence locations=1-31,54-56
ttcatttgctggtaaccaatttcagaatgtgtgtaattaataaataatttggtgca

SEQ ID NO: 90704 - DNA, 408 bp, Heterodera glycines
  SCN-specific regions: Sequence locations=1-90,112-351,373-408
gactcactatagggggcacaattagtgagttaaacattgaatttgccgggggttggccctcgcacacaaaatgccccaaaaatgccggcactttgggcattttccaaagtcactgattgatttgccattcctttctccaaattatcccaacggaagtctaacacaacgaattattacgatgccaataacagaaaaaagagtgccgttgaggatgaaacgccgaaaatcgaaaatacattctcgaaatgtgttccgaacgccgctgataattcccgaattggaactgatgaaaaagtggcgaaacagtcgaagaaatgacgaaaagccaaggggagaattaccaagccaaggggaagatgaagcaataaaattattgctgctgaatgatattgggcaaagtgcggaaga

SEQ ID NO: 90705 - DNA, 631 bp, Heterodera glycines
  SCN-specific regions: Sequence locations=1-84,106-301,324-335,364 -408,430-631
tgccgaaaaaataaactgaattaaattggatttatttttgaagctcttagtttgccatgaaaaagcttcttctctgtgtgtttctgctgcttcagtttctgctcgccaccgatgcgatttcagtgcaaagcgaagttggccaaccattttttgaccaacagagcgaatttggcacagtgccattgagcgaaatggaaaaacgtcgccgtaggcgcttttccaaactaaaagccgccgccttgggagcagctgccggattgggagccgccgtcattgccaaacacgcgggatgaagcggaacgacggaagggagtaaaagaaaggagccgaagatcaaaaaaataaattttattttgtaaattagatggatttgtaaatttgtttaaaattgcttaaatgagaatcttgagaaataacttcctcatttttggggtgctctcgtctcgcgtagtcaattaattctcgaactcaatcttgacttggtttgctttttgcctatgactccctctcgccgttttccgtaacccttcgttagcaaatgatccaatcttttgcggaattgtcgtcctcgtgtttcttgctcatctaattgctttgtttaattgctctaattaattaattgactatgaaa

SEQ ID NO: 90706 - DNA, 559 bp, Heterodera glycines
  SCN-specific regions: Sequence locations=1-289,311-559
ttcacatttatttccatcgccttgctgtgcaaacaccaccgcagcaaacatcatataaatgctggaccattggacgctgaaaaatcgccttcaaatggtgaaggaatccacaaatatgaagcggagaaattgaaaattggagaagttgcaaaattgaatcatggtgaaacaaaaactgaaatggatgaagcagatggccatagacattcattgccaaaagatcgtggcgatattgtgcatccaaaatctcaggacggagtgtgcaagattcatgaggatgtgaagcttgatttcaatgatgacattttcggccaacatgttagtggagaagaacgtccgccagtggccgagccaatgccaatgtcagcttaaattggtggcattttgagaggacacagatgagagtgtgttgttgttttttttgggatttatttagttatttatcattgttagtctcttttttatgttagcttttgtagtcatttttttattagctttaccacaaccttttttaaatgtcatcatatatatacctcaggttctttatggatattactat

SEQ ID NO: 90707 - DNA, 420 bp, Heterodera glycines
  misc_feature (366)..(370): n is a, c, g, or t
  misc_feature (372)..(375): n is a, c, g, or t
  misc_feature (377)..(377): n is a, c, g, or t
  SCN-specific regions: Sequence locations=1-66,88-360
tcgggtgggttggcttaactggtcctctgtacttttccgcatagtcaattcggtttgcacgcgggtgaaaacattgccggatctgtggcagtgaaagacaaacgatgttttgatcgcctcgtcgtgcaaattgagcgcaaatcgaccaccgaaaagttcgatgttctccaatgccgaaagtgtgtgttcaactcgtgttggcttggctcgcgcactttgcacgaccaacgcacttatctgaccaacctccgatcgtattgaccaaagaatatacggataacaaacaatgataacaactaaattattgacaattaaaatgtccaaaatgcattttgatcggatgaaaaaagactttccgccaaaaannnnnannnnanaaaaaaaaaaaaaaaaaaaaaaaaaaaaaaaaaaaaaaaaaaa

SEQ ID NO: 90708 - DNA, 812 bp, Heterodera glycines
  SCN-specific regions: Sequence locations=1-784
aactgttgcatatttttttcccaaaaatcttatttcaaactgttaattaatcatataataattaggcaatttgtaattgaatgcaaagtgttctcaaaagatttctgtcaactgaagcgccaacaacaaaagaacgtttaccatccaaatacgcgtggttatttaacattgtcttcagcgaaatcattatatttggcggcacttatttgtctctattggagttgcgcaaaaacaaacaggcacgacttaaactccacaaatattggccgagtgcattgaaacatttctattgggctgaagaccaattgtccggcggtcagctcaccggcgaaaaacttaaagtcgctgatttgaagagttggaatatcgaaggcaaagtcaaaacccagcagaaggaagacgccatttacacgtgcgagtgaacgacgcaaaaacaaatggttcgccagtcctccttttattacatgatggcgggcaacatgatcgttattgcgattttcgcggacagggccttaacgagacggtactttggcaagaagatggagccgatggcactgccctcgtggaatgcttttgtgaaaacggagttgaaagaaggcagggaactgacgatgccaattagcgacgacgaaaaattaattaattaacggacgattggttttgttcctgcacattttacaacttattatttcttttttgctggtttgttctgcacatttattcaagctgttctattgaatttaggctttcaacaaaaatttatggaaaaataaaatgaaatattaaaaaaaaaaaaaaaaaaaaaaaaaaaa

SEQ ID NO: 90709 - DNA, 1188 bp, Heterodera glycines
  SCN-specific regions: Sequence locations=1-27,71-71,104-104,127 -177,201-1100,1124-1188
tcgacaaagggcacagaaaggcggagttggcaaacgcgcaaagaattgctgagctggagcaacagttggtcacacaaaaaggaatggaaaagcaaaaaattgcacaagcggtcgaagaacagcggaaattggacgaaagtctttccaaaatggcgttggaaattgagcggagacggaacagagaaatgaccactggcgcaacacaaactgatcacctcgtcggctcaacgcgcaatgagtcggatgaagccgaattggacgcgcaactgaagcgggcggcgcttgcacacgccgaacatttggagcgagtgatcaggacacagaagcaaatccacgacatggagactcagcagattgtgcaggagacaattgccattgagcgggacaaatttggcaaacaaattgaaaatggactcgtaaagttggcggccattgaagaaatgctgaaaagtcgcgcaacaaaagatttggagaaccgaagggccaaaatctattggacaatttgccattcgctgacggacgcattggccaatggcggcacggcacagagccaaaaaacgacttactataaaacccaactgctggaacagattgctgttctcaaaaaactcgtccaaaatgacgcttttgctcagtccgtttgcgcccatttcccatcggacgatgccattggacggggtgtgccgacagagcagggattggtcaaacgcttcgacggggtgtacaaattggcccgctgcacggcacagattggcgacgagggcggcactctgtggcgctacatcacctcctggctccagtcgctgttcaccttcgagctgccctacgcgtactccgccgacgaccggctcgacctgaacagatacgacccgtacgagctgttggcccgctgccggcactttgtgcagcagagggacctgctgaacgcagtgcgggtggccaatctgatcagaggcaagtcggcccgcattttcagcgattggctcaaggacgccaaattccatctcgaagtgcgactgctggttgagctgctcttggcacattcccaggcttcgggaattaggacgacatattgaaaataggcggaaacgaaacaagaccagtttaatttgtccaaaaaatattgattggaatgataaagtttagacgacccatttcggacaacccgcaaagcccaccgacaaaaga

SEQ ID NO: 90710 - DNA, 55 bp, Heterodera glycines
  SCN-specific regions: Sequence locations=1-55
cgagaagcaaaccgagcccaacgcatccaatggcattgacaaaaaaaaaaaaaaa

SEQ ID NO: 90711 - DNA, 184 bp, Heterodera glycines
  SCN-specific regions: Sequence locations=1-162
gattgtgacgctggccaaagaagcggcggtcgacgtgaaatttgaactgtcaatttgattaggctttatttgaccgactgacgacgtgtagaaagaaatggacacagagaaagaaagagatgtagaaattcgtaaatttgtaagataaaaaaaacgatatttaaaaaaaaaaaaaaaaaaaaaa

SEQ ID NO: 90712 - DNA, 670 bp, Heterodera glycines
  SCN-specific regions: Sequence locations=1-276,298-445,468-670
ctaatctaaggttaagaaaccaactattgcgatggctgctaatgaaaatatgcaaacagaagacaataaaaaaggaaaagtgaccaatgatgagcgtaacttggtcgtctcatttattcagtttttgcgtcacaaagtctcatcgaaccaatgcactgatgaacagattgaaggccttgaagttgctattcaatgccttgagaccgccttctttgtttctgacagaaactatgcgttccaaccgtccaaacctctcatcgaaattttcaaagcagctgaaggacttcccgatggggatcaagagtttcctaagccgactcaaacggacgttgagaagtcaaacgcattgaaggaagaaggcaacgaactcgtgaagtcgaacaagttcgaagaagccatcctcaaatacaacgaagcaattaagttgaatcgcgaccctattttcttctgcaacagagcggctgcttattgtcgtctggagcaatatgatctcgcaatccaagactgccgtacggcattggcattggacccgaaatatgcgaaggcttacgggagaatgggcgttgcactttcatgtcagaatcgttacgatcacgcggttgaagcgtacaaaaaggcattggaattggatcctggaaacgaaagctacaaaaacaatttgtccatcggc

SEQ ID NO: 90713 - DNA, 428 bp, Heterodera glycines
  SCN-specific regions: Sequence locations=1-268,290-428
tcaaagattattcccagaattgcaaactctctcaagactttctgatcctttcgaaagcgagttcagatcactgcgccagttctcgcaactgcctgccattgatgtaaacgaaaccaaggaagcgtttgtagtccatgccgatatcccaggcttcacacgtgaagaaatcgacatctccctcaacggtccagtcctagcttttgaaaggaaacaaggaaaagaaggaagaaaagaaggatgaaacccagcacatccaagaaagaatccagagctcgttctacagaagcattacattgccagaaacttttgcacctgaaaatgtaaaggcttcattgaaggatggcatcttggaaatcacaattccaaagaacgctgtaaccaaaaagattaccatttcataaataaattattgcctctgaaaaaaaaaa

SEQ ID NO: 90714 - DNA, 544 bp, Heterodera glycines
  SCN-specific regions: Sequence locations=1-16,45-350,373-544
ctttttattttatcccaatttttagttttatttatttttaaatagcgcataaaaaatgacgacaaattgggagaaacttagaaaggaattaaacgaaacggaagaaaagggaaaaggaaattcgaagaaaagaaagcgaaaagtgagtgaaaattgtaacaacaaatggaagaaaatgcgagaagaaattgagaagaatgaccagcagaagccggaaaaggcaattgaaacgacaattagcgcaaagaaaattttgatggccatcgattgcgaatatgttggagttggactgaatggagcggagaatatgttggccagggtatcaattgtcgacgccgaaggaatcgctgtctatgacaaatacgtcaaaccgaccgaagaagtggtcgattaccggaccaaagtgagtggcattaggcccggccatttgctccgtggcgttccctttgtccaagtccaaagcgaagtgaggaagctgctctcagacaacattctgatcggacactcacttcgaaacgatttgactgttcttggcctcactcat

SEQ ID NO: 90715 - DNA, 304 bp, Heterodera glycines
  SCN-specific regions: Sequence locations=1-136,158-304
actggcgaacacgcaattgcccgccgagaagatgaagtgtttggtggagcattcgctccgagattatcttatggtctctctgctggccaatttggccaagactcagttggccctgcaggaaaaagtcacttcctcgtaaagttttgaccagtcaaaccgttgcggaaagagggaaagcgaaccaataaacgtgattcgagattattgctttgtgtccattctgtcattgttttgttactccattttcgttattcgcagaactgttatcagaaattcatgtatcatatatcatcattttgaaaaa

SEQ ID NO: 90716 - DNA, 531 bp, Heterodera glycines
  SCN-specific regions: Sequence locations=1-531
taagatacaaagcgaaggatggccaatgctgaagaggtttgcccaacgtattctgaggccttttcccatgggaatgacgacggttcgttttgcactatcactgagtttaaacggaataaactcgaaaccgaagctcgcaagaattgggatcgcttctacaaaagaaattcggacaatttcttcaaggaccgaaattggacaaagcgagagattgagcaaatgtgcgcaaaagacatggaactgagtgctcctttgactttgcttgacgccggttgcggctgtggcaacactttattcccattggccaaattcttccccaattggactttctgtggcgtcgatttttcctcaaatgccctctctttgcttcagcaaagggctgtacaaattggaactaacattcataccgaattggtggatctgtcgggcgataccctcggcaatttctcttcgcttcctaaagctgatctgatcactctgatcttcgttctctcctccatttccttggagcatcattcaaaagttgtccat

SEQ ID NO: 90717 - DNA, 674 bp, Heterodera glycines
  SCN-specific regions: Sequence locations=1-158,180-505,527-674
ttcagcagctgaatgtaaattgcataaatacgacataacataatgacgggtgtttgtgagttatcggaaaaacattccaaagttcggttacatttgccgctggaattgcattgtgagctgctttctgcgcttccctttgaacatgccgctcgtctgcttttactttctaaagcaattgccaaaaattgcaattctctcgtgcaaaaacaaaaaaaagggtggaaggtcttttccaaaaattgtatcgacaaaattatgaaagtttatcacccgctcgtctctccaacactgaaaagcattgaagaggaacatcattcacttgagcattcggaagcgcaccagcaagacacatatcttaataagcgtattcaagattctcgtgccgaactttcctttttcgttggtgccaatttggtgcggcgtttggcaaaatatgaaacggcaggccaagtgatgaccgaactgttgaacagcgtcgttaacatgcaccaattcattgaaaactttaagaagcgaatgaaagaaatggacgagcgattcaacgaagtcaaaaggcttgccgaccgaataaagtccgatttcctaccgcgcgacattccgtcccaaatgtttccgacggccaccgtttggtccgctgaacgtcttcggcgcgattacactgaccatttgcgtgc

SEQ ID NO: 90718 - DNA, 287 bp, Heterodera glycines
  SCN-specific regions: Sequence locations=1-45,67-85,107-229,251-287
gcaaagtcagcagcacaattgggaggaagagtccaaaggcgatggaaatgaaaggaaaaattggacgaagaaaaagcaaccgacgaaggaagagaaaaagaggaaatgatcagacagactcactctgctgtgatggcatttcctataaatatcctaattacccctccccgcttttctatggaatgccctcaaccgaccgacactttgtgcataattttttcactttcactatgaaatatacacatatacagtacatatgtattcaaaataaacagagaatcgaaaaa

SEQ ID NO: 90719 - DNA, 701 bp, Heterodera glycines
  SCN-specific regions: Sequence locations=1-701
gcgattgtaataggagggccaatcgtagtcggacaaatagcttctgtagcggtacagctggttgtagttgatggtcccttgacgatactgtgccaatcccttcgacaggctgtcctccatactgtctagtagccaagagcggtaacggtaggtgcgcgaatacgaatcgtagtaggggtcgtacctttaccaataatagtaccagcgattgtaataggagggccaatcgtagtcggacaaatagcttctgtagcggccccaataggagtacgaagacgaccaatagtacgggttgctgatgtagtcgctgtaatagtatcgacggtaagggaacagcgaacggctcgtctcgatttggcgtggcggtggaggaggacgaataattaagtggatggaatgaatgaacggaatgaacgtggaaaagcaaaatgcaattcatcttcatcaatcatcccttctctgtgtacaacgaaaacgacgacaattgagcaatgtcggaccatccaaatgttgcgctggccgacctcagctgcgtggcaaacgacgtttggctggacactctgttttggattgaccgcgtggaggtgggcacgaagtttgcactgatcgacgcacgtttcggcaagctggtggccacgcatttcaacctgcgcaagtggaggctgggcgagctgggcgttcatcgtgcaccaagcggatgg

SEQ ID NO: 90720 - DNA, 580 bp, Heterodera glycines
  SCN-specific regions: Sequence locations=1-445,467-580
gacaaatgctaaacgaatggcttcaaaaaaagggagtgccatcggatgaggcggctttttttcttgaaacttattttcatgaggtcacagaaaaactttctaaacaaatcacagcaatggaaatattttatcagaacgagaaacaaatattaaacaacttcggaagagcattcattgcttgtcatgaaacttatggaacaaattttacggaaaaattggcacaaattggcattactgagaaaaagttagtgcaaatttgtcagtttttagggtatgatgacaaaatatttgatatacaaccaatcgacagtgatgtgaactttgggcttccggattggaaagaattttgcccaaaattaatggccaataaaattccaaaaaattcagtggttgtaatggacaaattaaattcagtggaaaccgtcggcatgaacaaaggtcaaaatattttaccaaaacttttggcgaagcaaagccgtggcactggtgtttttttgccgaaaaatgcctaacaacgcgtggcactgctttacagtatacgtcgaaggcgaagatggaagaactttgaaaaactgtaaca

SEQ ID NO: 90721 - DNA, 393 bp, Heterodera glycines
  SCN-specific regions: Sequence locations=1-257,311-355,377-393
gtgaattggcatttctctgtttaaaatgcgcttcgttctgtccctcgcccttttggcacttttcgtcgtccaatgctccgccgacgactcatcgccgtcctcagaggcagctgatgagaatccctctgctgcccttgccgctgctgaaccatcagcggcaggcgacggagtgccgccgccaccgccgtcggccgaaggggcggcagccgaacgaaagaagcgcagcggagggaaagtcgcaccggcactaatcctttgaagaagccgaagaagaagagaagaagaagcggaagaacggaaggaagaagaaactttgaaaatttggtagtgatttatgacattatgtgaaaaatcattttgcaataaactgtgaaaagaaaaaaaaaaaaaaaa

SEQ ID NO: 90722 - DNA, 495 bp, Heterodera glycines
  SCN-specific regions: Sequence locations=1-495
cggcggattcagcggacgattcgctgtggagccgataccatgatcaaaatgcaatggaagagttgttggagaaggtgcacagcaaatgccccaatgtcactcgtctgtacagcgtcggccgatcagtccaaggccgcgatttggcggtcattgaattttccctccatcccggacggcatcaaattttgaagcccgaaatggtcagcgatgcacgtaacggtgaaccaattgcaaatgccgtggtgtgggtgagaaatgtgaccgacggagacggacaaacggccatcaaacacccggtgaccacgtggatcactggcgattatttccgtccgttggtctccggctgttaccaaatcgcggtggaagcggacggttatgaaattggcatcaaaacgctaaacatcagtcagaaggacgtgaaggaacgacgtccacacattgtgaacttccaattgcgtccgatcgaagttgaagtgccggaggcgcaaattggaa

SEQ ID NO: 90723 - DNA, 759 bp, Heterodera glycines
  SCN-specific regions: Sequence locations=1-66,88-759
gactctttataccgcggaatccaataaaatttctcttaataaaaaaatactcttcaaataaataatcattcctagctgcttttggtttgatcacaaatgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcgattgaattcttcaccaaaattgcgaaagcgtacggctccaaccctcacttgctttacgaaacgtttaacgagccattggatgtgtcttggaacgatgtgcttgtcccttaccataaaaaggttatttctgcaattcgtgccatcgacaaaaagaatgtgatcattctcggcactcccaaatggtctcaagatgttgacgtggcggcccaaaatcccgatcaaggattcagtaatttgatgtacactctccacttctatgcgtccagtcactttggtgatggacttgcc

SEQ ID NO: 90724 - DNA, 449 bp, Heterodera glycines
  SCN-specific regions: Sequence locations=1-449
aacaaatgcttgaggtcagagcagtcggaacaaatatcggaaaagagcaggatgggccgtcatacgaaatgcttttccgtttaacaacgacaaatagaagcaaatctgctccttttctggccaaaataccgacaaaaactttgaaaagggaagtcgcaatcgaagcaaaaacgaataattcaacaaatgatgacgagaggaaggaggaggagcaattcgcatctctgaaaaaccgttgccatacaatcgcatcgacaagcgcaccttttgcttcgacaaaagtgcaacagaacggcgtggacagcaatcattctccgtctgcaaaacagtcttcgtcctcttctcccgttgcatccacaaaaacttttcgacggcggactgcctttgaaacttcggaagcaatgcgtgaaattttcggtgcatattctcctttctcatcacagaaaaaa

SEQ ID NO: 90725 - DNA, 946 bp, Heterodera glycines
  SCN-specific regions: Sequence locations=1-694,716-946
tcccgattttatttgcattaaacataaaacaatttgccaaataacaattgcttttctgtttctccgagatttttttttagatttagggatttgtgaaattcaaagcaaaacgaaaagcaatgaattttgattgtatggtgaattaaatcaatttccctctccaaatatgaacactcattttattgcctgacgcgattcatttgttttgataaatttatcaaaaaaagtattgtttatgttttctttgtcttgttttcaactacttttaatttgtacattgttcaactctactgtttaattgggtcatgcgtcaagcctcgttttatgctgtcgcgcggggaagggctgtcggcgtattcaacacctggcaaaagtgtaatgacagcatcaatgggttttcgggggcaaagtttaagaagtttccaactttggagcaggctaatgacttcattgggaagcatcgtgaaactctgaattctggcggcaaagtgatttcgaagaaagggccccccgttcgtacaatgattgtaaaatcggctgctacgacctttgctgagagacgtttgacacgtaatacggcaatgtttggggttgaggcatcgaactcattggcagcatccaacttggtttccgtggacgatggatttacgactgttgtctatacggacggcgcttgtagtcggaatggatttgtcggtgcaaaagctggcttcggcgttttttggtctgatggacaccccgacaatgtctcagctccggtcaatggcccagccacaaataatcgtgccgaatatttagccgtaatttctgcgttggaaaaggcaaccgcgcgaaacattcggcgtctggtgatccgaactgactctgctcttctgatccaatcgatgactaaatggctgcccaaatggcgaaccaatggatgggaaaccatcaatggaacggatgt

SEQ ID NO: 90726 - DNA, 621 bp, Heterodera glycines
  SCN-specific regions: Sequence locations=1-100,209-212,234-621
tgaaggaaaatttaaaaaaaacgaagggaatttatagcaaatcaaaaaaagagaattatattattataaatgtgtaaattcgacaacgatttttaaagccaaatttaattttatttcaaaaaataatttaaaatataatgttggaaattttttaggaaatttaatttgaatcgataaaaaattataacttaaaaaataattattaattcaaaaatgttttcttggctcaaattcatggataaaaatttcgacgacccatagtcgagagggccgttgcaatgaaactgatcactttcgtctggacggcaaaatgtggacgcgattatctacgacagaatcggcgaattggaaacacgtcaaaatgtgttcgtcgtggaaagggaagtgaagagcgccctgttcaagtcgccccgcacttcaccttctctgtcgcgagcaaattcactgtttcgcaacagtcaaagcccgacgatgccggtggaagagccaaggcggtcaccctccgccagaagaatgttggccaacggatttgcccggcaaatgacaattgccgacactgactttttcccgaccaaatgagtgaaaaatcttatgtttccttttccgaagaatatccaactg

SEQ ID NO: 90727 - DNA, 515 bp, Heterodera glycines
  SCN-specific regions: Sequence locations=1-515
tgggggtaataagtcgcgaatttggcaattggggagcatggatccgagtggacaaagattggaccaactcctcggcaaagagtcaaaaagcaatgagcagaaacaacgcatttcttccctcttcacttccgtccatcttttcatgccaaaacccgtcgtcgttctctacggcgaagagcttggcctgttaagtggaaaaccgacagccaacaaattggccaaccgaattgtctatccgtggagtaacgaaacattcggcaatcagtcgcaaggatttttcgttttcccccaacgtacaaaaaacggagacttcgagagccagaaaaatgacaaacattcgccgctggcgttgttcaaagaaatcgcaaagctacgcgagcattccgatttcttctctggcgttttgtcgcattcgtcctcctccgatggcctcgacttttacaaaataaaacgcagtcaagggggattttttgtgttggtcgtaaattggggcgagaagcaaaaagcactcgaca

SEQ ID NO: 90728 - DNA, 812 bp, Heterodera glycines
  SCN-specific regions: Sequence locations=1-194,219-429,455-782,804-812
aatttgttaaagaattcaacagagatgaacccaaattggacattctgataaataacgcgggcataatgttttatccacgcttcaccaaaactgtcgatggccatgagctgacttggcagtccaactttttaggccattttctgttgaccgaattgctcctgccaaagttggagcgcagtgaggaaggcggtcgcattgtgaatgtgagcagcagtgtccatctccatgccgattcggtcgatccggaggtggtggagtcgcctcgtcgatttgggataatcgcgacatacgctcgctcgaagctagccaatgttatgcatgttgttgccctcaccaaacgcatccgtaccaatgacagcggttcaaaagtcagcgcaaacgcgtgccatcctggcagtgtcaacaccgaactcattcggaacaattttttcagaaaatacattaaaaaggcatttgctccaattatatggttcgttctggtaagtatttccgcataaattcatttctcttaaattttttattgtacgaattgccattgacccggggtgccaagcggaaatcctgggccttccctgatttaaaagaataaatttacagaaaactgatcgggacggagcacagacaccgttgtttttagcgctaagtagacaaattaacggcgtttccggaaaatattacagcgactgcaaagaggccaaagtgcaccaattcgcagaagacgaaatcgcgtgtgaaattctgtacaacaacagtttggagcagtgcgggttggaccattctgccatttgaagatgggaacaaaagctactttc

SEQ ID NO: 90729 - DNA, 383 bp, Heterodera glycines
  SCN-specific regions: Sequence locations=1-383
attcaaaatcaataaaaatgtccgcttggatttgtcctgggtttttgctgttttttgtgctcattctgatcactgatcactgtccgatgacccaagctgtcactcaaccgccctatggtcaattggctgtcagtggaaaaaatctagtacaaaaaagtacgaataaaagccgtggcattgcacggcctgtcaatgtactgtagccaatgcccccccaacttttgggtgaaacagaccgtcaacaaattaaaatgttcagtgcaatgacaacgatgtacgcgcagcaatggcatccagctttggcggttacatttcaaacccaactgccgaatataaaaaaatgactgcaatcattgatggggcaattgaccaaggcctttacg

SEQ ID NO: 90730 - DNA, 621 bp, Heterodera glycines
  SCN-specific regions: Sequence locations=1-48,80-249,271-621
tttttggcccattttcagctccctacaaaagtttttcctactccgacatttatctttttaaaaagcatttggccaaattcaaaatgttcggcacattgcgattcattgcgacactttttgctgttactgcactttttcttgatgacgcattggcatttggtccccgcgcgtttctgaagcgccaagcgcctcccagcgcagaaatggcaccaccaaaagcggccatggaccagcaagttgcgatggagctacagcagcagcagaaacattttgagcgctttgtgatggagccgcagcgtgtggtcccattcgtgccgtcgccagctactgcttactacggtggcggtgttggtggtgtatcgtatagcggcgccgcattcgcgccccaacaactgcagcagaagcggttcgattacgtaccgacagacccctacagctatgagagcttctaccctcttgtgccggccaaacgctttgatgccggcggctttggcgccgcttacggatcgcgcggacgcttttccggctttctttaagccctttacatgggatgatgaaaaaatgtgttatgataaaaacgatagacgacattttcaattattttctcgatcgaaaaataaa

SEQ ID NO: 90731 - DNA, 481 bp, Heterodera glycines
  SCN-specific regions: Sequence locations=1-154,176-286,308-481
ttcattttccaccttttcgcttttcatcgtcaaaatgtgccaaaattacttttgctgcgttttcacattgtttttttttctgtgtgtccttttttcattggtcgattcgcgtcctcagctgctcaattcggtcagtacctcgggccttttgatcggaaaaggaagcgaagtcaaatcggcttcggtcccccttctgtcggagccaatgattgaaatccattcgcattcggcgccagtgtcgccttcggagttgaacttcagcagaagacgaaggaagcgcataagcaacaacaaatccaattgaacaagaaaatttataatacgtatcgcaaacttaaaaatcaaagaagtaaatcgtcaatgaattcgtcaaattcgtcagtggctgttttttctgcctccaaaactgccgttttctttgaccaaatttcagatgcttgttcctaaaacatcgaaatgtataaacagaaagtgccaaaaa

SEQ ID NO: 90732 - DNA, 454 bp, Heterodera glycines
  misc_feature (148)..(148): n is a, c, g, or t
  misc_feature (160)..(160): n is a, c, g, or t
  SCN-specific regions: Sequence locations=1-191,213-235,257-300,322 -335,358-404
gtgaggcccggcaacgggtggaagccgcacccgcggctgcacatcttcggcaagttggaggtcaacggcgccaaccagcacccgctgtacgaattccttaaggattcgtgccctcaaacggtcattcaaatcggaaagagggaggaanctgatgtacaancccgatcagaaccaacgacatcacatggaacttcgagaaatttctcatcgattccgaaggccgtccgcgcttccgtttccatccgaccgcgtggtcccacggcgaagttgtgcagaaattctccgaacaaatggcagccgaacaagtgaaagaagtgcaaggagaagtgaaaaagtcataaacagaaagaaaaggaaggaattgcaaaacaatgagcaaattgcttaatcaattatttaaaatgaataaaaaatgagtaaaaatgaaaataaaagttaaaatttgactaaaaaa

SEQ ID NO: 90733 - DNA, 645 bp, Heterodera glycines
  misc_feature (561)..(561): n is a, c, g, or t
  misc_feature (635)..(635): n is a, c, g, or t
  SCN-specific regions: Sequence locations=1-94,116-266,289-595,617-645
ctgcctttcgacaactttttcttcctaacaatggtccaaatgtggtgcatggagacctacccgtgtggtgatccgcgtcttccgcaccactgtttcccaccaaaattggtgaatccggacgaattgaccaaacggacgggcgccctctattataagttggatttggaagaccaagtggcattatcaaaacgaattgcaattatgaaattggagcgcaacttcaccaaggaggacacgtacacattggacgcacagacaacgaacgattttaaggaaaagatcgcagaacttttcgaagagacggaaagtgacgaggatcaagcacggatggttttggaagggtcggcgtattacgacgtcgaagccaaagacggagtttggatacgcatcttttgtgagtatggcgacttactcatcatccctaagggcatcgcacatcgaatgaccacaacgccgaagaattatgtgaaagtgcgccgctttttcaagtcgagcgatagcgacgaggactgaacaaaaggacgaagaacgaagtcgaagaacagcataagtaatcaccanctgaaaagcttgccctattcaaatggtttaaaatgttcaaatttgaatgacattttgtcaattgtaaacaaaanagaaaaaaaa

SEQ ID NO: 90734 - DNA, 209 bp, Heterodera glycines
  SCN-specific regions: Sequence locations=1-129,151-185,208-209
tcaaaagttggccttgtgccgataaattacataaaactgattggaaaatgcaacgacagaaatgcgcaaatcatatgaccagtccgaacattggattaacggacaattcaattctctttcattttgtcatttcatttaaatgtttccaaattttattactgtaaaactttgtatccgaatttaataaaaataaacgaaaatggcaaaaa

SEQ ID NO: 90735 - DNA, 527 bp, Heterodera glycines
  SCN-specific regions: Sequence locations=1-182,204-527
catttcgtccgtctcccaaaagcaccaccaatcattcacaagccaagcacaaacaacaacaatatggaaattccatcaagcaattaccccccgccacctccctatgactcatcggtgctcattcagcagcccaacaacccgtcgccgaacagtccgatgatggagaagggtccactgccacaacagcaggcatatgcccagccacaggttcaacaccaacaggccgagcggagaatggtcagggacctggtcaccatgttcttctgtttcgttataccgccgattgccatcgctttgcagaacgggccttcaatgaagctgcacatactgctcagcgttctgttgtgcattctgggctgggttccagcggttttgcatgccgtttggtactgtttctttgccatgagacactacaaccattgattaattgatccccccgatttgcgtgatctatgtgatctgcaaatatttgataaaacactaattgatgcatattaacacgcgaaagcattggactaatctcattt

SEQ ID NO: 90736 - DNA, 358 bp, Heterodera glycines
  SCN-specific regions: Sequence locations=1-76,99-240,275-358
cgccttttctcccgccactcattcactcacttctcagttcattctcgtcaaaaatggcaacctccgcaaaaatttttgttctcctcttcgtccttcttacggtcgctttactcgtcgaacaagccacggcacagtggggctactactacccgtactacggcaaacgcgaggccgggttcgccccccagggcaatgccaacggaaacgccgaagggcccgcggccggcggagggcacgcgatgttcagattctgaagaagggaggaaggaagaaacgatcaaagagtgatcggattgactgatcagcaagcaaatggtccatttcaaaacatgcgataaataaacggaatgcttaaaaa

SEQ ID NO: 90737 - DNA, 487 bp, Heterodera glycines
  SCN-specific regions: Sequence locations=1-275,297-327,358-437,463-487
tttgtcgcgtccgtccatttctttgctcttcccatttctatggagtcccgcacctcaaatttgtcagcttccatccatcgccacggcgattatcagctgcgattggcccgctcttcggcctatgtgcgggcgaaagtggcgccaaatttgacgaaaaattttcaaaaatgtccaaaatgtctggtgatggtggacattcgactgcacgccaaatgcccagcggatgcaatttaccaaccgtaccaatgggttttggacccggaaagatggtatgtgtgaagaggaagcggacgaggcaaagccggacggacggaagagggaggtgaaaagaaggggaagaaggagaaggagaagaagcagcagacgatgtttgattactttttgggataatcaataaaaaaacacactgatcactcttggcattatgttttattgccaataataaacattcattcaaatttcccacctgcgacttattacacaagga

SEQ ID NO: 90738 - DNA, 792 bp, Heterodera glycines
  SCN-specific regions: Sequence locations=1-428,450-553,575-792
taacatcaattaataaattgaataaaaattaattcatcaatgcattcctttcttgtactgaccattctttttgccaatttggcaacaaatgcttttgggcaacaatggccaaaagcgactagtgaagaaactgttaaggcaacaattaaagtgtcaggaggcgtcaaagattttggcttcaaacggttgaccgcctcttcggcattgggcaccggtgatcagtcggagggccaaaaagcactgatccgtgccgaaaagaatgcagtgatcaaaaatttgatcattggccaaaacggggcggacggcattcattgctatgacgggtgcaccctgcaaaatgtgtggtgggaaaaggttggcgaagacgcggccactttccggagcagcagcgggtgcaaggagtacagtttcacggtcacgggcggcggtgtgaaaaatgccaaggacaaagtgttccaaatgaacggcggtggcactttgacgatcaaaaattttgtggcggaaggcattggcaaattggcgcgcgcatgcggcaactgcaaaacgcaatgccaaaaacgaaagtttgtgctggagaacattaaagtgactgggctgaaaacgctgttgtgtggcctcaacgagaattatggtgatgtggcaaccatcaaaaatgtgcaaatcaccgggtcgaagaaagtgtgtgccgaattccaaggcaacgaccagcaaaaggagccgccaatgttgcgcagtttcgacatcggatcgaaaggcgatggcaaaaattgcatcatttcgggcaccaccagc

SEQ ID NO: 90739 - DNA, 409 bp, Heterodera glycines
  SCN-specific regions: Sequence locations=1-146,168-226,249-253,275-382
attttttaccaaattattaaattaacaaaatgtcccctcttcgttttctcgccgttctgctgctgatctgtgccatgttcagcttcaacaatttggggctggccaatggcgaggaaagcaaagacagccaagtcgctctccgtcccgatgttgctgctgttcagcctgacctcgtcgttgttcgcgctcgccgtggttactatggaggtggtggaggctgttgcggtggcggttggggaaaaaagaaataagcagccaaagaagaaaggaaggatgccgacaaagattaattatctttaattagtaaatgatccattcgtccattttgtaattggccaaatttagtaaaagacaaaatacaatgataaattttgtatattttaaaaaaaaaaaaaaaaaaaaaaaaaaa

SEQ ID NO: 90740 - DNA, 508 bp, Heterodera glycines
  SCN-specific regions: Sequence locations=1-202,226-234,256-258,288 -437,459-508
cctttaaattctgccgctgatcaccgccgaagacaaagaaagcaaaatgcgcttttcctttccgctgctggcaatttccttcctaatgcttctcctcgtggcaccaattcaaattcatggaatgtttggaagcaatgggagaggcagacaaatgagcgggggaaggggccaaatgggaagcaacggcatgggaccaggaatgggaggcggtggtggcagcattagaagaatgcaacaaggccaaggaatgggaggcaatggtggcggtggtggcggcatgttctgaccgcaattttgaaagacgacggaggacggcggagcgtagcagaagcaataattggtaaagactgactgatcagcaagcagatgaaccaaccaaaacggcacgacgattagtgaccgaccgtactgtgtagtcaatttacgctttaaaaaactcaaaaattgtctcatttctcaactcactcgtgctgataaagaaacattttgttaaaaaaaaaaaaaaaaa

SEQ ID NO: 90741 - DNA, 354 bp, Heterodera glycines
  misc_feature (337)..(342): n is a, c, g, or t
  misc_feature (345)..(345): n is a, c, g, or t
  misc_feature (347)..(349): n is a, c, g, or t
  SCN-specific regions: Sequence locations=1-37,66-196,218-354
gtttcgattgttccaattaatttgacaatgtctccccatttgcttcatctttttctcattgttttgctcattttggccctttcgtttgtccttttcggcggaacggacgcaaaagaattgtttaagcgaaaaatgcctcaaatgagtcaaatggggccgatgggaccaatgggcggcggcggtggttatggatacggaaaatgaataaaaggacaaacggacggaatgcgcatttgagaaaggaacgaaaagagaaaaagcattcattcattaaccatgttaatgtgaactaaatataatcggattggaccttattaaatctaaattggtataaaannnnnnaanannnaaaaa

SEQ ID NO: 90742 - DNA, 530 bp, Heterodera glycines
  SCN-specific regions: Sequence locations=1-34,56-530
attattgcttcgaaatgatcaaattcgttttggtttgcttttccctttacattttcgtcgctttgacttttggccatccttcgctgggctcccgtgggtccgtccagcagcaaaatgggaatggcaattcagcgcaacaacagcaggcccaattcggccaaatgagtgtcagcgacaatggcacggcttctcccccgcccgccggcaacggatcctaccgggccaagcgaagtccttgctgcgattttggctcttaccctttcatggagccaccatcgcgttacggcggtttccgctaccctttcatgggcccaccaccgcgtcgcggcggtttccgtcgcggtggtcggcgacgcggaccgaccggtagcaccgcttctccgtcgtctaccaacagtgcagcattggcggaccagttcatcgtaaacaacgaaacggagacgaccccaacgccaacggaggggacggaaagcagcagaagtacggacggaacaaccgcaacgaatacggacggaacaaccgcagcgaat

SEQ ID NO: 90743 - DNA, 790 bp, Heterodera glycines
  SCN-specific regions: Sequence locations=1-23,46-790
atcaaatcgtttaaaatcaaaacaaatgcctcaaaacgagcatattgaactacacagaaaacgccatgggcgaaaattggatcacgaagagcgcacgcgaaagaaactggccagagctgttcatgaccgttcaaaagtggccaagaaattgcggaaagggaaggcgaagttgtaccacaagaagagatatgcggagaaggtccaaatgcgaaaattgatcaaacaacacgaggagaagaagcaaaaggggacgacggacactcaaacggagggagcagtccccgcctatttgttggaccggcaaaaggaaacggcggggaaggcactttcgactgccatcaaacagaaacggaaggaaaaagcggcaaagtaccaagtgccattgccaaaagtgagggcggtcagcgacgcggaggccttcaaagttgtcaatacgggaaaaactagacgaaaagggtggaaaaggatggtcaccaaagtcactttcgtcggcgaaacattcacacggaaaccggcaaaattcgaacgattcattcgtccgatgggtctccgtttttaaaaggcacatgtcacccatcctgaactgaagaccactttgtgccttccgttggttggcgtcaaaaagaactcttcttctcaattgtacactttgcctcgcgtcatcacttaagggacaattattcgaatgaatgtagtggaatcggaatggtcacacaaggccggcaagtggtggggcaagataccgctcagtgacttaccatgcgagaaacgacgatgcatcacgcttgtc

SEQ ID NO: 90744 - DNA, 599 bp, Heterodera glycines
  SCN-specific regions: Sequence locations=1-249,272-409,432-440,480-599
ttaaagcccttttacaaatcggaaatgaatcccaacggttttttctttgttttagcggtactttttcttgtgaaagtcgactttttacatggcgtttacaatgaaccaatggcacgacaggtgctgcaaaagcatgcatcacaatttcagcagcattgtaaaaatgcccgcagaggaagtgccgtggccaaatgttgcagtgccatcagaagcataatgggccgattcacaagccaaaaaaaggcaatgaaccaaatgctggccaagtgtaaagcgggcacaacgccaagcgaagcacagcaaatgcgaagaaaattggaaggatcgaataaactgaaggattgtggccagtttaaaagccaaattcagcacaagttcagcgagttgaagcagtactgcaacaatggggcagaaaatgaggaggaaaacgacgaatgatcagagagggagagagaagaggagagagtagagagagagaggaacagcaaaattctaatcactagtgatcactgataattgccgattgattgaccggtacgactcatttggctgatttttttttttttatggcataaagagttgcggcaaatttttttttt

SEQ ID NO: 90745 - DNA, 526 bp, Heterodera glycines
  SCN-specific regions: Sequence locations=1-489,514-526
atctgatgacattttgttggatggaatgtctcacaaccaacgtggcaatgcgaatgctaacatgggacctcctcaaggggttggttctggctcttctgctgagaattccgactcatctgcggataatcaaccttcaaatgagcaatgggaagcagcattcaatagcatcggcgatttttcacattttgttcggcaagtttttcattcggtcgttcatgggatggctgtgaatgacagcagcatattcccgccgaattctgcacaggccagaaacggcttcaccgccaactcgcgagtcaccggttttaccccttcaattgttaatcctccgctgtcgcatgagtctgatgagttgttcatgaacatcggcgcagttcaaggcctaattgccatgccaatgcctcccagggaaaatgcgccgcagaatcagcaccatccatagccacgaactgagccaatttcggacttgcccattgaattggtggccttaaactctcaaaatttgatttgtccttgtagcttattc

SEQ ID NO: 90746 - DNA, 550 bp, Heterodera glycines
  SCN-specific regions: Sequence locations=1-550
tgctttggcagttgatccaagtcgaagcagtcgagctcgacaaatttctcgatctcttgcaaaggttgaattatgcacaacaccccgaggcaactgcagcgattctcgtcattatacggaatatggaacccgacccggacccggctgttatgcgttccctgttgaggaacttgtttcttagacagccggacagggatttgttcacagttgatgctcttaaattgatcgttgattacagtgacaatattccaccaatgagcgattgcatcagcaaaatggtcaaacacgccattcacaatgacgaaattattgcgccatttggacaaacgaaattgggcaaggcacgtccaagggtgccggtggtggagaacattcttgaccatttggatcgttttcgaaggcattgtatcgacagagagtcaaaaggtgtcgaaaatttgttgaacaatgcgctcactctcgaattgttccgctcgctaaaaagtcatccgaaactggcggatattcgctctcgattcactgaattgttcgcactctttgacattttatt

SEQ ID NO: 90747 - DNA, 663 bp, Heterodera glycines
  SCN-specific regions: Sequence locations=1-15,38-663
gataacgaaaaaacagttggaggagaaggcgcagcgattggagcgcgaaatgagcgaatttgtggaagtggcggaaagggcgggtagtcgtggcgacttggacaaatctcagaaatatgtgaaacgggcggaggaagtcaacgcggagttggagaacgtccggaaattgcttgacccggaagcgagacaacgcgaggtttaccaggccggctacaaagacccgaacgcgccgaaaccgatgcgcgtgtgcgaagtgtgcggaagttttttgatcattggcgatgttcagcagcgcattgatgaccacatgcaggggagacaacacctcggatatgcaaaaatcactgccactttggcggaattgaagttgaaattgcgcgatgaagttacgcccgaacggacggtgtccagtcgcagtccgatgtcggcaaccagcggaggagggcagcgccgccagcgtcggtcgcgttctaagtcacacgagcgtaaagcgaacaggaaaaggtcgcgcagcaataacagccgagccgaaggaggtggtcgtcgacgtatgaaaaggtcccactcgcgccaccgcgacgatgccaataacaacgaaaaacactccgcccacggcgatgcgtctgacgaccaccgccgtcgtcgtgtccgcaactcggcttc

SEQ ID NO: 90748 - DNA, 857 bp, Heterodera glycines
  SCN-specific regions: Sequence locations=1-771,793-857
ttttttttttttttggattcgtttgtttggcataatccgaaaataaaagtcattaatttactcttatgtggctctttggcttttaacagaacattcagcacaatgacagattccgtgttaggtcaaaaagaatgtttgttaaacagtgtcaattcggagggtcgggtgagcggtcgcatcggatgcctttctcttcttggccaggctgacgttgccgttcttcttcagcccattcagcaattgttgcttcacatgattatactcaacgacacaagttcggcacaacgctctgtacaattcttgacctccgatcatttctaactcgtgcattccgacattcgaaatgtgaatgaggcggactgtccacagcggcaaactgcgcttagtttctcaattttctcagccaaaggaatgagcatcgccacattttggaagggctggtaaaatcaaaagtgcgtcttcggtgaacctcctgccggtaatcgccattcagtgcagcaatgatcactgttttgccattgtttgccaattcttgcgcgtatttgacgatgtctttgaactaacacaaatggaaatgccaaatttcctcgaatgcgtcttccattttcgtcgcactaatcgcctccattttgcgtttgtcgtgtgtgcatgcgtgcgactcgtcgtaacgcgtgtcgagcgcatatttaaccactgcgactttccgtccggcaagaatgtaccgctgagccaatcggaacaattcagtcctgggaatatcattgttaggagggagagaaaccaaaatcattttgtatccaattacaattactcacgtttttccgctgaacatgggtccttaaattaaaatattgaag

SEQ ID NO: 90749 - DNA, 157 bp, Heterodera glycines
  SCN-specific regions: Sequence locations=1-30,52-157
aggaccaatggaaccaattggaactgatcggaaggaaatgccaacatcgggcagagatcaattgcattttaacactttgataattcttctgattactttatgattttattttcctttaatttgataggtttaccaaatagaaaaccattgctaaaaa

SEQ ID NO: 90750 - DNA, 550 bp, Heterodera glycines
  SCN-specific regions: Sequence locations=1-399,433-550
ggagaggtccatgaaggcgttgattggcaccgtcgacgaactgaacaaagcggtgaatgcctacggcaaatacacggtggaaaagcaaaagtacgacacaatgtacaacaatctgatgcagaagagacaaacggagaacgaagcgcggcaatcgcgcggagaaccgccgctgacaatggaggacataaagcggcagctgaagcagccgcaaatgcagacaaagtacggaatgttggacttgctgctgaacgcgctggacaccgacgcattcacgacgtaccaaattcagacgaccaacgaaaacgtggccaaattgcacctttcccaagcggtctctgctcagcccgtcgtcgccgcctcttccgctgccattggcacttccgccgcaaatgcgcccaatttggaaaggaaataaaaacatggaaattggggcggagagagaagggaaatgcgaacggagcaacaaaaagattggattattattttgttttccctgttgctcttaattgtatggacacacacaaattgttgctgtttttattttgtttcg

SEQ ID NO: 90751 - DNA, 747 bp, Heterodera glycines
  SCN-specific regions: Sequence locations=1-115,163-437,463-589,613 -684,708-724
catttaccgatatctgccaccgaatgctcaggttgtgcttttgagtgcgactttgcctcacgatgttcttgagatgaccagcaaatttatgacagatcccattcgtgtgcttgtcaaacgtgatgaattgacattggagggcatcaaacaattttttgttgcggttgaacgcgaagaatggaaatttgacacactctgcgacctttatgacacattgacaattactcaggcggtcattttttgcaacactcgtcgaaaggttgactggttggcggacaaaatgcgagaggcaaatttcactgtttcttcgatgcattcggacatggaacaaaaggatcgcgacgctattatgaaatcattccgtgcaggggaaagtcgtgtattgattagtaccgacgtgtgggcccgtgggttggatgtgccgcaggtttcgcttgtcattaactacgacttgcccaacaatcgtgagttgtacatccatcgcattggccgttcgggtcgttatggacgcaagggagtggcgatcaacttcgtaaagaacgacgacattcgaattttacgcgacattgaacagtactactccacccaaattgatgaaatgccaatgaatgtcagcgaattgatctgagagttggtatgaaaccacacaaggaattggatcctaaacgtatttgtgttttacttttctcacgtttattgtttttgataaatggatactttggtgaaaaaaaaaaaaaaaaaaaaaaa

SEQ ID NO: 90752 - DNA, 482 bp, Heterodera glycines
  SCN-specific regions: Sequence locations=1-392,425-442
cccggcagtggcttcaaccaatgccatcatagcgggaagctgtgctcttgaggcattgaaactggcatcaaagtatctgtttcaacgttgttgcattggaacgtgatcccgaatgtttggtctgcggtcagaaatctgtccaaatgtattccgtgcgcgaggactgtacactctcaggctttttagatgacttgaaagacaaataccaacttcagaatccttccattcgagcgggtagcactttcctgtatgaaatcaacactcttatgccagaaatggagacagcaagtcggaagaatttgtgtaagacgctcaaggaacttcatgtcaccgaggatagcgaactgcttgtagcggatgaagcattaacgagatctattgtttttcggatcaaatattccaaataaattttattcgaatgtccgataaatatctctgaaggaaaaaaaaaaaaaaaaaaaaaaaaaaaaaggaaaaaaaaa

SEQ ID NO: 90753 - DNA, 516 bp, Heterodera glycines
  SCN-specific regions: Sequence locations=1-59,81-222,244-415,438-516
ccactgaaattcgaatcccttccaccgcaatgagttcattttcatttccgtgggcgacttttctgtttttctccctaatttcttgcctaatttcgctgacagaggccaacccgaagtttctcttgtcctgcaaagtaatcgacggcatttgccaaaatgacgaactttgcctggaagaaatgggcattcgtttccccgactgttatttggagcgcaaaattgattttctccaaccccaaaaaagcgcactaaatccacgccattcactgaaggggcaaatggaccacaacgatttctgaaaaggactccagcgatgaaactgatgaaggtgctaatgatgaaagatcggattccggtgggtcggagatgagcggagaatgccaaacgaataaaagtgaggatgagacgagcaaagacaaacaaataataatcagaaattgccacctcaaacagtccattcattctgtgcaaaaagacatttagaggcgaatgtttaataaatggaagaatcaaaaa

SEQ ID NO: 90754 - DNA, 529 bp, Heterodera glycines
  SCN-specific regions: Sequence locations=1-358,380-529
atatgccatgttggagaacgaaataggtgtcaaaatggacgaactgcagggactgataatggcactttcgtattcccatcagattgtcaacatggcggtctcaatgcccgagcccgtgtaccaagcggacgaattggccaagcgagggaaaaataattttgccgcattaaaacggttcaaaccgaaccaagtgccgaaaaaggagcaccgacttttggcgaaaaaaggcgcaaagcgacagaccatttcgctggttgaccaccacgaattgaacagaattctttcatattggggcgacggaactttcgtattgtctaatcgtttcacggcttaaattctaacgacgagtaattaaaggaataattttaatatttctgtatttgttcattcattcataatttttgacagatcattttgttgtttttaattctcactaaaagagcgtatcataatgttctattattcattctcacattgctttaatccattgttttgcattttgacatccgaaataaaaattgtccaagaa

SEQ ID NO: 90755 - DNA, 520 bp, Heterodera glycines
  SCN-specific regions: Sequence locations=1-437,459-479
tcgggcacaaacgctacactggtgaagtgatgaacggaatgggcatggaccggcacctgttgggcatccgtttgttggctgccgaacatggcgtgccgttgcctgaactgctcggctccgacatttaccaacgattgctgcacttccgtctgagcacctctcaactgcccacgtcccatgtttggcccatgggttttggcccgtccgcgcccgactgttacggagtgtgctacaacccgcaggagaaccacatcttcttcatcatcacggcgttcaacgactgcgcagaaacgagcgccgaacgatttgccaatgcgttggaacgtgccctgctggacatgcgcgacttggtcgactgggccgggcgattgaagggacgggcaaagctttgatcggcaaagtctctccaccacgtcatctaactaaatctaaagccatttatttttgccttaatttctaccctcaaattgcccaattgctatataattataaaatgtaattttaaattatgtataaattt

SEQ ID NO: 90756 - DNA, 217 bp, Heterodera glycines
  SCN-specific regions: Sequence locations=1-178,199-217
atgtgcccaactttttctccacgttgcataacgccatgcgtctttccgcactgctcaacgttcatccgtcgctttgccagtgaaaggacgagaatgggatgagtcagacccatccgactttaattgattctcaatttgacttaaatgatctgtttatcttttactgttttgttgttgtaaaaaaaaaaaaaaaaaaaactcgagactagttctctct

SEQ ID NO: 90757 - DNA, 74 bp, Heterodera glycines
  SCN-specific regions: Sequence locations=66-74
gtcctgcccataatatctgtggcatggaataaattttggaactgcgctgcctaacggcggtgcttaaaaaaaaa

SEQ ID NO: 90758 - DNA, 306 bp, Heterodera glycines
  misc_feature (50)..(50): n is a, c, g, or t
  misc_feature (52)..(52): n is a, c, g, or t
  SCN-specific regions: Sequence locations=1-1,23-103,129-149,173-306
tcccccccccccccccccggggtgtgtgggaggtagacgacctcagaaancntcaaaaatttaaaacttgatgctttattcaaagttttggctccaccagacgaagaattcgaagaatggctcagagatcttaagcttctacacaccactcgtttttgtgactgtggcaacgaaatgcgctacaaatggattaaggaggaccggatattttttataatttgtggacccaaatcgcggaattgtacccaataagcacataaatcaccttctgtttgttacttaaagcaattctgataataaaaaaaa

SEQ ID NO: 90759 - DNA, 544 bp, Heterodera glycines
  misc_feature (544)..(544): n is a, c, g, or t
  SCN-specific regions: Sequence locations=1-544
aacattctcaaacaaaatgactgagtttctatacattcgcatgaaagccaacgactgtccgttggtcgctcttatccgattcggcggttgtgccacctcattcacttctgaatctttcgcgcggaaggccaaccttttgggcaacattgaccgttccaattgcgagacaatttatgtgccgatttttggaggtgccaaagtgcttggctgggctaacgatgttcaaattcgaattgatgagctggattatcaatttgtgtaccgtttgggggtgatggaggacaaacatttgccgatgtattgcaagaagaagttcgacatgcttattgcaaccgattgctgtttcaaaattggatttaccatcgattgtggcaaaaaagtggtctcccgcaagggcaaagtggtcaaaattttgaccgaggaacaaattcagagcgaaatggaggacacctattgaagaaatggaagaatgagtgaatgaatggaccaaagtgatcggagaaacagaaaaatcagcattgttcggcgcaattttgtggaatan

SEQ ID NO: 90760 - DNA, 1221 bp, Heterodera glycines
  SCN-specific regions: Sequence locations=1-19,63-68,121-954,977-1221
agagagaactagtctcgagttttttttttttttttttttttgacttcttttctgtttcttttcccttactttctcctttcctttccctctctctttgctcctcctttcttccctttctcccatttgtgcatcaatgaccatcgatgtttggtgctttctttctctttgtctgtgagtccatgcgttttcactataaaaggcaacttcatatattcgtttcatcattcttttcaacatttttctgattgttttcgtcgtccgtttgttttccctttttctctctttttcattttccctttccatttacattccaagaattccctccacctttttctccaatttcttaaatgatgtccaacgcaaccaaaaacattctcggcactccaacaatcgtcgacaatgttagtttcgaccccaaagtgagcgccaatttccttcacaaagccatcgaagagaagcgaaaggtgagaaaggaaatagtgcgggaaaagaagagagagagaaagagaaattcaggatgagattatccatttgctgtgcaccatttccaaccaacagcggcaagaattggcacgcgaattcaaacaattgttcggcgaagatttgtcccccaaactgaagaaggcactctctggcgactttgaggaactgattttggctttgttggaaccgccagctgtttacgatgcgcagcaaatgcaccgcgcgatgtccggcctcggcactcgcgaatcggttctgattgagattttggccacgcatagtaaccgacaaattgatgagatgaaacgcgtgtacgagcagctgtacggccatccgctggagaaggacatcttctgggacaccagcggcgcattccaacgactgctcacgtcgctgtgcaacgattctcgcgacgaaagttggagctctgacccgatctgagcgaatatgacggcacatgatctgttctaagagagcgaggaggagagcggggtcaacgactttctgttctaccaagtgctggccaacgagaatttcattcagttgcatttgattttcaatgagtatcacaaggtcagctgtcatcccatatgacacgcaattcagcaacagttcgacggatacaccaaggacggttatttggcggcggtggaatgtgtgctcaatcggcactccttcttcaccaaagtgctccaaaactcgacccagagcttcctcggcattggcaggcgcgactcg

SEQ ID NO: 90761 - DNA, 405 bp, Heterodera glycines
  SCN-specific regions: Sequence locations=1-158,192-265,287-405
gtcgctccgcctcagccagttttacacacagaaaacgtctcttccttcttggatttgcaaaccgagttcatcaaacgtcgcgatgccgccattgcggggaagtcgcagtcattcgccacggagccgacgcaccggcgcactccacgaaataacattttggccataagcaaagaggaaaagaaagcaaaaagcgaagtttcaacgctaagagtttttctaattcgacaaaatgaggaagcaatcagaaaagaggagcaacagagggccaagcagcagcaaatccttcagcaaaaggcggcaatttatgaacgaatggcaaagggcgaacgattggtttacgacgacggaaaagaggccgaatttttggtcgattttcacacgaaaaaaaaggaattggaggaagaa

SEQ ID NO: 90762 - DNA, 147 bp, Heterodera glycines
  SCN-specific regions: Sequence locations=1-147
tctttttgtgtcgtacttttccgtctttgagttttggtgcgcagttcaacaaaaatctgttcgccgcttcacaaaaaaatgctgctctaacgaaacatttgcacgtctctcctttccgttacgccgattcttcggacgatggcaaaa

SEQ ID NO: 90763 - DNA, 221 bp, Heterodera glycines
  SCN-specific regions: Sequence locations=1-25,107-221
ggtagtatcgttacagtacacgcaaattaccattgttattttcgtattattattattctcatcattctcagcatcatcatcgtcatcaattattattattcttttttcgcttcaattcctttgattttgccctcccttttcgtcacccatcaattaattaattgatccctaattagtattcaaagaaaaaaaaaaaaaaaaactcgagactagttctctct

SEQ ID NO: 90764 - DNA, 94 bp, Heterodera glycines
  SCN-specific regions: Sequence locations=1-94
tcacttttttatctgcggtttgctacttcctttttctggccaaccatttccaaagtgtcgctgctgcttcaacgaacgtgttcgttcagggaaa

SEQ ID NO: 90765 - DNA, 193 bp, Heterodera glycines
  SCN-specific regions: Sequence locations=1-193
ctcagcatctgagttgccatattactctaaacatatttttgaatagctaaaaacccataaaagcctttaaatttaacgaagactccaaaaacaacaataaattgccaaaacttgcaaccatctcctccaagttacgaggagtctgacaaacgacagcgagagcttttgctgaactaccaagaattttccaaaa

SEQ ID NO: 90766 - DNA, 838 bp, Heterodera glycines
  SCN-specific regions: Sequence locations=1-838
aaaaaatttcaacggaggataaggaggacgttgtatcttgcgcacaattgtggtaagcatccattgatggctcacatgacgaagaaagcttcgaatttcttaattggtgatttcaactctgttgactttgacaatatggcggatcaacttggcaaccatggatatgtttcgccttgcaacatgctcactgcattggtatacattatgcggctaaaagaatcaaacgaaagagattttctcgccttcaatccaactgaactcttcgtttcttcgttggtgttggcaaccaaataccttaacgatggcactttgcaggaatttgtttggaacgacgaatgggcatcagtttcgggccttgcattacccaaactaaacgagttggaaattcgcctgctcacttctttacgttgggatgtttcaattcaatccgaagattttgaaaaagttttggcgagattagaagggttcgttgccagcgaaatggcccagcaaaatggcgttatgagctacaatgaactttgcattctgtccaacacacatggcttcaaccgttccattctctgtttgctcacagttctactgaagtttttgtttgtgttattggcttttcatctcgctttgttagccggtttatccgtgctgaatatggcagtctcgcgaaaacaggaattggcggcgagtgacgcgtgcatttatcatcacggatgggatgattgttcgcatccaccaattcttttagcaaatgaacgaaaaatcgatgcgaacttgacgaaagttgttcacaaggatgatttttttgcatttgttcatgcctttagcatcagttgatttttatttt

SEQ ID NO: 90767 - DNA, 845 bp, Heterodera glycines
  misc_feature (779)..(779): n is a, c, g, or t
  SCN-specific regions: Sequence locations=1-845
acaatggcgaagagccgggcttataaaagcgcttttgtgcggagaggaattgacgtggactatccccgacgaacgtgagcgcgagctcatggcttggcacgaggttggacacggagcattcgccgctaaagacaaagacgcgattccacttcgctacttgtccattttgccgatgtacgattccatcggacagacgtattgtatgcccaagtcagatgcacaaacaatgtcagtggcgcaagtgcgggcggaaatcaacggatttttggccggaacgatagctgaaagaatgagttatgggagtaataaagttacgacctcatgttcttcggacttgaaaagcgcctatcagtgctcccgaaatcattctcggcctgcccttccgcgaggccatcgacatgtggacgttaggctttgtgattgccgagttgttcctcggttggccgttttaccccggctcttacgagtacgactaaattcgcttcatcgttcaaacccaagggcttccgccccagcaaatgctggccgaggcggccaagacgcatcgcttcttcaaaatgatcaaagacatggcctcctattggcgtctgaaaagcattgagtacgagttggaaatgtccacgaaaagcaaggagacacgtcgctatgtgttcaactgtttggacgacattggccaagtgcaccttccgtccgacttggacgacatcgaccgaatgtgcgagcggaatgaccggcttgaatttgtcgacattctgaagcaaatgctgagcatggaccangaccgtcgtctgacaccgacccgcaagttgcaacataaatttgtaaaaatgacgcatatgatcgag

SEQ ID NO: 90768 - DNA, 614 bp, Heterodera glycines
  SCN-specific regions: Sequence locations=1-37,62-193,216-614
gccaccttcaaaacagctcctctcatcgctgtcgctcttctgatccattttggatgcttaatgtttttgatggaagtgaacggtgaagtccatgttcaaagctctctggcaccaagtcatcaagtggtaaagcgtcattgctcctgtggtggcagttggggcggctggggtggcggcggtggagcatgtaaaacaaattttttatgaaactaaaactcaaattatggtctggaacagaccgggccgggattggatttgagaaatttagggtttcacaaaatccaattctaagggaataaaaaattgaaatggctaaattaggacgaaatctcattgtttttctacggcataaattatttcggggttttttaggatgcacttggcactcacaatttaaggacaccgagcatatgggttgttgctataatttcaggcggtgaattcggttctggaatagaccgtctgaagtatgcgagcctgaattttcaaaatttgtggctttggagatgcccaatcccctttggtatataaattgaaacggctcagatggctaaattttttgaaatccccgtgatttccaaggacgtccttggcactaacaatttaagggcgcc

SEQ ID NO: 90769 - DNA, 524 bp, Heterodera glycines
  SCN-specific regions: Sequence locations=1-524
aaaattccacgccattttcatcatcttggaattgctgttggattgagtgacggaaatgggaagtgttggcgtcatctttgtcaaaaatgtggccatggttttgatgctgcttttcggacggacgatgatggccccgtttgcgattgctggcatcgtgagcgacaacgttgaggtcggctactacccgtcacgcgaaaaggggaagggcatttatgaatggatccaagtcatcaaaccattggtacagggccgagtaatgttgacattgacgattgccaattcggttttgttcattgccacgtgcattctgctcatatacctcctcgtttttgcggtactgcttagcacgtcgaaccaccagttggaggaactgcgtggaaaaatcaatacggtggattactgttcggtgctgcaccctctgtcggctgctctccaaaatgccagggagtcggcgacgactcgacgatgtgactggcaaatgtcctgaagatttcaacaaggccccggcgcagattaagtacagt

SEQ ID NO: 90770 - DNA, 538 bp, Heterodera glycines
  SCN-specific regions: Sequence locations=80-173,196-260,289-292,326 -538
cgctacttttgctgttgacgttgaggaaattgcggctgggcatcacgttacgcctgtggacatgacaacagctaccagcaaacttcagcttgaggctgccgaagtgcgaaatccggcgaataaaccgaattggtcatcgtatttgcgctctcaattggtgcctcaaaatgagtacaatttcattattgaattggaaaaggccaaaaacaagcaggagagggacgaagcgttagccaaggacaagacgaattcggcacggagtattatcaatttgatcaccgaagttgcgaaggatcagctgatccgttacgttctcacccttttcgacgaccttttgcaggaggacaaatcccgggtagagattttccatgattatgcaagacggcaaaaacgaactatttggtcgtggttccaagggattttaacgcgaaatgacagtttcattgtcaaccaaatgtctgcaatattctcaaaattgccttgctatggctctgtgcttatggatggacaagaactgcaagcttatttcaatttcctt

SEQ ID NO: 90771 - DNA, 552 bp, Heterodera glycines
  SCN-specific regions: Sequence locations=1-531
atttaaaagcaaaaagacaattcttttgtgccaatgccctcctccgattacgcggacaatgaggcggacgatcgaatcaaagcgccgccgagtgaacgctttctgaactattcgctgtttcacaattactctccgtacggaatgcgttcgttggcctacgattatgccaaatacgcggagcggaccaaatggccggtgaagaatccgtgcggcaccatccaattcgaggacgagccgcgcacgccgcgctttcaattttggagtccgttgacggcacgatacgagtgcagttacacacagaacgtatgaggaggacgaaagcagaggatatgagcggactgattgatcacttaccgatcaatcattcccggattcgcatcataatccaatacagaaaaccgacgaaacatcccgtggaggacaaaacagcgaaaacaattgcaataattaatccggtggaggccaaaaactggaatttggctgcttgttgctaaaaaatgtttgataatcaacaaccaattgtgactcaataaaataaatgttttgaaaaaa

SEQ ID NO: 90772 - DNA, 341 bp, Heterodera glycines
  SCN-specific regions: Sequence locations=1-153,179-193,217-300
aaggtgacagccgctaccaagaattgaaggacggaatttaccatggctaccagccgttgcgtgctcgcaaaacgttcacttacacttacacacaaagtgaatagggccccaaagcccgaagatccgtacgcgtggctccaaccgcaggccccaaaacagcagcaacaacagcaggaggaagtgacggaagaagcatagaggaagaagaagaaagtcagcactaaagcactgattagaggtgataagtgataatgacaatgataaatgataatgctggcgatggtgataaagttaattgtcaaaaaaaaaaaaaaaaaaaaaataaaaaaaaaaaaaaaaaa

SEQ ID NO: 90773 - DNA, 343 bp, Heterodera glycines
  SCN-specific regions: Sequence locations=1-242,278-343
caccgttcccgtccgtctgatcggaatccgagtacgatcaccacccgcctcgtcttctttgaatttccaaaattcgcgagaatccaccaggataatgttcggcacattgtacattcaattcgcagtgtttcgcccagccatcgattaacgctcatttccaactcattttgtctattgtttgcttcagtgtccgccattatccaacagtgacgtggaagaagattagaaatatacaagaaaaatttcaatgcaaaaatacattttatttagtgataatcgcaattggtgacaatttttattaaaatataagcgttttctttaaacaaattttcattggtcaaaa

SEQ ID NO: 90774 - DNA, 367 bp, Heterodera glycines
  SCN-specific regions: Sequence locations=1-101,123-367
ttttctgtttttttcgtttctccatgtccatgtgttgggcagagccatggaattcggctccaatttggccaacactcgtccaatcttttccgtctcctctttcaacaatgactataaaatggacagagaacatccgttcgtgaacgatttgtggagtttctacagcccaccgggcggcaacggcgaactgagcgatgagaatttgtggagcagtgccctcagccgacacctccttttccatatgaacagaaaaccgaaaaaatggtgaaaaaatgaaatttccaacaattgttgcaatttgagaagcgaaaaatgtcctaattaattgctgttaaattaatgaaagaaaagaggcaaaaagaaaaca

SEQ ID NO: 90775 - DNA, 322 bp, Heterodera glycines
  SCN-specific regions: Sequence locations=1-193,216-302
caccggagatgctgcaatttcggggtcatctgcacaacaggcaaaaacgggcaccgaatcgagcacgagcaagccaaaggcgtgctgcgtctgcaaggagacaaaagggaagcgggacgaatgtattattctgaacggtgaagagaattgtggtcaactgatcgaagcacacaaaaaatgcatgagagaatatggatttgaagtgtgatgagagaatatggatttgaagtgtgatagctgatatacgtttcttgttttaatgttttagtattattgtagtaatctagtataaatggttgactaaaaaaaaaaaaaaaaaaaa

SEQ ID NO: 90776 - DNA, 641 bp, Heterodera glycines
  misc_feature (620)..(620): n is a, c, g, or t
  SCN-specific regions: Sequence locations=1-565,587-620
ttttgcttatcaaattggcaatgactgatcagcagaattcaattgacgggggatggacagagcaaaatgtgaacgacgaaaaaatcaagtctctcgcttctcgctcagtggccaaaataaactccgagtcaaacgatcgcttcagtcttttccccttggaggtcggaaggtcgaactgttcgaagaatcagccaaacttggctgaccacgcaaactgtgcaacggaggatgatcagacagcgcgaaagacttttttggcaacgatttgggagaaaccgtgggaacaattcgagcagatcacttacaaactcgaataagaggaaacccgaagaaagaaagcgagcaaacagaagggggcggggaagtgattgatcacatcgcaataatcctgttcaaacatttaattatttccaatcggtaaaaaatggcgaaattatcacaatgtcctccttcccagctgatctgtcaatcgatggacgaaagattttcttgtcccgcattgatcacttttattgtcttccactgctgatcagtctgttttccatgtccctttccgttgggtacattatgttcaaaaattacaatttcaagacttacacttgataaaaatgaaaaattcnaaaaaaaaaaaaaaaaaaaaa

SEQ ID NO: 90777 - DNA, 496 bp, Heterodera glycines
  SCN-specific regions: Sequence locations=1-446,468-496
tctttgtccgtgtcggcgttgcaccattctccaccgttgcccgagcgcaactaccgtattacgtcaatggacgatgttagcgggtcgccgaaattctgctacttctattactatcccttttaccgtaaccgatatccgtcctaccaatacaatcggtgtcgaacttatgcttctccctacgacaaacactcctcaaattggcccgagcatcatttcaattaccctttttcgttgagtgggtataagccgtgctcattctatggctcttacacttatgcgccgtatcgaccgaataagagcccatctgggtactattatggatggtacaatggcatctcgggattctgagcaaataaattctcaaggcacaaaaaatgaaaaataaatgcttatgattttttctttaaataatgtaaatttaatgactttgaagagattcgtttaattttcactccaatattttttaaactctcttaaagaatttaatttaaaaaaa

SEQ ID NO: 90778 - DNA, 526 bp, Heterodera glycines
  SCN-specific regions: Sequence locations=1-147,183-451,473-526
tgtaaaatgagtcaacaaaatgaagaagcacttggcaaggatcaaaaggaacttcgagcagttcaacacgacatggaacgccttttcaaagcacgagacgcgaaaggactttccgagctgtacactgtcgacgccatcttcgcgagcaatttaaatttttaaattaaatttttacaataattgggtttaatgtttgttaaaatgatttgtttaggcccatccgccgatcaaaagtcgtgcagagattgaaaagctatggatcaaattccttgacacagactctgccgaattgcatgtaacttttgacgaagtttacttttgcggcgatttgggcgtcgaaaatggcacttataaatttacgaacaacgacggcacagtgacacagaacggacttttcatccaaacttttaagcgcggttcggacggaaaatggcttatccacaacgatttttacacatgttgaaaaagaatgaatcacaatgaaggcatcagaagaaaaagaaaaaacatttatgtgtgaaattag

SEQ ID NO: 90779 - DNA, 436 bp, Heterodera glycines
  SCN-specific regions: Sequence locations=1-334,360-388,411-436
tttctaatcttcttccacgtcactgttggataatggcggacactgaagcaaacaatagacaaaatgagttggaaatgagcgttaatcgatggctgggcgaaacactgcgaattgaattgactgacggacgcgtcatctatggtcagttggtttgcactgacaatgtgccgaacattatcctggtggattctcgcgaattttggaaattcaaagaagacgaggcgggtggtgatcgtactcggattccgatcagacggacgggaacggttttgatcaaaggagagtatatcaaacgaatctttcaaattgtgttgccagaagaagaaatgaattcgattagaagaaaagaggaagaaacaaccgaaatgtgaactcaaatgtttgaattgtttttccacatttcataaatgaaaacacagcagacagaacattggcg

SEQ ID NO: 90780 - DNA, 599 bp, Heterodera glycines
  SCN-specific regions: Sequence locations=1-29,95-599
cagtttaacaattgtccgtttcccttttgtctttttgctccatgtcttcctcccgcttctttgtcctccttcctctcctctttttcctcctcctttcgttcgaatgcgttcttttggctcccaatttgttctcctccaaaatcgtcgcttttggtgagagtggcgatgcgtttgattcgccgtcattcgccgatggcacatcgacggaacgcttttcggcaacggaaagcgacggaagggcaatggccaaacggaacagtcggatggtcaacgcattgagcaccattctgaacaaacggaaagaattgggcaccaatgatgcttttcgagttcgaatccgatcattggaccaaatgggcaatacgaattgctacttttcgccggttcagtgttatttctttgaggaacggtaggaaaaagtgaaccgacgatggaagagaagaaaagaattggaacagacaaaatgaaatgattgttttgggaatgagaagcgatgccctttttgtgatttgccaattaaattgcgactcaacgaattttcccgcgttaaacgcccattttttatcaattcgataatttaaacgatttcatcgaaaaaa

SEQ ID NO: 90781 - DNA, 490 bp, Heterodera glycines
  SCN-specific regions: Sequence locations=1-42,65-88,110-432,455-490
gtttgccacactgaagacaacaagttcaagcagacatttgctgccaattctgttcatcttctgctgttgctaccgcgccttttcaaattttggtgatgcggccattgtgccattgtcagccctgggccgctacaaggtgtcacttggcgagctgaacgaattgctgacagaacaacaacgctcggctgacgcagtgccaagcactggcgacaaattgccaaattatgccaaaattccatacggagccaaacacgaagataagaggagagagtttgaacacggctgggagcaatgtgaattctcaccaatttcgtgcatgttgcgacgtcggaagcgataaatgtgcggacaacgcaaaaaaacgataatgataataacccatgatgattggttaattaataatggtgatgaaaggtgtggattacacttattaaatgatgaaaaacaaacacacgatttgtctctgtcgcttggttccagtaaataatcg

SEQ ID NO: 90782 - DNA, 636 bp, Heterodera glycines
  SCN-specific regions: Sequence locations=1-513,535-636
gtggattaagaccatagcatcttgctgcacgtccttttttctcctaattattacaaagttttacacacatttttttaatgagttttccttgcggagacggatggcggcagcaaatccatccggaggaacagctaccacaatacgagcagaaatgtgacattgaaatgcaactggacactctcaaacaaacggtgaaggcaaacacaaaagcatgtgcagagtcggcacaacgaatcgaagacttgcaaagttttcgtttttattacatcaccttggcattcttcgcattcttcatcctcaccatgtctgcaatgttcctttatacacgaattagcttactaagtgaccggatttatacccaaattggcaatgtcgacaacagaattcgagatcatcttgacaccaaatctgagcgtctttatgccaaaattgacgctttatctgcccaagttcaacgacttgggctggcaatggctacgcttccgaatggaagccacaccacaacttgatgaaagaggacaacgaacgacagaagaagagaaggcattttgcacacacacattagcctcccgtgatctcctcctcaacaatgttattgataaaagcgggacgaaggatagaaaataaatttaaaat

SEQ ID NO: 90783 - DNA, 663 bp, Heterodera glycines
  misc_feature (15)..(15): n is a, c, g, or t
  misc_feature (20)..(20): n is a, c, g, or t
  misc_feature (35)..(35): n is a, c, g, or t
  SCN-specific regions: Sequence locations=1-166,206-245,267-275,297-663
ggggtgagtaagccnaaaangcgactgcattatcntaacctattagactgaaaatggctactgcaaaaaagaagacgcgaaagcttcgaggacacgtttctcatggtcacggtcgggtgggcaagcaccgcaaacatccgggcggtcgtggtaacgccggtggacagcaccaccaccggatcaacttcgacaaataccaccctggctattttggcaaggtcggtatgcgaaactttcatgtgcgaaagaaccattactactctccaagcatcaatttggacaaactgtggactctgtgcacagaacggacgcgcaaacaatatgcagaagtgaaggacaaagcgccggtgatcgacgtggtccgggccggctatcacaaagtgttgggcaaagggttgttgccgaaacagccgctgattgtaaaggccaaatgcttctcgcactctgccgaggaaaagattcggaaagtgggcggcgcatgtgttctggtcacataaatggaagaaagggcttgagaagaatgatgatgatggcgccccttgacgaggaacacctttttatgttgttgtctttgttaaagttattcctttcgaatttcttttttttgtgcaagtgtagtgggagccaataaaccgtgcacactggccatttcttatttgaatc

SEQ ID NO: 90784 - DNA, 116 bp, Heterodera glycines
  SCN-specific regions: Sequence locations=1-116
acggacgaaaaatatatggcaagaaaaaattcacagattgttcaagcaggcagtagaagaaggagtgcagaacgacccgtcacctcgttgcacgaggcctcgcacgttattgcaaa

SEQ ID NO: 90785 - DNA, 575 bp, Heterodera glycines
  SCN-specific regions: Sequence locations=1-285,307-520,554-575
accccgcatatttcgggctgtttttcccactccgtcgccatgttctgtcgctgctttccccactcctttcttctgctgctgcctgtactgcttgcacttctctcgctgttcaaatgcatttcggcttcaaatcaccaaccgcaagcagagaatgtactgctcgaagaactcatccaagaaattcgaaaactcaacgaccgtatggaaccggcccttgggagagaagggaatgctgaggaggagcaaatgttagaaataaaacggtcccaaggaatggtgccttccgaactttggaacagagccggggacaaaagagcgcagctgcctttttccggtggcatttatggcaaacggtcgccactgccattctctggcggcatctacggaaaacggagcgcacgcaatctgcacagttcgtcactgattattccgacgctcaatcggcaggcgcgtgcgatgcctgtcaacgacggaatgtacggcaaatgaaacagaaagaaaaaaagaaagacgcacaacggagaaaaagatgggagagagagagagagagagaaatgaattcaatggcaaacatt

SEQ ID NO: 90786 - DNA, 543 bp, Heterodera glycines
  SCN-specific regions: Sequence locations=1-68,113-543
tgcaaagtgccaatttttaatgtttagaatagagtgccacgggaccgggaattttgggcaaaaccaggaccttttcgggttcaaaaattaaaatgaaacaacaacaacagcacagtccccccgaaaacagcagtgacagtgactcaccacccgacccatttaagatcaatcaaggctcgctgacccttgcccagttggtggaatttttagaggtggagcatgccgaaaccgttgaattgatgcaagctgtctggcgtcgtcgtcgcttgtacaaaatgcctgttcggcctccgaacccaaacaaccaaaatgatgaccgttttttcggatatggggaccatttggcggaagatgttttctacaatttggtggaaaaaacgcgaaattccatccatggaattatccagctcaaagtgctgcatgttggagcgtggaagtcagttgacgtcgaataccacttttaatgagcttaaagagatctctttcaaaattgcctttgttttcacaatcacttaatctgacaataaatgtggtctccaaaaa

SEQ ID NO: 90787 - DNA, 285 bp, Heterodera glycines
  SCN-specific regions: Sequence locations=1-188,267-285
aaatgcatcgtttctccttctcgtaaatattttgctttgttcaattgtgttgctacatttattgtcaaatgaaaatggattggtcaatgccatgccggcattgaacggaggcgacgagttgttgttgagaaagaaacgccaagacgaaggtgatgaagcggaagaaaatgccggaggcgagaatgcggaaaatggaaatgaagaaaataacggagaaggacaaaatgaagaaaataacaatggggaagaaaaaaaaaaaaaaaaaactcgagactagttctctct

SEQ ID NO: 90788 - DNA, 459 bp, Heterodera glycines
  SCN-specific regions: Sequence locations=1-182,206-224,267-363,399-411
aagggccaaaacggaggcgcagctgaactattggccgtattattcgtcgcccgtttattcccacgccgcttcttacgaccattacaaattgggctcaatgtaccaatggtttttacgttcggccgcccatcagaacagcccaaaccgaagggcacgttattactgctacagtccgtacacaaaacagcacgagcacagcttcttcccctactttaccaaccactgaaaaagagggaaaagcaaaggaaaggaaaagcaaaggaaagacgaaacgcgaagaattctgatgattgtgctgcatgaacgaaaatattagcgcaatctgtggttcagcaacaacagaaacatcaaaaattcacctttatttcactcacataataataattatattgtaattgaacaattaatttgaaaaaaaaaaaaaaaaaaaaaaaaaaaaaaaaaaaaaaaaaggaaaaa

SEQ ID NO: 90789 - DNA, 330 bp, Heterodera glycines
  SCN-specific regions: Sequence locations=1-192,232-284,313-330
aaattgctaattttgtcattttttattctttttgccttctttggcttcgctgatgttgtcggaacaccgatacaagaacaagaatttgcaaaaatggtggcaaagcgtgccgatgggtttgatgagtgcttgttggcagcaggtgctacaaattgtgctggtcgtttagcttgttgtgaaaagtatggacaacaaagttgcatttgttgaaaagaaaagaaaatggaacaattttatcagcagattatgatgcttttggctttttagcaaaacatttcgatgcgattttaaaaaagaaaatataaaatttttgtccacttaaaaaaaaaa

SEQ ID NO: 90790 - DNA, 448 bp, Heterodera glycines
  misc_feature (374)..(374): n is a, c, g, or t
  misc_feature (381)..(381): n is a, c, g, or t
  misc_feature (389)..(389): n is a, c, g, or t
  SCN-specific regions: Sequence locations=1-154,177-448
attgtcgtcaattgtttaatttttgatgactaattccatgccgaaaatcctcttcacaatcatcgctttcgtcaacatctcacaaattttattcgctactgctatgtataagggcaaagaaatttgcggtaaaaccgtggaagagtgtcaagcggcactgattgcttttatgaaggatagcggaagtaatcagaactatcacgcgagcgaaaacggtccaatacagcttgctaatgataagtggtgtatttgggtgcaaagctatgtaacaagtggggccccaagatcaaaatggtgaagccatgaaaattgaaggcggacgaaagaatgatgaatgctaattgaccccatttgcttgttgttgttgttgtttntttttcntcgggtcntttgtttgtccgcacttttttgggattagatatgtagattaaactttttgctatcaaaa

SEQ ID NO: 90791 - DNA, 510 bp, Heterodera glycines
  SCN-specific regions: Sequence locations=1-96,118-510
gcatcgcttcggctgatggaaatgcgttgcgttccctcccgtcgcccctttcgtctcatcgccccgctgttcaacgcaattcctaccttttacctcattctcacccttattttctgcattctctccccctgggctgactctgcagatgcggacgaatggtatggcgcgagacaattacgcgcaccgaaacccaaatttatccgatttggacgttccggacaaaaaatgatacctttcagcagaagtttttcaacagaaactcagtacggcgacgaagggatcaaccaattggacgcgttggttgatgcggtcgataagctgtatcaatcatcgccagaaattagggcattcaaaactgcgccaaaaagggcacaaaagttcatacgattcggctgatgagagagaatttgacgaggaaaagcggacaatctcagaaaaagttaccagcagacgatctcacaatcccttctcttttctgaacaaataaaataagttgtattcgttaaaaaa

SEQ ID NO: 90792 - DNA, 490 bp, Heterodera glycines
  SCN-specific regions: Sequence locations=1-427,449-490
atgaacacgacgtcccttattcgtcttctgttcgcggttttctgcgtttttttggccaatttcccccaaagtgcgcaggcagaaacaaagaaagtgtatttcgtttatggtactcaggtcacagttacagctgtacataacggacgcggaattaatcttggagcaaccacgggagaaggtgttgaatcgaaacaatatttggagattgatacaaatgtgtggaacggaatgaatgacaatgatcagattgttttccatgttcgcacaccgcatagcgtgacttcatacgacaaaactacagttggtaaattacgtaataccagtgaattagactttgctgatcaaacaatccgagcagtttaatgatgaagatgagtaggaagcaaaccagcagaagaacggctttatgtatttgacttcatcagatgtcattttcattgctttgttgatgccatttttggcttgttgaaaaaaacatttttttaaaaaa

SEQ ID NO: 90793 - DNA, 432 bp, Heterodera glycines
  SCN-specific regions: Sequence locations=1-432
attttgccaatgcaagtcagtcaaatgagaacaatgtccttgtcggtggcaagtcttgttgcattgctcgttttacttgccatctccagccatccaacctttgccagtcctatttcttcaagagacttaaatgatgctgctgaagcaggtccactccaagcagttgaaaagcgtcggaatgcagaattcataaatggcttactgacaatggagcgtctgaatgcgatgggcaaaaggtctccagtcccagcatcatcagatgatggagtcgtgccgatgacactctggcgttcccagcacccgttcttctggacagagtgaaagcaaaaaatgaagcaaaactgcggattatttgtcggcttaaaaaacaattataatatgaatgacgcatcatttaatttgtgaataaataaagcggttaatccaggaaaa

SEQ ID NO: 90794 - DNA, 524 bp, Heterodera glycines
  SCN-specific regions: Sequence locations=1-295,317-524
taatagttttgcgttacattacacaaaaatgtcgtcaaatggcatcatcacaattgtggcgctattccttgtgttgtttggcactcacataacaacacaaattggggcaatgaatcgtcatcgccagcagcgctcacttggccatccgtttacggtggataagcagcagcatacggcacagaacgaaaatttggtcggcgcctatttgtctcggggaatgttcagctgcggcgccaaatatgttggcacattgcaaagactgaaaagaatcattgaggaagtgcatgccgactattcggaatgccaaaaatcgatgaagcaaatggacgagaacgagcaaatggcattcggaaaagggcacggcacagagcgatttgcgatgattgacgaactgatcaattgagcccagggggacaatttgtggcaaaatcacaaaattcgaagcataaccatttgaaaaacattgaaatgatttttcattgtttgtgataaagcgaaacagcaatttgttaataaaatgccaa

SEQ ID NO: 90795 - DNA, 516 bp, Heterodera glycines
  SCN-specific regions: Sequence locations=1-516
catatcccaatttgatgaagttcgttttatctgataaaattcgttcgcagcgcattcgcggctttcttgttgacataaatggcgtactctttgacacttctttggacggaggcaaggccattcctgggtcgattgaagcagttaaaagactttacgagctaagttgtgttcgttttgtaagcaatgaaagtagtgggacacgaggagcaatttgtcaaaaattacaccgtctcggattcgttgggcctcagcctgagcacattttcacaccggcaccggttgctgtcaaataccttcgacagcatggactacgaccaaaattgatagtgcacaaaggtttaaaagttggactttgagttgatataattatttggcgaaccaactgaaccgactaaaaccatgaaggacacttaatttaagactcctcgaacttcagatgtacttcccgattttgaagaatttctcaacgtcgaaaacccaaattgtgtggtgttaggcgacgcagaacacgagcta

SEQ ID NO: 90796 - DNA, 586 bp, Heterodera glycines
  SCN-specific regions: Sequence locations=1-152,175-586
ggttgtattatttttgttcggtattttgttggccgttcaattcaactcggaaatcgttatggccaagagtagcggcaagcaatcaaaagcatcgaattcaaaatcaaaaccaaaaccaaatcaatcaaaatcaaataagccaccatcatcaccgtcttcatcatcttcatcatgcatgggctgtctgtcgaacaccaaaacggccgggcccattgattcatacttgggcaagccggtcaagaacagcattttcactttctacggtgccggcggacgcggcgcgtgcggtctaaacgccggagtgccaaaaatgtcagctgccggctccggccaattgttcaagtcggacgggcagtggaaagacgcatgccgagccgacaaacagtacatgttggacgacccgatttgcaagaacatttgtatcaaagttgattacaatgggaaaactttgaccgtcccaatcaataacaaatgcccggagtgcccgcccaaccacgtggacttgtccattgatgcgtttaactctttggagccacgccggggtctcgtgggcatagcgaatggtgccacgctcacttacatgaga

SEQ ID NO: 90797 - DNA, 697 bp, Heterodera glycines
  SCN-specific regions: Sequence locations=1-235,257-429,451-697
ctctcaggccggaaaaggaaaaaagccacgaggagggggagaatgattttattcgttttgctgcgacatccatgcaagggaagagttcgttgaaattggtccattcgcatttaaattggcaactatttaaggatggcgaacccatcaggaggatgcgcataattgtatcctcagttttggagatgagtgctctttttttgcagtttatgatgggcacggcggttctgacgttagctcctacctgaagaaaaacttccccgacttcttgaaagagcacaatttgttgctccacaccactgacgaaggtctcagcgcggcattgcacaaattatttgtgaaatttgacgagactctgcgccacgacgatacggtcaaagcaatggtagagctgaagacagcactttcaacaacatcggaccaacaacagcaggcagaagagcaaaaggcaaacgaaggctgtgacccgggggagaaggagcgcaaggaacgtgagagtttgatcgatgcaaaaaaatagacgccgatttgcggcgagtagctgtggtacagctactattattgagccttttggctcaattttcggtgaattgggctcgacgatagccgagccaagaaaatcgccaggaacagccggacaaaaggggaggatgaaactcatcacaaacgtttgtcgttcggaccggaagttttgcgtttc

SEQ ID NO: 90798 - DNA, 503 bp, Heterodera glycines
  SCN-specific regions: Sequence locations=1-420,442-477
gtcccttattcgtcttctgttcgcggttttctgcgtttttttggccaattttccccaaggtgcgcaggcagcaaaaaagaaagtgtatttcgtttatggtactcgggtcacagttaaagctgtatataacggaggcgaaattaatcttggaaaaaccacgggagaaggtgttgaattgaaaacaatatttggagattgatacagaaaaatggacgggaatgaatggcaatgatctgattactttccatgttcacacatccgatggcgtgactaaatgtgacaaagctacagtacgcgaattacgtcaaactgatcaaccgaaagactttgctgatcaaacaatccgaacagtttaatgatgaagatgagtaggaagcaaaccagcagaagaacggctttatgtatttgacttcatcagatgtcattttcattgctttgttgatgccatttttggcttgttgaaaaaaaacattttttaaaaaaaaaaaaaaaaaaaaaaaaaa

SEQ ID NO: 90799 - DNA, 511 bp, Heterodera glycines
  misc_feature (502)..(506): n is a, c, g, or t
  SCN-specific regions: Sequence locations=1-280,306-320,344-511
tgaaatggtggacaaaggcgaaggtgacagccgctaccaagaattgaaggacggaatttaccatggctaccagccgttgcgtgctcgcaaaacgttcacttacacttacacacccgaatttgtgccgggagcattgaacattgcggttgcccgtgacctcgactccatcccatcggggccaaaggacgacggcgcacattaccaaatggtcacggcacacaaagtgaatagggccccaaagcccgaagatccgtacgcgtggctccaaccgcaggccccaaaacagcagcaacaacagcaggaggaagtgacggaagaagcatagaggaagaagaagaaagtcagcactaaagcactgattagaggtgataagtgataatgacaatgataaatgataatgctggcgatggtgataaagttaattgtcaaattaattgtctattaacgatggaattaacaaatattcacaaagaattgagtaaatgtgaatggtagtccaaannnnnaaaaa

SEQ ID NO: 90800 - DNA, 604 bp, Heterodera glycines
  SCN-specific regions: Sequence locations=1-85,107-284,306-358,380 -443,473-604
aaataccctaaaattcaacaccctcaaaaactttgagagggaattcgaagcgcgataacgggaacaaataaaccaatgaaataagataatttgatgattttcaacaaatatttttaatttttgggaatttgtaagcctacatttaggccctattttccatattttatatcttaaaaatagagcaccctcccccgtcattattagtgccaaaatgcgttccaaatgtgtttttctcgtcatttttgccaccatttttttgctgttaaacggcggcacttcatccaaacacaaaatcgccaaaatcaggagtgtcgttggtgcaaaaaagcgttactttggcttcacttcttcgccaaccgagtcagacggaggtggtcacccgcacaatgtcacaacagtgggaagtacagcatgatatgtatgattatgatcattaccctaaagacgatggaccaaaagaaaaaggctccaaaaactgctgcactataatgtaggaaatttggacaaatttcagacgctttttcgagtttggcgatcttagaaaattgtgtaatccgcttttttgaattgtcgaattgttgagtaaaatcttgttgttgctaaa

SEQ ID NO: 90801 - DNA, 907 bp, Heterodera glycines
  SCN-specific regions: Sequence locations=1-31,55-732,754-884,906-907
acacttcaatagaaagtgtaaaatggcacaaattcatttcaaaattttccttatcttttctctcattactttttcacaatgccgaatcaattcagaaccgagtgaaaaagaaggcccttcttcaattggtggaattcaaaatgcaacaagcgatcatcggtctgctgctgctgctgcttctgattaccatgcttcttcatgcgatggttttggttggacactgaacaagggaaaatgctataaagtgatcgaaggattgatggattggaatcacatgatcgccgcttgcaaaagtgagggtgcaattctcgtgtgcattcaaagtgaggacgaaaatcattttgtcgggaaaatgatcgcaaagccaattgagcgttccctgggcaattaccgcttggagacaactcttttcaacacattttggattggacttaaccgtgtcaaaaacggcgaaaaatacgacagcacgtgggtaaatgggaagaaagcaatgtttggaaatctgcccgagattaccaccgaattgtcaacagcaaatggcaagaacaaatacccatggggggagggcgaaccgtccggcaccaacaaattcacggacccaaccggagtcaaggaggagtgcgttcacatgttcagtgccgatggcagctggaatgatgctgagtgccgtgtgcaaatgagcggcggtgtgtgccaaaaaatgccgaaatattgatttaatgtcttaattaataattcaaaatatttaactcaaatatcgttcatttattattttttgtcttcaacgtttagaaaatatattatcatttatcaataaggatgggattttaggaaaaataaaattcacgaatttatttgcttaaaaatcccatcccgtattatcatctataataaaataatattttga

SEQ ID NO: 90802 - DNA, 702 bp, Heterodera glycines
  SCN-specific regions: Sequence locations=1-111,134-261,284-702
attatcaggaaattggtcgccgatggggatggcactggggatgaccggcgaattgtccaattattccaattgataattatgttgagcaaatcaaacgctgatacgaaaagtattactaacaaaattctaatcaacttggaccaaattgaactttctttccaaaaacaagcacagatttccgccataaccgaaattgaaattgcaaattatgaacaactttgcaccgaaattgatgaaatgatcacccaaaataacaacaaaatggatgcagtgaaaagggaattggcagaggcaaaacaaatccgaaaaaaccgacaggaatatgacgcactcgctaaacttatcaaagaaaagccgagcagagtcgaaacttcgaaaaggctgaaactgcttcaggatgagttggaagaagcatacgccaaacaaaagatgctcgaacaacggttgattgaaaagaggaagaatatgtacactcttgctgttctgctggacaacctcgaggaaatgaacaaagaatccgaagacgtgcccatgtcggaaggtgacgatgccagtccggccggagcagtcccatcgtcgtccgctgggtctttaaagtgaaagtcgatggctcgatctgatcacctattttctttctttcaaatttatgttcttttaaaaagatgttcgcgaattaagcgaataaagccaattctcggtaaa

SEQ ID NO: 90803 - DNA, 734 bp, Heterodera glycines
  SCN-specific regions: Sequence locations=1-527,552-711,733-734
ccccccccccccatgagattgaatgcggtagatattcgctcatatcgtatcttaaactcaccatcaaattataatgaaactggtcttgaacgggcgttattcttctcggcaccctgctgtgccagtgccattctgactcggtggctgttgaacagtcaaaagtggatgccgtcgatgttggagacgcgccgcacatgatgttgacgcgggcaaagcgtgccagcggcggcagatggaccacgcagcagatcatcgagtgcattttcgcaatttttatcccgcccgtggctgtgctgatccatggcggccacgaatgggtgctccatctgatcatcaacatcgttctctggattctcggctggattcccggcaccatccacgccttctggtactgtttcttccgctagatcgatgaaggatgtgatgatcaacaccgatcgagacccccatcattgttgaagaaccggcccaagaaatgagaatcctgccgccttatttttccgatcattttatgctttttatacatcaaccacaaaacacaacaacaaatcgccaacatattttccatatttggataacaaaaaaaaagcccgatgatgatttcgatcagccccatcaattttttaattgtttttttctccaatttttaaatttgttcaaacaatttgcttgctttttcgcacctccctcgtcgccccccccccccactcatttatttggtttatatgctttta

SEQ ID NO: 90804 - DNA, 132 bp, Heterodera glycines
  SCN-specific regions: Sequence locations=1-132
cctaattattacagttaaaaaaaaatattttggcgaaaatatatttaaattatcctcctattcactaaaacaaagttttttttcaatggcgctatcccccgccgggcttcatctttccaaaagtatgtaaaa

SEQ ID NO: 90805 - DNA, 485 bp, Heterodera glycines
  misc_feature (3)..(3): n is a, c, g, or t
  SCN-specific regions: Sequence locations=1-288,311-414,437-485
canaaattggtcgataagggcgaaggctacaccggctatcaagagctgaaggacggagtgtaccacggctatcagccgttgaagccgcgcaaaacgcccaaattcaccgcagaatttggactgagctcgggcatgctgaacattgcggttgcccgcgacattgactcaattccgaagggggacaaccaggacggaagccaataccagtacttgtcggcacacaacgtggccagaggccagtacattcctccgaccaacccgaacctgccgaacttggacattcctgttcaacaacagcagcaggaagtggccgaagaataactggataattcagaatccaattggtgatgaagatggaaaagaatgttcaatttaatatgtttgaatggttaaaaaaattggattaaaattacgataaaattaaaatttaataaaacaaatcatctgaatgaacaaattttaataccaaaaaaaaaaaaaaaaaa

SEQ ID NO: 90806 - DNA, 633 bp, Heterodera glycines
  misc_feature (558)..(558): n is a, c, g, or t
  misc_feature (561)..(561): n is a, c, g, or t
  misc_feature (568)..(568): n is a, c, g, or t
  SCN-specific regions: Sequence locations=1-239,261-633
agtaatgaacaatattcggccgggactttgtggcctttttttttcactgtcgatggagatgaaaaacgtgcagtgcgagaagcatttaatgtgattgaccgttttatctctgtcgaggaatgttctacggataagttcgacgatgagtgtgccaaaaaagagggcgcactgacggatggacaaaaagacgtttcggactcactcgcctcggagtgtcaacaaattcgtcagaataagcgccaatttgcttcaaatgccgtccgacaatacatgaccggtgcgcgctgctctctattttttgcgtctccgatgattcgtccgtacaatgtgtataaaattgctgagcaaatggtcgaccaaagtcagaaggaaagtctcacccgtttcctggcacgggttatccccgtggaagagacgtgccatgctaatttggacgaaattaagacattgctgtcagaaatggtcgtcaaacatttgaagggagagaagaaggacactccgccaacttacgcagtcgaattcaaagcgagcaacaccaaactgttgagcagacagcanatntacgatntggttgcgcaactgatgaacgaactgtcaccggaaagtgccgtcaacctcacccagcctgatctg

SEQ ID NO: 90807 - DNA, 607 bp, Heterodera glycines
  SCN-specific regions: Sequence locations=1-607
ttccctcttctctctaattgccattattattatttctttatcttcctcggctctttccatggatggacgccaaaagaagctgaaaactgttgactttgaaattttgacgcgagaacagctgtgcgtactttgccaagcggtgctgaacaaatggaagggacaagcgaacaaaaatgagcaacactttagggaggaaattctcgactcctgctcgctgatagaaaacccttccgaagcgaaaaagtgccgtgatggagtgaccgatgccaaagtggcgagactgaggaaggaaggaacggaggaaatgtgcgtggcggagggattttgcggaaagggcgagatgaaagagttggagaagaagatggagcggatggagaagagaatcgacgacaggaagcaaaagttcgagaagggactgcgcataattccgcccgtcgacttgagcccggtaaagtcagtcccaggggacaaagcgacgaacacaacgaatcaaacgatgggcggaggataaacgatcaaccgaccgactgaattgattgatcaatcaaaaagggagacgcacttattctgatcagtaatcacttgtccaatcacattgcctacgttt

SEQ ID NO: 90808 - DNA, 350 bp, Heterodera glycines
  SCN-specific regions: Sequence locations=1-275,299-325
cttaaaaatgctccgttttttgcacgccggctgtgtgccccattgtcgcatcaaagcgtccatttcgacggtaggcgagcgaaagtatcatttgttggactcggtgaagcgggacacactgtctcaaaaaggctcagggacattaacatctccaaagaccagatgctggacgtgcgaaaagatgtgggagaaccagtgacggattgatcgcccttttggagattattgaatggacaattgatctcttctcgttaatttgatgtttctttccgacgaaaatatttatttgtttgttttgccttcagtcggtataaaattgaaattcaaaaaaaaaaaaaaaaaaaaaaaaa

SEQ ID NO: 90809 - DNA, 720 bp, Heterodera glycines
  SCN-specific regions: Sequence locations=1-520,543-720
gaattatcagcccaaatctgtgtcacagttcagtgccaacccatgcgaagtgattccgtgtcggatttggattccaatggccgccactttccgattctcacccacccaaacgcctgggttttgagtgcgtccaatcccgttcattccaaagtcacattctaatgtttggatcaccgtctcctccaccaattcaacaaatcgctttacaccaatcccattcattttaccatccgcagacaatttgcgtaaattgaaaaccggataaacgataagttggcctggtccatggaaagttacaaggccgccccgctttattctgtgaaattcggcgccgagaaggcgcaatcgctgggcaaattcatcagaatattcgtcctgtcgaatgccaacggtgtaagtgggcggatgctccaaaagacaaaggaaatggccactgaaagagaacgaaagaagcaattaaccaatgctaatgatttaaaattggacaacattttgctggactcggacggtcacattcacttggccgacttcggaatgtgcaaaaccgactcgaacagagagaacggcatggcctccaccttttgcggcacacccgattatatcgcgccggaaatcatcaaaggacaattgtacaaccaagcggtggacttttggagcctgggtgttttgatgtacgaaatgctaatcggacagtcgccgttccacggagacggtgaggac

SEQ ID NO: 90810 - DNA, 270 bp, Heterodera glycines
  SCN-specific regions: Sequence locations=1-216,238-270
atggccgtcgatgctcagcaaataatcgaactcattctttgcctcattttgccgcctttggccatttttatccatgctaattccgactgtaatgtccacgttcttatttccatcgttcttcgttttctcctctttttccctgctgttcttcatgctctgtggtactgcttttttgcgtgagctgtcaaagggactgtccaacaaaaataaatcaacgaacgattgaaatttgaaattgatttctcattttggcatatttatgtttatgtt

SEQ ID NO: 90811 - DNA, 410 bp, Heterodera glycines
  SCN-specific regions: Sequence locations=1-343
taaaaccctgttcttggtcgctttcatggcactgttcttcaccggatatcctgctgatgttgctggtgctgttagttcatcaggcaacagacgaaatgttaaatacattgattatgggccgcttattcgacaatcccggaaaaaccaaaaccgtaataaaaactcgagaccgataaagacacggccgtcgccgagacgaggcgattgatgaccagcacagaagaaagaataatcgagagaaagctgatgaaaaattgagaaactaaggatgattaaaactgagtcgaaagtatggaaaatggatgaatgcattgtttttttgggaataaatcatattaaagtgaaaaaaaaaaaaaaacaaaaaaaaaaaaaaaaaaaaaaaaaaaaccaaaaaaaaaaaaaaagaaaaa

SEQ ID NO: 90812 - DNA, 840 bp, Heterodera glycines
  SCN-specific regions: Sequence locations=1-28,51-182,204-571,593-840
attttaaaggtggaaaattcatacaattcttcattttgttcctcatcaatatgcttgggttgttgaacgtgcgggaaaattccatcgcattcttgagccgggggtgcatatcgtataccctctcatcgacgagatacggtatcggcactgtttgaaggaaatgtgcattgaaattccacaacaagaagcaattaccaaggacaatgttcagctggatttggatgccatcctttacgtccaagtggtcgacccgtataaggcgtcttacggtgtgcaagaacctgaatatgcgatcagtcaacttgcacaaactgtaatgcgtgctgaggttggcaaactgatgttggacaacgttttccatgaacgggccaatctcaatagggcaattgtcggaggtataaaagaatcgtgtgctccgtggggcctcatttgccttcgctatgaaattcgcacaatgaatatgcctccggaaattcagcgcgccatgaagatgcaagtggaagcggaacggaaaaagcgtgccgcaattttggagtcggagggcatttgcgaggcggaaaagaaccgagcggagggcgagaagcaggcgcgaattctgcgctccgaagcacaaatgcaagagcagatgaacaaatcgatgggtttggcaaaagcggccgaagcagagaaaatccaacgcattttgcaatctgaggcggaaatgcaaatgaaagttaacatggccattggacttgccaagtcggccgaaagtgaaaaagagtcgcgcgtcatattagcggaagcggaggagcaggagcaagtgattgtcagccgtgggttggcgtgtgccatcgaaacgga

SEQ ID NO: 90813 - DNA, 82 bp, Heterodera glycines
  SCN-specific regions: Sequence locations=1-82
ttgttgcctcgcccaccataaaaatggaattaacgccaaaatcagaaaaaaaaaaaaaaaaaactcgagactagttctctct

SEQ ID NO: 90814 - DNA, 279 bp, Heterodera glycines
  SCN-specific regions: Sequence locations=1-163,185-258
gacaatcttcttcactttcaatgtctttgtggcgttcaattgggttgacttacacgcgttactcgcaggttgctgctgcgtcattgcgcgaatgcgtgaagaaaggcacttcgggcgaggcaaaaactgcggaaccgataaaaatcacttcatgggaaggaggcaaagcgaagaagcccgaataaggaagcattgaccttttaggaccaaattgtttttttgtagactccgttattgctattgtcagataaaaacgagatttaaaaaaaaaaaaaaaaa

SEQ ID NO: 90815 - DNA, 477 bp, Heterodera glycines
  SCN-specific regions: Sequence locations=1-392,414-427,449-456
aggatctaaaaagtcatcgaacaaagaatcgaaaaagtctgcaaatatttcgcctgactcttctgaagacgatttggagaaagacgaactcttggaaaagaatgctgataaacgagagcgtgaccaccagggaaatgaaattgttccaattggaggaaatcgttttatttctatggatagattcaaaggacgtattttgattgggataagagaatactatcaaaaggacggcaaatggctccctgggaagaaagggatcagtcttaatcacgaccagttcaatggcttattgaagattctccctgatgtgaagaagatgatcagttccgcctgaatgaagtgcacacgacacaatgatctttgtttagatttttagacaaatttgcttgttttgaaatatatttttatcacatcttgctggcattttcatttttctgaaataaaaattggacactgaaaaaaaaaaaaaaaaaaaaa

SEQ ID NO: 90816 - DNA, 453 bp, Heterodera glycines
  SCN-specific regions: Sequence locations=1-34,57-310,340-453
aacatttctgacaaatcagaacagatcgcatccctggtttaatttaataaaaatgaatggcgaagttcgtagaccaaataaaattgtcaggtataagccaattgatccgatggtacagccagtgacagcggaagacagcattccggagtatatgaacgtgttggggatggtcttttcgatgatgggtcttatgatgagactcaaatggtgttcttgggtggctcttatttgctcttgcgttagttttgccaatatgcgcgcgtccgatgacactaaacaggtggtcagctcgttcatgctcagcatttcggccgtggtgatgtcctatctgcacaatccaacgccaattgtgccgccatgggcgtaaaaaataaatgcattgaattgttcagttcaaattatgttattctatcggtttcatttacatctcttattatttgcctgaaatacccg

SEQ ID NO: 90817 - DNA, 571 bp, Heterodera glycines
  SCN-specific regions: Sequence locations=1-518,540-571
ttctttttcgctgacgcgacttttccccactttggtcttccaccgtcatggtaacattcaactgctgcaaattgcggcttaccatgagaaagtcattgaccattacgaaaacccaagaaatgtgggctctttggacaaaaatgatccgtctgttggcacagggattgtcggggcaccggcttgcagagatgtaatgaaacttcaaataatggttgacggaaacggacaaataattgacgcaaaattcaagacgtttgggtgtgggtcagcaattgcgagttcttcgttggccactgaatggataaaggggcagaatttggaatatgcgcgcaaaataaagaaccaacaaatcgcaaaggagctttcactgcctccagttaagctgcactgctcgatgttggctcaagacgcaatccaagcagcgctaagcgattatcagaagaagcaagaagctcgcaatgagaaaacttgaacgttgtgactatgattatcgcacaaaatacaaaagcccggcggatttatattttcattaaatatttgcgcaattatttctgttcgatatttctcctga

SEQ ID NO: 90818 - DNA, 419 bp, Heterodera glycines
  SCN-specific regions: Sequence locations=1-288,310-387
gaaaatcgaagcgaaaagcgccgaccaaagcgaagtcaattgtggcattggagacgcagttcaattgtccgttttgcaaccacgagaatgtgtgcgaggtgaaaatggaccgtgaaaggaatgtcgggttcattcaatgccgcgtttgcatggaagacttccagtccaacatcaccgctttgtccgagccaattgacgtgtactctgattggattgacgcgtgcgaggcggccaatcagtgaaaaacaaaagtggacaaatcaccaacagagaacggacattgtgtgcacagaccagggatcaccttattattcactgatcatattggcattattttccaacgcatttttttttttgatttcctttttccattaaaagtcgtctcgtaaaaaaaaaaaaaaaaaaaaaaaaaaaaaaaa

SEQ ID NO: 90819 - DNA, 419 bp, Heterodera glycines
  SCN-specific regions: Sequence locations=1-131,153-329,351-419
cttcgcttctacaatttttctgttcatcgttttgcaattaacggatgctgaaatgtcaaacgaatacaaagaagcgtgcaatgacacatgtgctgctttaccaaagcagacttgcggtcgtggaaggccacaaagtaacagtaactcacagataacttgctactgtaaatggaagaccagcggatgctgtttcggagaagggtgtgtaccacgtgaacaaaccgcagatgaaattacgctttacggtcgcaccggaatatgaagaaaacaacagcagaagcaacaggcaaagaaacctgaacacttccactgaccaagatgatattttgacattttcggaatgcaaaatttgttgcgatgttatgccatttatgttacatttgttagcggataaaaattgttgtcttaaaaaaaaaaaa

SEQ ID NO: 90820 - DNA, 369 bp, Heterodera glycines
  SCN-specific regions: Sequence locations=1-338
gggcacaaatggcggcaaaactggcgttttgcagatgttcgggcggcaatttcacattgtgatggctgacaattccgtggcagttttgaagtacaagagagtgccaaatcgacgaatattggacttttaccacactgaagtgccgcccgatttccgtggccaaggctttgctgaacaattggttcgggctggatttcgccattgtttggacacgcgtttctccgtgtacccgtcctgtacatatgtgcaaaaatacatcagagatttggccacggaagaagagaagaaaattgttgtagaaaaatatcattaaatttgctgctgctgttttttttgaattttgctcattttgaaacaaatatttaaaaa

SEQ ID NO: 90821 - DNA, 813 bp, Heterodera glycines
  SCN-specific regions: Sequence locations=1-557,579-813
cccccccggtttgaggaaagtgcttaattcgcaaagggataccaactgcttaggagatgccatcgtccagcgggtcggaaaagggtaatggacgcaatggcgttcgtggcgaggaagaagtgaagggaggaaaagaaattgctagcaagacacttaatattcaatcgaagcgtttttatttggacgtcaagcaaaatgatcgtggacgtttcgtcaaattggctgaggttgctatgaatggtcgaaagaatcgtttgttcatgtcaatgcgaatttgcaagaatattaaggaattgttggggaagtttgaggggcacgtgccagcgtcggaggaagtgaatgggaaagcggagaatgtgaccattcaatctgaatctatcgtgaccgagagacgtcgatattacatcgaccttcgcgaaaatcggcgtggttcctttttgcggattactcagctcgagacgcattccgggattcgcaactcagtggcattgccatttgaggggatcggccaattgcacgatgcactggactcaattctggaggaatatggcgaagggttcattgaggaggaagccgaacttccccattctcagatgattcgtactgatgggaaaagctttttttttgatcctggccacaattctcgcggggactttctgaaaatcaccgagttgaagtcattcatgggagtgcgcaattccggcgtactttcaatcagagcaattccgcaattcactcaagtcctctccaagctctacgatgactttcaggagctcagagccgtagaggaagtgaacgtgaacaatgtgctta

SEQ ID NO: 90822 - DNA, 622 bp, Heterodera glycines
  SCN-specific regions: Sequence locations=1-66,88-285,310-370,396-622
ttttgaatttgcgcaaaaaatgccaccgccaagcattcacggacagcccaaaattcggcatgacgaacaaagcaattcagtgttcctggaggtgtcggtgcagggcgcggacgcgccaaagaccaaatggtatttggaggagaaggaaatcgcatcgggcaccggcgcgtatcggatgagcacagcggagcaggagggcggacgcaagttgctgatctgcgagatcaagaattatgacaaggcgttacaaggcaattacaaagcggtgtttatcagcgcagatggcaaagaaaattatgccactttcactgtgaaatctggaagtgcacctgagttttatgagaagccaaaaattgtccaaaaggataatggaaaaataattcagataaaagttagggtcaaatcgcacattgaaatgacttcggaatggtttaaagacgacaagcccctgaagggatcagaccgattaaaaatcagcagccaaaaggacgaaaaagatccgcagggaatggtgttgttgttggacattcacgaaccacagaaggaggaccaggccaagtacaaatgcgtggtgaaaaacgcggagggtcgcaatgaacagtcgctgaacctgcagtttgaa

SEQ ID NO: 90823 - DNA, 457 bp, Heterodera glycines
  SCN-specific regions: Sequence locations=1-457
tgtcgtcaattgtttaatttttgatgactaattccatgccgaaaatcctcttcacaatcatcgctttcgtcaacatctcacaaattttattcgctactgctatgtataatggcgaagatatttgcggtaaaaccaaggaagattgtcaagcggcactgattgcttttatgaacggacgcggaaataaccagaactatcacccgagcgaaaacggtccaagaaaggttgataatgagtggtgtatttgggtgcaaagctatgtaacaagtggggccccaaagatcaaaatggtgaagccatgaaaattgaaggcggacgaaagaatgatgaatgctaattgaccccatttgcttgttgttgttgttgtttcttttccgtcgggtcaattgtttgtccgcacttttttgggattagatatgtagattaaactttttgctatccaaaaaaaaaaaaaaaa

SEQ ID NO: 90824 - DNA, 533 bp, Heterodera glycines
  SCN-specific regions: Sequence locations=1-219,251-533
aatgaatccctcaaaaatgtttgctgtacatttcgccggtgttctccttcccctcttcgctttggcatttcttctcaacgccggcggtgcttttgcctattacgcgcaacacttttatttgccgagcagcgaattcgccgacacttttggaaaaagaatcggtgcgcaatcattgccaatgggtgccaacgaatgggcggcacagccaaaaatggcaatggaaagagaggaagaggaagggacggaggagggacagcagcaggggggagccgaagtgatggcggagagtggggagggaaaagcgaaggtcgcgccgatggcgaggggaaatccaacgaaagcaccaatgattccccgccgtacacttcgccatttattcgacgactttggaagtggccaaatggggcgacaatacaaacgaatgaagccgtgcttttactctccaatccaatgtctgatgaagcgatcttcggcttaacccgaccgaacaatgccaaacaaagggaccattctcaaaatacccaatttctatg

SEQ ID NO: 90825 - DNA, 573 bp, Heterodera glycines
  SCN-specific regions: Sequence locations=1-14,36-399,426-573
tttttttattcgtaaattactactaccaaagagaaaatgggccaagctctaagtgaaccgatcacaaccaaaaacagcgcctcttgttccaatgatcgttattttgtcggttcgtcttcgatgcaaggatggcgaataagcatggaagatgcccacacgcatttgctcgaactgcccgaagatccgagcacagcttttttcgccgtttttgatggacatggtggcgctcaaattgcgaaatacgccagtgaaaatttgcatacgcaaattgcccaatcgaatacattccgtgagggcagaatatccgatgcattagttgaggcatttttagaattggacgagcaaatgatggccagtgaacagatcagagaggaaatgtccgggagtacggctgttgcggtgctaatcaaagacaattttatttattgcgcaaatgctggtgattcgagggctgtcgcttctgttgatggcagggcaattcctttaagcattgaccacaaaccaaacaatgaggaagaaagtcgaaagatattcgcagccggcggatatgtggaatttggctgtgacaatggg

SEQ ID NO: 90826 - DNA, 472 bp, Heterodera glycines
  SCN-specific regions: Sequence locations=1-399,421-472
atttactttcctttcgccgaaaaatgtccttctatactgtacatcgtgatcagctgccattgcgtgcattgttcaatcaacatggactaagctttcaacagcgttggcattcacctcactacaaatacagtgaggtgctcggcggcacttaccatatcccgcacagccgttacccaccccatgacgtgtacaaaacaccgtggctgtgccacctccatccaactcatttgacgccgggcgagcccgattggtggtactgaaagatgaacatgtgtaaagcaaagagaaatattaatgagtgaaaaacggtcattaacaaaaatgatattaattatactaaccgagaacgattaggagaagccataaattctccgtccgaaaattggccaatttatttttgattttattgtatatgctttctgtatactgtagtattgtacaacacaaaataaatgctaattgattttaaaaa

SEQ ID NO: 90827 - DNA, 439 bp, Heterodera glycines
  SCN-specific regions: Sequence locations=1-143,165-263,287-408
aaactttctcctgtaaacatcgactctaaaggcgtttttaagtacattctcataaaggcttctgatggcgcaactgaaagatttttggttcgtggttatggtcgttgtaaatttcacgcggatattttggaggaagtgcaggcaagcgaaggagagaaggccattgaattttcttgtgttggcggaggccggataaaacatgagccggaagccaaacgtatcttcgtctacggatattcccaggggtttggccgtgctgaccatgcgaaatctgtcgaaatcctgagggaacgttatccaaactacacaatcgaatggtccaacgaaggatattagggcagtaaatctagtatacaatattgtaacgttttttgttttctatatttaaaaataaaattgggttctcggaaaaaaaaaaaaaaaaaaaaaaaaaaaaaaa

SEQ ID NO: 90828 - DNA, 377 bp, Heterodera glycines
  SCN-specific regions: Sequence locations=1-297,319-377
tgtaattagtaacagttaattgcctttgtctaatccttttgccattcatttggctttgaatgctttccttttgtcccccctttttttgctcgtcggttgttcagcgttatttctaagaataaagcgattggcccttttctcacgcaaacgttcgatgctttttgttggtcctggggaactttgtccgattcccggccccgcctcaacgaaaagcggacacatggccaaaggaaggaaagcgaagtcggcccagaaccaaccatcgaattgagctaatagaataaccaaattctgatgcaattttgatttgtgcctaatgaatgtttttacccttttcataaaataggttaacgataaatgagcttaattatcaaaaa

SEQ ID NO: 90829 - DNA, 288 bp, Heterodera glycines
  SCN-specific regions: Sequence locations=1-288
gcgcaaaaaattcttcgcttttacaatttttctgttcatcgttttgcaattaacggatgctaaaatgtcaaaaaacgattatgaaaatacgtgcggaaacacatgtggtcgtttcgcgaaaaaaggtgattgtgctggtaaaagtccgataaatacgtgtgtaacggaaggagattgctactgtaaatgggaaggatgcagagcagactacgaagagtatgttagtaatccctgatctgatgtcatttttgttacatttgttagcggaaaaaaaatttgttgtcaaaa

SEQ ID NO: 90830 - DNA, 826 bp, Heterodera glycines
  SCN-specific regions: Sequence locations=1-620,643-804
ttatactggctggtgaagagaagcgtattacttgggttccgcttgagtcaaaccctgaagcatttaataagtacatcgaaaaaatgggcgtgaaaggagttgagtgccacgaacttttcggttttgagcctgacttggtcagcttcgtgccgggacctcacttggcgctaattttctgctacccttaccaagacaaagcaaatgactatcagaagggaatttacggacaattgacggcttcagacaaaggaggcgtgccggaatgggccttcttcatgaagcagaaaatacacaacgcttgcggcacttttgctctttttcatgctctgacgaataacaccgaccgaattgacattggaaacggcgtcttctatgattggtttaaggcggcaaaacaactcaatgttgaacaacgctcggaccttttggcaaacgattcggagttggctcatttgcatgaacactgtgctttgagggaatcggagacagatgtcccaaggaatgttgctcaccacttcatctcatactttacacatggaggacgtcttttcgaatttgactcgggacaggaatttccgcgcgactgtggaccttccagcgaggagactcttttaactgatgctgggaagatttgcaaagagctaatgggccaattggaggacatttcatgcaatgcaattgcactctgtgccaaaaacaattaaattgatgaaatgacaaagaaaatattacgatattcccgtgttttctgagttcaataaatttgacaagctttggtcataattttattaaataaaccaattgaaaaaaaaaaaaaaaaaaaaaa

SEQ ID NO: 90831 - DNA, 445 bp, Heterodera glycines
  SCN-specific regions: Sequence locations=1-445
aaatacgacatttacggctgctttgattagcgatggacgtgctgaaaatcagttggagcaaaagaaacccagccaattgcattccctcccattttccatggattttaatgggccggcattggtctccaaattcttccagactgaggatggcgctaatgggctcaaagcagcactgttccgaggacatttgcttttgggcaaaacggtcagagcgccggagggttttgcgttttatgcagtcaaagagagtgaacattcacaatcagaagaagggagagatgagcacgtacaatgttgtggactctgttccgtcgatggatgtttgggagtacgacgaaccaccagaaagtcgtaagaaatgcctgcagaatgcattggttgctctgcaagttgcgaatgatctcgccagctgaattgttgttaattgtataaattttcaccaaaa

SEQ ID NO: 90832 - DNA, 563 bp, Heterodera glycines
  misc_feature (198)..(198): n is a, c, g, or t
  SCN-specific regions: Sequence locations=1-540
taaattttgcaagcaagcgagaccagtgtggcatgcgcaattacatcgaacattcgttgactaaaatttgcgacggagaacccatactgtgcccattacgttgtgccgggaaggaacgcgacgccagtgctaagggcggaatattcaaatgggcgactagtccacgtgaacgcaaaggctttcagcacggagcgagtntgtttgcatatgaacaaccttaggacgcgcagtggaattccaatttataaatttgaaaactcccatttttctcacaataaatctgtgcaagggatgtggacaccgtcaaaatggagagacactcgtcagaatttgcacatacttcccaaacccgaattttcgccgttgttgacaagtgctacatctgccactaaatttctgtgggagaactctgttccgccgacagcggaggaagtgaaagacgaaacaaaatgattttgtttatttatttcgatcttttggtttatgaggacagatcacacatttatcccttttcgcgcttctgataataaaaagcgatgtaaaaaaaaaaaaaaaaaaaaaaa

SEQ ID NO: 90833 - DNA, 638 bp, Heterodera glycines
  SCN-specific regions: Sequence locations=1-638
aaatgaatgctttccgcttaatcgctgatctttcccacctttttgcaattcttattttgctgtggaagatatggaaaacgcgttcttgtgccggactcagcggaaagtctcaagtgctttttgctttggtgttcacctgccgttacttggacatccttcactttatctccatttacaacaccttaatgaaggttctgttcatcggttctctcttcgccacctgttatttcatgttcgtcaaattccgtgccacttacaataaagacgaggacactttccgcgtcgaacttctcgtcctcccgtgcattgtgctggcgctgtttgtcaacgccgatttcactgcgttggaagttctgtggaccttcagcatttacctcgaggctgtcgcgattttgccccaacttttcatgcttcaaaaacgcggcgaagcggagacaatcactgcccattatctgtttctgcttgacatttaccgcgctttatacattttcaattgggtctatcgctattacactgaggcgttctacgacccaattgtgatcgtctcgggcattgatcaaactgttctgtacgccgatctcttctatctttacgtcactcgagtagtcaaagatggagccaaattggaattgccgatc

SEQ ID NO: 90834 - DNA, 722 bp, Heterodera glycines
  SCN-specific regions: Sequence locations=1-285,310-722
atgccattggaggattattggtccaaagaacgtagtggcaaaagggttctgtcaatccaaagtcacgtcgttttccggctttgtcgggcaataaatgcgccgtttttcctttacagctgcacgggttcgaagtggacgccattaactcagttcaattctccaaccacacgcagtatcccaatgtgaagggccagcggctgaacgaacgcgacttggccgaattgttcgacggaattcggaacgccgatttgcctgccaaatattcgcacattcttaccggctattgcggcgacgcctctttcctccgtcaaattgcttcgatcgttcgcgagtgtcgtcagcacaacccaaaactgacttatgtttgtgacccggtgatgggcgacaatggcaaatatgtgagcagaattaggcatttttgaaaagcatttatgtcaaagtacaacggaattccgcgcgaactgtgctcaatttaccgtgacgaacttctgccattgtccgatgtgatcactccgaacgcattcgaactgaggacattgccatagccaacgaaagggactgtcttcgtgccatggaacatttccaccgagtcaaacggattcgcatcgttgtggtgacttcgggggtgcctgacgaaacgacaaaaaacaaatcgatgatgcattgctacgcatcggaagccattccatccgccgtcgacaccatccgagtgcgctattttc

SEQ ID NO: 90835 - DNA, 340 bp, Heterodera glycines
  SCN-specific regions: Sequence locations=1-194,216-319
gccttttcgtcagtcgaaaactgatgatggaatgtttgcggggtgccggactgattttagaaaggtcggcacaattcgaaatgaaaggggaaaaccccggaacaaaacagagaccaattggacaacgaattgttttatgaattggacggaatgtacattttggtagcgaggaaaatggccgagtgaaaggaatggaaaaggatttaatggattttaaaatttgttaatacatttattatttttgattgtttcacaacaattgttgaaacttttcaacagttaatttggcagtttttgaaaaatacaattattttttggcaaaaaaaaaaaaaaaaaaaaa

SEQ ID NO: 90836 - DNA, 232 bp, Heterodera glycines
  SCN-specific regions: Sequence locations=1-232
aattgcattggtgcgaaacgcgagcgccgaaacacgagcgccgaaacgggagcgccgaaacgcgtgggtccccaattcttatgcttaatttttaaacgatgcaaataaccaaattaccaaatttgcaacaagagtatatgtaaattactgtaattcatgaataataaagatttgttaatggtcaaaaaaaaaaaaaaaaaactcgagactagttctctctctctctctctct

SEQ ID NO: 90837 - DNA, 482 bp, Heterodera glycines
  SCN-specific regions: Sequence locations=1-388,411-482
aggggcgttggcgagaatgagtttcaagtggacagcattttggcacggcgcgtgttgcgggatgggcgcgtggagtatttgctgaagtggaagggctgttccgatagtgagaacagctgggaaccggagcagaatctgaactgtgctgacttgatggccaaattcaacacgcaaaatcaaaaagtcgaaccgatggatgtggagggcgcaccctcccaggacgaagtcgaagagattttgggggcagcgcggatgaatagcgaaatcttctatctcgtcaagttgaagggcgattccttggctcagttcttctcgtcccgaatcgcctctgaaaaattccccaaattggtcatagatttctacgagcagcgtgctgacatgcagtgaacgaaggcggggaggaaaagaatcccattgcaattgaccaaatgtttcattttatatattccaaaatttacaaggaataaaatatttgcttgaaa

SEQ ID NO: 90838 - DNA, 473 bp, Heterodera glycines
  SCN-specific regions: Sequence locations=1-193,215-288,310-396,418-473
aattgataacctctcctctacaaattacacacaacaaatatggttgttgacatttcaaagatggagcctttttcaccaccagtgagtcacgcgttgttcccccatttgaccactgttttgctttccatcgggctcatcttcaccgcgtggttttttgtgcatggggtgaccagtacgaagaaaacgcgaaaccttgtcaaggagttgttcatcggcacattggcgtacctttttcttggcttcggcaccctttttctgatgctttgggtcggcatttatgtttagagttgaaaggaggaagaacacagggatttttgtcttatttttggggactttttttttctaatttatttgtattttttttattcctctgctaattgttattgagtgagtctgcccttttttgtttgtttcttcccaatttggaaactgttgaatgttgtgtaattgtttgtccctttaatatttttatt

SEQ ID NO: 90839 - DNA, 538 bp, Heterodera glycines
  SCN-specific regions: Sequence locations=1-538
ttttacaatgtacaacaacgtaggactaccaactgctcgtggttctggcacgaatgcatatatccaagcaaatttgtccaatttgggattctccagaaataaactgcaatataatgcagaggaggatattgctaaggcagaggcagaagttaacaagactccaaacatcgaattactcgaccatgagtacaagcggctaatcgaaattaaatgtgtcgaatttgaggatcttatggaaggaaagggctttagtgagagtgaaatcacttcaaaagttaacgaatatcgtaaacttttgtttaccgagtttgagaacggtcgattggatatggacaccgaattggatcttcggaacactcattcgagggctaaagttgccaaagataacagagataagtggcgatcagcacttagaattgacgcagcttttgttgacggctcttcgctggaaaaattgaaaaaagccagcgaatcggtggttgaaatggccaagaatgtcgataagaaggcgcttgaacaagaaatggaaaaatcgctt

SEQ ID NO: 90840 - DNA, 498 bp, Heterodera glycines
  SCN-specific regions: Sequence locations=1-82,107-155,177-498
cggcactccaaatttaaacaccgtcttcatgctgattgtgttggccacttcgcttctgctgttgatgccgtccagcagcaatgccaaagtgatgccccaacttggcttcgcgaatgcagaacaactgatgaatgacaacagcagtccaatgggcgccggagttgagggtgaagtcatggacaaagtggaggcccgacttttgggtgcactggaacttcttcaaagctataaagaagtcccaattgtgcccaaattcacggaaaagcggaagaacaaattcgagttcatccgattcgggaagagaagacgatgatcaacaagagagagagagagtggaaggacagacagtcagacaaaaccatttgagtgatcagagagcggtgatcaatgatacatttttaacaaatacacgtacaattttggtaatattatcgctggcaatgggacattttttgcttttttgatgggcattgaataaagagaaacactgtgaaaaaa

SEQ ID NO: 90841 - DNA, 613 bp, Heterodera glycines
  SCN-specific regions: Sequence locations=1-351,374-592
attgcaccgtttccgcactttcccctaaatcctttgaacttacattctcatggtcgtggcgaagaatatttgccggacgaaaaggccattttcggatttaaatctgttgttgtttctgagttttgtcctctgttctgagtttatcccggcaacgaatgcgaacgaaaacggcagaagcgcgccgtggggacggagaggagccttcaaagtcatcgcctttcgtccaaggcgtgccttggacattttggaatcggatggttttggcggatttcggaaaagagcattggatgtgatggacggcgatgggttcggttcatttcaaaagagagcgttggattcactcgaaggcgacgatttcatggggctgaagaaaaagaaggctttgactacagcggacggggacggcttcactgatttgggcaaaagagcattggatgttcttgacggagatgattttgttggcttcaaaaaacgcagcgaaatgcaaaagaaactcgcactgttagaccaaattcagcaccgacaaatgagggcgagaagagcattggacgccctagaaggaaacgctttcggctttcggcgattagcaaaaagcctaagaaaaaagggcttt

SEQ ID NO: 90842 - DNA, 397 bp, Heterodera glycines
  SCN-specific regions: Sequence locations=1-61,83-371
gccacagtctttgtggaaattcgtgacaagaaggccgcctttgtgctgttcggaagcgcaatgaaacactttgacaaggacattgtgccaacatcggatggggcaaggaggaggaggaaaagcgaacagaagctcagactggagacggacgaacagagaatgaggctggagatggagaggcggacgaagacgcgcaagcaaataggagagaagaaacgcagaagattgagcaccgatgataattgggaataggaaaatgccaatttccgttttatttttattcattttaataatttcaaaaagcaaaaaaaaaatgacaaaaaaattgtttatatattgtgtatgatcagtgtgaataaattagcagcgataaaaaaaaaaaaaaaaaaaaaaaaaa

SEQ ID NO: 90843 - DNA, 460 bp, Heterodera glycines
  SCN-specific regions: Sequence locations=1-460
gcaatgcattttgggacggcgcaggattatgaaatgaaagattgtgccatttgcaacgagggagtgccattgggggagaaattggtggtggagaaagagacgatccacttgggctgcttcaaatgcgcttactgcggcacgcgtctgcaagtgggcaattgtgccatggaattgtccttttacaaccgatacggcccgtgctggtactgctcgctgatctgtgcccatctgccgaccggggaaaaggaggcaaagctcaaagcgttgggcaagcaggtgagacagccgaagaagaagcagaactgatgagatgacctaccgatggaatgacattgatcagagggcgagtgatcggaaggccaaacggagacattggcatggaaaagtgatcagttcgagcagaaaatgtgcaatttcgaaattacacaataaaaaactgatgaaaaaaaaaaaaaaaaaa

SEQ ID NO: 90844 - DNA, 632 bp, Heterodera glycines
  SCN-specific regions: Sequence locations=24-276,298-583,619-632
cttctcttcctcctcctccgtctgcgttcctttctcacttggacacaaattgtttctgtttcttttgccaattttgttcgccgtccaacaattcgggatgacagaagccagcccattaatccaacaaaaagatgattccatccccatgccattggtgttcgaccggccatggcaaccaccgatttcgttggtgccaaaccctcccccagcctatttcgtgatccctgcaaatgtgccattggagcggcccatttacgatcaaaatgatagtgccattgaggacgaattggcggaggaagcgaaggcgaagcgagcgcaaacgttcgtccgattcggcaaaagggcacaaacatttgtgcggttcggaaagcgggcacaaacattcgttcgcttcggaagggatgcgcaaaggcagcaagaaatggcaaatgagcaggcgcagaaaaaggagtgaaagggacggcggcgaagtgggagaagcaaaagaataatcatttgaaagaagaaaggatgaaaagtgacatgacccttttgatcagagaatgttgcacctttacccaaccgaattgataaaatgtaaatgaaaaaaaaaaaaaaaaaaaaaaaaaaaaaaaaaaactcgagactagttc

SEQ ID NO: 90845 - DNA, 668 bp, Heterodera glycines
  SCN-specific regions: Sequence locations=1-33,56-226,248-668
catacattgactttcttcgcagatgctgacgtggaatgggaggggaagggaaaaatgatttacccaaaaatgtttgcaaagaatcaaaactaaatccttcttgtccctcacgacagagaaagctttttttcaaaacctatttctaatttgcgaatgttgagtttattagttgcattattatcgtttaaaaaatttagccgaaaatgaatgtgtttcgactttcggccgatttagctcatctcgttgcgattttcatccttttgtggaaaatatggaagacccgcagtgtcgcgggcatctcgggtcgatctcaagtcattttcctcctcgttttcatttgccgttatcttgacttgttcacaaattttgtgtccatttacaacagcgttatgaaagtcttcttcatcggttcttccatcgcgacggtctttttcatttacttcaagttcaaggcgacatatgacaggaaccacgacactctccgaattgaatttctcgttttgccgtgcctttgtctggcactcctcatcaatcacgagttctctctatttgaaattctctggactttcagtatttatttggaatctgtcgccataatgccacaattgtttatgctttccaagaccggttcagcggagacgatcactgcccattattattccgccttg

SEQ ID NO: 90846 - DNA, 797 bp, Heterodera glycines
  SCN-specific regions: Sequence locations=1-294,369-423,445-578,600-797
ttgtcaattaatgaatcgattgccaacagattttgtttccgatttgcctatggaagttctgcctgccttttaccctctgccaactttttggatgcctcaaattgaaatcccaccattgagaaaatacgaagtttctaaaaaggaagtgttctaaaatgacatatctttcagtacacattcgaacatgaaaaggcagccatcttcagatgggaaaaagaaagacgaagcgaacgggtcgaagaagagacagagcaaactcagcagatgagaaaacaacggcaaaggcacatggaagagaaagggacgaaaaaggacggggagagggaaagagcggaggagggacagagacggacagaaaggcgaagggataacacattgaataaccctgagtatcgaaacggagaatgtttcaaaattgaatcgcactccttgccctcttccaatgtttcaaagcccaaccaaccgccacattttgcctcttcgtcacttctaaagccagtcccaatgtcgaagagttcgtccaattctttgcacgttggcatcgcatcaactcaaaatggaaatatgttgcaaaaatcgaccaataacaatacattgaacgggttagaggaatttgagccccgacgcgacctttttgacctattagaattgcggtcgttagacgcccgaaaagaattggagaagttctttgacttgtgatacgattattttgaccaactatcatcatgttgtttttatgtaaattttattatacctaaataatatggaatcttttgcctttttaatgtaaattttaa

SEQ ID NO: 90847 - DNA, 389 bp, Heterodera glycines
  SCN-specific regions: Sequence locations=1-13,35-244,267-271,293-389
ccaatattctgtctttattttgctgtgcctttttctgattgccgaatttggccacacttccgcagagtgccaaaaggacaaaaccgaagcgacaaaagaagcattattgcttcaatacttttttgctcgtggtttcccttttctgtccgactccgacgatttaccaacagcagcagcagatgaagtcaaacaaaaattgacaaataaatgtgattgatgatggtgatcggcagtgatcggttgagaaaatttaaaaagaaaattttaccaaaaatgtaatttcattaatgatttttaattggtgattggagtttgaaaatgagaatcgcagatcatctcttcatttttggttaatcaaatgaaataaaaattgaaaaaaaattgtaaaa

SEQ ID NO: 90848 - DNA, 475 bp, Heterodera glycines
  SCN-specific regions: Sequence locations=1-200,376-475
tctcccgcgctttccttctcttttgtcttatttttgtcgtcgcattaaactcttttaacgaagcgagtttaatcatcgacgaatgcaaaagtgtgtgcccaaagacgaacaataaatgcgcgacggattgtgtgaaatgcgcgagtggcaagtgcaaaaaagaatgcaaaaagccagcggcaccaaagtgcgcggagtgcggaaagaaagcggtgaatgaatgtaaagcgatgggaaagtgagggaaggaaaggaaaagcgaagggaaaaagtgaaagagagagtgaagaaatgggagagggagacagacggacaaagtcaaagagagagagagaagaaatgggagagggagacagacgaatgaaacgaaatgaatgaatggcatttgtacattttttaatgaaacgatataaccgaacattaccatttttatgtcaaattgataaatttgatgggaaaaaaaaaaaaaaaaaaa

SEQ ID NO: 90849 - DNA, 440 bp, Heterodera glycines
  SCN-specific regions: Sequence locations=1-316,338-416
ttacaaattaatttgttcaatatacacacataaacgatggagcttggtgatatggttttggcaattttggagttgatctgttgcttcttcgtgccgcccattgccattctgctgaagtcgggcgagtgcaaccaacaagtgctgatttcggtcgttctttgcattttgttgtggatccctgccgtcatccatgccatttggtactgtttcattcgctgaatgccatggcgaacaatggcattgaaatgattcgattggaccgtttcttattcataaaaaactattccgattttgggatttgttacatatccaattctcatcattttcaccttttctcatcaacatttcaaaaataaaatcgatcatggttgaaaaaattcaaatacaaaattaaaagaaaagtaaatttcaacccgaaaaaaaaaaaaaaaaaaaaaaaa

SEQ ID NO: 90850 - DNA, 592 bp, Heterodera glycines
  SCN-specific regions: Sequence locations=1-546,568-592
ggaatttggcatcggtgaccgatttttgcttgtcctaattagctcagcaattgtttacaaaatcttcccattctccgtttttgttgcccttttctcttttatcgtcgcttcgtggatttactttcaataccgccaaaaacaacattggcataatgtcggagtgccgggaccaaatacaaacattttatttggcaacacattgaaacaatttcgcactggcgtaattgaggttgacgaagaaatgttcaaaaaatatgggaattcatatggctcgtttttatttgagcgacgcgaattttgcaccaaagacccgaaaatgttacgacaaatgttcatcaaagaattctcgcactttcagaaccgttataatgccattcccgaacgcgaacacgcgccaaaatcactgatgcgcaatattctcactgtgctgcgcgacgacgattggagacgcgtgcgaaatcgcataacgccggcatttacgacgggataactgaaaaaattaattccgattttatgcgaaggcaccgaaaaactgtgtaaagtgttagaaacggaaaacgcactgaaggggaaggaagtgccgttgaaagag

SEQ ID NO: 90851 - DNA, 567 bp, Heterodera glycines
  SCN-specific regions: Sequence locations=1-445,467-529
tcctgatttccctgattgtgcttggcattctgctgaccaatttggaggcatttcgccaacaaactgttggcatcagaggccgtctgatgtgtggcaatcagccgttgaaggacgcgaacgtgaaattgtggaacaaaaacacgctcggttccgatgaccaactggcggctaacaggacagacaatcatggcaattatgagttgcaaggaggcgttggacagctcaccaagatgaatgtgcatttcaaggtgtaccacgactgtgacgacggaatcaagccatgccagcgccaaagtgaattttggcgttccggatcattacgttgaacgctcagggtccaccaagaaatggtttgaggctggcacaatgaacatggaattcaaatacccagatgaggaccgcagttgcatcaattgaattgaagattaactgaggcaatttgatgttgagaaaaacaaaatttttgatagtaaaatgcgaattttccgctgttcgttcgacgattatttaaaacagttgtgcttttcacattttttaaaaatttttgaataaaaaaaattaattttt

SEQ ID NO: 90852 - DNA, 583 bp, Heterodera glycines
  misc_feature (529)..(529): n is a, c, g, or t
  SCN-specific regions: Sequence locations=1-375,400-583
acaaatacagtgaaaattggtgtgatgaatgacgacattcgagatcagcccgggacgtgttcaagaattttccctctaattggcatcaaatatcagtattatttggacagactgacgccgtacactgcggtccgatggacaattgcaattacgcttattgtttttttcgtgtggaggattgtcgctatacaggggttttacattgtgacgtacgccttgttcatttactatttgaatctcttcttggcatttctcacacccaaaattgatcccgcagttgagtattgacaaagatgacgatggtccggtcttgccaagttcaaccaacgaggagttccgaccgttcatgcgtcgtcttccggagtttaaaatttggttgtccaccatgaagtccactcttgtcgcctttggctgcactttcttcgaaatgttcgacataccggtggtttggccaattttggtgacgtactttatcgtgctcaccactctgacgatgaagcgacagattatgcatatgattcggtaccgntacattccgatgtcgtgcggcagaccgcgccctcagggcgaggaggagaccggc

SEQ ID NO: 90853 - DNA, 588 bp, Heterodera glycines
  SCN-specific regions: Sequence locations=1-434,470-511,540-588
tgaaaaactaataactaattcgaatgtcaaccatcccaatgccaccaccaccaacacaagacgaaaaggaccaacaaaagaaatcccaatggaaaccgctggagataggaacaacgaaaattccggacccagaagaattgcctttcggaattgtacagactgcattccgagcttcagatcggatgcgcacgacctcagaagattcggccgagtcttttgacgcctatggaccggattcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttattttatttaacacttcttctgatttttcaataatgaaataaagacaaacccaccaaaaa

SEQ ID NO: 90854 - DNA, 589 bp, Heterodera glycines
  SCN-specific regions: Sequence locations=1-1,23-82,104-370,393 -442,464-589
tatgaagccaacttttctcatgctcatttcaacttgtattattgcgttggtttacgcatctgcggagtatgatgaatgtgaagtttgcactgatctgtttacggaggtgatgaaaaaggttgatgagtctggtgaaaagggagagccggcagtgaagaaaatgattattgagcattgcaagtctgtcaaaggtgtggatgataagaaagaaaaattgtgcttctttattggcgctcatcctgactcgtccacttcagtcctgggcgatattgcgaaaccattgagcttccataaaccgccgaataaagtatgctctcaactcaaggaaagggattctcagatctgcgcactgaaatatggtaaacatatcataaataaaataaaaataataagactggcaacgagttcacatttttgtctaaaattcaacctaaaacttcactattaaaataatttgcatttttcgtaacgtgaatttggatgataattgtttatttttgtcccctaaaatcgggtggatctttttgtaaaaactgttaaaatgattaaaaaatttctaatctgtccaatttaaatcactttcagataa

SEQ ID NO: 90855 - DNA, 531 bp, Heterodera glycines
  SCN-specific regions: Sequence locations=1-112,134-397,419-495,518-531
tttttcatccatcgcttcccccattaaaatggtcgtcgttctgtcggcactttcctccggcacttttccccctcatttttcactgcgttggcattccctctcatttttgctggtgttcattctgcttacagttcgcttctccgccgacttcaccaattgtcattccgtgccgtctttaatggcatttgaccccacaaaattgcgacgacttatgccaattcgggaatttttgagcgacgatcaattggcattcgaacgcgcaattcggcaacccgcgggcggcgtcaaatggatgcgctttgggaaaaggacgccccagggcaaatggatgcgattcggaaagcggaaaatggcaatcgaagggggcaagtgggtacggtttgggaagagagcggaagagatgcagggagaggagtgaacggacaaaatgtaagaggaaaaaggaagagatgagagagtggaggggacgagacactgtgaatagggagagaacggcagacgaacagacagacagaaaatcactgctgacga

SEQ ID NO: 90856 - DNA, 577 bp, Heterodera glycines
  misc_feature (512)..(512): n is a, c, g, or t
  SCN-specific regions: Sequence locations=1-304,327-477,500-514,541-577
tgaatcaaattaaagtagatcaggaagaaagcaccaaactttgggattggccattgcaatcccatgacgaacttgtgtcaatctacgatggtcgtgacagatgggaagttggcttggacaccggatttttcacgcccaacgaaatcgaagtgaatgccaagtgcaatgtgttgacgatcctcgaacggcacttggttcacatcgtagctgcagttgtacaattgttgataccggtcggcatggaacagatacaaatccatgttgaaaaaattgtaaaaaaatagttttccctgaatttttaaaagtttttaaatatttacaaaaattcctacgaatcgaatccatccgagtcgtgaaatttactgtttttcccaaaccatggccttatgaccctttgtccttttcaattccccgacaattcatacttaatttttgggcactgaaattcatcaccgacttaggtactcagttattgtgaatctctgtatccattcccaaaccgaagaaatttntcgagatttttgtgaaaaatttttggtcttatgtacgaaaatgtcataaaacataatgtaacaga

SEQ ID NO: 90857 - DNA, 299 bp, Heterodera glycines
  SCN-specific regions: Sequence locations=1-115,137-150,189-277
tttctttgtgtctctgagcaacaaaatggcaaaaaaaacgaaatatttgattgtaaggctcgcgagtgttatttcgggcactaaacaaatttgggttagggagagagcagcagccgaagcggcggccattctttacgacccggcgattggcaaaaatgtgctgttcaaagaagttgagcaggtgaaaggaaaggattcttttcccgacagagtgaagaaaatgtacaatatcagttgatcgaatttcaaatgcaaatggatttgataaatttgtccgtttttaaaaaaaaaaaaaaaaa

SEQ ID NO: 90858 - DNA, 508 bp, Heterodera glycines
  SCN-specific regions: Sequence locations=1-331,382-508
cccccccccccccccccccgtgaattgatctcatcgacaggctgcaagtgagatgaattttggaacaggcccaacaaaaaaattttgccaaatttgtagaacatggatcgatattttcgaagagaaggtccaagtggaaaaatttacgatgcacaaaagctgcttcatctgtgcaatctgtgactgtccgctgcagccgggcagctgttcccgcgacgacggattgatgtacatgcagttcatggccggccatcgcattccgatgtggctctgcagcgcgcacatgcacatggggtcgggcgagaaatacgaattgctgaaaaagaagtaccaacagtaccaacagtaccagcaacaacagcaacaacaacagcagcagcactgatcaacagaaagcagatcagcagcaaacaagtggaagcattgatcggaaagtcaaccaataaattagtggatttattgaccgattaaattaatttactgtgacataaaaaaggcaaattataaa

SEQ ID NO: 90859 - DNA, 365 bp, Heterodera glycines
  SCN-specific regions: Sequence locations=1-365
aaacggatgattcttgccgaggcggaacagagagcatttgcgcccattccggagtgctttttcgagctgtccaacctgttgatgctcaacgtgcgggaggatgtcgagcagtatgagcagcacaatactgtgccgaaatggttgaaacacttctcgggaaaatgtcggacaaggacgcgttccatttgcgcaaggagatgaatgatgttttgacgaaatacgcggccgccgccatcgacgacaaatgagaagagagggattgattgattgtctgccagtgatttattacgcttgcgcatattcatttgatcacaaattgtcactgcttttccgtttctgaccatttgttgagttagttattaccc

SEQ ID NO: 90860 - DNA, 485 bp, Heterodera glycines
  misc_feature (422)..(422): n is a, c, g, or t
  SCN-specific regions: Sequence locations=1-485
agcgatcattcgaacataatcaaaagtaacgaaaccacccgagcatattcattcctcaacccgccggacgagttcgatgagaagccgaagcacaacctgtaccgttggctgcacacaccgcgcaaggatggccgtccgaaaattgtgacaattcgcaagcggcgcaaactgcaatgggcttcgtttatgccaagcttgatcacgtttttcaacgcttcgagtactgtccctgtcaacttcctcgtcatttgtcacattgcatgccataccaacttccagaagtgaacgcgtgggagaaggaggcaaaccaaatgttggacaatttgctgtgcttcaccatcaaggacagtgacattgggcccgcactgctcgccgaactgatggccaacgaatgaggagggatgagaaggaagtgtgcgcantccaagcggaagatgaaaatattgtggatgaaataaatattcattgtaaatgtgccgatgggc

SEQ ID NO: 90861 - DNA, 662 bp, Heterodera glycines
  SCN-specific regions: Sequence locations=1-538,560-642
gccttgtccccgtgctggtactgcttgcactgcttggtgggctcttgcacaccggtgcgcaggagtccatttccacgcgctcaacacgtgcggagggcacactgatgtgcggaaaggtgccggcctcaaaggtgtacgtgcggctgttcaagaccaactccgatgaaatcagcaatgcgttggcaacagcggtgaccaatgatcagggcaaattcatcattgaagggaacaccgccaattaccaaggctcggaagcaaatattgacccgttcctgaagatctaccacaaatgcgatcagaaggaaggcaaaaaaggctaccgacggatcacacttcgttacccgagggaatacgtcacaattggacgcgttccacgacgaaattacagtgtcggaaatttgaatttggtgctccaatatccaaatgaagctcacatcgacgagctcaaaggcatttgaatgaatgaggaattttttgaaaaaaaaacgatggaaccgttaattgacaaacaattgaaatgcgtaaaaaacagcttgggaataaatgaaaattttatttgattataattccttaccgtcgattcattttgactttttcccaattaattaatgatacaaaatgcagaataaatacttaattgtcaaaaaaaaaaaaaaaaaaaa

SEQ ID NO: 90862 - DNA, 643 bp, Heterodera glycines
  SCN-specific regions: Sequence locations=1-643
tgccaaaagaaggaaatcgctttaaaaagcacttcgacccattgactaccaaagaagcaaagtcttctgtcacttttcgatccaccgaaattactgcccatgaatatttggatttttcattgtttcgtttggtgccaccgcatttggtggaccctggcacaattgtggtaaaaactgtgcgacagccaaatgttcttgaatagcacaattatcacaagcggccaattatcaaaaccctggtcagaaaacggttgtattggctgcgttctccctccccaacttttgctgattctgatcactcgcaaaacaatgaatcgtcgatagaatcagcggcgaatttgcatgagaatacggcgacggaggagagaccgcgcgcagaaagcacatcacaaaatgttggcgccgatgccaccgcgtgtatgacgacgcgtccctctgacgataacgagtcatatttggatgaacagggcctccgttggcatcgacttttcgccgtgcccgacaatgatttgtcgacactcctgcgcatttgcattgaatttggcggtggcacggcacagaattggtcaaatggcaacaaatgcattgttttcggttgcgcatttgcacaacaaaaaaatgccgacgctttgtgcccttttcg

SEQ ID NO: 90863 - DNA, 639 bp, Heterodera glycines
  SCN-specific regions: Sequence locations=1-19,51-639
agagagaactagtctcgagtttttttttttttttttttttttttttttttaaaatttagtcggggcttcttaagcctcgcatggaacatgcacatagaactaccaaaatcgatctgataaaattatcgcttttcttgtgcccgtttctttaattcagtgcactgctccatttatgctaagtcacgttccccgggttgttgcgagccaagttaagcattgagtaggctgactccatagttatctcacgatcaatttcgagaaaatcgggcaaacgcggctcaggatcaccaatagggcgcgtggtgtatgtctcgaggatcatcagctgttcttcattgtacatcaaagctggaggaagaggtgcaatgtaaatgtccaggttaaaatacacatttccgaagagaaaacacacacgtttcttgcgaattgcttgatagtctttgtcaagaagtttcaagtagatctgatactcatgccagtccaactgcttccgtgtttcaaccggttggggaagtttcttgccatcagcgtcttcaatggttcgggtcgtatgtgtgtacgtgtactttccattttggctacgcgagcgaagtcgaacctgactcgaaccctccatatggaggtaagcatcctcaatta

SEQ ID NO: 90864 - DNA, 538 bp, Heterodera glycines
  SCN-specific regions: Sequence locations=1-388,424-465,494-538
aatgtcaaccatcccaatgccaccaccaccaacacaagacgaaaaggaccaacaaaaatcccaatggaaaccgctggagataggaaatcggatgcgcacgacctcagaagattcggccgagtcttttgacgcctatggaccggagtgggaagggaagggacggggaattgggaacagaagggaactcagttcgccaaatatgaccagttcggggagacgaatgagcatcacagaacgcttatttggacgtccagtgccccaagaacgaagaaactcattgggagaggaacaaatggggcaggaaaagccgaaaagcatcgcggagaacaaagacttcaaagaattaatgaagcgtcagcgaaaaattttgggcgatgatgagtggcaataaagaaaggcaaaagaaaagaagccattagaggaaaacaaagtcggaatggatcaaagggtagaaaagggaatgacaatttatttatttgtttattttatttaacacttcttctgatttttcaataatgaaataaagacaaacccacca

SEQ ID NO: 90865 - DNA, 379 bp, Heterodera glycines
  SCN-specific regions: Sequence locations=1-262,284-379
tacttttagcctaatcgtttacaatgttgattttcccgcacatcaaattttcgacactccttaaacgcgcgactgtcaacagctcctattatgtctcatacgctgcctatggtgcctctgcttttcttgtgttggtttacgttacggaatggaagcgtttcgcccgttatattcccggactccgttcgcagatcaaatcggacgaatgaatgaatgtctcgtggggtgtgcggaacggtcgactaattaggcaatgatgatgacaatggctgctgttgttgtgtttaagcatagaattctgacaaaagcacgtgtataaatcacaaatccctttttttctcgaatatttgttgagtgatcaaatgatatttaatcaaaa

SEQ ID NO: 90866 - DNA, 383 bp, Heterodera glycines
  SCN-specific regions: Sequence locations=1-383
agctaccaaattaaattatcccaaaaatgatttcttcccaaatgttctttttggccctgcttttcatttgtgcttcgcttctttgcttatttactgcttcatctgctgcttcagatgatgggcttgaaaatgaaaacccgagcaaaaatgtgcgcaattttttggccgaatttggagataatggtcattagaagattttaggaggtttttcttcagtctcagatgttggatgagaagatgttatggcttttgggcgatgatgcacattttatgccttttccgactgattacaacaaacatttccattttatcactttccgtagagaatagttattttttattgtcaattagttatactgtagttaaaaatccacatgaaaaaa

SEQ ID NO: 90867 - DNA, 338 bp, Heterodera glycines
  SCN-specific regions: Sequence locations=1-297,320-338
ggtggacaaacatgaaaaatctgaagcggtgccaaccgaagcaaaaaatgagtcagaactgatcaaatcaactaaattggaggacgaagaggaatccgaggagtttcctgtttacaacaaaggcgaaggaatcgacacggtcgaagcacaggcggcgattaatgtttgggaggacaattgggacgacgaaacgcaagagacggacttccatattcaattgcaggaggagctgaagaagtgcggatacaaaccatccgcgtgattgcttttttgcccaattgttaccattcggatgaatgttttaaccatcagaaggaaaaaattgaaaatgaattaaa

SEQ ID NO: 90868 - DNA, 531 bp, Heterodera glycines
  SCN-specific regions: Sequence locations=1-487,509-531
gacatggaggaattatggaaacaatcgcaaaaaatacaaacggacaatcacgaattgtccgaaagagtgtcttctttaactcgagagaacaacactcttcgcaccgaacatgaacgaattcttggcgatcacaacactcttcgcaccgaacatgaacgaattcttgtcgatcacaacactcttcgcaccgaacatgaacgaattcttgtcgatcacaacactcttcgcaccgagtatgaacgaattcttcagcgacagcttgacgatttccactattggattctttgtttcgccttctttatcccgccgctgtcaatattagccaccgcgcgtaacaatgggctctcatttccggtaactgttctgtccgcactcgccgcgacaattttctgtgcctttctgtggatccccggcattctcttcgccttggcattttattttggtttgaggaagaacgcgaagaaagagtgatctgtacgaattggaattcccagtctttcagtctgagtgtatttaaaaaaaaagaaggac

SEQ ID NO: 90869 - DNA, 627 bp, Heterodera glycines
  SCN-specific regions: Sequence locations=1-120,146-489,511-522,544 -565,589-627
gaaaaagcttgtgaagttgtcttacacagaaactgataaaaccttattgagaccatagatgggctcgtggtattgtctagtttattaccgcgtatgtaagtttagaacaaacctgtggcaacatattcaggagctgcatatccatgagtaccaatgacctttgttgacacatgtgtattatcaccagtaggacctgcttttgccaatccgaaatctgaaagcttagcattgaagtcctgcatttagacacagtttcaaacagttaggaatcagaagcaaatcccgaaagtggttatagagagtatatgctcgggtttattacagcgtcgagtagaatgttagcagctttaaagtctctgtatatcacttgtgactttgcttcatgaagaaaagttagccctttagctgcacctaccgccactttcatccttattgcccatgtaagtggctgcgccccacctgcaagtaacattgaccggatgattataagaaaactgaaaaacaaagaaacatgtaagattcttcttgaattcaagattgttgagttgctgaaaacatacgtctaaaaagatgattctccaagcttccttttggcatgaattcatatacaagaagccggttttcgcc

SEQ ID NO: 90870 - DNA, 634 bp, Heterodera glycines
  SCN-specific regions: Sequence locations=1-634
atttgccctaatttttcaaaaatataacaaacatttttttttcaaaaaatgagtcaagcatttggccaccaattgctgcaccgttttcgtcgtccagcattatttgcattatcatcatcaaagttttgtccattgtttcgtgccaccgccgccttcgcaacggatggagcagcaacaaaacaaccaactgcaagtgctgctgcacaacaccaacatcaacaagttgaacagcaacaaccgtcgacgacaaagacggaatggcacctgggcaaccgggtggcaaggctggttatggacgacaagcgggtcaattcgctgtccttgtccgccatggaaatgttgcacgacacactgcgcgagttggacgctcggccggaggtccgggtggtgatcctcgccgcctcggggcctgcctactccggtggacaccatctaccggaattgacggccgaatccggcacagaaatgcaccgcaaagtgttcaacaaatgcttggaactgatgacattcattcgacaaatgcaattgcccgtcatcgccgaggttgacggcctcgtcgctgcggccggcacgcagctggtcgcagcctgtgacattgtcattgcgtccggtcgtgccagctttaatgtcgccg

SEQ ID NO: 90871 - DNA, 378 bp, Heterodera glycines
  misc_feature (358)..(358): n is a, c, g, or t
  misc_feature (360)..(360): n is a, c, g, or t
  SCN-specific regions: Sequence locations=1-378
actctctcatgaaatccttggagaactattcgaatgttgccaatatcgccatcgggcacttacgtgatacggttttggagagagacaatgaacttgcggacaagaacaaccagctgcgcgactattcgaactacattgagcagctgaaggcatacattacgcgatgcggtggccaagtgcctgcctatgttggaggtgcccaaatgcgcgggggaggcggacagtgagtgataaatgggtaatgtgggagtttgagaattgggtcgagcgcgaacagagacaatacaaacggacgattattctgtgcccgaatgttttttttctcatgttttcatctaaaataaatgacttctgaccnanaaaaaaaaaaaaaaaaaa

SEQ ID NO: 90872 - DNA, 641 bp, Heterodera glycines
  SCN-specific regions: Sequence locations=1-9,31-448,477-641
aagaatcaaatcacaataattttcaataaatgacttcgcagaaaccggcggaagacgatccgattggtgctgaagaaacagttacgacagctgcagattgtgtcaatgaactgctggaaacaacagaaattcaagcggaagttgatgaattggtaaagagtgtcgttgaatttgtttcggaagcggcctcagcagcggcggatgatgttgaccatcagcagcagcggaatgcggcggatgagtcggcaaagagtcgttttggcatttcgtcacatgaaattgccattccctgcaaggaattcgaccgtctgttgcgtaaaatcggtttaaaatcgggggcaaagaggcaatgccctgggaagaggatgtgccctccgcgcaaagtgaaggcatcggcatcggacggagtcagtgcgaaaatcccaaaactgagtgagaatggcacagctggtgggaagcagaagaagaagaaaatgcaaaacattgtggaatttgaccaagtgatggcttcccttttgggcaacttcgaagatgacccaatctttctgaagtgcaaagaagttcagggaatgaccaaagacttggctcaactcacctttcaaatcaaccaatttttgtgccatttcattacgttcataccc

SEQ ID NO: 90873 - DNA, 136 bp, Heterodera glycines
  SCN-specific regions: Sequence locations=1-136
attcgatggcaaacattccgacgacgagttccagcgtcagtgcactcaccgccatattcgaagcgcatcagcaacggctcaataacaatggtggaccagctcgaccgcccacggcaatgcgttatcgttctctgac

SEQ ID NO: 90874 - DNA, 612 bp, Heterodera glycines
  SCN-specific regions: Sequence locations=1-153,194-337,360-453,502-516
ctcatttttcactacaactcccaccgattctctgtttccatgcgtttctttgtggactggcgacaaaattgaggccaattttgggccaagtttcaaatttaatttggccactctttgaagaaagccgaagaaacgacggaaaggcgattaatcatttaattaattatttcttttttcatttatttttaattttgcatttgttttcattatgttatgtttgttgcttatttgtcaatgaataaaatttactgttttattttagtcttattatttgttttccttttttcatttaaaaattaggtaaaaagggtccaccgaataaatgctaagaaatcagcacgttgaatggaccttttaaattttttttcgcacttacagaggcaacaaataaatgttataataaagaagcatagatttttcacaaaatactaagttattgaaaaaagttatgagataaattaaacaaaaaataaattatttttcattacaaataaaaattaagacgaaaaaatttaaaaagcttacaacacctccgattcccaggacgtctcagttcctagtactaagaaggcctaacgttgcttaacttgccagatcggacgggatggcgtg

SEQ ID NO: 90875 - DNA, 247 bp, Heterodera glycines
  SCN-specific regions: Sequence locations=1-247
gcacatccaatggtttacggttgtcataattgatgaaaaattgcggaaatttctgttcggagcgtccggcgcattctaatagactcagttcaatggagttctttttaacttcctttgaatccataaaatgttggaccaccgaacgacaacacaaacacgctactcttccagctccgttcaatgtgcaaatgcattcatcgacaatcttccggcacgtctcatctgtgtaccaaaattggctcaactg

SEQ ID NO: 90876 - DNA, 475 bp, Heterodera glycines
  SCN-specific regions: Sequence locations=1-42,76-90,188-332,354-453
gccgcacatcactgactgggccgccgcttcgtcggattggaacgcgccgcccgcggagcagcagccgccgcaagcgcagcaaatggttgtgccgtcgcagccagccgctcaggcgccgtccgctgtgcctccgtcggcgattgcaccgccacaggccgccgctgttgcaccgccgccgccacagccgattcagcagcaccaaccgatgccgactcagcagcaggaaccgccgaaacagcaggacgactggggaggcaatgccaccggatggtaaatgacgacgacgacgaattggagacggacggagaaagaagagaagcgagagacggaagaattgttaattgaaaacaaaaatagtaatttgttggattgattgggttttgacgttttttatttctgttaccgattgatcatttgggtttttgagtgtcacaggaaaaaattgttgttgttaaaaaaaaaaaaaaaaaaaaaa

SEQ ID NO: 90877 - DNA, 611 bp, Heterodera glycines
  SCN-specific regions: Sequence locations=1-16,38-562,584-589
attgattccaacaaacaaagcgagcagaatgactactgaacagggaaagaacgaacaacagcagggaaagggcatttacgagagcaccaaggaaagtctgtcgaacgtggcggaggggacgaaggaatggctgacgagtgccaaggacaaagtggccgattcgctgacttctacgaaggacactgtgaccggcaagtcggcggagatgcgcgacagggcgtccgacagttacgaggatgctaagcagggggcgcaggaccgttacgagcgtgccaaggagtacggcagtgagaagacggagcaactgaaggactatgccaccgacaagaaggaggaagcgggcgagaagatggagcagaacagggagaaggctgctgagaagtgggacgagacgaaggaggctggaggcgagcgtatgcagcgcgccggtgacaaaatcaggggcaaatagaaaggatgtccaacagaatgaagagcaaatttatctgatctgatcggactctgtgagcccaatttaactgctctttttattggaatatttgttgtccatctcatataaaaatttttgtgaatgaaaacaattcactataaaaaaaaaaaaaaaaaaaaaa

SEQ ID NO: 90878 - DNA, 481 bp, Heterodera glycines
  SCN-specific regions: Sequence locations=1-36,58-435,473-481
gtttagatttataaattcaatgacacttaaattcgtaggaaatttatttttgggggcttgcattggacaagtctttggccaaaggattggcgcattcattcgatgccaaggtgattccatgctgccgactttctataatggcgacattctatgggctcgagtttgggacccaaacgatggtttacgcccgggagacgtcgtgtgtttagttgaccccacaaatgcaaatcagtatgtcttaaaacgtgtttccgctgttcatgaaaacagtcgtccctccgacccgttggccggtcgtatcgaagttcgcggcgacaatgcgacaaattcggtggattcgcgcgactatgggcccgtgccggctggacttgtctgctaccgcgtgtctgtgcgactcttccctttgaatcggaggaggaaaattgaaacagcgataatttaatatgaatgttttttgtatgtaaataatgaagaccggtgc

SEQ ID NO: 90879 - DNA, 631 bp, Heterodera glycines
  SCN-specific regions: Sequence locations=1-55,77-575,613-631
gaaaatccataaaattaatttggaatttggcccacctttgtttggttcaaaaatgccaatgttatcaacaaaatcagtgccaatcccaaatagttggctttgtgcacttcaacatcgacggatcgctgttgcggccgcggaataagcctgaacaattaaacaattaataattaaagccaattaagaaatatcaatggttggcattgattacctgacaaaagtgaaaagagagtcggcgaagaattcttcataaatgggctcaattttcagcttttttgcctcactccgaccaatttcaatggcataatgctatgagcaataaagcgggtaatgtgaaaaagaatacggtgcccggcacattttgttcctgaattattttgccggtggcactgtccttcaaaagcacacgaaaagtgctgctgctgacgcccccgccaatggtggcatttgccggaagttccaattcgctgacaaccgtcgccgcgggcaattcgttggggaacacgacaaagtgcacgtcacgcctgtcctcattgcccgtcttgacaatgacagaattcaattgaaaatgtcggtaataaataattaattaattgtctttatataatttttgatttgcccccgtccacct

SEQ ID NO: 90880 - DNA, 627 bp, Heterodera glycines
  SCN-specific regions: Sequence locations=1-14,47-598,620-627
gattaccgagattcttgtgcttcaacagatgaagaagatgatttattttttcaccgcgtttcttcaaatcaagcacaggaaaataacgatgatgattctgagtccgaatttatcaaaatcttggaaatgtgtcgaaagcatcgtgaattttctgctgctaaaatgggagaagacagtcaaaataagccgcgttctttaaataagcgtgataaggtctttgattccgagtattattctttacctgcgatcgaccaacttaatatacaagtcaaagaggagactgaattcaaaagatttggtgttgttgattcgcacataaattttttagcgaagataaagcctgacaaggatacgccacatcttggatatgagacaattctattcaatcacgacaaaaagccaattggagagatttttgaaatattcgggacagttactgatactttatatgcattgcgattcaatgacgaaagtgacgctgtagcgaaactcccctgttgggtaaagtaatttattatagcaaatttcagacaatggccgtgaacaaaaccccggtcctttcccaaagggaatttgtcataagcctaaaaagaaattaggggaagaaccccacatacaatattttct

SEQ ID NO: 90881 - DNA, 600 bp, Heterodera glycines
  SCN-specific regions: Sequence locations=1-600
tcggatggaagatgagcacagcttctccaggcagaacaacatgagatcgccttcgaagtcagcttcaacaccaacgatggcggaagagccaaagaaaggcgaattaatggcggaaaacaacggaacaaaagggcaactgaacagccacaaactgttaccggtgaagaacagtttgtccgcaactgaacttttcgccactgcaaatccaatgcatcggaatggcagcacaaattcaaaattgaccaacgaatttgaccaatcggagaaacaacagccacaagctcctcatgatgacatatacaccaaattctaccaaccggagccaggaacagtcttcgggagacggctgctcaactgcgaagaattttatggcaatttcaggcgatgcgcggaccgaaaagcgaaacactcgaacattctcctctccattgaaagggatttgcattccgtacaaacgttgtcgaaagtggccgagttccgttcccaattggtaaaacagcgaattgcagcgacatcgaagagaatccaggaattggagtcgaaaagccaatgactatcaaaaattagcagtactcaatttactttccattatttctgtct

SEQ ID NO: 90882 - DNA, 615 bp, Heterodera glycines
  SCN-specific regions: Sequence locations=1-615
gaatcagaaaaagcacttctttccattgtcaagcgcaatgttgaccgtcttcatcaattatgcaatgaatggataaataccggacacttctcatctattcccgaccattaccggttattgtacgcattttgctgtgccgttcgtgccaaactcattcgatcagttgtctctccgacattgtgacgatgggttgctgaagggcaatgatttggaggatgaaagtctgtccaaattcgcttctttcttgtgccgcaaatttcttcctccgccctcagaagtgccggaacatcagaccgataattgccttcgctcgaatatttcttcaacaatttttataagcttcaagtccccgtcatcattcgtggaatggtgaatgggtggccggcatttgaaaaatggagcttttcttatttgaactcgatttgtgggcatcgtttggtccctgttgaattgggtagtaaatacacggatgacgactggcgccagcagatgatgagtttcaaccaatatttggacgattttgtttttcccactaccaatccgtcccagtccggctacatggcccagcaccgactgctcgaccaaattcccgaactgctcgcggatgtgcctgtg

SEQ ID NO: 90883 - DNA, 200 bp, Heterodera glycines
  SCN-specific regions: Sequence locations=1-177
ctggcgaagaactttcgtcgcattgtcaggctgttcaacggggctaacgagttgaggcagtaaggaggagagtcggttgctgcacgactgcaaatgttttttggtgatttctcgtacaaaacatgattattattatttgtttatgtaaattatgcgtttaaatgaaacaatccggtcaaaaaaaaaaaaaaaaaaaaaaa

SEQ ID NO: 90884 - DNA, 607 bp, Heterodera glycines
  SCN-specific regions: Sequence locations=1-468,490-539,563-607
aaattctcacattttgtggcacaatttccaaagtgctgagcaaatcgccacctttttggcctgttgttcgccccttatgctccacgaccttttcaaagagttttgtacaaatttcaaagaaagtcgtagcggatttcccgatttggtcgtttggaatgaaaacgtggcgaaaatggcggtggtggaagtgaaggggcccaacgacagtttgtccgccaaacaacagcttcggctgcatttcttccgaacccacggcgtccgctccgttgtttgtcacgttgtcgcacgcaacgatcggatgctttgaacaaacgactttctgctgctggacaaacacaatgccaaaatgcttcccatttcgtgctaattcgcaacactaactgttactacacccacccactacggtactccctcccctctgttacggtactcctccgacttgcattttccattctcacaattgtagtcagttctctttccatttgtctgatgctccttttgccgcatttgactttcctcccttttcgttatttttgtgatttttgttgcctttgttttacttcaattgtttcatcactcccagaatatccgcattcttttttaagtt

SEQ ID NO: 90885 - DNA, 526 bp, Heterodera glycines
  SCN-specific regions: Sequence locations=1-206,230-489,514-526
gaagcattgtgtgctgtcattgaacggctgccaaaggaaatgcagctgttgatggcgcggaacattgtgctgaccggcgggaacgccctcttcccgggctatcgcaaaagaattgagcaggaattgcgttccatgatgccggagcagttcacgcttggtgttcagcagccgtccgacccgatttgccacgcgtgggaatgtgcacgcgacgcaatccaacaacaacagcacgatgccgagacttctgcatcatccgctgctgatgttggtgctgccacacaattctcgcctcggttgaccgccaaatttgtgagtcgcgcagaatatgaggagaacgggccgaacatttgtcggcgacggtttgccaacgtgtacaacaacagaaatgtcgaagacgacgacgacgaaggcacgaacagcggcacgcaaaattgaaacgaagaaagaaaagcatcgataataaaagcaatagcatttctcaaattatatattttttgggttttattaaattttgaaatttcaaaaa

SEQ ID NO: 90886 - DNA, 574 bp, Heterodera glycines
  SCN-specific regions: Sequence locations=1-303,327-574
cttctcatcatttttcaaagcaaactcaaaaaatggacaatctttcggtttatgacagttggcccatgtcacagcgcaactctccgcgtaatcactcctcaaattcgacctgttcctctgacgataccgcgcaagccgaagatcaaccactcaacataggaggaacaattcgagaccgactcgcctccacttctctgtccatcgcgtcctttgacgtgatcagcgccggcggcggtttgaacggtggcggaggcgccgccgaacattttggcaattcaacgccatttactatctcttctcacaatcaacaacaaccgcagcaacaaagcaattcatttgcagcctattttagtgagctcaaccgcttacccatcgaccattggcttaagtcgacttccgctgcaaatggtccgaaaaaggcttttccatccgtcacaccgtcaatgccagtcacacaacatccgatcattcccaataacatttccgaaatgttttcaaaaatgcacatgaacaccagcgaaacgcaaaagaagcatcagctgaccacttccacacccatcgggttgcactgtca

SEQ ID NO: 90887 - DNA, 613 bp, Heterodera glycines
  SCN-specific regions: Sequence locations=1-96,132-155,179-613
agaaatggaaaatgctgcgaccggtggaaagagagtcccccgtttctctcacagcgcggggacagagggcgccgagggggagaaggagccccaggcggaggagccgccctccgccggcaccgccggcgccgatagacctgccgaagaccattccctgctgctcgcccagctgctcgccgccttcgccctgttcggtcttgtcactgcgctgctcttccaattgcccgccttccgcgtgcgaagtcgcattggcacggacggacccgtgccaatccatcagttggacccgcaaatggccgaatgtgcgaagacatgcagaatcgaattggtcgagagcattccccaaaacgtgtcttttcacctttccctcggcaattcgcccgctttggccatcccaacattctccgcttggatgcaactgatcagcgaggccaaacattcgctggccattgcggcttataagacgagtcttcgcgggaaacacgtgctgggggaggaccaaggcaattactcgacccaaggggagacggttttcgatgctctactcgatgccggactgaggaggggcgtcggcattcgaatggtcgaaaatgccgtggccaaagacaaaggt

SEQ ID NO: 90888 - DNA, 196 bp, Heterodera glycines
  SCN-specific regions: Sequence locations=1-196
tcgagcccatactgtgttggtctctggcgcctgcggctccgttgcctcaaattttgtgaattacgcctttgaaaagcggccgcctagcaattatgtgaacttggacgagttgatactgaacagtgactggaattacttggcaccgaaagtgcgcaattctgcgcggtactgaagcgaattggccgacattcacaac

SEQ ID NO: 90889 - DNA, 614 bp, Heterodera glycines
  misc_feature (511)..(511): n is a, c, g, or t
  SCN-specific regions: Sequence locations=1-2,33-146,168-443,465 -497,541-614
gccgtctcttttcccttttgcttttcccttccgccaattcgtcccccactcctttcccaatgttcgacttcccagctttgcatagcagtgcttcgtttgcactcagttcgccagttgcccaattgtcccattcgaacgccgtcctcgtccaggagaatgaacgactgaacgacagagtcggggagttggaactgatgttgcgtgaccatgtggcccacatcaactccatttaccactctctgcactctttgcacggtttccatgcgcttcaattgcccgacggggaattggtccatctgtcccaattccacggctttcctttgcgtttcatttgcaccaaaacgaccgaaagtgaagcgattgtggccgatgaggagcagcaccgtattctcgaacaggcgacggacaaccggcatacggtgggccaagcacggcgctttatgctgcagcagcgacaaaggcatcgtcagcagcaggggagcgtgaatgagtcgttgtcctccggctcctnctcctccttcacctcctcctcgtccaccttcgactcttcgtttgctgctgatccgactgacttttccctggcgatgatgcgacgtttgtgcattcgcccggtg

SEQ ID NO: 90890 - DNA, 616 bp, Heterodera glycines
  SCN-specific regions: Sequence locations=1-616
ttctgctcctcgctagcgcaatggtctcaatgctttgcctcatctccgggctgttccttctcccgccggacattcactctttcagcagcacaccttcagagcaagatgccaaccgccaaattccgctgacaaccgtcggccgattgtcctgtgtcactgaggcgggatgcgttttgtctgacacctcgcaactgaattttttggtggtcggcgacatcggaggccttcccgtctttccgtattattcgtacgcgcagacaaaagtggcacgggcaatggccaaaattggcagaagacaccggactcattttgtggtgaatgtcggcgacaatttttactttaacggagtccaaaatgcctttgatgggcgtttcgaggattcctttgaagagatttacgaccagcccgaacttttggtcccgtggtacacaatcgcgggtaaccacgaccatttgggcaatgtgacgggccaattggcacgcaccgatttcagcagccgatgctcaggacgttcccccgtctgttctacaaagtgcgtttgtccttcgacggtctctcccctccctccgccgtccgtgtcgatttgctaatgttggacaccgtcgttctgtgcggg

SEQ ID NO: 90891 - DNA, 409 bp, Heterodera glycines
  SCN-specific regions: Sequence locations=1-384
gtgccacaaaacaaacgcaatggtggtgctggtgccgcgtcgttcattcgtggcggcaacctgatcatgcgcaacgcgtacattggtggtggtgcggctgcgcaccatgccagcattggcatgggcggtggcggcggttcaatgcgaggttcttctcatcatcacccgcagcagcaaatgcccatgtattcaaatgcgtctgccgcggcatacgcccaatggtactacaacgcggcggccgctgctgcatacggggccggaggatatctgtcataagacatattagtctaatttatgatttcgacccatcaacgattgatttttcttttcatcaagtgcttcattttcacccgcgtattgatgagaataaaaaagttatttgtgaaaaaaaaaaaaaaaaaaaaaaaaa

SEQ ID NO: 90892 - DNA, 635 bp, Heterodera glycines
  SCN-specific regions: Sequence locations=1-106,128-145,168-274,296-635
gctttttctgccaatcaaaacaatgtgaagccaaaaagcaacaaaaagcacggaagaagcaaaagcggcggagttttactcgtaaaatcggcgggcgttcattgggaagaaacaaacagcacaacaaacggacaaatggaagacgaaataaaaaagaggaagaaaaacggaaggacacatcgccgagccaaaagtcacggggccgtacgaccgattttccatccgccgacggagacaatgaaagggtgggacaaaacggcgacggacaaatggacaattgggaaggaggagaggagggcacaaaatgccgaagagcctaccattcattcgtccgcaattaaaactcagaagaacaaaatcacggtagcgaaacgacggtattccgtttttcgacacgattcgctgatgtgggaagagatgccgcaattcacagaaagtgatcgccgactgcgcaaatccgtgccgagttccccgcagacaattctcgttttggccggcctttttgtgtgcggcctcatccttctgatcagtggtcttattgttctaataacgaattggcaaaacgcaaaagcaattcaaaacggatggtattaccacgtggctggctgtacaatgcttcttcttggcttttctgg

SEQ ID NO: 90893 - DNA, 570 bp, Heterodera glycines
  SCN-specific regions: Sequence locations=1-570
tcaatcaaagggttgtaaaaaacctgtgagaagcaacctccgttgtccaacctgtgtcaagatgggactaccccatgcattcttttgctcacaaacatgttttaaagcttcttggatggaacataaattgtgccataaagacgattcatccaatatcaacgagtacaacccgtggcctttgtatcaattcactggaacgcttatgcccgccccacaaagtgcgcgccgcgctgtcccggaacatattccttggcctgattatgcattgcatccggaatgcgtttcattggaggaacaaaacgcactaaacagtggacaaattcaggtgttgaactacgaggaacagttgagaatgcgtttggccgccaaattgggacgccaggtgctcgacgaggccgcacgtgccattgagcctggcatgaccaccgatgagattgaccgtgttgtgcacgaagcctgcattgagcgtgagtgctatccgagcccactgggctactacaaattcccaaagagttgttgtacgtcagacaacgaggtcatttgccatggcatcccggataaacgggcact

SEQ ID NO: 90894 - DNA, 329 bp, Heterodera glycines
  SCN-specific regions: Sequence locations=1-239,263-304
cgcttttttgcaatcgacggaccaaaaactgttggttctgctgaccgcacttaccagtgtccagggccaaaccgtgcggttggttgatcggctgaatgtgctcgcccgtgatcggcttcagcatgagcgttcctcgtttattcagcatcgccattgctccaatttgttcccgggcttatttggacgcttctaaattaaggcacagcaaattacctatttccttttgtctattgcttctgtttttgttgctttaatgtgtgtattttacgatttctgtctgaaattttacgataaattgaattttaaaaaaaaaaaaaaaaaaaaaaaaa

SEQ ID NO: 90895 - DNA, 329 bp, Heterodera glycines
  SCN-specific regions: Sequence locations=1-40,62-264,286-329
cttcaacgaatcgctgctgcgtcagctggaggccaacgccaacgccaacggccagacacaatcagttcaacatgacgctgtcgccgcccatcctcaagaccaatctgtaacacctgccgaatccgccgtcacgggcccatccccgacccagctcgaggccctcatccaggacgaagtcaaccgccgcgtggccgcccagctcgagcagtcccagctcacgcagggcgtgcgcgccgaccaccgcgccgacttggactcgcagacggcgctcagggaggccgacgacttgttgcaccggttgggcagggtctcgttgcccacgcccgagc

SEQ ID NO: 90896 - DNA, 574 bp, Heterodera glycines
  SCN-specific regions: Sequence locations=1-391,423-574
gcgcaatggtgcgcgacataatattgttctgctggaggggagggattaacgtttacgacatttaccgcgactgctttccgcagcacagtaaaatggccgcaattcgacggggaattctccgtgcaaaagcatttcattcaaacgacacgaatctttgggagccattggaggagattaatttccgcggaggtgccccgtgtttggacgaccacgcgataaccaactacctgaacactccacgggtgcgtgaaacgcttcacattccgccgaatgtcccaaattgggaaagttgcaacgattgggttggcatactgtacacgacagaatactccgacatgtcaccttttgtgaggaaggcgatcaatgccaatttgcgggtgctgctttactccggagacactgacatggcctgcaactttctgtcgggccaacacttttcagcgcaacttggccttgcgacaatcgcaaagaaaaagccgtggtattttagaggacaaatcgcgggcttcagaacggagtacgcgcgaaatctcaccttcatcaccgttcgcggcgcgggtcacatgggtccccc

SEQ ID NO: 90897 - DNA, 401 bp, Heterodera glycines
  SCN-specific regions: Sequence locations=1-401
gttttctctaaaaattgtccaaatttcttgaatttcgttttctctgcccctccgtttttcttcttcgccagttcggtttcaacaacatttcggccactaccgatggctttgccgcccgctgattccttcgcttcgctttcggttccgtgcggcgctgcggtttccgttcaaatgcagtcgctgttttgtttgtgcgcacggcgcgtgtcgcagttgtgcacgccgtcgcgcatgtgcgagttgcgcgacgcactgcccccggcggtgttcgacacgctcactgcgctgcaggcggacatcgaatgcctgaggcactatttcccgaattctcgcaaaaactctgctgatgaaggctctccccaaagtcacttctttctgcccgagcgctgttttgtgctgaa

SEQ ID NO: 90898 - DNA, 612 bp, Heterodera glycines
  SCN-specific regions: Sequence locations=1-612
gtccaattaagaatttcgccggtacttgttggactgtgccgtcaatatttaattctccccatatacttttcgacttttttgccctcctttgcctcatccatatgatagactttaaacgagaatgtaatggtcgacttggctacactcttgttgaggatgattcttcactgttgggtggcatcacttttcgctcaattgtgtccggtgacaaattgccgttgttgcgcgattcaccgcccgagtcgcatgttgagccggtggcgcaactgttgcgatctccacgtgaccacatggacaacatcttcaacccagcggacaacaacattgtggacaacaccaatggcttcgctttggcgccttacaccgaacagcgacgtgcgcccagcggagtgttggcacagcaaacgatgcaacggttcggcaatgcgtatttcatgggtaatagtaataatagcactaacaacaccaccacttcctccgcctattcattggcaacaattggcaccaatacgacgacgtacagtggcggggcctgcaacggcagcggcggcacattggtcacaaacgcaactggcacaacaggcggacgtcgtaaagaggtgtacactgacg

SEQ ID NO: 90899 - DNA, 608 bp, Heterodera glycines
  SCN-specific regions: Sequence locations=1-252,274-608
cgaatgttgttgggtcgcgtgtgcattgtgacaggtgccagcgagggcattggtgaggcggtcgcgcgcactttggcattggacggaggggcgaccgttgtgttggtggcgaggagaattgatcggttggaggcgctgacacagcaattaaatgctttgggagtgccttctgaacgcttaatggcagtgaaatgcgacgtcgcaagcagcgaaaacgtacgggcgatggtcgcacagacaatggaacggttcggccgagtggacgtgctggtgaattgtgccggggttatgttcttcattcagtccagcaaaggatacaccgaagaatggacgcggcaaatcgatgtgaatgtacacggaacaacaaatgttgttgggtttgtccttccgttgatggtcgagcgtaagaatggtcacatcttgacaattacttcggacgccggacggagagcttttcccggcttggcggtgtatagcggcacaaaattttacctggaagcatttatcagcgcactacgacaagaaaacgtggagaatggcattcgattcacaaatatacagcctggtgacgtggctacttctctggcgaggcgttcaacggacaccga

SEQ ID NO: 90900 - DNA, 605 bp, Heterodera glycines
  SCN-specific regions: Sequence locations=1-288,313-368,396-449,480-605
acccttccaaaacgtctagccctaccggaagtttgcttctcagcgaaggcgagcattccactgcgtctgggtctcttgttaacgttcgaatgccgaacataaaagtcttttctgggtcttcacatagcgatttggcacaacgaatttgcgacagacttcagcttgaagttgcaaaagccgctttaaagaaattcagcaataaggaaacaaatgtcgaaataatcgaatctgttagaggcgaagatgtctacataattcagagcgggtgtggagaaatcaacgaccacctgatggagctgttgatcatgatcagtgcatgtaaaattgcttcagcttgccgcgtcactgccgtcattccgtgctttccatatgccaggcaggacaagaaggacaagtcacgggccccaatcacagcaaaattggtggctaatatgctttccatctccggtgctgaccacatcatcaccatggacctacacgcttcgcagatccaagggtttttcgatattcctgtggacaatttgtatgctgagccggccatcctgaagtacatacgggagacaatcccgcactggcaggaatcggtcattgtgtcgcctgatgcc

SEQ ID NO: 90901 - DNA, 621 bp, Heterodera glycines
  SCN-specific regions: Sequence locations=1-621
gcttcacaatttggttcgaggaacatttcccaagcggaaaacaaaaacatttttgtcaatttctttataaaatttgcacaacttattgcttggtgaatgcctacaaaaatgatgatcgcctgatgaaactgtggctaaaattgacagaaaattttcccgagagtggcttcgctataatggaattcgcattttccaaggggtcttgtcgccaattggccaagttctacatacattggagcaccatgtatcagtccattagttggtggaacaaagcacgggagaagttgcagttgggccaaaaaatgtgtgcaatgccattagatttgttgcatcgggcggttgacgaattggaagcttcagtgatgaaagtgacgcgaagcggggagaacagcgaagagactgaagcggacgagatggttgctgtatctttggagcagtcacgcgaaactctcggcaaactccgtggccttggacggcgccatttcgctccaatcattcgcactgcgcaaggccctcccgggactctttccaccagcaaaagaaacacctcgtcaaaaaatgccaaaaacaacgaacactttgaaattcttgccgatgaattcacggaatgtgtttctttga

SEQ ID NO: 90902 - DNA, 640 bp, Heterodera glycines
  SCN-specific regions: Sequence locations=1-68,90-640
gagattctcaaattataataaaaaaaatgaacaacgagaatggaactcttccgagtgtcagtaccattaaaaagaaagccaatgccacggggggaggttatggcgtcgtaattcattccttcgattcgcaaaacaaaaacagtgcacaaagcattgtctacgtggaccacaatcgacctctttatgttgtgccacgctatctcttcgacgtcacttatctgaccaaccaaggcttctccaagtcgcaagtgaacaaacggtccatcgaactcggattcggagctaacatccaatttgaatcccggggcaaccaaattgtctatttcgaccgatgttccaagggacaggactggatcaagattggtgaacaactgctcttacaggacaaggacaggcgattcttttttgaagacaagttcattgatgcaaaaaatgcgaatattttgcttcgtgcccacgggtgtgtgtcggatgaagaagtgcgtcgctttttctgccattccttccattccgttgattcgtttcgcgtgccttacgctgaactacaaaaagtgattccgaatgttctgtacgatttgtttgtgaacatcgacttggacatgcacggctacgaaccaaacatggaaagcgcccattgtca

SEQ ID NO: 90903 - DNA, 612 bp, Heterodera glycines
  SCN-specific regions: Sequence locations=1-75,98-300,323-612
ggataatgaatttacggccaaaagcagtcaattttgacgatgtgtggtcaaagctacgtgaaactctcgaggcgatcatttctctcaagccaattgagcgtattacctgggaccataattttagcgatatatactttgtttgtgtgagcgttcccgaggcccaatctcgacgactttatacggcggtcaaaaactcgttagaactacacactatttcaatccgagagtctttgctccgtttgtccggtgaccaattgctcagtgcgtacaacagcgaatgggaaaaatttcacaaaggcgccatttatttgcataatctttacggttatctgaacaaacaattggtcaaggaaaaaatggacgcggagtcgcagcatccttttgtggtggataatgacagcgacggtttataccctcatttgggagttggcgaccttgccttttcaatttggcgaaatgagttgctcatgccgttggctgctcagcttgtggcccatatcattgagctgctcggtcggattcgaaatggtatctctgcttcatttggcattcgaatttcggacctccggggcgccgtcctctcctttgtcgatgtcaatgaatccatccatc

SEQ ID NO: 90904 - DNA, 319 bp, Heterodera glycines
  SCN-specific regions: Sequence locations=1-319
gtccaattaagcttttgtctcattttcgctttaatctcttctatttcctccttcaaattgccccattatccgccattaattaatgtcttctcccccctcgccaaaagcctcgctcattttggaggcacaggccgattttgcgttgaaattgctgcgcgaagtgtccacggacgaccgttcgtgcattgtttcgccgttttctgccgccgtcactttgtccatggtttacgcgggcgccaagggaaaagacggcgaagaaaggggcaactgcttgcaaagggtgggcccaaatcgaagggcacaaatcttcggggctttt

SEQ ID NO: 90905 - DNA, 628 bp, Heterodera glycines
  SCN-specific regions: Sequence locations=1-184,206-321,344-440,462-628
atttcacaacaaatggctaaaataaaaataaagtggggtaccaaagaacttaatgttgacgccaatcccgaagaacctcccctattgctcaaggcgcaactattcgggttgacaaatgttccacctgaacgacaaaagttgatagttaagggcaagacgatatctgacgaagcatggaacggaatcaaaataaaagatggaactgttataatgcttattggaagcactgaatcgatgttgataaaggcagaaaatgctgagtcgtccggccatacaaattcgacagagacggaaccgcgccaacagttccccattggtctacgaaatttgggcaacacttgttacatgaactcgagtttgcagtgtttgaagattgtgccggaatttgaaaccgccttgaagcaatacaatcccaaccaatctgttgacgggtcgaaccaacgcataaaactcttcaccaattctatgaagaagctttacaacgagatgaatgttttggcgaaggaccaaacggcggactctcccgaagtcattccgttgtttcttgtgcatgtcctccgccaaacctttccacaattcgacactcaagatgaacggggcaaccaccagcaacaggacgccaacgaat

SEQ ID NO: 90906 - DNA, 262 bp, Heterodera glycines
  SCN-specific regions: Sequence locations=1-112,142-262
tgttctcgggattgcctcggtgtgctctctgttgtctatcatcgccaccgtcctttctctgccttctcggtactcgtagatgagccaaatgctgcgttgagtgcgctacggagttgaggccttccgcgtcaacaccgactctctctgcactgacttgatggacgtgccagtggtcgtgacgcctccgtgaaagccccctggtaaccgcttcgactgcatcttccgtgccaaacgtcaactgcccggacgctggcagtgcgct

SEQ ID NO: 90907 - DNA, 417 bp, Heterodera glycines
  SCN-specific regions: Sequence locations=1-26,51-137,159-248,270 -316,354-417
gatgcgtttcgcttccattcgtttcgctttgtttttatttctctttttggcacattttggcgccaacgaaacgacggaaaatggcgaaggacaattggaatcagaggaggagaaccgaaacgaactgcgcaaaatgccatttgaggagcaggaaaaagcgtatgacagagcgctgaaaaagaaccgatgccaaaacagcggacaatgctaaaaaaaacagggtttcatttgcccatgcgaagataatcgaagaacattttgtgctgctttcgatgctctgaattaaaaatttataaagtaccaattacgaaaagtcaaatgtttttacaaataaaaaatattttcgaaatttttatttgtacaaataaaagtgtaattgttaaaaaaaataacaaataactggacaatcgtttaaaa

SEQ ID NO: 90908 - DNA, 365 bp, Heterodera glycines
  SCN-specific regions: Sequence locations=1-337
ggatgcggcggggcgttgcagatttaaggcgctgcaaaaagatcagacacaatgtgtggcaagttgcgcgtagggggtttcattttcacttgtgagaacacggtttgtgccagcccatcaactcattttgaagaattttccgtttgacatatgccgtttgtccaaccttcaagtgctttacttgggtggaaatgcgttaatcgacgtgccggacacaatcgggcagctgtcagaattaacttctcttggtttggcggacaatcggctggagcaaataccaaccgcaattgccagctatcgcaatttgcgaaatttggcacttcataacaatcgactgaaaaaaaaaaaaaaaaaaaaaaaaaaaa

SEQ ID NO: 90909 - DNA, 620 bp, Heterodera glycines
  SCN-specific regions: Sequence locations=1-446,481-513,535-579,601-620
gagcaacaaaaaatggcaccgcctctgccgactgtttctgctgccacggtggcaccaacgccggcagcgctggccattgacgacttccgactgattgcggtgcttggccgaggtcattttggcaaagtcatattgtcgcaatacaggaggaccaacgcgtactttgccctaaaaattctgaaaaagggcgacattttggccagggatgaggtggaatcgttgatggtcgaaaagcgcatcttggaaattgcgagctccagcaagcacccgtttctgatcaatttgcacgccacttttcaaacgcatgaccatgtgttcttcgtcatggagtacgcaatgggcggcgatctgatgaggcacatccatgacgacattttcgcggaggaccgtgcctgcttctacgccgcgtgcattctgctcggattggaatttttgcacgccaacaacattgtgtacagggacctgaagttggacaatttgattctggaccgggaaggatatgtgaagttggccgactttggactttgcaaggagggcatgggcccattcgacaaaacgtcaaccttttgcggaacgcccgaatttttggcccccgaggtgctgacggagaacagttacac

SEQ ID NO: 90910 - DNA, 320 bp, Heterodera glycines
  SCN-specific regions: Sequence locations=1-195,217-294
tcatcattgtatttcccttccacgtcaatcatttcacttattacacatttcgactgtttgcctttctctcattccgtcaaatttcaccaaattttcccagaatttgtgatgattgtgattgatccatccaaagcaatgcttcgcttcaacaaatgtttgtttttgccaaacattttttttctccttttgattgtgtattgatgtgtcaccatttttatgtgccgccgacaaaattgccggacatttttactattttggtgtcgttttacgagtaatataaaacaatatggagcgaaaaaaaaaaaaaaaaaaaaaaaaaa

SEQ ID NO: 90911 - DNA, 606 bp, Heterodera glycines
  SCN-specific regions: Sequence locations=1-606
gatatttcgacttccgacatacgtccaaggcttccgtctgcatcaatgtatcaatttcctaccaagattggctcaacgtcgacgaaattttccacgtcgacgcttcctccaacgccttcgcctttttctcgaccaatgcataattcgttaaagcccttacaaccacggccaacgacgagtgatgcacagcattcattcagagaaaaatccgctgctaatgatggggagttaatgctgaaacaacattctcggagttcacaagttccttgtcttaaaggactgaccaaccacggaaacacttgttacttcagtgctatcattcaatgtttggcttcttgtgaacaatttgtcaaattttttgtttgcaatcattcggaagagacaaccgatggttcttccactgatcagtcttccaccaattttatgccgttgctcactaatgcgctatcggcaactttgtgttgtttatggttcaacaacagcttagcggattcttcttgttaccgactcttgcaacttatttcaaaggccaatccgcaatttgtgttttcccagcagcaggatgcccatgagtgtttgatttggcttttgaatcgtctccatgat

SEQ ID NO: 90912 - DNA, 600 bp, Heterodera glycines
  SCN-specific regions: Sequence locations=1-268,291-548,570-600
ctcgttcagctgatctctcaaattccttccctcagccatttggctttggatgtcgcctttttaaatgcccattttctccgccgtctcttcgccggcggcgttcattctccgggtgctggtctccgttccctcagactttgccgacttcgcatcacttaccgggcactgttttcgattggccgatgggcccgttcgcttgtcgacttggaaacttcgcatatgccagcggtggacgaccgttttttggttttgttgggaaagaattgcaaatatttgcaaaatgttaatttcaacggatgcaaatgggtgacagacaaaggagtggcgagtttggccaggaattgcaagcttcgagaagtgcggataagagggacttcctgcaccgataagtccgtctacgcatttgcacagttctgtccaactctcgaatggatagcacatgccgatttcagtggaaggccaaatttcagtgacaaagcattgaaatgccttcgcgactcgtgcattcagagagtcatttgctgattgacattcattcattggcaaatgtccaaattttcaacccaatttgatggaattccttcttcacatactgtaaat

SEQ ID NO: 90913 - DNA, 607 bp, Heterodera glycines
  SCN-specific regions: Sequence locations=1-607
gatcgactggtccagtgggcaccaattcattgtcacggaccctaacaacggcgaattgttgtgcgatgtctcgaattgtgggcctttggaagcgcaattggcggttgctgccgccagacgaaagtttccgcgttgggcgttcgaatatacggccaaagaacggggcgccgttttgcgcaaatggtgcgaattgctcggaaaaagggaaaagcaattggccgaactactgaccagggaacagggtaagccgttggccgagtcgcgtggcgaaatccaatacgccgcctcctacttggattggtacgcggccgaagcgcgtcgctgctatggccaagtggtgcccgcgtcgaaaccgttccgttctcacgtccatttgcgtgagccgtgcggcgtctgtcttctgatcactccgtggaattttccggcggcgatgattattcacaaagcggcggacgcgctggcagtctgctgtacggtggtggtgaaaccggcggaggacactccgctgacagcactcacacttgcgcatacttcccatgaggcgggcgttccctccggcgttttcaatgtcattccgtccgaccgagacgagactgccgaagtttcc

SEQ ID NO: 90914 - DNA, 157 bp, Heterodera glycines
  SCN-specific regions: Sequence locations=1-157
cgccgaaaaaggcactcgttttgggcccctctctctgaaacttccgaaggaattgttccccgtagcgggtgtgccactgattgagcatgagatttcttggctttgcgaacagttggaaaacctccacaatgttgatattgatggattttacgccggc

SEQ ID NO: 90915 - DNA, 444 bp, Heterodera glycines
  SCN-specific regions: Sequence locations=1-286,312-383,405-423
attttattgaagcttttcctaaaattcaatttacaaaaatggttgccaagcttcttccggtcattctctgctgcttgtttttggcttccttcggcctcactgctgatgtgctgaaattcaaacgagaagcggcgatcagcagttgtggagctggacagtttgaatacgggggcggctgctgtacgacatgcacaagcgatgctgattgtacgggcgggaagctttgtgtgccaattctcaacttgctcagcgtcagtctgtgctttgccccatgcggaaattaagacagaaaacacagagaaagaaagcagtagcaaaagagggcgctgataatgtgataaagtgataggattaaatgaaagattgggagttaattagttaaatgcatttaaatagtgtttgatcaatgaatatttttcggagaaaaaaaaaaaaaaaaaaaaa

SEQ ID NO: 90916 - DNA, 614 bp, Heterodera glycines
  SCN-specific regions: Sequence locations=1-234,256-399,421-614
gacagacccaacatattcgcttctgacaccttccttcccatgccatcagctaattagccactaattaaccccaattaacaaaactgtcccctgcttctcccgataatggccccaaaatgccttccgcccgaacttttgttcgaacttgtgcctttattccctgtcgaggaaactcttccgaatgtgtttttatcctgtcggctgcttcacaattttttgcttccacgtgttgacaaatggaaagaggaaatgcaacgaaatacagaagaaatggaccgaaagttcgaggaaatggaaaaaagactcaccacaaagtttgaacaatttcgcgaggacacatttgaattgctcgacacgattgttgagcgtatcgaagacggcaacaaggaaattgcccacttttgtcgacacacagcccaaacgatggacttactagcacttaacatcaccaccagtgtgtcggccttcaaaaggcgcaaacaacagtgcggacaggacactgattcagccatgaccgctgaacgaacgttcggcggcggtcaactgaccgccgctgctccgtctgccgccacatcggctgcatgcggcggcgaattcggtgcgaaagtaaataa

SEQ ID NO: 90917 - DNA, 166 bp, Heterodera glycines
  SCN-specific regions: Sequence locations=1-166
aactgaggctgaaaaggcgcacaaagcgaagccgggcggagacacgatcttcgggaagataatccgcaaggaaatgccttcgacgattctgtatgaagatgacaaggtgctcacgtttaaagacatagaccccgaggcacccatcaatgttacggtcattcctaag

SEQ ID NO: 90918 - DNA, 318 bp, Heterodera glycines
  SCN-specific regions: Sequence locations=1-153,177-286
gaaatcgctagcgccggaaaagttggaattctggcgccagctcagtgccgactttccctacgacatcattgagggcaccaaacgcgagacgcaccaaacaaaggacgaactctgatcagtggcgaaggaaggatgatcagagataaaggcaaacattatgccaaaaaaggcaaacatgccaaatcaattaatttaatcaattattttgtagcaatccaacagtatttgtatttaaatttcatctcaaatgtcaattatgtaacaaacaaaatgaatgtaaacacataaaaaaaaaaaaaaaaaaaaaaaaaaaaaaaa

SEQ ID NO: 90919 - DNA, 225 bp, Heterodera glycines
  SCN-specific regions: Sequence locations=1-200
cgtgtgttttcgccttcgcatcactccggcactgagttcgaccctgaagaagatgaccccgttctcgaaccctcttggcctcatttgcaactcgtctacgatttccttctgcgttttgtcgaatccgctgattttgactgtcgcattgcagaaaaatttgtcgaccacaaattcatagtcaatgtaaaataatgttgattaaaaaaaaaaaaaaaaaaaaaaaaa

SEQ ID NO: 90920 - DNA, 634 bp, Heterodera glycines
  SCN-specific regions: Sequence locations=1-397,419-432,454-634
ataatatggaggaatatgaagcttcatcagtgagacaacgggccaaaattgaagaaagggatggcaaaagggcaaaagcgaatgcacaaaaggcaccaaaaaatggcgaaaaaagtctccaaatcggatggattgtttgctttgtgctcttcacttttgcaattggaatcttgttaatgtatcaaagtcgtgaaacaccgacaaattatcaaaaggaggtgaaccgagaatgtgacgaagggacagggcaatgtattgcaatagcagattatacacgggattctggtaagacatggcatcgaggcattttttatgtcaatgaaacgacattcgattttgagaaaatgctcgagaaaaaaatcggagcagaagcaattctcaaatgtcctgcaaatgcagatgcccccgaggggtgtgtgcctgaccacggtcgtttgtcttggccttacgttgccaccatggccattatgccatttgtggtcggaacactgcaccatcccacacaaatgcagcagcgaacgcagtcggcgctggttattgggatgggcggcggcactttggacatgtttttgcacagaaaaacgcccagtttaaatatcaccatttacgagttggacccaatggtcgtacaaat

SEQ ID NO: 90921 - DNA, 629 bp, Heterodera glycines
  SCN-specific regions: Sequence locations=1-162,184-316,338-629
caagtttgagatcgtttgtccatttctgctgtcctcgtttgaatggactccgtccttccctcctccactgatcagttcgcttccgctgcgtctgatcaccaaactctgccgatgtatgcccaaaccactcgtcctctctacgtgcttttcgtcttctccgttctcgccgttctctctctgctttcgctgttcgcctttcttcgccttcacatgcaaaggcagcgccgaattgccgactcaacgccaaaactgcggtatcgccggcaccacagactttggataatcgccgcaggggcaaaccgaaggccaacaacggagcaacaacagcagcggggaatggtcgaattggaaaccatcgtcagcaccggcggcagtgggggaggacaatgaacgagaagggacgcaattcggaatgtgttacttcattattcacaacaattgaacgaaggttcaactatgaaaaaccccggtcacggcgagcgccaagccacatgaggaatggaagcggcggtacgagcgactgcgccagcaagcacagaaaatgaagcatgagctgcgcaggtgagggcgggcgacacagtgagcgaggcggacttatcagcgaacatgcagcagacggactgaaaaaa

SEQ ID NO: 90922 - DNA, 641 bp, Heterodera glycines
  SCN-specific regions: Sequence locations=1-48,70-641
gtctaataaaaagctgaaaaatgttggcaaatctttctttgccaatggttttgcttgctttttattccatcaacagcaaacttttgattgtgtcatgccaacaaagttcgaacttttcggaatgcggcatttccgacttcgaacctcaattggccaatgtgtcaaaaatggcaatcggcacaaatcatgtgtataaagggcaagaagttggtgatgacaaggcacttccatggatcgcccgactgatttttggaaagtcgtattgcagcggaacaattgtcggtccccgacatattttgaccgcattgcattgtaccgagcacaatgttgcagaaaatcaaattgtcattgcgtatggttccgcaaatttgaaacaacagcaacaactcacgggcgttgcggccgttaaattgcacccaaagggcaccgacacgcaacgcaatcaaattaatgatgctaaagcagataaaaacgtcattataaaagcgcagggattgcaaccgaatccatatgacatggcaataattgaattgaagaacccacttgcattcacagcaaatgctcgtcccatttgtttaatggaatatggcaccaatgatcagtcaacctttgttgttgctggttggggccgtacttcacca

SEQ ID NO: 90923 - DNA, 349 bp, Heterodera glycines
  SCN-specific regions: Sequence locations=1-292,314-349
tgcattcaggatcatgcccagctctagtgctaacaggccgcactcttggacctcatggcgacaccgcacagacaatcgacctgcgataattcttatgctatattgcatcgtggacctggatgtttgcctaattccgctagagatgaactgttacgggggcagtggacaaggcttcaccagttggatcctattccgactgacccttctgttgatggcacgaatgacgtgcgcactcactacggccatgtattcgggacaccgtgtagaaactttccgctccctcgaatgtccgcctcgaatggttatcacccacacaattattatacctgagtacccctccaagtcactt

SEQ ID NO: 90924 - DNA, 627 bp, Heterodera glycines
  SCN-specific regions: Sequence locations=1-480,502-627
cttttttcttctagttcatgtgtctttccaattctgtcataatgctgagccgcacttggatcgtcgcaatttgtttttatattttctttggcacgattttaccattctctgaagcaattcgtttttatgtggcttctaacgataagaaatgtctgaaggaagaaattcacaaaaatatcgtgttgacgggcgaatatgaattaagcgattctgttgggcacacaacgacagttcatgtcactgatactcgtggtcacactctgtacaagcgtgaaaacttcccagaggcccgtggaaaatttgcatttactgcggacgaatacgacattttcgaaatttgcttccaaatgcatggcccgactcaccaacaaaagttaaacagagaagtccatttggtgctaaaacatggagtggaggccaaaaactacgaagacttggccaaagcagaaaaactgaaacccctcgaggtggagctccgtcgtctggaggatttgtcggattcgattgtgcaggactttgcttacatgcgtcagcgggaggaagaaatgcgggacaccaatgaatcaaccaacagtcgtgtgctctacctcagcatcttctcaatgttgtgtcttctcgggctcgcca

SEQ ID NO: 90925 - DNA, 631 bp, Heterodera glycines
  SCN-specific regions: Sequence locations=1-265,287-367,389-422,444 -471,497-527,549-631
tgaagtaccacgttatctactaaaatgttcatttgaagaaataccacgccctaactactatgaatgaataccttactttttaaatagggctcgcttctatatagaggttgcttttgaaaaagttgaggaagaatttagacttcaagctaaaaatcagaacgaaccagcctgtatcaaataagctgatctgctagtatttcagatctcttttttaggaactactctttccaagggcgcttttttttttgtatcttaaatccttcgaaaaaataggttgtttttctcatttaacgatcaatcttgattcccgaactatatggttccgaatgtatatatagttaaatactatcagtaggcgatatagttttggttaccggtctctccatcaagtaagttaagcacctaagccaacctgattaaattctataaaaagaggtgctcttgcactgagccttgcgtttattatctgtcattttagttatgtattgatttttataacagctattactataactggagatggcagtgtagtaaaaggctatttaagtcttttgctgtatgaccagtgggcattgttatggcaaaagattgtgcatcacaaaacacattgtgtaggttattaggaaaaaga

SEQ ID NO: 90926 - DNA, 284 bp, Heterodera glycines
  SCN-specific regions: Sequence locations=1-139,163-261
attagcatcagacaccgagtcagagctgccttgagaccacccgaggaggatgaacttcattttctgatgtcaccgagcccaatgagcggattgacacctggagaaccgtcctcaacttgcggttcggcgacatccaatgaaccagctgatagtgaaaagaatcatatggaggaagacaacagaagtgatgttgcggaaagcgactcaaatttcttaaaatctaatttgtatttatttttgtcgataatgtttctctcgttcaaaaaaaaaaaaaaaaaaaaaaa

SEQ ID NO: 90927 - DNA, 626 bp, Heterodera glycines
  SCN-specific regions: Sequence locations=1-306,328-626
tgaatataacgttcaccccatttaaacgaatacaaaaaatgcaaccaaattattacgttgctttgtatggaaatggaaaagaaccgcaaaattcagccaaaaattatcgattattaaacccaacagtggatttaattgacataattggtgaggaaacaaattgtgctgaatttacgacggacaaaagttgtaaacgtatcaaaaatgataattcaatcatcttggacggattggtcagaaacaaattatacggagttttactctgttctgtcattgatcctcacaacacaaactatcccgttaatgacacaaaacaatattcaaaaccacttgtttatcgtctgtttttgcaagcacgcgaatctgttttgaatggatcaatggaaaatgtgaacaaagagcgagaaaactacattttttggattgttggcggctccggcattctgtgcgcatttttactgattttgattgtcacaatattttttgcatattgtcgtcaacgtgacaaaaatcgtaaaaaccaggccaacatggaacatttgcgtcggaatcgtgaccaacgctacacagattttcctgcccgaagtcgtgaagaccaatgggagttggaaaggcgaaatttgatc

SEQ ID NO: 90928 - DNA, 613 bp, Heterodera glycines
  SCN-specific regions: Sequence locations=1-613
aatcgaacgctaacggacgacctaatggaaaaaaatccacgaaggagagaatttaattaaatccattcctcgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataccaaaatataaggaaaaattttttatccatctttctttttgatactaaagcatcagagtgctaaaattaacttgtaaataaaatttggtgcgctttagagcaatttctgaaaaatatttatgaaataaaaaaatcgattttttcaagtgtccgtttggggtactcaaacaattatggggagcaaaaatccaacgcagaattaaagtacagactatagggaagctattcccaaaggattcggtctctccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccga

SEQ ID NO: 90929 - DNA, 215 bp, Heterodera glycines
  SCN-specific regions: Sequence locations=1-143,166-181
atttggttgaccccaacctgcattttttatatatcaactttctgctcactccaattttacattcattgtgattgtcctttactgtctgttaaatcgattcacagctcactcactataaaacattattccccgcttttgtgatcaaatttgtttaaattcattttaataaaaataacgagtgaaaaaaaaaaaaaaaaaaaaaaaaaaaaaaaaaa

SEQ ID NO: 90930 - DNA, 632 bp, Heterodera glycines
  SCN-specific regions: Sequence locations=1-540,562-632
caggcgttggtgtgccgcggcatcgcttcggcaccgttggcgattgggtgcccttcgggcaaatcgttcgacccgaaaacgctgaattgtatcgctgccccggagcaatgcgcagtgctcgcatctgctcaaaggcccatccgacagctgttgctccatttgtactgctccaaagcgcacccaccgaagaaagacattccgaatgacgaagatggaattcggatgcgatcagaaggcgacgagccgtcgcagcagcaaaagccagcgattgtccaagtgtcgtcggacgcgcaacagaatcggtgccgaaattggtacgtggtctgtgagtcagttgaagagcctgaattggtcttttgcgacaatggcaaaatgtttgacttgtcgaaacgcatctgtcggcgcattttgcccggggatcggtgtccgttcaatggcgtttgccggggttgggagtggcgaatgagccccgtgggcgaatgtcgccgcgactttttgttttgcaacggcatccgtccgcaactgttccaatgcgagaaggagcaggaagtgttccgggacggcgagtgcaccgccgcgagttccgcttgcgacgtgtgccaaccgggggaaagcaaaaggtcgacagacaa

SEQ ID NO: 90931 - DNA, 633 bp, Heterodera glycines
  misc_feature (589)..(589): n is a, c, g, or t
  SCN-specific regions: Sequence locations=1-83,107-505,527-633
tgaatgctgttcaagatttgcgtctgaaaatttttcacatactccgcaacaaattcggcatcaataactttaaacacaaacaggagcaggcaattgccgctgctatgctcggttttgatgcgtttgtgcgaatgccaacgggtggaggtaaaagcctatgctttcaaataccagctcttgaggacagaggtgtaactgtggtgatttcgccattaatttcacttattcgggaccaaacgatgaaattgaggaatggcactacaacaattccgtgcgctgtttttgatgccgaacgaatggcaagagatgtatacattaatcgaattcccaccttcaaattgctttatgttacccccgaaagggcggtaaaaaatcgacaattccttaaatatctgaggtatttgcatcgcatgaatttattggctcgttttgtggtcgatgaagcgcattgtgtcacccaatggggcaattctttccgtcccgacttccttcagctgggcgacctcatgaagaaattcagggaaaatgccgagaagaaagtgccgataatggctttaactgcgtccacctctgaaagcgattgccgaanagcattcgaatatttgggcatggactgtgaaagtgctctttggt

SEQ ID NO: 90932 - DNA, 636 bp, Heterodera glycines
  SCN-specific regions: Sequence locations=1-636
gtccaattcactcgcacattgtgcaggctgtgcttacgatgctggagaaggggctgaacccggcagacatcagccaacttcaccaggcttattccgatgcttccaattcgcctcctccgccgatggaactcatccggcacaatgccttcctcgaccttctcatcgatgccctttttagcgccaacggacaacgaattcacgcggagcaccgtcccaaatacattttcttgctcgctttctcatgctctgttgccgaagtgaggggtgaacaaggcgaaaggacgcgtgaactgggcgaacttcgcgagatcgaacaacagttggaacaattggccaacattctgcactcacccgaagacattttgctttccctcgaggcgctgttaagactttgtcagactccggtggttgctgttggcattttgcactatttgaagacgcttttgcttagggaggaccttttggctgagccgagttccctccattttgcgctaatcgaccaaattgcgcgtgttcaccccaatttgcactcgagagtgttcaatttgctttgcgatctctacgatcaccagtcgaaccgcaacgaagtggccgaagtagtcatggaaaggcaacggcacgtcgtggagagatttg

SEQ ID NO: 90933 - DNA, 573 bp, Heterodera glycines
  SCN-specific regions: Sequence locations=1-62,84-492,544-573
gtcgctcttccctaatgggttgggcagcggcggcgacgggcgcaatgctgttgatgtccttcacctcaattaccctgttaatagagcgcgtacaggcgaagccgagcacacctgttggcggaccgtattcggagcatggttcacagtgcaatgaaacatggcgcccaaatctaattgagcctttacaaaaatgttcttcaacccaagcaaaaaacgagtgccaaaagggttaccattgtaatggcgccggattttgctgcccggaaaaaggcacgatttgtcgaatggagacagactctggccatgagtcgaaggacgaaccatacaagcatatccgacgatatgcttacgatgtgaatttggggggttgcacaattttctcgtattttggtgccggaggcaatttcaataatttcaaaaagttttatgaatgtaaaaaattttgtgatggaattaaaaaaactaaataaaaacagaagatatttcccgatgaatatttttttttgttattcattttattaaattatgttaaaattttaaatagacttttccaggaataaaattcatttttta

SEQ ID NO: 90934 - DNA, 420 bp, Heterodera glycines
  SCN-specific regions: Sequence locations=1-15,46-224,246-398
gaactgatgtgttcatttcaaagattaagccatgcatgtgtaagtttaacctgccagacagggaaactgcgtacggctcattacaatgcagcaacaacagcccgttccgaagtgtggcaatgtgaaatgcccctgtggagacgcgtgccagtgcggcactgactgcaaatgcggtgcgaaggaggccagcaactgcgcgaacgagaagtgcgtttgtgagaattgcaagtgcggcgccgactgcaagtgtggccagtaaacgacaccgaagaatgggccggagggttgtgataagaagagcaaaaaacagttaccttatttaatttgatcgtgaccgaccataattttgacatgtttattttaaaatgctgattgatacaataaatattataagaatgaaaaaaaaaaaaaaaaaaaaaa

SEQ ID NO: 90935 - DNA, 636 bp, Heterodera glycines
  SCN-specific regions: Sequence locations=1-417,439-636
gtccatttaagaaaaacttaaaaaatgtttttttcctacagtattttggtgtcaaaaaattccaacttcgctgtcatatggaagtatatgcatgaccgccatggtattgtcaaagtatccaagcgcgaattgctttccattgacattgcaagagcatgcgaagatttgcaaaattacatcccaacgggtgtgctgctgaagtctgaattgcgcgacaaaatgtcactttatctgctcgcccaattgtcgtacggaatcactttggtgttccaagcgcatgtcaactatttaatcaccgaccttgaatcagccatcaaatcatttgctcggtttccggaggaaaacaagcgagaaaaaactccgcgcaagtccacgggccgtaagcgtagacttgccgaacttgacggagtggtggaagcagtgatggcagtgccacggggcatggagcaggaggatatggaagaagaggacgacgaaggggcgaaacgccgacgcatttcggcgccacggaaggcatcaaaattggacttggcagatccgagtgcttatgtggaccagcaacttcctgctgctcgcgatgtgaacgaccagtcgatgctaatggatgagagcagccgcttggacgacatgttcatg

SEQ ID NO: 90936 - DNA, 500 bp, Heterodera glycines
  SCN-specific regions: Sequence locations=1-347,370-426,468-500
caatcggattttccagtccgaattgatcacttttacttcggtttgatcagtttcaccaccgtcggctttggcgattattttccctcaactgatggcaattttcttcgtttgcttttgcatcttttcgtcctttgcgtgggaatgatttcgatgggcctttggttttcttttgtccgcgaccttttcatgggctttttctgtttccaccggcgccattttcgccactttcgcgacgtttccgtgaccaaacgaatttccaacaacggcccattgtaacgaccaaatcaaaggcttcgccaacccaaattcatcaagttttggacgaattggactttctgatttcggatgcccttttggaagtgcaaagcaacaaaaagtcgttggccatggcaaattcgcaacggaaagaagaaattgtggcacaataagaaaagcccgttagatcatttgtgtttattttaatttttcattcaaacaatatgccataaattttcgctgtt

SEQ ID NO: 90937 - DNA, 171 bp, Heterodera glycines
  SCN-specific regions: Sequence locations=1-146
gcatttcgccattttggccattcgtccatcggatgtccgaatttgcgcgttatgcctctctctctctctgaccaacccaataatctgtagctaattacccccaatactgttttatacgtaaatttccgccgaataaatgacgaattaaaaaaaaaaaaaaaaaaaaaaaaa

SEQ ID NO: 90938 - DNA, 620 bp, Heterodera glycines
  SCN-specific regions: Sequence locations=1-456,479-488,511-519,542-620
aaagaactctatcctctttatccatccaattcacgggttattgacctgagaagtaaaataactcctgcgcctatgtcaaaaaccaagcagttttttaatgagttgcaaagaattgctggatcatcgccaacaaagtcatcatcgtcgctacacatgaaaagggcttacgaaagtgagcgttggtttagcccacgggtcgattctgaccaggcagacacttcgggaccgcctcgtcgttcaattttaacacaatcaagacttcaattattgtcggcacagcgaggacgtgaaacgagaaaaccatattggcgttgtccgatgccatcagcaagatccatcgatacggaaattacgcagccttcacttgttgacattattgctacgccgttagcgcgacagggaccgattaagccatttcgacaccgagagccggagacaggcagaaaaacgaattcgtttgctgtggatgaagatatcttaactgttgaggaaaaagaaaaggagttgatgagcaaagtgcaacctctggaagcaccgaaagctggttttctcggaacgcctcctcctcttgtggatttgttcgaattttcggacattattgtgcgtggacctcaacttga

SEQ ID NO: 90939 - DNA, 185 bp, Heterodera glycines
  SCN-specific regions: Sequence locations=1-14,36-163
ctcatttcttccaatttgaaaagccttttttctttgttccgtttgacacgggagtaatcccgaaaaatcacaacgataatcgccttcagaggaaactttgaaggtttggcaggtttcgtcaacagattttgtcaattaaattagtccttaaattttctcgatgaaaaaaaaaaaaaaaaaaaaaa

SEQ ID NO: 90940 - DNA, 159 bp, Heterodera glycines
  SCN-specific regions: Sequence locations=1-72,136-159
aatccaaaaatggttgctaaaaatgggaaaataggtgctaaaagtttcgaatttaggggggtgtaaaatcgaaaattttatccaaaaaggtaacaaaattaaaccaaatcagtattgagacaaataataaaaatcctcgtcaaaaaaaataaaaaaaaa

SEQ ID NO: 90941 - DNA, 628 bp, Heterodera glycines
  SCN-specific regions: Sequence locations=1-53,75-628
gttattggaagttttgccttttattcgcaatgaaggaaacaaattcaaaaaatagtgaatctgctgacatttgcatcactgatcagcctgataatgagaggcgtgaaattgctgaactgttcccaaacatggacctcaccgaagtctttgctgagtatggacatctcagttccgaagctatcattggactgatactcgaaaaacgacaccaaattccgttgaaagggagaaaggcgtgttccttcttcgtcggtctttcggtgtggtggcctcgttggctgggcggccgtgttgtccgcaagttgctctcttccttcggtgcacgggtcaccggtattccgaccgattcgctgctcgatcaattagaaacagaaagcggtgaccacccgcggcgacagtcggtgaaagagtgcatggaatgctccgtctgctgggagacgaccaccgtggacgaactgtgcttttgtgacgggacgacaatgacagcgacaagcagcagctcagctaaactgaccaccgaaactcacgctttttgtcgtcaatgtttggaacgccacgcgcgcgccgctgttgaggaaatgccattggcaaagggcggactcggcctccgatgcatggccgccgattg

SEQ ID NO: 90942 - DNA, 635 bp, Heterodera glycines
  SCN-specific regions: Sequence locations=1-121,145-635
gtcgattccgatgatgagcaaggcgatacgctggccattggcgggcccgattcttggtatgcgttggcacttcgtgataccggcacggtgctgaagaaggacaccggtggcactggcaaaggcaaaaagcagggcaaagagagggacccgaacgcaccgaagcggcgccggacaaagaagccgaaactgtcctcgggacccaagttaaacaccgcgcaaaaaatcgctgccgcgaatttggcgggagtgctcagtgatcagctgtcggtgcagaatgacaaaaacgatgaggccactttggcatcacaggaacatgtccaaatccgcggcaacgacgctcgccatttgctcatccaaaaactgatgcgcaccaatcgttcctctgtcgtggtcctgcgcaacatggtgacgcccgagggcattgacgagtatttggaggacgaaattcgggaggaatgctccaaatacggccgagtgaccgatgttgtaattgtgcaggaacaagagacacacagcgtgaaaatatttgtgcgctttgccgagccgttgcaggcggaggaggcacgaaaagcaattgacgggcgcttcttcgatgggcgcaccgtggcggctcagtcctatgatcagattctgtt

SEQ ID NO: 90943 - DNA, 626 bp, Heterodera glycines
  SCN-specific regions: Sequence locations=22-436,459-626
ccacaattttccatttctcccttcctgcaaaagaaatgtcgaaagaatttcgtcgattcgatgatgtacaacttcgacttcgttcatttgatgaacgaatgtccaaagtcggcaccttggatgtacctcccgcacaaattgtctcctccactgtccgtccaatctctgccaaatcgacaaatggcgacagtgccgttttggtgccctccacaacaatggcaccaccgtttgtctccagcacagccgcaacatccgttgagagacactcggcggaatcatcggaagaagaggagacggacaaacgccacagaaagggcaaaacgccattgagaggcaatggcggactgagcatcagtgccgtttgggagggagtgaagcgaatgatgggcttcaccgccgactgccataacggcggttacaaaaccatcggcggcgattgcatttgcccccaatttttcgagggccgtgcctgcgagcgcattgtctgcgccaacaacggcacgcgcgtgcgagtggccgcgttcggcggggaggaggtgtgcaagtgcactcatccccagtacatttcgggcaaacactgcgaagtggtgcactgccaaaacggggggcgccttctcaacgatggc

SEQ ID NO: 90944 - DNA, 156 bp, Heterodera glycines
  SCN-specific regions: Sequence locations=1-113,135-156
aaaatcgcagctgacggtgaccaatgaggacaagctgtgtgtgatgcgcaaaatttgtggcaaggacggtgaactgcgtcagaattgcccgtaagtcagtcgatgatgtattactggcatgagcgtgcatgtataaatttgcaacaaaaaaaaatc

SEQ ID NO: 90945 - DNA, 629 bp, Heterodera glycines
  SCN-specific regions: Sequence locations=1-629
aaagagcggaagtatgctcagaccatcctgcaagtgcgcaagtccggcaaccggttgctgtgctcgctgctcatcggcaatgtttgcgtcaactctgccatatcaattctcttcgacgatttgaccaatggcacaattgccatgatcgtttcgacgaccggcattgttgttttcggcggaatcttccctcaggcgctgtgtgtgaagaagggcttggctgtgggtgcctgtaccatatgggtcactcgtttcttcatgatgctcacttttatagtatcctacccgatcagcctcattttggacaagctgttgggggaacaagtcgagtcatatgaccgcgagcgcctcatcgagctcatcaaacaacagaaacgcgtggaaaaggcatcgcgcacgggaagcaacgcgtcaacgaaaagtggtgggagcggtgccggtctttacaacggtgtacaaacgtcgttagcggctgttagttcggacgaggcatcgcgcacgggaagcaaagggtctttaaaaataaagtttactatgcatacggacgggtcacgtgtcggagagccgacgtagaggcaaattcaatcgaagggtccgtcgtccgattacctgcccttctccaattatcaacg

SEQ ID NO: 90946 - DNA, 628 bp, Heterodera glycines
  SCN-specific regions: Sequence locations=1-628
gtcaaaccttatccaagatgcggtcctggacactaacttttatcgctgcagccttattggttgggtcacaggcacagcaggcaggatttaatgtaaacgggatggttgacactttgctaagcagagcagaggaccatattttgccgtccatcgatatccctgatgtttcagtctcggagttgttcaaagtcctctttttcaacgttaaggccagtcttgacgtgagcaaaggatggctacttggtccaaaatcagtgcggaggttcgatgactcaaagctgacgatggaggatcaatatacgtttagtgtagacattccagttggtgtcaacgaaataaactttgggtacaactacaagaccaaggttgcgggcatttccgggccacgtggaaactttacggcaacagtgggtgccacagccgtaaccgtccgggctagtgtcactatttacgatgagttttgctacgcaaagttcgaatcattggatctcacgcagctaggcaacgtcacggtgagtgctactggcttgggcgtggcaaactccatctattcaaagatgctcacaaagtttgcggagagtcagcgggacaaagttcaggcacagattgccgaggacttcgaagaagc

SEQ ID NO: 90947 - DNA, 623 bp, Heterodera glycines
  SCN-specific regions: Sequence locations=1-623
ggacaatggaacgggaatgcgatttctttgccttttacatggatccgagtgattgcccaaaagaacttttgccgcccaaatttggaggcatttcgatgagtatcagcatcaatcggtgcaaagaagtgttccgctcaataaaacgagcattgcaacgggacaaactccgttccgaaatcaccaagctcagactgttgtccaccttcgattttgatgaaaagtccgcgcagattttactcactcaaatcgaacgcattcgcagcactttgccaaaagtgcgttcactgaacatcgaactgagagcagtcgaattcaatccgaaccaggacctttattcgaacgacgacttcgccgactccaatctgatcccatcctccgcttccgcttgttcacatgtagcacttttctttttgaattggatgcggaaaatgaaaatgggcgacattgaaatcgatggatgtgttcggttggacgtggactatcactgcggcgaataaggagagactgatgacgaagcgagagacattttgttggagagggctctgcgagaaaccattacgcgtgcagctgaccaactttgggtgcagcagctgcaaaactcagtgactgctcggaatggctgt

SEQ ID NO: 90948 - DNA, 351 bp, Heterodera glycines
  SCN-specific regions: Sequence locations=1-11,96-101,126-197,226-351
ctctttatctgctctttcctctctccctcctgtctctctctctctgctgattattctctctccctcccactctttctctctctctgtctctctctgctggtcattctctctctccccctcccccaaggtcattaatccgtcgttgcgctctttgggctctttcagcgaggcgatgcttaactttttgcaatcgcttaaccaaacatttgctcaacagcaacaaaaggcgccggacgatgaagcggaggaaggagaggaaatgaaagagcaattggccgagccaacaatcgacgcattggtggaggaacggatgaaagtcaattgaggggagggggggggatgatcaaaatt

SEQ ID NO: 90949 - DNA, 629 bp, Heterodera glycines
  SCN-specific regions: Sequence locations=1-18,40-629
cattgattcttcaaatgggtccagcaaattccaagtggatttgctccgctggatcaaatccgaatttcccgaatggccacaagtgattgccggcaatgtggtgaccatgcgacaggcgaagttgctcattgaaaacggagccgacgcattgcgcgttggcatgggcagtgggagcatttgcatcactcaggaggtttgtgcagttggccgtgctcagggctccgctgtgtataatgttgcgcgctttgccaaaaccttcggtgtgccggtgatcgccgatggcggcattcgcgacgtcggttacatcaccaaggcgttggcattgggtgcttccactgttatgatgggcggtcttttggctgggactaatgaggcgcctggtgagtatttctggggtccgtcgggcgtccgtctgaagaaataccgcggcatgggctcattggacgcgatggaagccaacgagtgcagccaggacagatacttcacttgcgaagatggaaatatcaaagtggcccaaggcgtaactgctgcccaacgcgaccgcggaagtgttttcaaattcgtcccttacattctccgcggcattcagcacggacttcaggacatcggagttcgatccatcgccgagc

SEQ ID NO: 90950 - DNA, 445 bp, Heterodera glycines
  misc_feature (423)..(423): n is a, c, g, or t
  misc_feature (425)..(426): n is a, c, g, or t
  SCN-specific regions: Sequence locations=1-196,218-337,359-417
gccaaacgcacacagataaactccgttttagtcaagatctgtctgttcgtcgttctcctcccaatcggttccgctttgtccgttctctcgctgtttccaatcactttcatttggctcttttatttggccctttctttcgtcaaactcattcccattgttggccagatttcgatgctcttcgagttcgccgaatacatcaccggcttcttcggctacggggattggttcggttcctacaaacgcgctgaggagggccgacgtgcggagagagcgcggaacagactgcaccgccttgaacaacgcaagcgacggattaaaacaccataattttatattgttgttgttgatatctttgtttatacacaatattggcttttttcgcatttgcttttcccattgatagatattttacgggtgaaaaanannaaaaaaaaaaaaaaaaaaa

SEQ ID NO: 90951 - DNA, 639 bp, Heterodera glycines
  SCN-specific regions: Sequence locations=1-639
cctcctatcagcgcgactcggacaatgccgagcgacagttccgtgccgctctgaagctgaagggacccaacgacgacgccgaactgagcacattggccaacctcggcctggcactgattttcctttcctccggccgagaggcccaattctacgaactgttcgactcactttcgccctcgcgcatcccttcccaagcgaattcactccgttccgcggcccatctcatccacggctttcactactttctgcacgcgcgacacaacgagtgcaagaaacagctgatggactccattgccatctccaaggaggaggacatggcccggcttcagagcattgcgttgcttctgctcgcaaaactcctttcctccaaggatgtgctaaaagctgcttccgaatgggccacaaaaagtgccgacgttggccttttgctgtgggccaattcggtgattcgttcggtcggtgacgcgagcgactcgaaaaaagcggaggaggaaatctgtgcaaaacggcgacaatttgacacggcacgggaagaaagtgcccgaggaaatgcacacgcccttctcaagtgggtcgacagggaaatgccaagcgcagcaacttttcgacaataagccaaagaatctcccagataattaa

SEQ ID NO: 90952 - DNA, 607 bp, Heterodera glycines
  SCN-specific regions: Sequence locations=1-8,38-607
attgaattgtttttacatttgaattttttataaatgtcatcaccgtcgttgccagctcattggccagccaggacagcgaaagacatcgaaataatacttttacacgaggcggcgcaagccaccgtttgtcacgcgcttggatgggcagtaactggtatgcgttttacggcgcaaggcggagtggtggattggcacagaaccaccaccttgaataaaatcgagacgcttgaggatttaatgaagcggatttgtattcacatgagtggtaaaatagctgaggaacaattacttaaaagcaacaacactgggtctgagacagacattaaccgaataagcgaagagatggagaaaattgtagagaatggtatgttgccaggcctaccgaaatggaacattacgtcaggttatcatggaccaaaattgttggctgaatatgaaaaagccaaaagggcgttgctccaagaatgcaaaaaacgaacggagagaatcgtaatagagcaaaaagatgtaattgaggatcttgcgaaaaagtttggagcatcaactgagttgaatgaagagcaagtgcagaattttttcgcggcgaactcgccgagacactctccat

SEQ ID NO: 90953 - DNA, 607 bp, Heterodera glycines
  SCN-specific regions: Sequence locations=1-37,59-142,164-219,241 -564,586-607
atttgaaaccgaacaaacgaaatgccaagttcctcgactcttttctctctgatcttctctccgtccattcttcgatcgtttcccgtcaaggcgaccccggcccagtgcttcaactcttccgattgcttctcaacgaccgccaattgcaagaaattgaagaaaatccggacggatatttcgaatttacggcactttgtgagctgccgattaaactgtccgtggggaagggaaggccaaaagttaaaactttggccgtctctgtgctcggctcgctgcttcaactgaataagcaaagtcaaatgtaccgccgcgtgcttcgcctgcttatttctctgttggattcgccatacgcgtcgctgagggaacaagcagccgaacagctcttcgagtttttcagttgcgaatccgacgacagcgaacatgggactgaaatggcattgaaattgctgacagagaccgactggggccgagggagggagggcctaggagagaacagacgccggatcagtgccattctgttggccaatgcgagatgaaagtgacgcaaacagcgaatcaatttcatatttccattctttttattattgaaatcattccgagggggagg

SEQ ID NO: 90954 - DNA, 628 bp, Heterodera glycines
  SCN-specific regions: Sequence locations=1-249,271-628
gtccaaataagcatttgtctgtcatattcgttcggcgagtgaacacacaacaaacataggtcgttaaatcagtaacacatgtcgaaaccgaaaacattggtggaacgtatgagactgttgttcagcaccagcaatggggcggacattcaatttttggttggggaaagcgacgaaaaagaactaattcccgcccataaaacaattctggcctcggcctccgacgtgttcgaagcaatgttccgatttgacgccggaaatactggtcgaaaaacctcctcggcgatggtgccaagccccgtggtggtgcccgatgttgaggcggatgcattcaggacgatgttgggcttcatttacacggacgatttgagtgggatggacggcgacaatttgttcgacgttctttacgcggctaaaaagtacaacattgtcggcctggtcagtgcctacttggactttcccatcccttcgctgcccaacgttttcttcgcctttgcccaggcgcgttttctcgaagaaaaggattttgctcgccgttgcatggaatacattgaacaaaacatggacactttgcaccaatcggacgcctttttggaaatcggccaaagtttgctgtgcgaagttttggacc

SEQ ID NO: 90955 - DNA, 536 bp, Heterodera glycines
  SCN-specific regions: Sequence locations=1-282,304-486,531-536
cagtctgactaaatatgtggacactttcatcggtgttgcgggacccaaccacggcatttcgctgcagttgggtgccctttccgtgcccggctgtcttctgtccgtgttgcccgtgtgcaatgctcagactggcctatattccggcttctgtccggccgaaagcgcttttctccaggacatcaacaggcagcaggcatacgagggacagaacaggttttccatctacagcaccagggaccaggtggtcggccacaaagtgtgtggtcgggtcacttcgcaactgccgggccaacatggcgaaaaagtgtacgacaacgcggaccatgacggcgcatttctacactcattccccgtccaacatgccatggtgttgaaccacgcgctcatttgagggaaggaaaggacgggcaagcggacgaccgaaattcaaaattcatttattctttcgttcgttcattttgacatttctccgtttaaaaaatccactttattttattttaatcttatttttgttaaaatattaataatttcaaaaa

SEQ ID NO: 90956 - DNA, 635 bp, Heterodera glycines
  SCN-specific regions: Sequence locations=1-635
tataaaatttccccaatgccaagcatcatcattacggccacttttgtagcggtggtacttttcacttgcgcttttttggacctttgccatgcattgacttgcaaaagccgttcgataacggagaaaaatggcaggcaaccaaaagattctgttctttgtgagaatggccaagacgtttgtcgtgcgttcttctgcgtagcgaaccattcccttttattcatccaatgggattgtgcgacattcagcaaaaaggacaaatgcccacaaaaagatggccccaacacggcaaatagcgtaagagtggaccatgggcttcctcagtcggatgattggcattgcgtgtgcgaatttggccaagttggggaggaaatgggcaacgaacacatttccaagatggacccgacggaaccaacgccaatggccgattcggatgttcgcgcttctgtcagtccactttttgtcctttcgtttctctattgggtcattttgccattggcaactgctctttatcgtcagttgctgacctgggctgattagcaggtggccaagagtacaacgttgtgatatgagagaagagtgccaatggacaaaggatggatgtgaagagaaataagaaaagaatttcaaatttcaat

SEQ ID NO: 90957 - DNA, 499 bp, Heterodera glycines
  misc_feature (478)..(479): n is a, c, g, or t
  SCN-specific regions: Sequence locations=56-499
cctcgtgccgaattcggcacgaggctcaaaagtgccatcgatttcctccccacaaaaagcatcaaattctcgattctcggaaaaatgaagccaacattcaacttcaacctttttgcatccgtctttcttgtgctttgtgtggcctcgtttgtcctctgtgagcataagcgagcagccgcagcagaagcatgtaatcaccccaaaagcgttggaactggcaacttgtcactcaaacgatggtggtgggacggtcgtcattgtaagcaattcacctacaaagggcagggcggcaacacaaacaatttcccgtcaaagaagctttgtgatcaagtgtgcaagccatgaaatgtgccgtggaatgatggtatgaagcgtgaagagacatgcaaagaagaaaagcgaagaaaatttaatgaaatttttcattaatcaccaataactaaagatttgattgaataaataaaattttatcgttcannagggacattttgccattaaa

SEQ ID NO: 90958 - DNA, 350 bp, Heterodera glycines
  SCN-specific regions: Sequence locations=1-167,189-317
tagattaattgcggtgccgaggcgggcgcccgacggtacgtggacctaatggcactgatcgaattcgtcttcaactcgggcgccaggcatcgcgaactgctcacttacggttccaatgtgttggacccgcagttcgatttggtgatgccccccgtgctggcgccaaaatgtccaccaaaggacccgtcgaattgcaccaattgttgccctattaaaaggaatttgaaaatcactataatttatcgaatttatccttattcattcgattatccaatctcgtttatcctatagtctaatcaacaacctaactcttctttaaaaaaaaaaaaaaaaaaaaaaaaaaaaaaaaa

SEQ ID NO: 90959 - DNA, 629 bp, Heterodera glycines
  SCN-specific regions: Sequence locations=1-15,38-92,122-201,236 -311,335-581,605-629
caagtttgagctgttatccatctaaaaatacaatgtccgccattcgtaaaaagttggttattgtcggggacggcgcttgtggtaagacatgtttgctgattgtgttcagcaaagaccagttcccagatgtttatgtgccaacggtttttgaaaattatgtcgcggacatcgaagtggatgggaaacaggtcgaacttgcgttgtgggacacggccgggcaggaggactacgaccgactccgaccgctcagctacccggatactgacgtgattttgatgtgctttagcattgactcgcccgactcgttggataacattccagaaaagtggacacccgaagtaagcgattgggcggaactttcacgaccgtatttcacacttaaggtgcgccatttttgtccaaatgtgcctatcattttggttggaaacaagaaagacttgcgcaatgaccagcagaccattcgcgacctttcacggaacaaacaggaaccggtgaagtcggagcagggaaaggcaattgcagaacaaattggtgcatatgcttatttggagtgcagtgcgaagaccaaggagggaatccgagaagtatttgagaaggcaactcaggcagcacttcagcagaagaaaaag

SEQ ID NO: 90960 - DNA, 343 bp, Heterodera glycines
  SCN-specific regions: Sequence locations=1-181,203-343
attttcttcggcttctgtctctccgcttgacaccttcccaagcaaaagcaacaagaattgttcatccaaaaatctaattgactaattcgccgtccattagacgagtttaattcgaagaaaaaaaacaactaattgtatttgaagatattattattatgggagatgaatgaactgaagacaattttgtgctgctgctgctgtactctgatatgataaacaaaatgtacccaattcggcaaattgtttgttctgctaattgatttgtttgatttattaattgcagcagtaatttatacagacaaagaatattaacaaaaatgaaaacagacactaaaacacacaa

SEQ ID NO: 90961 - DNA, 374 bp, Heterodera glycines
  SCN-specific regions: Sequence locations=1-138,160-342
gaatatcacaccgtacccattggaccgtagtctttcctacactcactttatactgtaacgaatccgctccatccaatcgttcgattttctgctctaatgcgccctcttttctcagggaaaccccagggagaaaaagtcttttccgattaatttaaatatcccattcattctttttgttttttggacaattggacctcgaaaagcctcaattatcaacaactataaagctaatttaacaaatcatcgattccatccattcttcaaaatgtctttcactcttcgccatgtgaaaatgttaatgatgataatttgcttttcatctgataaataatttttgatgttaaaaaaaaaaaaaaaaaaaaaaaaaaaaaaaa

SEQ ID NO: 90962 - DNA, 289 bp, Heterodera glycines
  SCN-specific regions: Sequence locations=1-238,260-289
ctgcgaattagcctggcgcaacaattaccggatgttggaacttagcaggacatgtcaagcggctgtgatctcaatcacctgtgtcattatgaggctgaccggcactttgggctttctgttctatttccgttgtgttttcttacaggcttttgtctggcaatacaagacgggctttcgatggagtgcgtttttcacgagtcgttcgcttttcctcacccattcagtcgttagtggccttttcacttatgtccttttttgggtgtatgtctacggacttgtccatgtctat

SEQ ID NO: 90963 - DNA, 289 bp, Heterodera glycines
  SCN-specific regions: Sequence locations=1-15,37-128,150-263
cagaagcgaatgccgagtgtgaggaatgaatgaatggaatgtacgcctccccccacccccgcccatttccctgtcgttttgctgccgtcgcgcgactccgtttttcttttaatgagagaattgaaaccgaaagagagagatagagaaaacatacggataatatcgagataaagcaacaaaatatttatcctctgagactgttgtctttattgttcgttgttttgacgctgcttcttttttttgttgttaaaaaatggatggagaaaaaaaaaaaaaaaaaaaaaaaaaa

SEQ ID NO: 90964 - DNA, 465 bp, Heterodera glycines
  misc_feature (444)..(445): n is a, c, g, or t
  misc_feature (447)..(447): n is a, c, g, or t
  misc_feature (449)..(450): n is a, c, g, or t
  SCN-specific regions: Sequence locations=1-57,79-392,415-416,438-465
cttaagtttttctaaatgatcgacgaatcgtgtcttttcgactcggaagaggaggatgaagaagcgaagaaaaagacgccggaggagcgcaaatatttgttcagaaaggagctgcggtcgatgctattcggttttggggacgaaagaaacccaaacgacgacactttggaggcacttgagcaaattgtggtcgaatatgtgaaggaggtgtgccgcaaagcgttggaggttggcaagccgaaccgagtgaacttggaggacattcattacttgattcggagggaccagaaaaagttttcgcgcgtcaaagaactgttgtcgctcagcgaggaactgaaaaaggcgcgcaaggcttttgacgacgcgaaagatttgtgattgatgaaccaacaaagaacaaataatgtaaaaaaggaacaaatttaaatacaattaaacacatcnnanannaaaaaaaaaaaaaaa

SEQ ID NO: 90965 - DNA, 424 bp, Heterodera glycines
  SCN-specific regions: Sequence locations=1-424
tcgtaaagatgccggccaaaaattggctaaagctttagcccatattttgcctcaacgtgataacattgtggttttggcacttccgcgtggcggagttgcagtggcttgtgaagtcgctgatgcctttcaggctcctctcgatcttctgatggtaagaaagataggtgctcctggccatgaataatatggaattggtgctgttgtggaaggaaatccgcccgagctcgccattaatgacgaagctcgtcacaattacacgaccatctgaagcatatgtgccaaagacaaatgcattaatcaactcgaagaaaaggacagacggccaataacatatttgggcgacaaaccgccggtgtcgctggaagggcgaattgccattgtcgtggacgacggagttgcgacgggtggcactgctcgagttgcg

SEQ ID NO: 90966 - DNA, 400 bp, Heterodera glycines
  SCN-specific regions: Sequence locations=1-57,79-400
cacggagatcgctggactaaagcccgaaatgctctgtcatactgaacacatccttgggcacgctttgtgtgtgctccactcgaaaactcttgatcaatccctagaattgatccacccaagtcccttatcgcgaaatggcaccgcgcttttcactccgtcgggaattgccccgcgccgtctcctcgcgtagagtgatgtgcgccgagcgggcctacatgtgccaatccctgggccgcgtccgatgtactctttcccccgttcacgtgcaagttctcctggccatgccgattactatggaaaagctggtcataattcctacacccaacctcgaaatgtgacacatctgagacgctctgaggatgcctcgactgcaaccagaccacatctatctcttccacaa

SEQ ID NO: 90967 - DNA, 481 bp, Heterodera glycines
  misc_feature (461)..(462): n is a, c, g, or t
  misc_feature (465)..(465): n is a, c, g, or t
  SCN-specific regions: Sequence locations=1-126,148-152,174-380,405-481
tacaatccaaggatcatcatcaatctcatcttttccttatgggcgttgattctgctgatgatgactcagtgcctgatccaattgtgattaagcagggcgagtcattgagcctttctcagcttgtgcaaaaaattgaacatttacaaaaccgaactgttcaagagttgactgccaccctacgtcgtcgcacgtacaaaatgcctgttgggcctcccgacccaaatggagatcgctttttccaaaatgggcatctcctggtagaagatgttgtgtacaaggtggcaagaaaaacgcgtaactccatccacggaattgtccagcttcatgcgtatatgggaattccattgcttgatgaagtcaattatcacttttagtgattggttaaagaaaatttttgtaaatttgtttgtcttaatattttgtacgctatgcgaatttgacaataaatttgttccaatgannaanaaaaaaaaaaaaaaaa

SEQ ID NO: 90968 - DNA, 465 bp, Heterodera glycines
  SCN-specific regions: Sequence locations=1-36,58-64,86-298,320-425
gtttgaggcctaatcttaaaaacctgctcattggtaaaaaatgaaatccttctttaatttcccatttgtcttttgtgttcttttgctcattggctgcgttgacaaatgcgtcggaggagtcgcggcattgccgccaaaatatttgggcattgaaaaccatgacaaatgcttaaccgacgagccaataggctcttcgcgtcggctttgtttgccagcgcagaaaaaaatcgaatgccaagatgaaacgttgaaagcgcttaatgatttggaagaaggccaacatccgccgacttgcgcatgaatccgaagacagaagcgaaagaagcaaatgaagggattgaagaatgacagggaaaagcctggctgaacaaaattttgtctacaaaaatgaaataaaaagttattgaaaataaaaaaatttattgaaaaaaaaaaaaaaaaaaaaaaaaaaaaaaaaaaaaaaaa

SEQ ID NO: 90969 - DNA, 322 bp, Heterodera glycines
  misc_feature (293)..(293): n is a, c, g, or t
  SCN-specific regions: Sequence locations=1-28,50-297
gacaagcagaatatacagcaaaaagaaagaagatgagaagataattgggggcaccgaaatgtgggaaaacgcccaagtgacaaatgagcgatgcccaagttgttctcatgacaaggcctacttccagcagatacagacgaggagtgccgacgaaccgatgaccattttttatcgatgtgccaattgtggacaccgatggaaggagtaacggatgaaatccgaatttaagtccatgttttttagttagctgcttgttgatcaaatcaaataatattgctataaagggaaatccnatttaaaaaaaaaaaaaaaaaaaaaaaaa

SEQ ID NO: 90970 - DNA, 597 bp, Heterodera glycines
  SCN-specific regions: Sequence locations=1-79,102-193,218-597
agaccattgaaaatattcttttgattctcctgtttttgtcgtccttttgtccatttgttttggcttggctctctctttgcctatgacttcctttgcctctcaaaattccgtttctttggcggttcaaaatgcgctgcatcaaattttgacacttcctttgccatctccgcaagtgccagcggcgcaaaacgaacagagccgacgggaggaggaggacgaagcgtcggcgcaaatggacttttggacggctgcgagtttaaacacggagaacattcgggattacaattttgaagatgagataaacgtcaaaaatgctgcaggttggactcctttgatgtacgccgcctatttgggccatcgcgaactgtgccaactgttggttctgaggggggccgacgtggaggcagccaacgagcgcaatcaaacggggattatgttggcagcctcttgtggtgccattgacgtggttcgaattttgttggacttttctgccgattgcaacagacaagaccaatacggacggagcagtctccattatgctgtaaaatattatcatgccccggtggtacagttactgcttgaaaacggcgcagaccc

SEQ ID NO: 90971 - DNA, 619 bp, Heterodera glycines
  SCN-specific regions: Sequence locations=1-99,121-252,313-619
gtccaattaagtttctctgatttttgccatgaaatttgtcacttcgttcgcccgtcgttggcccctttcgctttctgtcgccgcttcgtttggccgcgtcggtgcgacgcgcgccgcctcgacgctgacaattcgcgacgcattaaaccagcagcagtgtctcaatccgtctccactgatcgctcccatcgatcgtcggcgatttgcgacagtcaaaaagaaacggcaatggaacagaacggcacaacaatcggaggatgaggaggacgacgaagcagaggaggaggaggaggaagaagaagatgaggaggacgaaggaatgccaaccgattgccggaacaaagaattcacaatgctttcgcggagattggacactgtggtcggagtggcactcaaaacgagcataagcgcacttggcaattggattttgcagggccgcgttcgggtcaatgaaacggtggtcatcaaaaaggcgcacgagatagagcagggcgacttggtggaagtgtgggacgcgccgtacgaggaaaacgcgcggcttgccacggtgcaccgtctgcgcattgtgcggtgtcgttttgaccaacgcaaaggctatgtgatcaaaacgaagtgttgg

SEQ ID NO: 90972 - DNA, 365 bp, Heterodera glycines
  SCN-specific regions: Sequence locations=1-181,203-322,347-365
attcacataaaatgttatcttttgacttccattctataacaattcaccaaaatcgtgtccgtcctcgccatacattgtggcatagccggcggcggaaaaattacgccacgcgaaagggtaaacttcgtcaacaaaactggcacttcgataacgtttcctcgtcaacggctaaatgcttttgaatgatcaaattattaaaagaagacaaaatgccctaaccaattcctcctccgtttgtgccgtcaaaattggaataaatgcctgtggtgtgccatcgccgacaatattataacctggaagaaaaactgtagcttgattggactattttaaaaaataccattaaaaacaacagatttcatttcatt

SEQ ID NO: 90973 - DNA, 627 bp, Heterodera glycines
  SCN-specific regions: Sequence locations=1-435,457-627
gtccatttaaggcatttcgtgcattttttgtacaaatttttgggcatgagtacagtcccttccacctcatcggtcattggcactcagctaagcgatttcaatcagcatgccctgaagggaatggccgctggcgcatttgcggctgccatttccaaaacaacagtggcaccgatggacagagtcaaattgtgccttcagttgcaaaatgccgctgtttccaccccccatatgcccgttgttcgcctcccctccgcccattcgctcccttaccgcggcatcgtcgattgtttgcggcgtttgtgcgccgacgaaggcatccgttcgctgtggcgaggaaattcagcagctgttattcgctgctttccgcacaatgcgctcaatttggccttccgcgattggttccgtgtcgcctttttggatggcatcgaacgtcgcaaaaggcccattcgctttgtggcaggcaatgtcgctgcgggcggtgcgggtgccgctttgaccctcgtcttctgttacccgttggacctcgcgcgcacccgacttgccgttgacggaggtgtgcaccgcggcttgtttcactgcttttcggtgatacgctcccgcgaaggcactgctgggctttaccgcggc

SEQ ID NO: 90974 - DNA, 625 bp, Heterodera glycines
  SCN-specific regions: Sequence locations=1-311,333-625
gtccaattaagcttcgtttactccattcgttaccttttcccaatgctttcgtcccatcatcgcgaatcacttctcctccaatacggtcgttcgcaagtgctttactcggacgaattctgcaaattgaccgacgaaattctgatcatcaaaaagttcttttttggcactctccggccaaaggttgtgctgctgaaggacattcgcgtggtgtacttcgacgagcaaaagaatcagcagaagaaatacgcacatcgccgtgtgtgggggcgggcgccgaattcgctttattgggctgccgacttcaaacggtgtttgcctggcgttgacaagtgcaaccgcagtgacgtcatcatcgacatggaagacggactgctcaaagggttcaccgtggccgatgcccagtcatttctgagcgtaattcgccttttcgcgccgatgtcgacgataattgtggacaatttggacattgcttaaggcacttttcgcctttaatttcggccatttcactcattccattggatttcattgttcgggcgacgtttgttaattaccaagtccaatttgtaaagttgtcaatgtttcaattcataaaaaacacataatttgaaaaaaaaaaaaaaaaaaa

SEQ ID NO: 90975 - DNA, 400 bp, Heterodera glycines
  SCN-specific regions: Sequence locations=1-400
tgcctctgtgtgctttttgcctcctatagtcggcacagtcgtcactctggaatgtctgtactctgggatgagccgaatgaaccgcctagggcgacagcgagctgacgccttccgcgtcaatagcgactcggcctgtactgatttgatttacgtacatgtgggcttgacgcctgcgttaaggccacgtgcaaacccctacaactcgatcttccacgcgtttcatctacggcccagacactgcctgtgcactagcctcgaagatatcagctgatccccttgaccgcccgggaagacccgaacatctggacaactgtcattgcctggaggatcaagactactcggacagacatggaggactgcccgacccgatcctccttgcccgttatcgaagatcacctgc

SEQ ID NO: 90976 - DNA, 625 bp, Heterodera glycines
  SCN-specific regions: Sequence locations=1-541,564-625
ggctcacgggcatggacattctgtggcacagcggaatatgtggcacccgaagtgattctcaacaaggggcaagacagtgcggtggacctttggtccctcggcatttttatgttcgaacttctctccggcagtccgccctttgcgtccaccgacccaatgcacacgtacaatgccattctgaggggtgtccaattgttggcttggccccggtacatgggggacaacgcgcgcaatttgatctgcaagttctgccgacgcgatcccacgcaacgattgggctatgctcggatagaggatgtcaggcaggacatttggttcaaaaacttcgatttcgcctcctttcgcaaccactcaatgcgtccgcccatccgaccgaaggttcgcagtttgacggacactcagaatttcgaccgctatccgtcgactgataatttcgcctgtggctccgatgaaagcggatgggacgacgatttctaatcactcactaattagccttctgtgaaggcacccgtttttatcatttgctgtatgtaaaattgagcatctttcatttccttttttcatcttactcatgtcaacttaatttttgtggagataaaaaagacattataaaaaaaaaaaaaaa

SEQ ID NO: 90977 - DNA, 625 bp, Heterodera glycines
  SCN-specific regions: Sequence locations=1-420,442-569,594-625
gtaaaacataagaatagacaaataatctatcatcgagaattatgtcgaagttctttcgaggtgctatttcaagctccgagtcatcagaaagcgaggagtctgccgatgagcaaatcgttcaaacccgtacgatagctcgcgatttcgcatatccgagtgattctgaggacgaaggcccaaaacgaattgtgcgcacccaaaaggacaaaacttatgccgaactcaaagaacagatccgttcttcacgaaatgctcgaaatatcaaggatattgctaaacttcaaacagtgtttgaggctcaactgaaattatgggaaaaggcaaaaacgtttattgtacgcgaaaatctgagcattcctcgcttttacattcgctatttggccgaacttgaggacttcatcaacgaacaatgggaggacaaagaaggaagaaaaataatgtcaaaagcgaattcgaaggcattggcctcactaagacagaagttgaagaagtacaacaaggactttgaggaggatttgggcacttaccgaacggagcccgacccaatgggttattccagcggcgctgctgaagacgacgaggacgaggagatccctacagcgccggccattgcaacaaatgacgt

SEQ ID NO: 90978 - DNA, 527 bp, Heterodera glycines
  SCN-specific regions: Sequence locations=1-46,71-527
ccctctcaaatccattccgactttttttcctgcgcaataagcaaatgccctccctccttctcctcccaacattttgcttcttcgcctttgccgtcgtagtggcccattcccagatgactttctccgatggttggggaaaacgttcagcggttgcgccattcgcattgcttgcggacagacatatggcgggaaacaaacggcacgaaaagccgagggcggcggccaatctgttcatcagtccgacggatgaggacgcactggcgatgagcccggcaatggaagcgtgtcaagtgggatacgcgcaaagactgatgcaactgcacgagcaaatgctgactttgttcagcacgtaccaacaatgtcagacaaaagcgacgatgatggagacgaagaaagcgtagagaacgacgagagaaagaaagggacgaaaagcaaaacgaagccaaaagcgaaaagacaccaaaggaaaagccagtgtcactcaaaagtaattcattgtgtttaaagctaaattagtcattcgttga

SEQ ID NO: 90979 - DNA, 609 bp, Heterodera glycines
  SCN-specific regions: Sequence locations=1-609
ctgatgtacagttgagggcccaagaagaaattgataccgtatgctcgagcgaaaatccgacatacgaagagctgagccaattgaaatatatggaagcggttataaaagagacacttcgactggttccagtcgctgcaaccgttgtgacgcgtgtttgttcacagacgacgacattgggccaaattttggtggaaaaagggaccggagtgacaattgacttgtacacttttcatcgaaataaggagttatggggtgacgatgctgacgaatttcgaccggaaagatggcttgacatagatcctcctccggcctcagcctattattacgcatttggcggcggtcctcgcatttgcattggcatgcgatttgcacttttggaggagaaaatggcacttgtgcgactgttgcggcgctattcactggccaaaaatgagcaaacggagaaattgctaaaggtcaattcgcaagttgtgcttaatcctggcgcagtgatggtacaattgaatttgagagaagagaatttttaagaaaatcaaattgactgaatttgaggaaaatttgtaacaaatttattaaaatatttcacccaaatatgttttatgtaaaaga

SEQ ID NO: 90980 - DNA, 265 bp, Heterodera glycines
  SCN-specific regions: Sequence locations=1-265
tcaactttcactcaaatgctcttatgggaagttggagttcgagaagaacagctgcgttgagtcgtcctattacatgagaaaccctttcgagccacccaatttccacaagtcccaccgcgactattccctcgacgactttgtcatcgtcggctcccgttgctttatttgcgaacagcacatttgtgtggacgaacagcgttctctgttctacagacacacgttctggttgcgctgtgtgtggagagaacggcacaccttccccagc

SEQ ID NO: 90981 - DNA, 591 bp, Heterodera glycines
  SCN-specific regions: Sequence locations=1-266,289-505,527-591
gaccaacctgttgctggacccggccatccgcacatgggtgttcgtgcccattgtgttaatcacttttttggttggcattgtccggcactacatgttcctgttgctggtcaccaagaagagtgctgacctgcactcagtgccggacagccattgtctgctgaaggcgcgtctgttgcgtgagaatgggcgctttttgcccgccgattcgtttgcccagctgcgctggctgctgtgtgacaagcagcatggacatctggtcaagcggcaagacaaacataacactcagacgaacccgatgatggacccgtccacgatgaccgagatggtccagggcaacatgctaaacatggtgcccatgctggtcatctgcgggtggatcaactggaccttttccagcttcatcaccactcggatgcccttccctttgacacttcgcttcgaacccatgcttcaccgaggcgtctatttgcagactttggacacatcatgaggttcctccgcttcatggtacttcctgaacgtgttcagactcctctcggtgtacgcgctagtgttgggcagcgagaatcaagtctacatgatggacgagca

SEQ ID NO: 90982 - DNA, 512 bp, Heterodera glycines
  SCN-specific regions: Sequence locations=1-512
gtccaattaagatttattgtttttttgtttctatataatgtacggaaataatctcttcccattagtcaaaaggaagcagacaaatgcggagttggaagctttgaagaaattgaagctgaactcaccaaggatgaaatttcgcttcaggttggaagcatttcgctttgctttatacgtgttttggccgattaccatcgtttggatcttcaatagtccattcttccaacaaaaatcggaagaattcattcaacgatttggaagacaatttggcataacggaggaatttatccgctccaactcgcaacgaatgaaggagttcaagcagcaagtcaccgagggaaaacagcgcgaggaatatgccaaattgctgcacgagcaaatggaatttgagtcggcgcgccgtttcagagagaaatatggactctgatctgatctgctttattaaatcaactccgtttattgtctattaaaattgtgtttccaacttttttctgaaacaaaaatagggaatt

SEQ ID NO: 90983 - DNA, 624 bp, Heterodera glycines
  SCN-specific regions: Sequence locations=1-225,247-360,383-442,465 -481,504-624
aaaccatttttattagcagatttagccattttttaaaacttttgcccaattttaataatttttgcagattaaaaattgtttgactacgaatggatatttatctgaagaagaaatgcgcaaaaaaggacaaataatgggcgaattgacaaaaattattaaagaatgggtaagaggaaaattgggaatagagatagaaaattcaaatttacgaatcccgcgcgggattgtaaatcaaaactttttgcagtacgagatcccactggataatcccgcaagtcccgaagttaaatttgcgggaatcagcgcgggattgtgagcttattgaaatttgaaaaaatatcgatttcaactaaaaattcttcaaaataataataataaacatgaccaattttgtcaaggtttttgctaaaataagtacaaaagaggtaaaagctatgaagtttcctaaaagaattttaataacatttcttctaggttaaccttttttcttctttatccatttaatttctcatcacgcctctttcaaaaaatttctggttggggacggaatgacgataattcttagcagattttgtcaaaaaatacaagggattagccctgaaaaattcccaaaaaatcttgcaa

SEQ ID NO: 90984 - DNA, 587 bp, Heterodera glycines
  SCN-specific regions: Sequence locations=1-29,51-288,310-515,539-587
acaaagttacgattgtttgcgtcggacaggttggcatggcttgtgcctatagcattctccaacagaacattgcgtccgaaatcactctctgcgatgtacaaaaggacaaattgctgggcgaagtgatggacttgcagcacggcgttgcgttcactcgccaaggggtcgtagtgaatgccagcattgatggttattcgggcactgtcggctctaaagtgttttttatcaccgccgggtgtcgtcagcgtgagggcgaatcgcggctcaatctgatcaaacgcaacgtggagatcttcaagggcattgtgccggaactcgtccgttactctcccgacactatcattttggtcgtttctaatccggttgatgtgctcacttacgtcacttggaaactctctgggctgcctcgtgagcgtgtgttcggttccggcactaatctcgactcggctcgtttccgctctttgctgtctgagcgtctcaacatcgcccctttcaattgccatgcctatgttattggggagcacggagactccagcgttgccgtgtggagcggaatgaatgtggcgggcgtcagtttgtctctgttg

SEQ ID NO: 90985 - DNA, 172 bp, Heterodera glycines
  SCN-specific regions: Sequence locations=1-150
gtgcccgggccgtggtaaagtggaactccacttcagcggttcggcacgcaattagtacaatgcatgcaaaaaaaacaaccattttttgttttgttcaattatgtttggtgtacttttacaatttgcaggctcaattaaagtgcgctcaccaaaaaaaaaaaaaaaaaaaaaa

SEQ ID NO: 90986 - DNA, 475 bp, Heterodera glycines
  misc_feature (454)..(454): n is a, c, g, or t
  misc_feature (456)..(456): n is a, c, g, or t
  SCN-specific regions: Sequence locations=1-423,447-475
caataattgcatcttctttatttctgctcgtaattttatttttacttcacatcactgagctttttgcttcactttcatcaacccatgagacaaatgtgccggttataattgacacgcccaatggtcgcctgcgcggttttgaatccatttttttgcacagtcgggtcagctcattccttggcgttccgtttgctgagcaaccgattggcgaccttcggtttcggcctccacaaccaaaaaggtcatggaatggaaccattgatgcgatgaccctttcgcccacatgttaccaaggccgtgacacctataatgaatctttttgggggtccgaaatgtggaatgcgaacactccaatcagtgaagattgtctgtacatgaacatatgggcaccagtagatgccaagtaaatatagtgtgatcttcattaaaatttgtattggaaaaaagaattacntnaaataaacttaaatctaaa

SEQ ID NO: 90987 - DNA, 525 bp, Heterodera glycines
  SCN-specific regions: Sequence locations=1-32,54-525
cccgttaatcttttgattgtttctgaaaccaaaatgacttcaacaaaaaataatagcaaactgaacgaattgttacaagctggtggttatgatgcttctgatggaattgacagtctcatccccagtcatcttaaacaactttctcgcccggtcattcgtcgtgttcgaatgctgaagaaaattcaggcacaatctttggaaattgaaagccagttttacaaggagttgcacgagcttgagattatgtaccaaccgttgtacgatgctgtgaatgccaagaggactgccattgttcgtggcgagatggaacttacggacgcggacggtgaacttccgccgcttgttagtgaactcgagccacagactttggagaaattggaagaaaatgcgcctgtggagggaggtgaaccgtcgaagggcattccgggcttttggttcaacactttgaacatgaacgcatcgataagtgacattatcaaagaatacgacgagcccgatcctcaaggtaatttggtggacatcaca

SEQ ID NO: 90988 - DNA, 639 bp, Heterodera glycines
  SCN-specific regions: Sequence locations=1-75,97-639
gtcgttcatcataatttttaatggctaatacaattttacaaactcttgcatttgaacatcaaaaacatttacaacttcaacaacaacagcaaatgcaacaggaagatgatggggaattcggtgcacaacagagaaaacgcaagaccagttgtcgggcgagtattgcattgaatatggagcagaaaatgcgactgatcgattacatccacgaaaggccacaaatttgggactgcaatgttgagggattccgcagcaatcagtcgcgtcagtccgccttcaatgaggtcgccgtacttctttcggatgacattgaaacattttcgaggatacaaatccaagaggaatggggcaaattgcgctactgtttcacgcgcattatgaagaaattgttggaggaaggaggcgggagaacggtcgacgaggggcagctgaacaccatttcatggccttattggaagcgaatggagtttttgctgcccggcgttcgggcacaactcgcgcaccaaccgacatcgacggagagtgaatgtggcaatcaagagcagggttcaccaggaaaagaatcgaatgtgtccgtcacggcgttgccgaaagtccgtaggaagcgcagtgtccggaagaatagcgtagcaatggctg

SEQ ID NO: 90989 - DNA, 631 bp, Heterodera glycines
  SCN-specific regions: Sequence locations=1-8,32-631
gtttgaggtaaattttttttaaaaattatttctcactgactaaatcaactactgacgaaatcacttactgacgaaatcactcactgacgaaatcaatcactgacgaaatcaaccactgacgatatcaccggggacgcacgccattccctttcatcatttaacctcttcattcgcgacttcgtctcttggcaaccaaaaccaaagatttgccccatcaatttgaatgctgtaaatacgaagagccctcctttggatgtatacacttgtcatctcctcctctatttaatgttcggaaatcattgaccacttcatttctctccgagctccgaacttatgatgtgtggcgttgcgaagacggaaacgaatgtgcaagtggctgttgtgaatgtgaactcgggcgtcattggggccaatgggaacggcgtgttattggcggaaagggaaaccaactcgcgaaatggcgccgattttacaccaaactttgacaacactcaccagggcaatttgttgccctcctcgttttctgcctgcggtgcttccaccccgagcactttgttgtcgatgccattcgagtgcagccatgacttggacacgaattcactgcaggcactgcaccacgacgatgatgaag

SEQ ID NO: 90990 - DNA, 122 bp, Heterodera glycines
  SCN-specific regions: Sequence locations=1-101
ggccgtcgatcttggacaccatcccttgcgcatgttcggttattttgccatttaaccggttcaccacaaatttatagtaaaacggataaacattaaattggaaaaaaaaaaaaaaaaaaaaa

SEQ ID NO: 90991 - DNA, 642 bp, Heterodera glycines
  SCN-specific regions: Sequence locations=1-234,281-402,438-449,471-642
gcccagtgaaaaatgttctctgagaaattctaggggttgaccccgatttctattgcatttccataagcgacagaggtcgagagttccttctccgaatccgatatgtcattcttgacgaagtttactgtataaggttcatgacatcatactgtctgattgggttcgcttttgaatcaaaagggccaccattcagaggcgtgcgaaaaccaaaaaaataacttccgaaaagaaacgaaaaaatatttatttttactaaaacgaaataaaatttaaaattttagaatccgaaaacgaaagttttttgttggacgaaaacgaaacacgaaaacaaaaaaaaataatagtttttgtacgaaaagaaaacgaaaacacgaaaaaattttgttaatttcagccataatcaagaaacataaaactttaaattgtattaccaaattgaagaaattgaaatccaagattttttggaaaagagtaaaaatgaataaatcaagaattcttagcaaggtcataatccggaaaaaccggtcaaaaattcgccggatcggaccggattggcattttcaaaaatgaccgatttccggacccggaactctaatcgtctccctaatcctgagcccaattccgtccgcgtccgaactagtc

SEQ ID NO: 90992 - DNA, 628 bp, Heterodera glycines
  SCN-specific regions: Sequence locations=1-628
cccatgagagcgaacggactcaattttggccaaatagcatcggaaaaaacaacaacaaatacgccatcgtcggcccgtccctgcctgctcgtcgtctgtcgatgaactcaacgcttataatcagccgaacaaagtcacgtccatttgtccttctctcgtccccgtctttttgtcctctcgacttcgcaatttggcacacgaacatcccggagaagaggacccagcaaaagtcatccagtgatatgttgaagacctttccaaggatgaccaaactcttttcgaggccgctttgcatcagttcatcgaatgcactttgctttccaaggagaaggatccgtacgtggtcattcggcgagtgcgacagttcatcaccgggatgaagaattatttgatgaaaatcggtgaggccgatttgcatccgatcattaagcgggagagaagtcgactgaacatcgacgaattcctcaacatcgatgcgatcctcgaagaagttctggtcaagattctgttgtccaaattgaaggcccatttgtaccgtctgatgattttggagagcaccagcaacggcgagctgagaaggctgtctgagaacattgcgcaagtgcgtgcgatgagtgcggctgaattg

SEQ ID NO: 90993 - DNA, 404 bp, Heterodera glycines
  SCN-specific regions: Sequence locations=23-381
cattagtgctggtatgatcgcattcgttagtatatgcaatgcaatcgtatatattcttttttgaagacttgatgaaccattcgccgtgggtcccacccgctatgtagggataccccatctagtcttaacgagctttgatgcatgaaaaaattcgaaaacaatgcttgaacaagtaattttgggtccgtaatatagcccaaataacgaaaattcccgaaaaagaacttaaaggtcaaaatttagggtcgacaaaacgtcaatggagaagttccattgtcctgcttctttcgtcggagggctgtctttgggcttgctgaaaaggtatcacatgccaagtttggcctcacggtctaaaagttatggagtcataaagttttaaccaaaaaaaaaaaaaaaaaaaaaaa

SEQ ID NO: 90994 - DNA, 509 bp, Heterodera glycines
  SCN-specific regions: Sequence locations=1-458,480-509
gtcgcattccatttttgaacaaaacgctcgactgggccttcaaatcggcgaagggaaagcccgaaatgttgagggcatgcgcacttctgcagaggaaatttggcgatgttttcttcagcgaaggacaggaagaacaagcggaacgttatgctcgctctgctgaatatttgcttgacgaagccgaccgaatcgaagggattccaattggtggagaagggagcagtggcgaaaaccgcgaaacggacaatgccgacgacgcggcgcagaaaatcgactccgaactcgaattggactaatttccatgacgcagacatatcgaaaacggtggttttggcatcgcaaaggatttacatgattagtttcgattatttttgtgatgtccaatctctctccccacggttttcccaatgattggccggtcataatcacctctaattcccatcctattccaaattaacttgtttatttgatttgtctatttgttgtttcttgtaaaacaaagatttatg

SEQ ID NO: 90995 - DNA, 312 bp, Heterodera glycines
  misc_feature (287)..(288): n is a, c, g, or t
  SCN-specific regions: Sequence locations=1-27,212-222,244-288
gttcagggaggaagattgggcagcactgaagaggaaagggaggaagagaagcaaagagacacgagagagaattgaagacggagagagcggagagagaagctaagagacatgagagagaactgaagacggagagagcggagagagaagctaagagacttgagagagaactgaagacggaaagagcggagagaagctaaggggagaaaaagaacgaaaaagtgcaaaaaggaagagaagaacaaatattaattattgtaatttgttgctaatttaaattagtttccttnnaaaaaaaaaaaaaaaaaaaaaaaa

SEQ ID NO: 90996 - DNA, 548 bp, Heterodera glycines
  misc_feature (528)..(531): n is a, c, g, or t
  misc_feature (533)..(537): n is a, c, g, or t
  misc_feature (545)..(545): n is a, c, g, or t
  SCN-specific regions: Sequence locations=1-129,151-548
atataagcacttctgctgcattgcatcgcgaactgagaaatttgagtttccgtaacccgggctatcgttgcacattgcccgaaccttcacgcgctaagcgaactgtcgtcatttctgcgcaacaaccaaaaacatcttccgaaccttcggccgatcgacggagcatgagaaaacgtacggccaagaaggacgggtcaaattctgatgtacaaactcgctctgccaaatccaaactccgctacaacaataaggggcgactcgtcctgccgagtcgtacagaagtggacctttgcgattgcttggatcaaaagtgcaatggatgccaatatcagtgcaaaaaatgtgggggcaataaatgcagctacgcctgtcgcgttaatcggaccacttttattgagcacatcgacacacttggcggaggtcggaccaataacccgtttttgtgaatgaaaagcatgcaagacattctcttttttcataaaacattttttatttgacaaatttctttcgctataaatgcttttaaannnnannnnnaaaaaaanaaa

SEQ ID NO: 90997 - DNA, 619 bp, Heterodera glycines
  SCN-specific regions: Sequence locations=1-152,174-439,464-619
ctcagttgtcggggcacgtttctttgacgaatacaatttattttgcgttgacaaaatcggaagttgcagcatttgggagagttcgcataggccggaacagataataacgcggacgaaggaacgaaagcgaatggcaattgccgaattggagtcggaaagactttcctttgcccgaaagaaaagagtcaatttgagcaaaaatgccaatccgacttcgtcccattccgttgaactcaccgcaatttccctgcacaaagccaaaaagtttttggtaaccgccttcaacaacggcgtcttttgcatttttgagcttcctgaattggttttgctgcaaaactttcgcatcagtgaggtgcgcatcaacagcgtcgacatcaattcggccggcggttggttggccattggctgtggccaaggcagcgagtcgcaactgctcgtctgggagtggcagagcgagtcgtacttgctcaggcagcagtcgcaccgtcagaacgtcactgtcgccgcctattcgcccgacggtgcactgctcgcgacgggcgcggaggacgggaaggtcaaaatatgggactgctcctcctcgttttgcaccgtcacattctctgaccacggcaccggc

SEQ ID NO: 90998 - DNA, 635 bp, Heterodera glycines
  SCN-specific regions: Sequence locations=1-635
gtttgaggttgcaattttttaaatgccaaaaaaagcaaaatatgcgaaaagtgagtggcgcgactccgactttgtctcattttgggaacactacgcaaaggtgcaagaatgggtgcacattgagagcgaatgtcgtcaaaatgccatggatgactgggagtggcgtcgggccgagaaacaatgcatttccctgctgtcccttgctgctgctcacctcggcagcgaacttgacaccgccgcggacgaaagtgccaattccaccgacgacggcggcccaaaaaatggcaaccgaatgccaaagagaggggcggacagccacggccaggaggaggacggccagcaccaaactttgcaagacgctgctccactgaacgaattggacgcctccgccgtttatttgccgtcgtcggccaagcgcaaaaaatgccacaaaaaggcgaaacaacggcaggagcaaaaatggccaaggaaaacgaattggaatcagcagcaaatggaggacaatgagcagggggaggaggaaaatgaagacggaaacgagtcgatggacgaacaaatgaaggcattccgaaagaccacgttggaccatcgcaaacaatgggagcagaaaaaacgtgaggagcagcaaaaggcga

SEQ ID NO: 90999 - DNA, 161 bp, Heterodera glycines
  SCN-specific regions: Sequence locations=1-140
atctatataagcgtagtgctggttcagtcggaattcactgttcagttattaacgcactagaatttcgtattttttagattaaagattgcctttgaaagtacgaaacacatgtgataacaatttatttttgacataaatttaaaaaaaaaaaaaaaaaaaaa

SEQ ID NO: 91000 - DNA, 634 bp, Heterodera glycines
  SCN-specific regions: Sequence locations=1-634
gaggagaagcgcaagagcgacattctgctcaatcggatgctgccgcggcaggtggcggataaactgaagctgggtgaggcggtggagcccgagtccttccaaatggccaccattttcttctcggacgtcgtctccttcaccactttggccggcaaatgcacgccattacaggtggtgaatttgctgaacggactgtacaccgcctttgacggcatcatcgacacccacgactgctacaaaattgaaacaatcggcgacggttatttggtgtgttccggcattccgaagcgcaacggcgaccaacacgcgaaggaaattgcggaactttcgttcgctttcctccgcacggtgtccaacttccgcgtcgaccacctcccctccgaacgcgtcaatctgcgcatcggcttccattccgggccagcagtcgctggcgttgtcggtctgaccatgccgcgctattgcctttttggggattcggtgaacaccgccatgccgaatggaatccaacggaaaggccggcaaaattcacatttcatctcgttcgaatcgcttcttgaccagcgtaatcggaggatatgtgacggagccaaggggcgaagtgattataaagagcaaaggtgtgatggagacattt

SEQ ID NO: 91001 - DNA, 595 bp, Heterodera glycines
  SCN-specific regions: Sequence locations=1-88,110-222,244-261,313 -323,347-363,385-520,542-595
gctaatttacttttttattattcataatgaaactattcaatagtttaccatttgtaatggtaatgggctttctgttactgaccttacgctgataccaggaccagaagaaagcacagaaccaagagtatatattcctcctgaaccaccaatcccaatcatttttataactcttcctccctcagaaggaaccatatcgtttccagcaattcaaatgcctactaaaaaagaaggagaaaaatatttagaaggacacataaaaaggatagctgctttattaggtatgactccaaaagaagctgaagaattgaaagaaggagctcaaagaatgaaaaaatggattaaaaatgagatagattcttgtataaattttattttccccaaaaaagcaaaagaagaagcagcaagaagaacagcagaagaagaaagaaggaaggcagcgttttgggaagaatataggagggaaagagcggcgatagcaaaagaagaaacaatggactagttctgtgcgggaatgggcatggttaaatataagattttaaaacagcttatcattaggaaagacccttttattttttgtagccttaagatgagaaaa

SEQ ID NO: 91002 - DNA, 624 bp, Heterodera glycines
  SCN-specific regions: Sequence locations=1-624
gcgattttcttctcgtcagcactccttctcccttctgcttttgttcgcctttctcgtcattcttccgcctgtttgctcccgttatgaagatcggtacaacatgaacatgcttccctgggacctgaagccggtccaagacttcatcggcctttggcaaatggaccgcagcagcggaaacttcaaagaattgccgccaccaaatttaattgacttggccatcaatccaatcccgaaatttggagcacggacaatgaacattacgcacacttacttggactcggcccgaaatgtcatccgaagtgattacggctttatgccagtgaaaaatgccacccgaagggacccgcgggtgcacgtggcatatctgacgacgagcagcgaaggatggtcgatgatggagcaaggcttcttcaaggacggcaaattgattttccacctcaaacaattcttgaaacgctcattcggtgccgggagcaatttggacatcagagaatttgagcgtcaatttgaactgtccggcttccactcgatgacactcaaagtgcgcgccgaaacatcttttcagacggaggcttacacagcttggtacacaaagattctcttctgagtgagcaaatttaaaat

SEQ ID NO: 91003 - DNA, 618 bp, Heterodera glycines
  SCN-specific regions: Sequence locations=1-618
gtttgaatagcgaccgaatatgctcaggaaaaccataaaaacacttcaaccgatatataacgccagaacagcattccgttttcagaccggaggttatgctgcgcctggtactgaagcacaagcacaggaagtaaaaaaacagacaagcacaaaatacgtgattgatgaacaaaagcgggagaagctgactctcttcggtcaatatgtagccgcatgtatgcccaaattcgtccagcaagttcagtttgctggtggggatgaattggaagttctgatccacccaactggtgtcctgcccgttatggccttcctcaaagggcatcactcggcccaattcacaaattttattttcgcttgtggcttggacgttcctacgcttcggacatacactgacgaagttgctccaatcgattccatcactccagtcttttccggtgctgaatggtatgaacgtgaaatctacgacatgtacggggtttggttcaacaaccacccagacttaagacgtattttgaccgattacgggtttgaaggtcatccccagcgaaaagacttcccattgtccggatacgtcgaactgcgttgggaccacgagctgaaccgagtgatttatgagcc

SEQ ID NO: 91004 - DNA, 625 bp, Heterodera glycines
  SCN-specific regions: Sequence locations=1-351,374-625
ccgaaatctaagaactgaataacaaatcgcccctcccccattcattcgtaattttgatcttcactcaactttccccaattattgcattttctcggctttcatcttttcaccccgataaatgttgctgttggatgattgtgactaaatttacaaaaaatctttacaaattttaaagtttgcgtgataagaacatttgctttatgtgatggtgagtcatgactggcaaatgtcgctagcctcattattaatcgtctcattctttcaactttacttttctcttaccaacaaatcattgttctccggtgatttttctatctgtccagacgataccaaaacaaaagctcatcgatcgaccttaaacacacaaaagccgttgattataccgttgtttaccttcccaattcctattaaatcggccatctgcgtttaatgtcacgatgagacaacataatggagtaacgactcaattaaatcgcgctgagggcacaaacaaagcgggacgggagctcatctgtacacttgaggagagaatttggaaagaaagtgagacgaccaatgctgggcaaagcccatctgttgacagcccaaaatcaaccaaaacacgacatttttgtcaacaaagacc

SEQ ID NO: 91005 - DNA, 629 bp, Heterodera glycines
  SCN-specific regions: Sequence locations=1-629
cgagcacgatgatgcgcctactcctcgcacttgctgccattgcggccagccctgctatcggcggtttgcttgatgcgggtaccgtaggaaacaagttcatggtcacgtacagcatcatccccgaccccttccaccagttcagcttctactccatgccccgcaccgtcagcgaggccaagaaggactcgttctcccaggtcaccagcaacgacgaggacaagacgaccgtgtggtgccgcaagaacgactaccgcgtgtgcgtgctcttcgaccagcagggcagcgtcgcgggaatccaagtgtcgataagggaggctgagctgacctcgaaggactctgctagctttggtggtctgagcacgctgctcacacccgagtggcgccgccagctcttcctcggcaaggacgtgtggaccgctacggcctacttcgtgtcgaaagaggtgctgctgagcggaggccgaaagatggacaaaaacacaccaaccgcacccgagggtatcttcgtccagcaggtggacattgacaacaaggaaacgggccgcctcgcggtatccagcactgaagcccaggccactgctgccggtttcaccgaacaggcttgcttctacggcatgggaaaacactat

SEQ ID NO: 91006 - DNA, 551 bp, Heterodera glycines
  SCN-specific regions: Sequence locations=1-122,144-551
ctctctgcacagcaacaccacatcgacccaccctaggcattcgcttcccaccgccaccgcccgtttccgccaccgatccatccccgccgtcgtcaaaaggcaaccacgctgccctcccttgaacccaattccaattcccaccatgcaactcgcaaaacaactcaagaagcgtgcccagctcgcctactaccgctacgagctcaccacggcgctctacatgctcgacttttgggaaaagtgcatcttcaactcgctcgtcctcctcggcttcatcctctttgtctacacgtccatcaactacactccggactacattctccacggagtcgatggcatgtccgagtacttcccggccgttagccccatgtttgatggcgttagagcgtggattgccccgcccattcatgacgagttgtgagcaggttgcccgcggatactctcgaggattggggcgagggtttgagcgagggatcgtgtgtggcgacagctgattcgggtagttgatgggccgatttggtttatttgtgtatagatgctccactttcttgttc

SEQ ID NO: 91007 - DNA, 114 bp, Heterodera glycines
  SCN-specific regions: Sequence locations=1-114
gctaaattgccattttttggacaaaataggtaaacaaatccaccaaaaattggctaaatgaacgaattctaccatcccacacgaaaagaaatttcaaaaaaaaaaaaaaaaaaa

SEQ ID NO: 91008 - DNA, 626 bp, Heterodera glycines
  SCN-specific regions: Sequence locations=1-136,160-626
attttatttttcgttttcgtatcgaaatgccctttttcgttttcgtatacgaaattttttttaaagttttcgtgcagtcctgccccccacccctctcttccctttttggccctaaatgcttttcccgttttattccattttaaaaataaaattaattttcttccttgattgtccaataaaattatttgaaagtgttcaaagaatgcatttccttcccctaaacttaccttaatttccgattccttttttggggtgcaattctccgccgtctttgagttgttttttggttttgtttgttttttgttcctccccaaatcaggccgaaacgagtgcaatattacaaattgtgccgcttttcaaatatggcaaacgtcacagcctgactgagaggaggaagcactttggaggagtgaataagagaataaaataataataacaataaatatgattaaaaggaaataatgttggcggctttgaatttttctgatcgaattttgggcggaattcgtcatccatcgcccgcattcattcgttgccacaatttggccgtggcctctccaccccttttttcgcgtcttttgtccgtccgtccgcccacttttctccgattggaacttttgagggtc

SEQ ID NO: 91009 - DNA, 307 bp, Heterodera glycines
  SCN-specific regions: Sequence locations=1-209,232-307
tgtattagcgccgatatctatggagaattatcctcgcgagaggccaatttggttctgtgagtctgaagatgacaccgttttggcactgcacgagaagatcaccggccaagttgaggaagaccccgatcattacctgctacatttactggtctcctgactttgttccgtgcacaatgtgagcatctctgcagagctttccgcaattgcacctcctaacgcttgtgatgaacgcgatgagggaaacggaagcgaattggatagtgcggtggacgacgacgagactgaggaagacttggagatggaagac

SEQ ID NO: 91010 - DNA, 279 bp, Heterodera glycines
  SCN-specific regions: Sequence locations=1-102,127-279
gtcgggacttatgggtttaaagggggcttaacgcctaagtaaaaaaacaaaaattgggtgggaacgaaagagacgaatgaaacggaaaagcatcagaatggctaaaaaaaaataaaaattttaaaagccgccttcgttttctctcagatggccccacaaatttcgaattgaaacatcggcacaaccaaagcatcgatttgtcctcttcactttcgctgttttctatgcccaaaattccgtttaacaacagcagacaaatgcccatttgtgcgcagtgtt

SEQ ID NO: 91011 - DNA, 617 bp, Heterodera glycines
  SCN-specific regions: Sequence locations=1-437,459-570,592-617
gccgtcggcgtaggctcaccattttcctcgggtacacctccaatttggtcacttctggacttagggagacatttcgctatttgctggagcatgaccaggtggactgtgtggtgaccagtgccggcggggtcgaggaggacattatcaaatgcctacggcccacctatttgggtagtttcaaaatgccgggcaacgaacttcgtgccggcggcatcaatcgggcgggcaatttgctgatcccgaacagcaattattgcgcttttgaggaatggctgaacccaattttggacaaatgtttagaggagcaacgcctccagggcactcgttggactccctcaaagctcatcgctcggcttggctccgagattggcgacaagcggtcaatttgctactgggcttggcacaatcgcatcccaattttttgcccggcactcactgacgggtcgctgggcgacatgctctacttccactcggtcaaaaatggtggcgatggcattgtgttggacattgttgaggatttgcgttatctgaacacaatggcggtccgctcgctgcgcaccggtgtgattattctgggcggaggggtggttaagcatcacatcaacaacgccaacctg

SEQ ID NO: 91012 - DNA, 637 bp, Heterodera glycines
  SCN-specific regions: Sequence locations=1-637
gtgctgaacaaagctttgctgtcggattcggccgcccaagctcaggccatggacataagcttcagaccgcatgattatttggttcttctggcaattccgaattcttttgcacttcgcgcagcgtctgaattggtcaaaatgcttttggacactgcccaatttggttttaagggtgtgactgtcgtgcggcagcccaccttggtactgtattcgtatgatgtgaccactggcgttgttgtggaccttggcgagcggttgtccattgtgccggtcattgatgaatttgtcgtggatgacgctgttaaaatggcacattttggtgcaccacaaattcgggaacaaatgctcaagggaattggtgacaacctgcagaaagtgttggacatatttggcaatggcagtgatgacgacgatgcaagcatacaattgctgttacgatacatcgttgaaaagtcatgttacgtcgctgccgatgggattgaggaagagcgggccaaaggaattaaagacgaattggttgaatttgttggtcaacattcattaaaggtgaatggtgagctaaggttcatggcaccggcaggactgtttaggccacagttatggggactcgaaatgccggcacttcaccggatggtcc

SEQ ID NO: 91013 - DNA, 630 bp, Heterodera glycines
  SCN-specific regions: Sequence locations=1-369,392-630
gtaattttgaccatggcgtcggccacggggttggccattttctgaatgtgcacgaatatccaccctacattggctaccgtgtgcagagcaagtacaactatttgcgcaagggtgtggtggtgaccattgagctgggctattatgcccagggctcgttcggcatacggttcgagaactgctacgaggtggtggatgccaagggcacggcatcggtaacatcaaaagcaacagcatcaagacgacgacaacaagcacatccctggtggatgccaatgccaagggcacggcatcggtaacatcaaaagcaacagcatcaagacgacgacaacaagtacaacaacgccttcaacagtgccatcgtcgcctgctgagggcaatgccggcggcagcaacgccaagggcagcggcgacgcggtcagcagcagcgacagcagaaagttcgccatgttcgctccgctcacgtttgtgctggtgcagaaatcgttgctggtccgtgaactgctcgaccagcacgagattgattggctgaatcgataccacaaccaatgcctggaggcggtgggtcgctacttgcaggagaaaagcatgcaggaggagtacaactttttggccgaggcgtgcacaccattc

SEQ ID NO: 91014 - DNA, 548 bp, Heterodera glycines
  SCN-specific regions: Sequence locations=1-455,477-490,512-548
caagtttgagactaaaaattccattcccttccattagctttgcttttgcttttccttcttcaaaatgccttctctcgacgaacgtttcaatgctgcggttgaaattgtgcagaaattgccaaaagaaggcccccttcaaacatcgaatgaccaaaaactgaaattctattcactgttcaaacaggcgacaattggcaacgtgaacaccagcagaccgggcatgttcagtctggtggaaaaagcaaaatgggatgcatggaaatcggtggagggaatgagcgctgaggaggccaaggagaaatacattgagacacttttggaaaaatttgacgatgctgggactcaggtggacatttcggattggctgtccaaaattgacccgtcaatcagaaccaatttggcgctgctcggcaaaaacctttgagccgaaaaatcattggacgaatgtgtggcaccacaaacagagaatggcgttgtctttaagacaaaacgatcaaatgttgtcaaaattaattaattattcaagaaatatttcatgtgtaaaaaaa

SEQ ID NO: 91015 - DNA, 412 bp, Heterodera glycines
  SCN-specific regions: Sequence locations=1-362,387-389
gaaattcttgttctttgatcgtgtccaaatgtatgaacagtaccagcagcagttaccgcattggacctcaatggtggaaaaagcctatttatcaaagtcccgtggtcaatccattggagcgtgggccggatttcagttttgtggatggtcgtaggcttcctttcaccactgagtcggaatttaatcggagagtgaagcaagtggaattgggtaggaaagttgtgcaatatttggcagaaatactcctcgcggaggagctttacaaagaaaacaacttacaaagggaaattgtgcaacagaaaattgagcagaacatgccgaaacagaaggggacagaagaattattctgagttgccattagttcattttttaatagaaaatttatttttaaaaaaaaaaaaaaaaaaaaaaa

SEQ ID NO: 91016 - DNA, 525 bp, Heterodera glycines
  SCN-specific regions: Sequence locations=1-314,336-525
gtgcaatgggctgatctgatcatttcgaagactcgtcggaattccattgtccagcaaggcatgtccaattgggtgttgaacatcggcttggtcttcgagactttgtcggctgttttcctctgctactgtccgggtttggacaaaggtcttcgtatgtacggactgcggtaagatttttttttctttttttgtcacattttcatcacatttcccaaggttttcgtggtggttccccgcattgcctttttccattctgattttcatttacgatgaaattcggcgctttttaatccgtcgtttccccggcggatgggtggagagagagacatactactgaagaaatgacagtttaatgtgaaaagttcaacaaaacataccttacattttatctctttagcttttatttttgtttcaaaaattgcaaattagtcagttgccaattaacatacccgattttttcgacttgcatacccgtaaccaatattgtgtacttttggctcgcaaataaactaatcgctttcaaaa

SEQ ID NO: 91017 - DNA, 117 bp, Heterodera glycines
  SCN-specific regions: Sequence locations=1-37,74-85
gatatcaagaaaattttggcagcgcctaattgtcaactaaaaattatataaaacaaatttgtataaataaatacgaataattttcaaaaaaaaaaaaaaaaaaaaaaaaaaaaaaaa

SEQ ID NO: 91018 - DNA, 622 bp, Heterodera glycines
  SCN-specific regions: Sequence locations=1-8,31-622
gtttgaggtgtaattactaattagttgtttttaaattcatatctgtcgttttttggaatcgaatgtctccctcaactaacaccgacttagtcacgccaaattatattgctgaaattgttggagttaatgagactgtcgccccacaacagcaattgaatttgctggtggaagatgcgctggactgggcccactgctttggccttgtgttacgtacaacggaacataaagaccggagcgatgtttgccaagcggctccatttgcgcttttctcatcgcctttcccgcgtaatctttttgacgaagcaatggcggtccaaaaggatttgaacttgttgtattttcgtatctcgtgggacttggaatttctgaaggaagcacaccaacacgtgatcccttccgatgcattcactcgaaaaatgctcgaaattttggaggatgtgcacagcggtggtgtcaaacagcatatcactctgctcacacaacgcgcggattacatgtgccatgtaacaacaattgatgaccaaacagagacagcgaggcaacagcaattcgagcttaagcagattgaggtgaataacatagccgttagtatgggcggattggctcagcgtgcttccgttct

SEQ ID NO: 91019 - DNA, 621 bp, Heterodera glycines
  SCN-specific regions: Sequence locations=1-272,294-621
aacgctttgccaacctcggcgccgtcctctacattttgcagcgacttcaccgactccaccccgacggcttcaccgtggcacaatatgtgcagtttgagaatcgtcagaagcgagctcggccgacctctgagggcttttttttcaacaacactttgccatcggtggcttcgttgttggaatcggacgacgatttgctaagagtggacataaaggaagagaagttttacgtgtcggaggaggtcactctgacgcacctcttctgtctgagcaagaatttgtgctccaatttgttccgtcttttgcgtcgctgcagctccaacaatgccatccgcgtccagcatttgctcgaaatctcttcccaattggtgcccatcggcgcccccatgcccaactccaacgctttggtcgacctgtgcaatcgcttcccgaccattttcaaattgcgttgttcgcctcaagacaattatcgctttgacaattcggtgattatgctcaacgaacagttgctggacagcgagaatttggcgtggcgcgtcgttttggacactgacgaattttaaagggtgaattggcgaagaagcggactctgaccaaatttgccataaaatctttttgttgttt

SEQ ID NO: 91020 - DNA, 366 bp, Heterodera glycines
  SCN-specific regions: Sequence locations=1-194,216-366
ggaagcaatttggcatgtgcccgggcgtgggccaatgacggaagaacaaatgcgagtgttcatggagacagcagctcctcaagcagcgacagtgacgaatgaatgacgtgacgcgtggtcggacgagacacatggagaaaagtggctatcggtatggacgagaatttttgcagaggatactaattaaatcacggatatgtgcccatcacagagagtgtggctcccctttgtgtgttgtataatgaaattgatcccccgtcaaatccatccgattgtatgtatataatttacccactgatccaccatttgatattaccaatgtctgaataaatgccattgaatttccctaaaaatcaaaaaatataa

SEQ ID NO: 91021 - DNA, 630 bp, Heterodera glycines
  SCN-specific regions: Sequence locations=1-630
acgcttcttccacggcttttgccgcctccgctgtgtttcctgatgggcctcgttcgcaagcggaccaatggcaggaaatggccgtgctggcggaggcacaccatttgagacaacaccaaaaaaggctggaagagagagggattgtgctggaagatcaaaacagacaattgcaaatgcaattggaaaggcttcagatgctaatggcaaagaagggaaacgccctccaaacactgccaacaacagaagagcaacagtctcacaatcagcccggctttatctcctcaaccgacgcggaagacacagacatggaaatgcttgcgctggcgatgccaatcagagagattaaagcgatcggaatcagttcaggccaattgggcacggaaatccgtcgcaatcggatggacaggctgagagagacggtggacgaattgaacagggccatggagaactttgtggttttcacgcaaaattgtgcccagaaggagcagcagcaggacacggacgacagtgggacagcagacaatcaccagcaaacggtggaggagttggagaggtagcgagggaagtgggggaagcgaatggatgagaacgaagggggaagcggaaagattggaaagagccggaggaagt

SEQ ID NO: 91022 - DNA, 634 bp, Heterodera glycines
  SCN-specific regions: Sequence locations=1-233,255-305,327-634
ttctcatcgcccattttaaaccgacggtggaacagcgaatttgccaaatgattgagggcgtaataaacggcgatatgaatgccgttttggcgacgatgccactgaaagtgcgcatcaatgaggacaatttggacttaatcggcagaaacttcggaattagccccgaccaaagcaaaaattcggagataaaaatatcaaaaaaactgcaagcgccacgcaatttcacactgctcaactttgtctctcagctgagggacagaaatttggtgctcgacttttcactgatcgacgaccctttcgttagtcaggggacagttctgatgaaatcgcacggcgaaatttcgtacgatggcctcggggaaacgccatttgcccctccgaatgttatcattccgcaagcgcagggcgtttttatggccgagttttttggcactgattttgtcgccaattcgatgctttaccacgcattcaaacaaaaatatatggacgtggtggttggccctgaatcatcgccacaactgaaggatgttctgcttacgacttgctcctcgggcttttgcatcggcgaatatttgggctctctcggccaacaattccccggccgtcaggtcgaaattcagttcagcgccaaaaa

SEQ ID NO: 91023 - DNA, 626 bp, Heterodera glycines
  SCN-specific regions: Sequence locations=1-626
gctgagcaaattaattgatggccgatctttccaggagccttacattttccagattcgttcactcagcgacattggcacttcaaattggaaacagtccaaacgtttggccgaccctttgtacgaggagccgacggagtttgaccagccgaacccagtgggacttgctgagcaaatcccccggaatgatcagtttagttcagtgggctttgctgcttcagccttcggctcagcgacggcgttgtcgagctgaaagcatttgagaagaaaagagtgccggaccttccaacaatcgcctgcccggggagcaaagtaaaattttagtttacgggaaggttgaattgtgccgtgggtatctttttttgacgaaagaaaattgtcaattgcttggcggacaaaaaccaacgcaatgcgtgccgacggtgccgcttcgacaaatgtctgtgcaacgaaatgcgtccgggagcagtctaattagagagggactgaattgcgacgacacgacggaatggcaaaagcccgaaagccgttcaattggagagggtccgaattgctttgacacgacggaacggcaaaagcccgaaagccgttcaattggagaggggccgaattgctttcacacgaaggaa

SEQ ID NO: 91024 - DNA, 625 bp, Heterodera glycines
  SCN-specific regions: Sequence locations=1-435,457-625
gtacgcgctgccgtagctctgtatttcgcttgccgcaatctatcgccccgatcacttcgtcgcgaatcctcaacatggacaagttcaaggagaagctcaacctgctccgtgccgaagccgatgcggccaacgcccgcgccgaccaagccgagctccagctcaagaaggtacaagagcagcttgcgtccaaggacaacgaggtcaattcgctcaataacaaggtggcccttttgcaactcgataacgaacgtgcggaaaaacgcattgaccaagtcaagactcaaaatgccgccgagtccgacctcaagtcgcaaatcgacgccctcaaccgcaaggtgtccttgttggagaaggatttggccacggccgagtcggcattgaaggttgcgcaggaaaaggtccgcacccttgagctctcgtccgagcaattcgagcgcaaggccaacaacctcgagcgcgagaagatcgagctggagaccaagctggacgacatctcggcaaagtacgccaagaccaagcaagagctcgaggacacgctcaagcaactcgaggagctgtaaatgcagcgacacccgtcgtgttttcgatttagcccttttcctattgcctttccttgcccgtctac

SEQ ID NO: 91025 - DNA, 432 bp, Heterodera glycines
  misc_feature (411)..(412): n is a, c, g, or t
  misc_feature (414)..(415): n is a, c, g, or t
  SCN-specific regions: Sequence locations=1-289,338-378,403-432
cttcttcgtcctaccgtaccctttgtgtccctctcccttttcctactgttgttccttttcatcgcttttccttccaccgatggcttcggagtcgaaagggctgtacgtgataaacgcggatggccttgggattggatcggcaaacaagcatgcaaaacagcggcaaattgcaaatgcaaggatggcaaaagttgggccaaatgtgtaaagtcggaaggctacgcggccagcaattgttgcgacaaaaattacgtgtgggcatgttgcgggaagaagcccaaacattgatgagagaagagaaagggagagaagaaaataaattaaaggataaaaagattatggctctacgaccttatatcaccgatcaattatttacgcaataattaattaattattaaaaatgacaaagcnnannaaaaaaaaaaaaaaaaa

SEQ ID NO: 91026 - DNA, 621 bp, Heterodera glycines
  SCN-specific regions: Sequence locations=1-621
aaaatctagaatttatttgtgccaagaccaaaacttaaggttattagtcttgttcggatcttgaatttcggtcgtattcaattgatatcaaccaataatgaaatttctgaaaagatgagatgacttggtccacacgtcccgaatgccaaagaaaaatctaactgtgtacgtatttttatgtataatggaaagtttgcattaacgtgtagtgttttatttttttccaactgtgtacgtatttttatgtataatggaaagtttgcattaacgtgtagtgttttatttcacggagtcatcatcaatacaattgtaactggtttgttacctataataaaattagtctgattaataattagctgttcttgaaaacttatactccacacagaataatactaaaaaatatcacttccttaaatttaataatatggacgaaatatgaatagaagaaaagagaaattcacgtgcgtctcatgtgaacacattaactctatactttcgacgtttccataatcaaaacaaaaaaccattttcaaatgaccaaataaataacagtcaaaaagtttacaaaagaagtaaaataaataaataaacgcaaacctcaaaaaaaacaaaaaacaaaaa

SEQ ID NO: 91027 - DNA, 255 bp, Heterodera glycines
  SCN-specific regions: Sequence locations=1-13,37-255
caattgtcaactactcctatcggaaataggattgactacgtattccagccatagcacatggtttcataaaaccgtacgattctcccgatctaaatcaagccggttttacatgaagaagatttgactcggcatgttctattcgatacgggtaggagaaacggtattcttttcttaaacttaaaaaaatagagaaataagaaccaagtcaagatgatacggattaatcctttattcttgcgccaaagatcttcctat

SEQ ID NO: 91028 - DNA, 630 bp, Heterodera glycines
  SCN-specific regions: Sequence locations=484-630
ctctcactcaaacgcatcggttgctgcaaagacaaatcttttcaaaagttgccaaaagagtgtgccaacatcgcaaatactcaactccatcagaattatacgcaatgcaagcctccaaaaacaacaattgtgtcgactcaaatttcaatttcttcgatgcgtttgacttggacagccaattgacggaggaagagcgcactctgagggaccaagcgcacgcgtactgccaggaaaagttgcagccgcgggtcacgcaggcattccgcgaagagaagttcgacccttctcttctgcccgaactcggtcggatgggttttctcggcgcgccttacaaaggttacggttgtgccggcacttccttcgtcggctacggtctgttggcgcgtgagttggaacgtgtggacagtggctaccggtcgattgtgagcgtccagacgagtttggtcatcggtccgatcgtcacttatggttccgaggctcagaaggaaaaatttctgcccaaattggccagcggtgaattgatcggtgccttcggacttactgagcccgaccacgggtcgaacccggcggggatggagacgaaggcggagtgggacgagcagcaacagttgtacaggctgagcggctcta

SEQ ID NO: 91029 - DNA, 640 bp, Heterodera glycines
  SCN-specific regions: Sequence locations=1-65,94-141,163-640
cctcgtgccaagtttgagatgtccacgaataatcacaatgactcttacgcttctacgtctattgaaggtcttacaaaacaaaacaataattgcatccaatcggcccgtaaatttatggtcaagatgcacacacaagacattattgggatttttatcttttttgcccttccgattggatttttatatgccgtaacttttccactttccctttcgtttgacccgttcagcaagggttggcttgtgtgggtcgtcccctgctcacttctcggcctcaatgtttacttaaacgcgctgatgatgttcaaagtgggaccgaattcccagcgcaatgttttgccgtcggtggtgaagcgcgactttcacttctgccacctttgccaatcgaattcgcctccgcgttcatttcactgtccggtttgcaacttttgcgtcttccgccgtgaccaccactgttccttcaccggttcttgcgtgggtcacttcaatcagcgttattttgttgccgctgtatttaacctgtggccagtcgtgttttcatgctgcgtttggaattggcatgcgcttttgctcgccttctctccgatcagtctgtccgactttctcaaatgggtcttcccgcacatggctttgctgttccgct

SEQ ID NO: 91030 - DNA, 214 bp, Heterodera glycines
  SCN-specific regions: Sequence locations=1-214
tgactctcccagacccaagcccatcacccaatcagccggcacacaaacgacgccaccgatcgcttcaacgtcacctttttcctcgacgacgacggtgcgccgacgtgcccactcattggccgacttcccgcctctttacaatttttcccagcgcccgttgactcacattcggcacagcagtttgggtgaaaacagtggagcggacccaaatttt

SEQ ID NO: 91031 - DNA, 634 bp, Heterodera glycines
  SCN-specific regions: Sequence locations=1-235,258-634
catccatcttcaacagcaattgtgcaacatccagtcattacttgggcattcatcacacgcttgccccaacacacaactctagtgatgtcggccagtcagcgtggctcaacttcccaaccctccggctctaacggacaaccaacgccttcaccggaccgacactggagttcgacaccatctctcctgaacgtgcttcagtccgctgttgaccgtgcggctactttccaaacgacggctcgtcctcctccaaatcccaattccttggccccacctccggtggttgtcgaagggggttcagacatggaaccggacaaagaagaagatactgagcaccaaaataagggcccgaacgatgacgaagtcgctgatagtcaggagtctggcggcaactctgatgatcatccggatgatgcgggagacaccaattccgccggtttattgactcaattggcagcagcacttgcggtcccggggacagagcattttatggggacgctggcacaagacttgcatggattgccatctcgtgagaaggaccgattatttgccgccttattgattaatatcgcctatcgtcaggcaaatcctcctccacctccaccggccccctctgccatcgaccccgacctggccg

SEQ ID NO: 91032 - DNA, 484 bp, Heterodera glycines
  SCN-specific regions: Sequence locations=1-165,192-448,470-484
gacgagggcagactcgcgcccgaaatgatttcgattgtgaaaagaaactcatgtggaaaagcgttggaaattgcgcgaaaagcgcgcgacattttgggaggcaatggaattgtggacgattatcaggtgatgcgccacatggtcaacttggagtccgtaaacacttacgaaggcacccacgacatccacgcactgatcctcggcaaggcaatcaccggacaccaggcattccaatgagaagacgggcgggggacggacgaccaaagcgattgtcggaattggggaagtgttgtcgggttgagacggggaagcgaagtgaatgaatctttcttttgccctctcaaaaatatcatttggcacttaaactcttactttttttacggatttttcaatgccaacatttgccttatgattggaatgtttttacaaattattaggccaaataaatgatatttattcaaaaggctgcagacaaaaaaaattt

SEQ ID NO: 91033 - DNA, 430 bp, Heterodera glycines
  misc_feature (405)..(405): n is a, c, g, or t
  SCN-specific regions: Sequence locations=1-302,325-325,363-400
atttttattacggcctcaactgtcccgtggttggcgatatgaagtacgtgaaggcgcacctcaagtgcgacacggtgttggagacggccatttcgcccaatgcaatggcggcactgtcgctgcgcaaaaatgacgtgcgcaagctgccgatgtttctgcaccgtgccgaggtgcacctgccgtggacaaaggccagcgacggcaccgtcaactcatttcacatgatccgtgccgaaatgccacccttttttgtgcatgcgctgaagaagcttcatctgctcaggaaatgagaaggatggcactgttgttgtttcactttttgctcaaatatttaatttttgaaattttatttttcattaaaactattgttacgcttacaaaatgtatttctcaaatttttaaaanaaaaaaaaaaaaaaaaaaaaaaaaa

SEQ ID NO: 91034 - DNA, 332 bp, Heterodera glycines
  SCN-specific regions: Sequence locations=1-290
aacagaacacagcgaaagaaggcgaagaagtgacaacccaaaacatcaacaaactgtgatcggtgttttttccgcgttttaaatggaataagggagcgaaatggcggcagctgtctccaaacaccgaaattatccccaaatccctttgtatgcatttttcacccattcccatgtagaagtcttccaaatactttaatttcgactttttgactgatgttcctaaaatttttgtatgagcaacatgaatccatcttcgagcacttatcattttgaataaatcctgtaatattaaaaaaaaaaaaaaaaaaaaaaaaaaaaaaaaaaaaaaaaaa

SEQ ID NO: 91035 - DNA, 636 bp, Heterodera glycines
  SCN-specific regions: Sequence locations=1-347,369-585,607-636
gtcgaacaaaaactcacttctgtccatcgtgaggggttgtcaacattggaaaatgttcagaagcaaatgctggaagagcgagggaccatctatctaaaggccgcacagttttgtgccttcctgaagaaatgggcgctgaagccgtacaatgacagcatggaggcgtacatcaacttgtctattaagcaggcagaaaaggtggtctcggaatgcaaaggagaagcggatgagaatctgcatgaggacaaactgaagggacttcgagaatctctccgtctctaccgagagcagaaggaactcattgacaatgcaactgcggacgattccaatggtccaaatgtgatcacggctgagaatgtgaagaagttcttcgatgagttgtgcgatttgccagtgtttggtgcagacattcgacaaatgttcgagacaaagcaaaagtcccgacatgagcatcagaaagagtactccgagaagaagaccaatgttggggtgaagttgaggccaaccaaaagtggaaaagtcgtccaaccggaacagtgctggaacgaagagcagcgaaaactcttgaagacctacgagaagaaacaaaaggaaatggaacagttggagcgggagatggagaatgagaatatgctg

SEQ ID NO: 91036 - DNA, 640 bp, Heterodera glycines
  SCN-specific regions: Sequence locations=1-60,82-640
aaaacaagtaaatgtctaacaacaaaaacactctgtcgcttcaaaactccgaaacttcctcgtccgcttcttcttcctccccccgtccaacgtcgccgaacggaattatgaacgaatacgtcaaaagtgctactgagcggatgatccatctgagtgtgttggaggtcggccgcgtgggcaacgacggcgttggcattgtgcaactgcacaacaccttcgacttcggcgcgtcggacgcgcggcggacctgcgcttgttgtgccgttctgtgtgcttccgggtgcgggtgcggccgtttgctggcggaagagaccatcttcaactacgcgaagaatggcatcggtgcaaagtttgggagcggaggccgaggatttgggcggagatttggtcgcaaatggcgcaagaatggaagggacggacgcctcgaaacgattcgcgaagggacgtacggaagagacacggcaatcgaacagaacggagagagggcgggacacgggacggtgcagagaggcggcagaagacgaggagtgaccgtcagaagaaatgagatgcagcggcaggagcaatcgatcggccagagcgacttccgtcttaaagcgatcagcggacaatgcgacttccaatggcaaccgatcggatg

SEQ ID NO: 91037 - DNA, 625 bp, Heterodera glycines
  SCN-specific regions: Sequence locations=1-13,43-625
gtttgagcatttgaattatttttaattttctatttaaaaaatgcttccaaaagaccttttttcactttatctaattgttgacccaattctgtgcggtggtcattcccattctgtgaagttgcttaatgcggtcatcccttgcggggtgaaaatcgtccaactgcgggccccgaattggcacaaaggggcaattttggcacttgccaaagatttgttgaccataacgaggccaaaagggattccgttgattatcaatgaccatgtcgatgtttgcctggcctcgggcgctgacggagtgcatttgggtgccaacgatttgccggttgagtctgcacgtgaactgcttggccccgatgcaattttgggctattcagtgaacaatgaaaaagcattggaacatgccattcgacttggccataaaattgattatttgggcgttggaccggtatttccgactgcgactaaatctgaccacgcgccaccacttggaattgaaagacaacgcttaatatgttcaaggtcaattcatccaactgttgcggttggtggtatcaatgcgcaaaatgctgccgaagtgatggccattggagcgccagatgcattggcagtcatttcggcaatttgt

SEQ ID NO: 91038 - DNA, 403 bp, Heterodera glycines
  misc_feature (385)..(385): n is a, c, g, or t
  SCN-specific regions: Sequence locations=1-77,99-163,186-380
cgaaagccgaatgcgaaatttgtcacaaaaaatttggacgcccgtggctgctgaacggacatatgcgaacacacagcggggacaaaccgtacagctgcgaaaaatgtgacaaaacatttgcggaccgcagcaattgtcgtgcccatgaacgaacacacggagcggaaaaacccttcgaatgccctcgctgcaagaaagcattcaaagtgaagtcttatctaacgaaacacaagaaatcatgcgggaaaagtgaatcgaaatttgatgattgatgttttggtgtagttcgtctttctatgacctttttacggactttattctcatcttctcacaatttgttctttttttcttcatttgtattatgtgaatctcttttatgcaaaanaaaaaaaaaaaaaaaaaa

SEQ ID NO: 91039 - DNA, 313 bp, Heterodera glycines
  SCN-specific regions: Sequence locations=1-166,191-282
cattattcaaaaatgtgcctcctccgttttcttttcaccctttttctgatcactttggcaattttggccggcacccacggcactaatgagaactcagtgggtgatgagcataatgcggcatcgtccattgtccgtgaacgccgaggcgatcgcccgggacattatcgaagcaaatgaaagatgatgaggttgtaaatggaaaaggaaaaaagcagcaattaaaagaaaaatttggaaaatatgtttgtcgaaatatgttttacaatttgcataaaattgaataaaaataaaagaaaaaaaaaaaaaaaaaaaa

SEQ ID NO: 91040 - DNA, 630 bp, Heterodera glycines
  SCN-specific regions: Sequence locations=1-294,334-407,429-630
ccaattaagtattttttcccatcggaaccacaattctgcatctttgcccaaagcatttcttcgtggatttcttgaatgtctctacattttcctaatgccaaatggcaatgatacgagtcaatttgcgtaacactttgcttttcatcatcgtttcttccttcgtttatcttgcttttttgatttggactgccaaagaccgagtgccgcagtttgaagtccaattgagagatgttctgagttatgttgttttggcggtggaaatgggcggtcatgccattgtccgtacttttatggaaaagaaacaaattcctttttccgaaaagggccaaatggacgtgggaagggccgaactgcttaccaaggccgacctcatctccaaccaattgatgctcactttgttaggccgatttcctttcctaaaggtcatttcagaagaaaaatcggaatttttgccggaaaaagagaccgaaaggtatcgtgccgataactacgaactttggttgggtctgcgcgaagtattgtccaaattcccatcttggcgaattccgctagcccgggtgaccgtttggattgacccgctcgatgccacgcaggaattcacggaaggtctaactcaattcgtcactgtga

SEQ ID NO: 91041 - DNA, 222 bp, Heterodera glycines
  SCN-specific regions: Sequence locations=1-222
cccaagggggacctggtcacaacctctactttatcaaatgccaaaaaaaagttgagcaatataaaatgacccctttcaaggtcttgtactaaattaaacccggaaaccttgccatatttttaatgggtatatcggttttattcggtaaataggaaacaggaaaaaaatcaaaacaggaaataaaaattcagagatctcttccgaaaaaaaaaaaaaaaaaaa

SEQ ID NO: 91042 - DNA, 244 bp, Heterodera glycines
  SCN-specific regions: Sequence locations=1-147,169-219,242-244
acagaagaaattcccggatgcaaccggagaccttgaccactcttctgaccagtctggtgaccgctgctcgaagcgatctcttcggctgaaccgcaaggcgggataggcacaattgaacggagtcgctggaaatgtaaatgtgcaaggagaagacatgaagaaatatgtgatgtcgctgagcaacgaactgatgattaacatggtgaagtcgacatacgccgtttccactttggtttctgaagat

SEQ ID NO: 91043 - DNA, 626 bp, Heterodera glycines
  SCN-specific regions: Sequence locations=1-504,533-626
atttatcgcgaaacagtcggttcccggctattggcgcacatttacgtccaccacactgccgaggaattatggcgtcccaatttggcatggttggagcgcgcgacgcatttggcgttgcctcggctgatgaagcgacaaaaagagatggacgaatgggcactaaaccgtaagcgttgtttcgtcggtttgccacccaatttgttgcgccattgcgttttgcatggaattcgtccgtccgatgtccaattgagacaacttttggacgaacagtccggaccgaacgccgtcgtcgatccgtgtccgccaaaagataatcgacgtcaaaggtacgaaccggcgaatttggatgatttgctgcaattgcacgggttaaatgtcgaggacagtccggcgatggatggcgcgctgcagggatttgtcggcactttcttgcgcactttgcttcccgaccaggaacaggcccgcttggactctttaatccaagcattacgccaacgcattggttttgacagtggcggcggcggtgggccatcagctgacaatgcgacggccgaattgggcactgaaaatgagcaggaacagcgccaacaacagaacgatgctcagaatcagcagcagcgaaatga

SEQ ID NO: 91044 - DNA, 271 bp, Heterodera glycines
  SCN-specific regions: Sequence locations=1-271
gtcgtcaatgtctgccgtcgatttgttcttcaaacaagaatatttgcaagtgacctttcgctactaacagcgaggggcgcgctttgcccttctgcgactctctgacaatgaaccttcaatcggactgatcgctgcgtcagctggcaatcacgcactttccctggcttaccatggcagcggattagtcatcccggtgactgcggagatgcagaagttcgcccctctaatgaatatttcctgctgtgaatcatacaaggacgccttcattctt

SEQ ID NO: 91045 - DNA, 343 bp, Heterodera glycines
  SCN-specific regions: Sequence locations=1-343
ggcttctactattacgcacgtggtcttctaccttgatggtgttctgatcgacactgaacgtcattatacaacggccaacgagcggacgttggataaatttggagcaaaattcactccataaatgaagctcaaaatgatgggacacaaaaagacggaggcggtcacggttttgctgaaagatgcgaggatagcggatcgcgttacgatggaccaatactttgcggagaacaacaaacgcttacttcatatcatgcacgctctttcggaggaattgcctggtgccaccaaattgatcgaccatttgtacgcccacggcgttcccatggccatctgtacgggatcg

SEQ ID NO: 91046 - DNA, 471 bp, Heterodera glycines
  misc_feature (454)..(454): n is a, c, g, or t
  SCN-specific regions: Sequence locations=1-136,161-195,311-316,354-471
ggaataatcgccatgaagtccatcgctgcctacctcctcgtctgttctcggtggtaacgagtctccctcggttgccgacgtcaccgccatcctcgcctccgtcggtgttgatgccgatgagcagctcgagaaggttgttgccgagctcaacggcaagaacgttgaagatatcatcgccgagggcatgaccaagctcgcctccgtccccgccggtggtgccgccgccgctgcccccgctaccggtgcctccgccgccactggtgcttcggctgcccccgctgctgcccccaaggaggaggagaaggaagagtccgatgaggacatgggcttcggtctcttcgactaagcgtctctttccaatccaaaaatccttgttgtctgtgagcttgttggatcccctgcaaatccagtgtcggaattccatacatcccactttcaattttcgccaaaaaanaaaaaaactaataaaaa

SEQ ID NO: 91047 - DNA, 591 bp, Heterodera glycines
  SCN-specific regions: Sequence locations=1-31,53-591
gttgtggcatgttcacaggtggcggcttcggatgtggcatcagcaattgcaccaaattcacataagtggtggagggcggctgatcatcttttgaataagaaaatttattgaaacgaaaacattttcggcggtaaaaaaacgtttgaaaaaattccaggcaaaaaatggggttaaaattcaagaaaattttgcttcaataaagaactcggtaaatctcatgatactaatggcgctgcggtttagtcgagtcttgaagacaataaaatgtcaaaatgttcgcttgagccaagagaattccaggccagggaattaccgaactaaaggggacccaaagtgcccaaatttcctcaaaacccaattctcgaaagcatcgccaattttggcacctttgccgaactgactgctctccttccaatgccgtcggttgctggacatcattgaagatgatggtattgcttggtggtgctgctgttttttgaatccggcgccgactaagccggcgccgctgcgccgggttcgactccgaatcagaaacagtccgagcgccatcagcgcacatgcaacgccgcaggcaccgaacaccgccctgga

SEQ ID NO: 91048 - DNA, 611 bp, Heterodera glycines
  SCN-specific regions: Sequence locations=1-172,204-611
gcgccgctttgctccatttttttcgtgtcgcgctttgttattcggtcgacggaataacctttttgccgtctcgccaaaaaaagttgcaatggattcccaaagacgcaaatgaccgccacaactggaagttgtgcgtcactttaaaagcgattatcccttcgctctccccactttctgcgccttctccgcccccaatgtcttccgcctcctctttttcgccgacaaattccgctagtgaaaatagctcaattcgctttgccttgcccatcaatcaggcgaaacaactgctgcattgccttgaacagctccaaattgatggtggcagcgacggaggctgtgccggcaattcggatccattgaatgtgcatcagcaaagattgtccggcccattgttcggcttcaaaaagagcgcattttatttgagtgtctgccgtccgtccaaagcactgtcgggcaaaccgctcgtatttctgtctgaacaccaacttttgcccaacgaatttcacgcctggcattcggtggtcaattcccttccattgtccctgtgctgtttgcccgaactgcgcaaatgtctccgattggtgcttgaacagcccgaggcgacttcctct

SEQ ID NO: 91049 - DNA, 388 bp, Heterodera glycines
  SCN-specific regions: Sequence locations=1-58,80-388
gttgtccgtgttccaattgcttcttgtttggacaattatattgggatttcttctgccatttgtgttggcttttgcctttggagccaaggacacagtttattccgtctgggcgagtgacggctcccgcgagctcacactccttcaagcgtatttactcgcctccgttttctaatagatgggcgctgcccttttggagtatcatgtgactgacacaatgtgctagggagtgattgacctttacatttactatggacgctagtaggaactgatgttgggacagatcgccgtgtcgaccgggtgtggcgcttggctgctcattgccactttctagtagattgacgtctccaccacggactctattgttgggggcaccagtggatattcaatg

SEQ ID NO: 91050 - DNA, 616 bp, Heterodera glycines
  SCN-specific regions: Sequence locations=1-616
cgcacaaattcgatgctctgagaatggtgccattttacgacaaattttacgatgaacgagtcgaacggtgcatggacctttatttggcgccacggcaacgcaaaatgaggctgaatgtggacccgaaacaacttctgcccaatttgcccaaccccaaagacttacagccttttcctactactttggcattttatctccggggccactcgggccaagtgcgtacattggcagtcgaacctgaaattggcgaacttttagtgtctggcggagcggactctacggtccgcgtttggctgttgcccagtggcaaatgccttcggctcttcgaaatgccagcctcggtcacttgcgttgcgttctgtcccaactccaaccgaacactcactttggtctcttgtgagtccgacttggtcactgtgcttaacattcaaagtggcgatcggttggccgtgtccaacacgcgccaattcatcgccggaattccttttggcactgagaacaccgctggcgttctatggacacacattcacagcaaaacgatgaatggaatccgaataaaaatgaacgacaaaatccgaagtctttgttggcacaaaagtggcgattatttcgctac

SEQ ID NO: 91051 - DNA, 239 bp, Heterodera glycines
  SCN-specific regions: Sequence locations=1-239
taatcagccgcagcccgctgtccaagatgctggactactggccgctaaccaatacatgcatcttctttatggtcaacttcaacgcgcgcaatcgcaactgataatgaccaacgacaatctttcagaggaattttcacgagtcgtacgtgtaaatgccgttttgaccagacgcattgaccttctcacacgttcggctccacagcatcatccgcacaatgcggtcgatgctttggtcaacc

SEQ ID NO: 91052 - DNA, 620 bp, Heterodera glycines
  SCN-specific regions: Sequence locations=1-292,314-620
acagagaattttctgcgtcccctctccaaacaatcgcaacattttccgttgcttttggtcacactaattacttaattgaggcactgattggccagaaaagggactctttcgcaacttcttctcccaccgattttgaggtcatcgacgaggacatccgttttctgttcaatgccgaggaaggcatcgaaattgggctcgacttcgaccacaaagaagagattttccgaacttttccaccgcttctctctccgagttccaagttcactttgaaatggcgttgggttcgccttggcatcgctgccgatggccgtgccaaaaggacgagtccccccgctgagctgctcttccgtgggcccaatggcaccgttttccacaggatggccctgccttcttacaattctttctccggcactcaattcgcacagttcgaatttggccgtttttctggcgtttcccccggtgtttggtccgttgctttgcatgccaacaattcccttccgattgcctccctttctttccccgtctttcccgacccatcactcagcagcgaatgggccgagcaaagaattgttcgattaatcgacgaatttttcaccgtccgcgacttttgctcagtcact

SEQ ID NO: 91053 - DNA, 418 bp, Heterodera glycines
  SCN-specific regions: Sequence locations=1-418
gcttatctccaagggcgaccgcgagcaaatctaccagtaccttttcggcgagggtgtgctcgtcgcccgcaaggacttcgagttgccccgccacaaggacatccccgtgtccaacttggccgtcctcaaggcgtgccagtcgctcgagtctcgcggtttcctcaagtcccagctctcgtggcactggttctactacaccttgaccgatgccggtatcgagtacctccgcgagtacctccacatccccgccgagatcgttcccgccaccttcaagaatgatcgcgccgctgcctcgcgtcgcgaccgttccgagggtgatgtccgccgtccccgacaagagggcgagtgctagtcttatcgccgcgcctgaaataaagacggtgcccccgctggtaagtacaacccacacttccgagga

SEQ ID NO: 91054 - DNA, 638 bp, Heterodera glycines
  SCN-specific regions: Sequence locations=1-638
accatttttcgtccggtgttttcccatttggttggccgtgcgtttcgtgttccgccggcagttgcttttccctgttttatggcttcgtcctctgaacaatccgccggtgggcagtgccaccaaaaggcgggggatggacaaacgccggccattgatcggcttgaaggtgctaaaaaagacccaaaggcagtgacggaggacgaatggcgcaaagtgttgtcgccggaggcgtttgaagtgacgcggcagtccggcacggaggcaccattcaccggaaaattcgacaaacatttcgtagccgggggtaaatacacttgcgtgtgctgtggtgccgctctgttcgtgtcggagcagaagttcaactcggggtgcggatggcccgccttctccaagtccattggggacgatcaaaacattgtccgactgcccgacaattcgtacggccgtcaacgaatcgaagttcgatgtgccaaatgcgacgcacatttgggccatgtattcgatgacggaccgccggccgacggtgggcagagatactgtatcaacagtgtggccattgactttgtgtccgggcaacagaaatgaggaaattgagaattgccctttccgctgtgatccgtcattgaccggtccatcat

SEQ ID NO: 91055 - DNA, 633 bp, Heterodera glycines
  SCN-specific regions: Sequence locations=1-120,142-633
tttaaatttgcaaatatcaaaatgatcaatgggattgtgtctgctgaagaacaacagaattccttcctctctggcggttattcagcttcttgttcaacttcctatgttcagcagcattttcagcaacaacaacagcaacatttggcattttcatgtcggacgccactccaaaaactgacgccagaacgaatgagggaatatttgcgaaatcgagaagatctcgactgtatattggaaatttaccaccccaaagttgcacaaaaatcttatggcactgaaaaaagatttttctctccgcctccgttggtttatttacgcggccggggttggcgatggcggtggatgttgttgcagaacggaaatgacaaaatgctggacatccaaaatatccgattcagcgaattgtccaacgaatttcctgagcccatcgcttacattggcatcgtcggaagcaaagaccaggaaaagcacaaattggactggcaaaaggacaaagacggaaggtgcgctattaaatcattgcacatcagcgagaatgacaacaatcgcaagaagtacttcactctcagcgtttactgttcttacaaaacatcaatgcccggactcttacaaacattgggagtgttcgagtcg

SEQ ID NO: 91056 - DNA, 636 bp, Heterodera glycines
  SCN-specific regions: Sequence locations=1-116,138-177,199-543,565-636
caatgagtgacactgtcggttccctctctgaagcattgcaaaacgaagacccggggattgagctcgtgacattctacaattcagaagggtcaaggatatcgaaaagcacacgaattcagcatcttttaagacttccctctttctacattcgtatcaacgatacgtttttcaagttcaccataaattcctttgtttttgagaacattgagaacttagaaactctggatgggataaagtcgaaagtattttctatgtacagcctaatgaacatggatgaatacaaattaaaattggaacactcacttatggaagagatagaaaatgtcgaacaaaggctcagaccgctgataatctttaggtacgatctgccattgaaaaagaatgtgaagaatacactcaacgtgtcttttggctgggattttccgcaatttgttttcaagttggcgtttttgccagattgacttggtgggaatattcatgggatataatggagccgattacttacttttctactttttcttccgtggtcattgctatgagttattacattgttacaaaacaaaatttcgaatacacttcggctcattctcgggtactgcgaaacgacttttacaaacgctccctaaaatacggttt

SEQ ID NO: 91057 - DNA, 282 bp, Heterodera glycines
  SCN-specific regions: Sequence locations=1-202,224-260
ggacatcggagttcgatccatcgccgagctctggaacggagtcaattgcggtgccgtcaaattggaacggcgaacgcacagcgcacaattggagggaggcgttcactcaattcattcttatgacaaagtcgccatgtgattgatctttgcctcgggtccattaatctccaatttctcgaccattccgatatttataagtgccgtttatttaaatgttttgttttcctttattggttttccgtaataaaatgttgaaatgcaaaaaaaaaaaaaaaaaaaaaa

SEQ ID NO: 91058 - DNA, 106 bp, Heterodera glycines
  SCN-specific regions: Sequence locations=1-84
gagaaacggtgtggggcggagataacgacacggaacagcacggattgtaagcggactgctttgatttgttaaataatttgatataaaaaaaaaaaaaaaaaaaaaa

SEQ ID NO: 91059 - DNA, 646 bp, Heterodera glycines
  SCN-specific regions: Sequence locations=1-331,358-517,539-646
gttttgagtcgataactgcgaatataacatccattttgacattaaaactattggctaattaattataaagaaaatgtattttagggccattgtttgcttgaaatgccttccggaactggcaaaactgtttctctactggcgcttgtcgttgcttatatgagaaagtatccggtattttcacgatctcccatttaggctatttaaatttttacaggaaagactccacaagctgatttattgctcacggacaattcctgagatagagaaatgtgtcgaagagcttaaaaggctgtttcgctattataccaatgtcaccggagtgcgtttcacattttctcttttttaaattgttttctctaagtccgcccccgatttccttgccctcactctctccgctcgtaaaaatctgtgcatcaataaatccgtcgtcagttttcggtatggttcggccgtcgacggagcttgtcaacgtttgacggcgagttacgttcgggcgaaaaggcggctgaatccgaaccttccctgttgttcctttttcgaaaaatttgacgagaaaagggacatgactttgccgaagggtgtttacaatttggtgagttgattttctcatttctttcctaattgagtgctgatgcctaatcagtca

SEQ ID NO: 91060 - DNA, 574 bp, Heterodera glycines
  misc_feature (559)..(559): n is a, c, g, or t
  SCN-specific regions: Sequence locations=1-90,114-248,281-391,423-574
ccttaccggacccacttcacatcatcaaaatggtcaagttcgtcaagcccggcaaggtcgctgttgttctccaaggtcgttacgccggcaagaaggccgttgtcatcaagaactttgatgagggcaacaaggcccaccccttcccccatgccgttgttgccggcattgagcgctacccgctcaaggtcgccaagaccatgtcgcaaaagaagattgcccgccgctcggtcatcaagcccttcatcaaggtcatcaactacaaccacctcatgcccactcgttacacccttgagctcgagagcaccaagtcgctcgtgactgccgagaccttcaaggagcccacccagcgcaaggaggccaagaagaccgtgcgcaagatcttcgaggagaagtacaaggccggcaagaacaagtggttctttaccaagctccgcttctaagctggacttgcttgtccccgttgcgtcattgtgcggatgggatatttgacatgagggaagtttggttgtgtttgtttgattcaaatgcatcgccttgttctctttgattgattgtgaanaaaaaaaaaaaaaaa

SEQ ID NO: 91061 - DNA, 505 bp, Heterodera glycines
  misc_feature (482)..(482): n is a, c, g, or t
  SCN-specific regions: Sequence locations=1-92,118-202,226-261,286-479
acaacattggccgtgtgggcattgtcggacatcgcgaacggcacccgggttcctttgacattgtgcacatcaaagacaaagttgtgaagggcagtacaaactgtgcaaggttaagaagcaggcggtcggtgacaagcaagtgccgtacattgtcgcgcagacgcgcgaacaccattcgctacccggacccgcacatcaaggcccaatgtgcgatttgctgtggtccgacccggacgattggagctggacgacgagctcaactactccttcctgcagtttgacccgccggccgcgcgtcggggcgagccgcacgtgacacgccgtacgcccgactatttcctctaggcaaggaccagggaccgacatacaaccaccgactgactgactgaccaccaagaatgatgatggtgtatttgatggataatggaatatattctttttttgttttttaattgaatacagcaacaaaacaaacgattaanaaaaaaagaaaaaaaaaaaaaaa

SEQ ID NO: 91062 - DNA, 244 bp, Heterodera glycines
  SCN-specific regions: Sequence locations=1-244
agcgactgtgagccttgaaattgaacacgtactccacaatttggagcggaggaaagcggctgtaaatgccgaaaagactttcaccgcaattctcggctccccgcaaatcgttcgcgagccaaagggcgtcgttttgctggggggcccgtggaattacccccccaatactttgttgaggcctttggtcgaggtcttaggcgctgggaatactgccggtttgaccccggccgaaatcgcgtcgaac

SEQ ID NO: 91063 - DNA, 629 bp, Heterodera glycines
  SCN-specific regions: Sequence locations=1-54,76-629
aagacgacgaaaatgagttcggcgctcttcgcgctgtgcaaattgatgccgcgctgttggacaacactttgttggcatttatacaagcgcggattgaccaaattgtggacattggtggcgcccattgtctccaacaatacaagcaacactttcgcgaatgcatcgcaccgctctactttttatcccattttctaacaggccaaagtcccggccaacggctgctccaaattcgcaccaattttccaacaacattcaaagcattgctcaattatgtgctctgttttttgttgccatcatttgttgccttttttgtcaaactgagaccattcgatcggagaattcagctttggtacagcagggcgcagacggcccaccgactggtcgacttcatccacttttgcctgtttcttgcgcagggtgggccgataagacccaccgaacgactgtttggtagtcgacccgtttatgtgcagaaaccgacaattggctctctcaattttacggcactgaaccgtgaactgcttggccattcgtttgtccaattgtgcttcctttttgtcccacttttcaatgtgttcaagcgacgttttttgcgggcgctttcccgccgccggcaacaacattttcgc

SEQ ID NO: 91064 - DNA, 330 bp, Heterodera glycines
  SCN-specific regions: Sequence locations=1-81,178-330
taagacaagataaatgttgaacaacactcaaagaaaaatacaaaaaaacaactaatttgaaataaataaatctcatcaacctataaaaatatttaattataaaaatggaaagtaaaagatttattcaaatataaggcaaaataattatagcaaaaaaaaattttataaaaaattaaagtgttttctttataatcagtttttgaatgtttaatcgattaaatatattttttgaaaagcatattaaaaattaatgtaacaaggaaaattaatataagaaaaaaccaaaatattcgtcgtaacaaagaaagccatcaggaaaatgaatcaaaa

SEQ ID NO: 91065 - DNA, 602 bp, Heterodera glycines
  SCN-specific regions: Sequence locations=1-20,44-54,86-117,143 -234,259-348,378-451,477-478,501-514,536-602
gtcatttcaaagcaaacaaaatggctcgcggtcccaagaagcaccttaagcgcctcgcagcgcccaagcactggatgctcgacaagatgacgggcacctgggcccctcgtccgtcggccggtccccacaagctccgtgagtgcttgcccctcgtcgtgttcctccgcaaccgtctcaagtacgctctcacctacaaggaggtcatctcgatcctcatgcagcgtctcgtcaaggttgacggcaaggtccgcaccgacgccacctaccccgctggtctcatggacgtcatctccctcgagaagaccaacgaggctttccgtctcatctacgacgccaagggccgcttcgccgtccaccgcatcaccgccgaggaggccgagtacaagctctgcaagatccgcaaggtcaaggtgaccggcaaggccatccccgttgttgtgacccacgacggtcgcaccatccgctaccccgacccgtccatcaaggtcaacgacaccgtcaagatcgaccttgccaccggcaagatcaccgactttgtcaagtttgagtctggcaaccttgccctcatcaccggtggacgcaacatgggccgtgttggtgtc

SEQ ID NO: 91066 - DNA, 522 bp, Heterodera glycines
  SCN-specific regions: Sequence locations=1-326,348-462,484-522
ctttcgtccggctcccaagtggacatgcggggagacttggcattcaaaggcatgcgaaacacggaccaatggatgcccgcggcaaaggcaccctatttggagcattattccaacgaatttctcaaggaacaatgggccggactttgcgatgttgtagcaaaagtgtacaaggacctcggaggaagttttccatgcgaccgcgttctaaacacactgaagatccccgttttgatcgtcaacggtaacatggaccggttcgtccttgacccgagcttgatgagcaagaaattggaaaatgccaggattgaaatacatgcccagggagggcacgaccttcacatcaaatacccacgttggtttgctttaaaagtgactagttttgtgaaggaatcggcgaaaagtgatgtgaaagcgaataggaaatgaaagtaaaatcagtttcactgcttatattcaacccaatttcactttgtatttttcactgtgatcgtttcgttacaaatgctgccaaataaagcgcga

SEQ ID NO: 91067 - DNA, 342 bp, Heterodera glycines
  SCN-specific regions: Sequence locations=1-246,268-279,303-312
gtggaggcacttttggggacgaactcctccgaagtggaggcacttcgggagacggactcggccgaagtggaggcacttcgggggaaagtggaggcagtgggaccggtggtactggcgtaaatgaacccagcggaaatgaaggcaatgacgggaacggactcggcggaagtgggggcactggctaagggaacggactcggcgggatttgaggtgattagagaacggcgactgatttgatgaatggaattaaaagagaaattccctttttcatgttaaatcaatgttgatcaacgacaaataaatctttttgttaaaaaaaaaaaaaaaaaaaaaaaaaaaaaa

SEQ ID NO: 91068 - DNA, 296 bp, Heterodera glycines
  misc_feature (273)..(273): n is a, c, g, or t
  SCN-specific regions: Sequence locations=1-273
caatgacaaccatgggacagctctaccaggaccgccacgaggaggacttgttcatgtacatcgcttacagcgaggagaacgtttacggctgatcgtcggttgggcggcggagtgtcggtttggccgtggcgcataaaactcccatcgatgggagggaataaccagcgaatcgtcgtcggcttttatgtacctttttcatccctttcattcatatttttcaagtaatttgtgtgatcacgcatcgatgatgattatataaaatcgcttttttcnaaaaaaaaaaaaaaaaaaaaaaa

SEQ ID NO: 91069 - DNA, 475 bp, Heterodera glycines
  misc_feature (453)..(453): n is a, c, g, or t
  misc_feature (456)..(456): n is a, c, g, or t
  SCN-specific regions: Sequence locations=1-453
cgattgttttgttgaattttcgcccgtcccttgggaagtgccgtcgatggtctaattaagcaaatgcttttgttggcagagtgcccacattgtcaccggctcccacttcagccaagtgttccgactcggtttcaaactgagattgatttgcaaagctcgcggggaccctcggcccaaaatcaaatggtttaaagagggaatggaaatgcaaccgaagcgaaacgcccattactacgaaaagccgctgggaaaggatgaaatttggagcaaattggagatcgatccggccacaatgggagaccagggcatttacgcatgtgtggccaacaaccaacacggagtgatggccaagaatttcaaagcggaataccggtagaaaaacagcacagtgctcaatattttcaagtgcatttaattcataatttatacagaaacacaaacaaattaacgccnaanaaaaaaaaaaaaaaaaaaa

SEQ ID NO: 91070 - DNA, 616 bp, Heterodera glycines
  SCN-specific regions: Sequence locations=1-616
atgtcaagcaccaaagatgaaaatttgcttgacgaaaatcaaaaaagcacaaaaattcaacgattacgaaactttgaaattcagccaattcttccttcttcacttcaaacagaacacattgaactcactgaagcggttgtgcttaacgttacaaacaaaagcctcttctctgcactgttgcgcattttgcccccattgccggcccaatttgagcatttgaagcgcgtcaatggcaccgaattgttggtcagtgttagccaaaatggcgacgacggcacaattggcaccgccgaacggacggcgattggccaactgattggcggggagccaacattcatcggacggcacattccatgccgaaagcctcagagtcggcaccagttggagatgtacaggaaaatttggcccatgtcattccataaaaatgccaaattggaggcgatgatcgacggcactttgctcaccgcggatgaaagtgcacgcatcaaacaactctttgtcattgtcgaacggacaaaaggtgcgctgttttacgatccggcaaccgaccaaattgtggccgacggcacgacgacggcacaatttgaggcgcctgcggcggcagcgaacccacggc

SEQ ID NO: 91071 - DNA, 557 bp, Heterodera glycines
  SCN-specific regions: Sequence locations=1-491,514-557
ctaaagcatataagtgcaaatgagtgccagttttgatgacgaacttcagctcgaaatgcaatcaattgaagccatttttccaaatgaaatccatattgaatcggctcgacaaatttctgtccaatgtgcgtcgaatgtacaactaaatttgaacatcccggcagactatccgagtgcccctccatcagtggaaatttgcgccccgtcagttagcggtgagcagaaacggcttctcctcagcgcaatggatgccattgttgtggactatcgagaggggccaatgctttacccattgattgagggggcacttgaattctttgccgaacaccggcagaaagatgcggaagagaaagaccaaagtggagcggaggaaaaagagccctacgccagcgctgacgaggagacgtgtgcagaattttttgccggaccaaccattgaagacagaaagagcaaattccaagcatatgtggccaaagttgaatcaaaagaccaggtggatttccttttgaccaaatcaaaggtgtaggaaaattgcaagagccacacacaacccatac

SEQ ID NO: 91072 - DNA, 509 bp, Heterodera glycines
  misc_feature (469)..(471): n is a, c, g, or t
  SCN-specific regions: Sequence locations=1-230,252-424,453-466
aggcaatgattatcgttgtgcaccattcggtgagtgactacgcgagcaaagtgttccgccgcattttcgacgcgggcttcgaggtggaatttgacgaggacagcccggacacgctgaacaaacgcattcgcaatgcccaactcgcccagttcaacttcattttggtgatcgggcaacaggagaagaacaacggaacagtgaatgtgcgcaccagggacaatcaggtacgcggtgagattgctgtcgatgcgctcatccaaaagttccaaattttccgcgacacttttgcccaagacacagaaagtgcaggatcttttgaaggcccgaaggaacaaaaagaaattttggatgacaaaaaatgaacaatggcattgcaatttcattttagacgggtttttgttgttaacaaattgtgaaatgttccatctggttttttgtttgtttgttaattacaacttgtgagcccaannnaaaaaaaaaaaaaaaaaaaaaaaaaaaaaaaaaaaaaa

SEQ ID NO: 91073 - DNA, 409 bp, Heterodera glycines
  misc_feature (389)..(391): n is a, c, g, or t
  misc_feature (393)..(393): n is a, c, g, or t
  SCN-specific regions: Sequence locations=1-409
atttcctcgcactttgtgcccattccattggcaaatcgccgctttcctttttcttccccaccttttcgatcagttgctgttgcatttgccacaactgttcctcgggaatgccgcatttgtccagtcgcgaatttttgcgcttcaggcgcttctcagccgcaattttgcactcgccaagcacagagttcgccgcgtccacatattcacgcggaaagccaagatttttgagtgctaaaaggagacgacttaacgaatgagaaaggaattgcaagagagattatccgaatttggttttaatcacttgagaggaaaggctattaatcctttgttttacgaatgttcaaaatcagggctttttccacaaatttaaaatcaaaagcgcagtcaannnanaaaaaaaaacaaaaaa

SEQ ID NO: 91074 - DNA, 580 bp, Heterodera glycines
  SCN-specific regions: Sequence locations=1-495,517-580
atccgcttccgaacacaaggaatgaggaaatccttattaccaagctggataatatgaggaggccctttctcactacaacctcgctattataaagaacccgaatgatccgacttactttacaaatagagcactttgcaatttaaatgttacaaaatgggactccgcctcggacgactgcaaaatagcgcttgacatggactttattaatgtgaaggcgaattactacctggggaaggtgtacgtgcttgacggacagtttgatgaggctatcatagtggtgtcgcgggctcatgaacgcgttctctatcttaagcaaacatatggcgactaaatagacccgttgctacggttagcgcgcagagaatagttccgtcgagaagaagactaacgcatggctccggagattgtacttcaaagttacttaaaccaattaattgacgactacatcaccaaaaaagtgaaccaattgtaggacaagagggaatatgacgttgaacaaaaggaggaagagctgaacactcagggggacaccttcgaaacaccgctgaacaatctcgttgttcacgttgacgatcgtaga

SEQ ID NO: 91075 - DNA, 292 bp, Heterodera glycines
  SCN-specific regions: Sequence locations=1-27,49-292
cgctgaaacgatctggcataaactgttgaggaaggaattcctcatgaaatacatgaggaacatttgttgttttttggaggaacaagccgaacagggtgtatgcgtttatccgcctcgtaatctcatcttcaacgcgttcaatctgacaccctttgacacgatcagagttgtggtcatcggtcaagacccctaccacaacttgggagaggcacatggtctctgtttttctgtgcccaatggtcagccaattccgccgtctctcaaaaacattttcaaggaactctcgtcggaa

SEQ ID NO: 91076 - DNA, 571 bp, Heterodera glycines
  SCN-specific regions: Sequence locations=1-124,151-571
agaagacgactggctgtcttacctctcgcttaaccatggacatcattggcttatcgaagaaatgccattccaacttgatcgggatttgcgttgttcctttggaagacagcttcgtgtcatccgtgaaagggaggaaaacatgaaaaggaagaattccactaatggacgacgacaacgccgacaaaaggtttttagtcaaatcaacaatggaaacagcaccactccttacacggaggagactgagagatatccagcggaaaattggaaatcgaccaattcaaatgtttctaacaataagaaaaaaggtaacgaaaccagtggacaactgtcggcctcacctgtcaataatttgtttgagggcgttgagttgccgccgtttactgacaatcagatgaatgtttggtttaagtatttgtcctgcatcaattcgcggatcagagaaattaccgaggatgcatgagattattttatttacctaaaagggaacggatctgaatttatttatcgtttcggtgcaatttaaagctgattcaatttgtaaaagactatttgactattaaacaatatccga

SEQ ID NO: 91077 - DNA, 345 bp, Heterodera glycines
  misc_feature (313)..(313): n is a, c, g, or t
  SCN-specific regions: Sequence locations=1-153,175-310
cttattttatgcttttgcttttcttctcttaattacccgattagtgataaaaaaattgactgaaaaaattcacgtctcattcaacaacatcgaataaaatttgtcgcacaaagcctgacaatctaggcagaacgagccgtatccaccgtgcgctgaaatgggaccaaaggagccacaaatgcgcaaactgttgttgggatttgcagttctgggtgccaagctaaccaagaaaatgccgcgttgtcattttttggaaattgattaaaataattaaatgttttatatcattcgtataaatactagcatggctaanaaaaaaaaaaaaaaaaaaaaaaaaaaaaaaaa

SEQ ID NO: 91078 - DNA, 624 bp, Heterodera glycines
  SCN-specific regions: Sequence locations=1-359,382-624
ctttgcttctgcttcttcccctttttctgctttgtgctgcctttctcctccccgactcggcttcttccgaagtgttcaaattgccgctgcggcgcttcgattcgctgcgtttccaactccgccgcaagggccgcttggcggtgaaggcgtaccacgaggcggaacgcgtgtcgcggctttaccacagcagtgagccgggctatcttcgcgcaaaataccagcagacggtgtacgattattactacttgtaatacgttgcgctcattaccatcggctctcctccccaagagttagaagttgtgatggacaccgggtcggccaacctttgggtgccagacacaacgtgcaattccacttccacccaaaaatgcttcaaatggtgtcaaatttcattttactgtagcgccaactgtgacgagtactgttgcggcgaaagcagcaaagtgtccacgtgtgatcaaaagagcaaattcaacagcgcacaatcgagcacatatgagcagaaaggaaaagcattccagattatgtacggcaccggatttgtctatggatttttgggaatggataccgtccggcttggcgcctcgatcgatcaaaatgcgctaactattccgaaagcattta

SEQ ID NO: 91079 - DNA, 614 bp, Heterodera glycines
  SCN-specific regions: Sequence locations=1-64,108-151,173-181,204-614
gtcattaaaaatttgtcgaaaaataatccccccgtctccattaaaggccctgtctccaattatgtccccctttctgaggaggttgaaaaataatccccccggggccttaattagagcaatacggtatggcttttcattccctattcctttctctctctaaactttaatttctttcttattaaaaatcttctaaaaaacaaaatgtcggaccctgccctcatttttcttcacattccactggaggaccttaaacgcgtccattcccgccaattgttcctttttgaatagcttggaaccggtcaccccaactctcaagccggacaaaaacgatttgcccgaattgaaacgctcacgattcattcgtattgcggaatacgaacaatcgctcaagaggtatgttaagcttcgagtgacactcgttgcattcaacaacgccctgacaccgcagtgtcaactcgaattgatggacgctcgacgttggatttgatccgtctcggcgtcacgttttgattttgattttcattgtcaatgtatctgagctgttcgtttagaactttatcattcccaagcttgacgaggccaaaacacttgctgtaaatattttgacacgttcg

SEQ ID NO: 91080 - DNA, 228 bp, Heterodera glycines
  SCN-specific regions: Sequence locations=1-228
tccaaaggaagacctggaaacattattaaaaaaaataaagaattcgttagacatttggatagcttttcttacccgacatgacttactcaacaaagataatttgccccaaccgttaaatagcaacagcttaaaaaaggcgttgcatgttttagatacgataaacttcactgctgaggaaagaatggcttatgaagatcgcttgaaatggttaaggatagaagcgaatac

SEQ ID NO: 91081 - DNA, 630 bp, Heterodera glycines
  SCN-specific regions: Sequence locations=1-391,414-630
gtggtggacgtccaaaattatgtgatggaaaagcacccattcagtgggcaattccacgaacatgctcaaaaggtggtaattccgaacattcggcgactgattgaaactgcgcgccaattgaaaattgaagttgttttcacggttatggagaatcagacgaaggatggccgtgatcggagtttggactacaaattgtccaacttttttatccctaagggatcacgggaagcgaaagtggttgaccaattgactccgttggacgacgaattggtcatcccaaaaacgtcgtgcagtctgttcaattccaccaactttgcttatctgatgcgaaacattggcatcgatacgatcgccgtgaccggctttttgactgatcagtgcgtcgaccaaaccatccgcgacggcgccgatgccacgggcggtttttggatgatcggagtgagcgatgggtgtgccgcggaaacggccgaacgacacgcagccgcactgaatgttctgcgcgggtattgtaggatggaaagcactcaatcactgatcgaagcaatgcacagtgaaatgggcggagaaagttcaaaaatgggtgattgagcaccacaaatgatctggatatgtattgattatgacggacgg

SEQ ID NO: 91082 - DNA, 519 bp, Heterodera glycines
  SCN-specific regions: Sequence locations=1-519
gtttgtcggtggaagaatacgcggaacttctgctcggtttcctcgttcagaaacagccaatcaaagccaagtattgctatacacgcgcaatcgaaaagttcgtgagaaaccaacaattgatgcaaatttgggagtttggagacacaatttgtaagcaaaactttgacaaggcattgcgaatttgcaacgcgacgacactcggcgaagcgctgcagccgtacgtcgaagaactcaaacgtcgtctgacctccgttcagctgttcaccatgaccaattcatattcctcaattggactctccaaattcgctcaattggtgggattggacgagtcgagcggaactgtgcaagagttactccaaaagtgcaattggactgtgtctgaggacggcttcatttctccggtgcgaaacgcagaattaatgcaagccattgaaagtctcaacgacgccaaatttggaacgggtttcgatattaagtttgcggaacggggtgtcggtggagcgaccgaatcggacagca

SEQ ID NO: 91083 - DNA, 624 bp, Heterodera glycines
  SCN-specific regions: Sequence locations=1-624
taaccaccgccgtcgtcctccataatgttgaaattgacccgtgtttttttcaccgcaattccgacctcctccgattcggtgaacagccgcatcttcaacagacagtggcgtcaccagcagcagcttcaattgcgtctttgctcgtccttctctaccaccggcccccctgggccgtcatttaattgcaatggtcagcggatggacaatttgcgtgatgttcagcaaaaggaggaggacacagtgaagcagcaaaggccaacagtcagcttggccaggagcggcatagcgaaggacttcagcgggacgaccgcggaactgttcgagttgcagcgacaggctggccacaatgtttttggcgatgacgcctgcttcatcgcttctcatatgtccacttatgctgctggtgttgcggatggcgtgggcggatggcgtcgctatggcgttgacccgtccaaattctcttcccaactgatgaaaaactgtgcggacattgtcacatctggcgaattcttgtcacaacggcctgatctgatcatttccaaggcttttagtcaactcagatcaaagactcggccagttgggtcttcaactgcctgtgttttggtggtacacgatcgaactctt

SEQ ID NO: 91084 - DNA, 464 bp, Heterodera glycines
  SCN-specific regions: Sequence locations=1-464
gcacagtgagcgccaacgcacaataacaagcattgccataaccgatttgcctgaaggtaccgctgttaattgtgtggcaattggactccaatcggggatgatcaggctgatcgaaatgtggacaatgactgtagttcgtgacatttcattccaatccttccattttcccgtcctcagtctcctttttgccaacgaatcgcgccgtctttacgccgcctttgccaattccaacgtcgttctgtgtttgcaggtcccttcactttatggcgcttccagtgaagaaccaatgactgtgagcagagaacggccatgcttcaaagtgctcaacccttttaaatgcagcgactcttttcccttgtaacgttttcttctcaaagttctcattgttagcaattccttttttgccccctccccctttttccgttttgtttttccgatgagtgcgttaattggaatttacgagt

SEQ ID NO: 91085 - DNA, 331 bp, Heterodera glycines
  SCN-specific regions: Sequence locations=1-302,329-331
ggacgcagatgggcgaaaagtgatcgtagtgtacaatgggacggggtacctcaagtgtggatatgctggcagcaattttccaagttacattttcccatcggacgtcggacggcctttggtcggatcccctccacgattagtgaacgacatcctgattaaagatttgatggtcggcgaggaatgctcctagttgcggcacatgttgtacgtgagctacccaatggagaacggcattgtgcaaaattgggacgacatgggccatccctgggactacacttttgggacggataagctgacattgatacagatgactgcaacattgatgctaaca

SEQ ID NO: 91086 - DNA, 355 bp, Heterodera glycines
  SCN-specific regions: Sequence locations=1-299,321-355
aaagaatggggctgcaccacatggcatggacctaagcattgtggtgcaattaatcaactttcgaagtccgtgtgcacatgtcgctatggtgataaaggcgaaacaatgccgctgtttccaatgcctttaatattttttttatacggcgcacatcgattcccaccaaatcgaacacagcctgaagtgtagtggcgcaggagagaatgatgccgactcagccgatggcacactgaataacaaatatgttattgaaaatggcatgccggccacaattaaattctccacaaatttcattattggtttgaatttgtttgaataaaagtacataaaatgtagaagatccaaaaccaaaaga

SEQ ID NO: 91087 - DNA, 601 bp, Heterodera glycines
  SCN-specific regions: Sequence locations=1-601
gagaagcgcaagcagaagaagatgaagggactgaccaatgaacgggagaacctccagcgagcggcaaagcgtttcggcgaggcggccacctcagcgctgttggagtattcgccgtcgtttcggcgctgccaccagcggccccagtcggcccgaactcattccatctacgactttacctctcgtgacaaaagcccaacaaaactgatcaagccccgcttctcgctcaatgtcggctcactgagtgcgcgcgagccgcgaccgtcgccttcctttgaacgaatccaatcgttgctttctccgcgctccgcctccgtaagcgatcagttgcgccacagtgtgcgtgcccgtgccggttcgggacagtccaccaaatcgtccatttccccgtcgccccggcatcgctcgtcaatttcttcggccggcacgcgatttttgagatggatcggcttactgtcgccatccgacgaagggcatcatcggcaaaacgggaagaatgaagacagaaagaagtcgacatcaaacaagcgaagaatgtcctcttttcaatagtgatcagtgatcagatatgagtggggaaaagacgagaagagagacttgggcc

SEQ ID NO: 91088 - DNA, 613 bp, Heterodera glycines
  SCN-specific regions: Sequence locations=1-9,31-613
aagaaaggcataataaaaatgtctttaattaaattagttgtgaaaaccattgatgggaaagattccatcgttcgagtggatccgaagatgtcactcgaccaccttcgccatgcaatcgaagcagcaactgggatttccaaaaatgaccagcgactgatttttcgtggccgtattctcaaagatgaatcattatcactcactgaccagggctttgttgatggactggcaattcacgttgtcacaaattcaccacccgcttctacgaatggttcatctacggaaagcagaagcagtgaaacgtcgcagagtcatcagcaacccgaagttatggtcgtaccgcaaataacgactcagaatctgattgtcggacaagtcgtcctcgaaaggacttccctcttcgacaacccaaatgttgcattggatgccgtgaccaatgccttggaggagattcgtggggcttttcagctcgaaacagaatcttcgctaaacactaatatccaaaatggaagttttgctgtcaatgtgatcttacgcggaatgcgtgagcaaattgtcgatggaccggcgagagagcgcttcgaatcgcttagagttgaggtcaagaaactcgcgt

SEQ ID NO: 91089 - DNA, 205 bp, Heterodera glycines
  SCN-specific regions: Sequence locations=1-205
tctgaccaagggtgacaataacatggttgatgacagaggtcttggggcgcccgggcaacaatgtctgccacgcaaagatgtgatcagtcttgcctgaggatttgttccatacgtcgggatggggactatcatggtgaaccactattcgatactctagtacaccgttctcgttctacctggtggcttcatgcttatgagtccagaa

SEQ ID NO: 91090 - DNA, 198 bp, Heterodera glycines
  SCN-specific regions: Sequence locations=1-119,141-147,177-177
gtttgaggtgtgggagcaacttctcccccggacacgggtatgacacacgacgccaagttttcgctggtcaagttggctttgttctcgaatgcaccaagattggtttccccataaactccgattttcaaaactgtattgtgaccccaattttttaagtaattaaaaatgtctaattgtaaaaaaaaaaaaaaaaaaaaa

SEQ ID NO: 91091 - DNA, 604 bp, Heterodera glycines
  SCN-specific regions: Sequence locations=1-99,122-604
gacggtgttgtgctgcagtggcaggacgagttgtgtgtcgcccaccgaaacgaagtcagcaaattgattgcgatgctcacgacaatttaccaatttgcgaaagtgccattcccaaagccaattcattccttcgacccaatcgcaccgtttgtcaacatgaacagttcactccccacaatcagcaccagttgatcaacgacagcctccacgctcatcgcaattttttgtccgcttctttcccccttttcccatttcaatcgcttccaatcattttcagtcggccgacgattacgtgctgagttccgcattggcccaactccaacagcagcacggtcacttgcaacaccaccaacagcagaatacgatgatgaccactgctattcatcatttgtacgacgaaacgccgcgggcaatttaggttaacattgagccccatttgtacgacaaagtggccaggccgggacagaagaggcacttcaacagcacactcatcagccgaagcagcagcaaccaattcagacgataacaatgaaagtgtcagtggcttcttcggtggtcagtccgacgcagcgggcagcggcggcgaatttcaccccgcgggtga

SEQ ID NO: 91092 - DNA, 162 bp, Heterodera glycines
  SCN-specific regions: Sequence locations=1-140
aaaggacagaaaaaggcatctaaaaatgaatcccgggctcagcggaagaaaaagtgaatgatttttgggaaataacaaatgattgatcaatgatcattatgaatggaaattgacctgataattgatcctcacatttacataaaaaaaaaaaaaaaaaaaaaa

SEQ ID NO: 91093 - DNA, 555 bp, Heterodera glycines
  SCN-specific regions: Sequence locations=1-458,481-555
cacagtggattggtaaagaattaagtgacgcgtggccagaataagtcataaggaatatcaaacgtgaaattaccaaagacattactgacccgtacgcctacaacacgactgcaaatcgcatcaacaatgaagttttgtcaagaggaccactagggcaaaatgacaaactgtttgaccttggtacgatgatcgcaacaattgagcagcaaacgggcgacttaaccgaacattcacgattccgcagttttgtgatcctccacataagcacttggacctcaaaagcctgtgtaatcccaattggattatctacgaatcaatttttaaattattccggctttggatatgttgagatgtatgcacaccatttattcaccacaaatgatgaattgtataagttgttcctgtttctgtaatttccttgaaacgcatttgtaaccattatttctggataaaggaacaaaactaaaattcctaccccaattaatatagtcttaaaattaactctcttatttttttgcgacaattttgttttgtatgaataaaaacatttttacc

SEQ ID NO: 91094 - DNA, 520 bp, Heterodera glycines
  SCN-specific regions: Sequence locations=1-110,150-193,224-372,394-520
agggggggggaagaaaagggggggtcccgcgggaaaaggggggaccgcgggcggaaaaaaacccctttttgggggtccccgaggggaaaaaagaaaaaaagggggggggcgggaaaaacaaaggcgggaaaaccccgcaggggggggcgcccccccaaaaaaaaaaaaaagggggggcggagggggggagggcccaccccctttttggggggcccaaaaggagggaaaaaaaacgcccttcttttttggggcggcgggaaaaaaaaaaacaaaaaggggtgtgttggggggggggggaaaaacaaaaagaaagaccgcacttttttctttgcggcggcgaaaaaaaaaagagggtgggggggggggcgggggacgaagaaaaaaaaaaaggggtgctcccccccccccccccaaagggaaatagagggttggggggggggggggaaaaaaaaaaaaacacggggtgggggttgttcaaaaaaaaaggagggggagacgagaaactaatcgtggtgggtga

SEQ ID NO: 91095 - DNA, 417 bp, Heterodera glycines
  SCN-specific regions: Sequence locations=1-390
ccgccgctcgtcccgggcaaattctgtggcttttgggactgactcgtctccaaactcagatgagagttgtgaaggctttccaagccactgtgcagaattcccacccgtcttcgctgtctcttcaggcgggtgaccgtctccgccagtcttaccggcgacttcgaattgcgaaagaaattgagcgcgctaacgaattacgctcgcgtggacccatacgaattgtggattccgagacgaaacccaagtcatccgacctgaaattcgtctagccaattgcaatacgctcacttagtgccggtcaaacgatgatcccttcccccgcggattattcgtttttcaatggcaccataaagtgtcctttttgttgcctttatcatacaaacagaattgaaaaaaaaaaaaaaaaaaaaaaaaaaa

SEQ ID NO: 91096 - DNA, 566 bp, Heterodera glycines
  SCN-specific regions: Sequence locations=1-18,48-566
aattctgaggaagcaaagcggagagaaatagagaaaaaactcaatgaggcgatcgtccgctgctgtccaaagtgtcgtcttcagttcgtgaagttggacgcctgcaacaaaatgacatgcgcttgtggaactacccaatgttacatttgtcgggaagttgggattacatacgaccacttttgcaaccatccacgagaccttattatagcgaagtgcgacaagtgcgttaagccaaaatgcatgttgtgggaggacttcaagcgtcacgatcgcgaagcaatcggccgcattctcaaggagtccggcgtagagattaacatcccggcgtcgcctatgcctggaccgtccacgaaacagcaaccacgagccatcattccaccgatgctgcctcaacgtgttcatgttgcattacatttgccgccgcgtgtggccccgccgaatcgtatggctcctccaccgcaacgtgttgctccaccacaacatgtggctccgccgcaacgtatggctcctccaccgcaacgtgttgctccacctcaacatgtggctccgccgcaacgtatggctcc

SEQ ID NO: 91097 - DNA, 614 bp, Heterodera glycines
  SCN-specific regions: Sequence locations=1-614
ttctttctgtattacaacagtaaatgaatttttatcatgcagaggctgcagaaatactcaataaagcagcaaaaaaggaaggatctcttcgcagattcatttacgagagcaaattgaaggataaaaaagtcctcctcaaaatttgctgcgaagtcgcaaagcacagacattggcttcaacagttggcatgtcgtcctgctgtgcagacatttttagctcgcgagttaagctgcggcgactcatcatatcaattggtgttgatcttcgaacttttgcatggcaaatggaaacgcaaagtgccgacaaatggtaatggacaacactggacggcactcagacaattgaagagcattctcgacgaagagtcggatttgctgctgaaggacggcgtttcctcggagagtctttctccggcagagtcttccgcttctcttctgccgcgttatgtgcgcgtgaacaccgtcagaatggcattcacacaagcagttgaactgcttgaacgggacgggtggtgcctttgtcgtttgaagaagcgcattacgccaagcaaatatcgaagattggtgtcaacattggagtcgcctaaaatttacgtggacccgcacatttacgac

SEQ ID NO: 91098 - DNA, 563 bp, Heterodera glycines
  SCN-specific regions: Sequence locations=1-103,521-563
caagtttgaggggcatctcttggtaatttttgtcgttgaaacacagcaccagtgacgcattgaccatggactacggcgtggaacgcaaacgccgcagactctccaactacggagcgacgtcgccgacaaagagtgtccaggaggtgaaacccgtggcattgtcttggcacggtctcaccgctgtccatgccaaatcgggacggaaaattcttgacgacgcgtccggcatggccgacgcgggccaactcgtggcactgacgggcgacggcggagtggacaaaacagcgcttttgaacacgttgctggaccacaacctgaagactttgagcgtggagggtcaagtgctgatcaacgcgcactccttgggccggttcatcacttacgtcatcgggtacgtgcaacaggacgacttgttcatgggcacgccaacggtgaaggagcatctgatggcgccggcacagctttggatggtcggacacacccaacggacgatgcgtagacgcgtcaatgagttggaagaagccatttcggatggtgaggcgcgtcgtttgccgttcgtcttc

SEQ ID NO: 91099 - DNA, 290 bp, Heterodera glycines
  SCN-specific regions: Sequence locations=1-27,49-183,205-266
cagggcgacggacttttggtgatttatgagcaggagcaggcggacccaacttatgaattggcggtggactcagtgcacgccatgggcgaagttgtcgacgctttgtacgaacgggccaagaaaatcaaagccgtttaaatgctgagaaaggcgcaaatggcgacggacaaacggccaattcggaaatatttttatttattttttcactgtgcatttttttgtttgtttattccgttcgtattgcacaattaaatttgactctgttcaaaaaaaaaaaaaaaaaaaaaaaa

SEQ ID NO: 91100 - DNA, 480 bp, Heterodera glycines
  misc_feature (460)..(462): n is a, c, g, or t
  misc_feature (464)..(464): n is a, c, g, or t
  SCN-specific regions: Sequence locations=1-480
gtccatttaagtgtaaagaaaatttatgcattcataataaaaactaatgaattatgtttacggctccactaatgaagtgtttggggaggcgttggtcgacaaaattctggcccaaatggatttgaatgtgcttttggatgaccaagtgcggaagactgttgcagaatatgccggtgactatgtggataaggttctgcgcaaggcatgcgaattggccaaacatcgggggtcaaaggcggtgtattaaagcggacatttgctacgtgttgaagcactactttcgcaactaacaaatgccaacaagaaaatatgccgtgccgacttgttctctaattgattttcataataaagacaatgccttaataacatccgatccataatcatcatttgtaaaattgcgatctcttcccatcttccatttttttaatatccattcatgaataaatggctctagtccaannnanaaaaaaaaaaaaaaaa

SEQ ID NO: 91101 - DNA, 609 bp, Heterodera glycines
  SCN-specific regions: Sequence locations=1-48,70-132,186-471,512-609
cacgcgctgctgccgtacgaccaatatttgcatcgttttgccgcctattttcagcagggggacatggaaagcaacggaaaatgcattacgagaaatggaacccgcgtgcgccactcgaccgggcccattgtttggggagagccgggcaccaacggacagcacgccttctaccagctcatccatcagggcactcgactgatcccatgcgacttcatcgccaccataaaatcgcacaatccgctgcggggaggactccatcataagattctcttggcaaactttttggctcaaacggaggcactgatgcgcggaaagtcggcgacagaggtggaggaggagctgagagcgagcggaatgagctcggagaaaatcgccaaaatcgtcccccacaaagtcttcgaaggcaaccgtcctaccaactcaattgtgctgccgcaactgactccctccacgctgggctcgttgatcgcgatgtatgagcacaaaatcttcgtccagggcgtcatttggggcatcaactctttcgaccaatggggagttgaactcggcaaacagttggccaacatcattctggacgagcttcggggcggcccgacacgcaagcacgat

SEQ ID NO: 91102 - DNA, 543 bp, Heterodera glycines
  SCN-specific regions: Sequence locations=1-114,137-543
ctcccgctcccgccaagagccacgccaacacacaatgtcctcgtccaacaccaacacgaccgcggctccctccaaacgcagcagaaagcacaacggcaccggcggctcttccccctcgccaatgccctctgcgtccgccaccgtgccgcacacttccaccgtccccacgtcctcctcggctgcctacatcatgcccgccgacctgccgctgcccccgacgctcatgatcgacccgccctcggaacccgacccggactttgtcccgccattccttgaatccggcgcaaggcagctatccatgcccaacaaccgcggccgcaagctgcagatccagtcgcagccggcaccgtcgacgccccagtttccgcaatggtcggcgcccaaatccgaggtggcggctatgatgggtttgggaccacggccagatattcgtgcgccgttgtcgggggatccgtttgcgaagaagacgcagttccggttacctcaaagcgacaactactatgccgcctacgcggatccagtatcgatcaagaagcgccagcg

SEQ ID NO: 91103 - DNA, 445 bp, Heterodera glycines
  SCN-specific regions: Sequence locations=1-114,137-445
gttgtccgtcatctgtttggccatgaaatttcttatacaacaagaagcgattgacatctaccgggagctgttcacctcctgcgggttctgcgtggaccaactgatggaattggcggaggtggcctgtgcccaggatatcggagaaacgtccgataacgcgaacgatctcattttgtcatggcctgggaataatgacggcgatgagctcgtttgtgcgagactcttgaaggattttggattttcgcctaccattctctgtacaataccatcaccaaatgatctgatgcaactatagacgcttcaattggaatgatctcgacgttcccttcgaacgaatctttccctgaccccaattctattgagacgttgaacttcagtccttgacgaaatcttcggttttatctttcgtcacccaattcaggagccattcgacgtaattttgaag

SEQ ID NO: 91104 - DNA, 402 bp, Heterodera glycines
  SCN-specific regions: Sequence locations=1-402
ggacaatttgcacgtgaactcaatcatcatccgtcactgagtgatttcatagcagcattcatcaaggaaggacatcgacaaacaactggacattggacgagcagaacgtctccagaagagtcgaaaacgaccgcaacggtacatcatcaaggaacagagtgttgtgcgtatccttgacgaggctgactttgaatcggaagaaggattggcaaacgccttgcatctgctcggactcgtaatgcagggctttgtagaggggcttcacatccgtggaaatgatgagagtgatgaagaaactgctgatgccgatggaaattgaatttaaaatttagtgttttactttctattttttctttggattttaataaatatctatttgcaaaacacacaaaaggatagaat

SEQ ID NO: 91105 - DNA, 609 bp, Heterodera glycines
  SCN-specific regions: Sequence locations=1-366,389-609
ctcttagcaatcttgtctagcgaccaagaccattccgtaaatgacgacctcagcaaccaacagcgactcggccaagtttgtcttcacggacgacatgaaggtcaagtttctcaatgatggctacctcatcatccccggcttcttttccacggccgacgcggccgccctcaaatcgcgcgctgacgaactcctgcactccatggacctttcgacgcaccctatgaccacctttgcgaccggcggaaaggatggcaccaagcacgtgggcgacaagtactttctcgagtcgggcgacaaaatccgctatttcttcgaagaagacgcggttgacaagcagacgggcaagctgctcaaacccaaggagcgcgccatcaacaagattggccacgcgctgcatgtgctcgacgacaagtaccgcgagttttcgcaccggtcggctgtcattgacattgtgcgcaagttggatttcgagaagccggtcattttgcagtccatgttgattttcaagcagcccgaaatcggcggcgccgtcccgccgcaccaggactcgaccttcctgcacacggatccaccctccgccgtgggcttctggtttgccctcgaagactg

SEQ ID NO: 91106 - DNA, 309 bp, Heterodera glycines
  SCN-specific regions: Sequence locations=1-219,265-287
ggagattcttcgtgacccgggcatgcgagttttgctggaacaaatgagccatgacccggatgccgctcgagaacatatcagaaacccggacattttccgtaaattgatgaaattgcaagaggcgggcgtcatccaaattcgctgagaatgatcgacggaggaaagggcggaatggctaattactcactgaacgttccgatttgaaggattttccacatctttttgattttgctgttgtttttccttttgtcccttttgtttttgcattgccgtaaattctctgatggaaaaaaaaaaaaaaaaaaaaaa

SEQ ID NO: 91107 - DNA, 283 bp, Heterodera glycines
  SCN-specific regions: Sequence locations=1-283
cggacaagagagattccgatgcatggtgccgttgtacatgcgaaatgcaagtgccgccgttctcgtttatgacatcaccaaccgggaatctttcgaacaaattgagcaatggcacaacgaagtcctgcgttgtcccactgccctcgaagagccgatatttgtgctgatcggcaacaaggcggaccagcacgacgagaaccgcgaagtggccgaaggggagggcgtccaaaaggcccttcgactgaacgcacatttttttgaggtgtcctccgtccactctgaa

SEQ ID NO: 91108 - DNA, 484 bp, Heterodera glycines
  SCN-specific regions: Sequence locations=1-484
gtccaattaagcaaaatgctgcgtcattgtatgctttattcgcgtgcattttgtactgtcaaatcgcctccgttagatctcacaaaagaagtgatcactaaattggaacggctgtccgcacttcagatgcaattgccacaagaaagtcgcaacttggcagaggacattcaagtggcagagcgtattttcgaagttaacactgagggtgttgatccgctgcataatattgtcgatgattttatcaactgtcccgtgcgagaggacgtgtctgaacatacttcgattaacgagacgcttgccaatgcgcgtaaaactttcgagggattttttgtgtcgccttctgttggcgttgagtacaaacggcgggggaaagatggtaacaagaaaacggacagataggaaaaggaaagtgcgaaaatggacaaacaattaatttatttcggtgttatttcaacagatttgagttttataaatgtattgttta

SEQ ID NO: 91109 - DNA, 620 bp, Heterodera glycines
  SCN-specific regions: Sequence locations=1-355,381-552,577-620
ctacgacagcctcccttcacacctcctcaccttagatcatagatccgttcggactctctctcttactttcccccacccacactctttccaacatgaagtctactctcatcctcgccgccgccctcgttgccacggttgccgccgctccctcgtacaacgcgcccgcgcccggctccaactacgatgccgccaagcccgcgcctgcccccgtccaacccggctacgacgcggccaagcccgcgtctgcccctgtgcagcccgggtacaacggtgacgccaagcccgcccccgccgtgacgacgccctgctcgtctgccgcggccgctaagcccaccgtgcccgccaacaactacgacggcgcggcgccggccccggcccccactggtgcctacgacggcgcgtcgcccgacggcaagacgccctgcacgacggcggttgccgaccaagttgcgactccctcgaccacgccgtgcgaaaagtcggcggccaagacgaccgacgcgtacgagcaagtcgcgccggcgcagcccaccggtgcgtacgatgtcaagatccagcctgcgggccagcagcagaatgccgacgggtcgctgtaccaggcgtcgagtgccggcaaggtt

SEQ ID NO: 91110 - DNA, 512 bp, Heterodera glycines
  SCN-specific regions: Sequence locations=1-512
gcttctcacagccactccgccacgacacatcatggccaaagtcccgcgcaacttccgccttctcgaggagcttgaaaagggtgaaaagggcattggtgatggcaccatctcgtatggcctagccaaccccgaggacattttcttgagcgattggaacgggacaatccttggtcccccacataccgttcacgagaaccgcatctacagccttaaaatccactgtgacgcaaactaccctaattcgccgccggccgtttcgtttgtatccaaggtcaaccttccgtgcgttagcccaacaaccggacgtgtcgaggcgtcccgcttgccttgtttgagccactgggagcgcaactacacccttgaaacggtgctctctgaaattcgccgagagatggctgccccgaacaacaaaaagcttgcacaacctccagagggcagcactttttaactgctttggctcgcttcgaccgagcgttccccgatttcaagccttgatggagtacgatgtgacc

SEQ ID NO: 91111 - DNA, 626 bp, Heterodera glycines
  SCN-specific regions: Sequence locations=1-489,511-626
ccgacttcagccatattaaggaccgaattgtcgcttcggtgccgggacgcttccaaaggagtggcaccgatggtgatgcctcgtgccgttttggccatttgcgcctgcgtcggctgctcagcgaagcattcagtgtggaggaaagacagcggcacaaagccttcgtgggccaattcagctccatcggttcgctcggcgcacggcccgaggcgtggctttgcgacgagtttttgacgagtctgtcctgcggacggtccatgatcagcgcttcctcgctgaaactgatttatccgtcggtggaaaatgtgcgccgttcgttggagggctacgcggccggcctttccctgccgtacagttcgcagacgcaccaaaaacagacctatctgaagcagttcctgcatcaatggcgaagtgaccggctcaaaaggtccgccgcttcgccccacgtgaaaagttacgtcgcgttggacgccgctggcgagtgccaatggctgctgctgaccagtgccaatttgtcccactctgcctggggcaagttggagaagggcggcacccaactattcatccgctcctttgaacttggcgttctgatgtgtgcaaaggaccatcttcgccgacaatccccc

SEQ ID NO: 91112 - DNA, 638 bp, Heterodera glycines
  SCN-specific regions: Sequence locations=43-51,77-77,107-118,246 -251,335-335,359-415,439-486,508-638
tgcaattctaataaatcattatatggcttttgctggcgatcatattgaagaattacgggaacactaccccacgcttctgcaaaatggaggaagtggtttcatttcttccaccgaagtccaaggggcgctgaaactgttgggtattgaccttcctgggtaccagattcgtgaacttttatcgcgtcatggcgacccaaaacatttgaattgttctgaattcgaagccatttacatggacttggacatcttttcgaaatgcggagacggcgcgatggaaaaagcgcattggcagtgttacaggcgcttaccaagtgcagggcattgcggagcatggggctgaggaaattgtacacaccatcagagtggaggaagaggtcgcatttgccaattggataaacagcagtttgtcagaggaccaacacctgaagggacttctcccgctgaaaggtggcgacctttacgggaaagtaaaggacggactgatcatttgtaaaatgatcaatttggctgttccggagaccattgatgagcgtgcattgaacacgagtgtgtttgacacgtacaccaggcttgagaacctcacattggcgttgaattccgctcgtgccattggttgtgccatcgtcaacattgatgcg

SEQ ID NO: 91113 - DNA, 589 bp, Heterodera glycines
  SCN-specific regions: Sequence locations=1-175,197-351,373-589
gtcaaggtcaagcaagaacttaaattcctttctcgactaattagcgaaaactctcgaccaaaaccattccaatcattcaaattcaacacgacatatcacattctcaatcactacaaaaatggttccttggtggagttccaacccgtccacattgaacagttcaatggagagcattgaagctgctgctgctggtgaacaacatcgtcatgttcgaccagtgcacgcaacaccaccaccagccgattattttgacggaattgttattgttgggcaaggagtaacagcagatgtaacggcagcaggagactttgtgccatgttcaacctctactttggcacaatcaattgaacgcgtttttggcaatttgcaacaccagcaaatccatcctgaaagctatgaagaagcgaagcgactgttggtctttgctggactgtttttcctgctaatgtgcgcatttgtactaatcaaattccaggtggcattcgatgatgtctttcgctggtcaccagcagtttggctggtcagcgtaatcatttgtgctcttctgatgaatatgtctgtgcaaattaggcgatttgtgcaacgcata

SEQ ID NO: 91114 - DNA, 217 bp, Heterodera glycines
  SCN-specific regions: Sequence locations=1-217
gtcccatccgatatgcccccagagctgtcccccgccatctcttggaccccgttacaaatctccgctcgacgacttccgaaatggtccccgtgagaaagtgctgttcgtcacctgtcccactgtggcccccacataagtggccgattcagtggccaccgtcgacgtcaacccgaacagtgcgaccttttgtcaggtgatcgcacaagttcacctgcct

SEQ ID NO: 91115 - DNA, 442 bp, Heterodera glycines
  misc_feature (420)..(421): n is a, c, g, or t
  misc_feature (423)..(426): n is a, c, g, or t
  SCN-specific regions: Sequence locations=1-27,50-124,146-381,405-442
gaagtatgttggcagataaagtcgtcattttcataattggcaacaaaatcgatttggcacggcacagaacggtgccaaaggaagaggccaaagagtattctcaatccatcggagccaatttctgtgagtgctcagccaaaaccaacgaaggggtcagcgaactgttctcgaagttggcaattgaaatgttaaataaatcttccgaagagacggaagacaccgatggaatcggcacgactcctttccaacggcattacgggtcgaggcggagccttagaattgcggacgaagatgaaacacatgcggaacggaaacgacgcggaaaatgttgccgatgatgcataaaaggaaataagatagacgaacattccaactaattgtattatacttatggacaaagttctataaatatttacggcnnannnnaaaaaaaaaaaaaaaa

SEQ ID NO: 91116 - DNA, 123 bp, Heterodera glycines
  SCN-specific regions: Sequence locations=1-27,50-102
tcgagaagggtcatttgatctcaattttatgtttgcatttatttaaaaacgattggccaattactccaaacgtgactttcattgataaacacataaaattgcaaaaaaaaaaaaaaaaaaaaa

SEQ ID NO: 91117 - DNA, 542 bp, Heterodera glycines
  SCN-specific regions: Sequence locations=132-186,208-246,269-444,484 -542
agaaggaggagcaattggagaagaaggaagagaaattggagaagaaggaggagcaattggagaagaaggaaaaaggcaacgacgcagcagcagcgaagaaagaggaaaggaagcgaaagaagggggtgaagagcgacgacaacaaccgggccacccccgccccgtcccctcctcaccatggaagtggagtataaacctccataagaaggcaatgctaccactgcccgcctccccgcaacgcccccggctttaaattcaaaaatttttcaggtgatgatgtcgaacccccagttgctccaagcgttgcccaaacccgtcgcgctcagtggcaggcgaaagtgatcatgatgatcaatgtgtcgaccgactgaactttctctgccctactcgcgatgacgtcattcgcccgtgcatatcttttacaattcatttgctatctccgctcatttctctccttctcaacaaatgtgatttctgttttgtttcctctctctctctctgtccccgcaaatttttctgcagaataaattgagttatgaaaa

SEQ ID NO: 91118 - DNA, 264 bp, Heterodera glycines
  SCN-specific regions: Sequence locations=1-240
atccatcggaatgcacccacttgtccaagctgcaagtgcagaagcaggtccaaaaatccgaagaaaccgcgcaaaaaggctgagccatcggaattgcgaaggaattgatcgaaagttattcatcgttcgatgttaatggaacgatcaaaatgaaattgtagacggatttgttcagagtttgtttcataccccaaattttggcctacctattatagtttttttactgctaaaatgagccactttattttataaaaaaaaaaaaaa

SEQ ID NO: 91119 - DNA, 267 bp, Heterodera glycines
  SCN-specific regions: Sequence locations=1-36,58-183,205-243
ttcattttttacaaattatcgttgtttcgtgcctcattgaaaaaatgtcctaaaacatcatttggcgattttaacagtgccacggaggaggccccaccgacgacggccccggtcccgccgccgatgcctggcggtctttcggatgtgaaggtgtgccaagaaggagacgaaaaactgacattctgttttgggttttatttgtaatgacgattttatataaggaattgattaaattgtgtaaactttttaaaaaaaaaaaaaaaaaaa

SEQ ID NO: 91120 - DNA, 264 bp, Heterodera glycines
  SCN-specific regions: Sequence locations=1-15,50-191,234-241
acgagcagaacaagcaaatgttgaaggaggaggaggaggaagtggaccagaatttgtgtccccccaattcataacggataaaaattcgtcaatttgtgtttaatggactatatttttgtgtgccaattctccctcccccggacttcgtttgtattgagaggtcagccgatctactccccctcctaatgtcctaatatttaattttttatgtatttattctcaaataaaaatatgccgtctgaaaaaaaaaaaaaaaaaaaaaaa

SEQ ID NO: 91121 - DNA, 502 bp, Heterodera glycines
  SCN-specific regions: Sequence locations=1-502
acaacaacaaattcatcttctgattgttcgtccacagcgacacggccttttgtacacatcaacgtgaatacggtggaatatgccgtgccatcggagtaccaatttgtggactatttgggcggtggtaactacggcaacgtgatcaaagtgcgagcagcgcaaggcgtcgaattggcggtgaagaaaatgtacgagccgttcagcagcgcgatcaaagcgcgccgcgtgttccgcgagttgaaactgttgcagctgatcagccatgagaacatcatccaatttgtggacatgtacacgcctgacatggacgacaaatgcttcaaaaatgtttacattgtgtccggatacgctggcgtcagcctaaagcaggtgttggaccgacaaaaacagttgggccaatcgctgatcaaccatgaccacatcaaatacattgtctaccaattgcttcgtgcactgaaatatctccattccgcaaatgtaatccaccgggacttgaagccgt

SEQ ID NO: 91122 - DNA, 534 bp, Heterodera glycines
  SCN-specific regions: Sequence locations=1-180,202-534
gtcattcagttgcctaactgtgcggatgcgcagcgtcgcgtttcactgaccaacggattccatccgccgccgccctatttcgtcaactctttccctgcacaaccatcggccaggccgcagcccttcgctatgagcagtcccaacccgaaacccgcgcgtggccctcctccttcaatgctgcacaaacaaattgaaaacattctgcgcagttcacgcggtcgactgcctcccaacggacatcctttcatcgtgcggaaaatcagcatccgttcgcaggtccaacaggtcgtacaaaaggagcagcaggtccaagtcgtacaagaggacgagcaaagtcacgatcttcagaagccgaaacaatcatcgaatgctaaggacgagtcggaggacatcatcggacaactgatcgaacaatttaagagattgaaagtgagtgattgaagtgatcaattttgttgtttttggctgtttgccagttgtgcactacatatttttctcattatgtgttttggttggcaataaatgatcctattc

SEQ ID NO: 91123 - DNA, 301 bp, Heterodera glycines
  SCN-specific regions: Sequence locations=1-167,189-273
ttcagattattgaagcagacgaagctgctgggcaacctaagcaagtggtggctgagtatgtggacggtacgggcagacgagttaccatgaaagcaagcggagaggtccgaattggccaacttgttgctttctttgaaggtcctgacagaaaccgcattcagcgatgcttcacgaacaacaacaacaactgatttgaaggatttgataaaaataaatttgaaaaacgtatgtcatcctttttgaaagcgcaataaaaaaagcacatttctgtgtaaaaaaaaaaaaaaaaaaaaaaaaaaaa

SEQ ID NO: 91124 - DNA, 574 bp, Heterodera glycines
  SCN-specific regions: Sequence locations=1-458,480-574
gtccaattaagaatccaatagcaaattttatgattggacttgcataaacttggtatttccttctgacagcaaaatggtacctcataattctgagttcacgcgaaagttgcgggctgccgtacgtgcctaaattgaggagtttggcattgacgtggatgacgaattgcccgactatgtgatgattatggtcgggaacaaaaaggacaaagctcgaatgaagtccgacctgaaactgttcttgggcgacaaaacgcctgactttgttgaatggctcttcggcttcttccaaaaggtcaaaaatgccactacaacaagttcagcgtcgacacaacaaccgcagaaacaaagctcgaccgaatgggcaacggacaaagagaagaaacggacgatggacaaagacaaaggggacggagagggaaaagcggcggagaaagtgtcatcgatggaggaaaagccgacaaaacacgacagacgggaacggacgagggaatctgaaaagccctcctctgacagagccaaagtcatcagttcgtcgtccgcccattcgcaaccacagcgaagttcgtctcacacc

SEQ ID NO: 91125 - DNA, 615 bp, Heterodera glycines
  SCN-specific regions: Sequence locations=1-120,142-615
gtccatttaagttttgtgttcattttcctttttgtaataatgagtgcatcacgtgaaataattgcaacacatggcaaggaaattacggctgacgatcattttcgaagtgcaaatggcgccaaagaattcttcaagcgcaaagaccgatcaaaatcatatgaaatgaacaacgtttcgggtgtgaggacaatctcgtggaatgcgagtggaacttatttggcgagtggttccgacaacagagtcgtttctgtcgggagtttggacccacattcttgtcgattgaagcaaatatttgttggctatggtcacgaagacatcgttgaagcgattgaatttgcaaaacgcgatgaaatgaaaatggcttcatgttcaagtgacaagtctgtgcgtctttgggaccttcgaaatccgagtagtcacaccaaactctcaacgccaggcgcaaatctttttgtgacgtggtcctactgcgataatttcattatctttggcgacaaatctgataatttgggcgttattgatgcgcgcgctatgaagacactggaactattcacattcaaagatgaaattaacgagttcgtttgtcacccaaacgggccactgattttcgtggcc

SEQ ID NO: 91126 - DNA, 512 bp, Heterodera glycines
  SCN-specific regions: Sequence locations=1-209,231-469,491-512
attttgagctaaaacatattaaggggatcccagacgacgaagatgccccaatgttactccaattatgacaactacaaaatatacaacaggaactcgaacagtcagaacaaattcgggttgagttggagcagcgaaaccgagaaaacaatcgcctcgcgcagaaggaaattgacacgttaagaagtgccttagtagatcagagcaacgaactccaagatcagagcaaagaactccaagatcagagcatactactccaagatcagagcaaacaactccaaaaacaacaaaataccatcgcttctctccttgccgaaaacgactccctccgaaacaggctgcacatctttttgctgtttctttcatttgtagcgccgcctgttgctgtggctatgaaatccaattcacgccgaatgagtcatgcggaaactgcatcggctttgatccgctgcacatttctctgtttcgtcttctggtttcctgctgttatttttgcgatcagtttcgtcggcgtc

SEQ ID NO: 91127 - DNA, 608 bp, Heterodera glycines
  SCN-specific regions: Sequence locations=1-608
cagcaccacccttctacttcgtcagctgccattgcctctccgtcaatgtctgtggacgttccccccttcaaaatggcaccgtcttccccaaattcggccccctcgtcggatggcactttctcttttcaccaacagattgctgcttcgtctgacaacgcaaatgccgagggaccgaagcgaacgcagcaaaaagacggagcaatgggcaaaaaagcatacggacgaacggcggaagggatgggattaccgacggacggacaatttcagtcgcacggaggagggggaccattcttcggctttcaccaccaccaacacccttcggcaccgccagtccatccttccatggaccatcatcattccgcaagtgttcccccgcctttcatgactcatctccatcccccgcccttcggccaccaaatccattcctccgctgtcggagggggccctttcaacgtccctccgcccgtttttccgatgtccgccgctgcttccgtcgctcccaatgccgccccttccttccaacaacaactcggttcccatgcctttaatgtcggtggcttttcctcgtcctccgattccgtcggtgggccgccccgaccgcagccgtc

SEQ ID NO: 91128 - DNA, 554 bp, Heterodera glycines
  SCN-specific regions: Sequence locations=1-420,442-554
ggcggggggaacggacggatgggccaaacaccgcaagaaaaatggccatggcgaacagcagaggaggaatgccatcgatcaatccgtgtgcctttggcaccggccaatttttgttttgcaagccgagcaccgcgccaggcgctccttgcccgggccaacaattttgccatgtcggagacagtccgacaacgacgatctgctgcaacaaaccagctgccgtcgatgcgtgtcaacagcctctttttgttggcgttggcccttccaatttggtccgatggtttttcttcgcaccgtcggcacagtgccaaagtttcacgtacaaagggcttcagggcaacgaaaacaattttctatctcggtttgattgcgaacagatttgccaagcaaatccatgtgctgtgggcacgcctttgcgagaccaacaaggacagattggcttctgctcagccactcagcagaacatttgccccattggcttttattgccatgccggacgcgacgtcaagaccagtttatgctgtccaatgatggctggcgacccatgctcccaaccg

SEQ ID NO: 91129 - DNA, 424 bp, Heterodera glycines
  SCN-specific regions: Sequence locations=1-169,191-377
gtcttttgcctatggaaagtccattcagcagaatggtggtcccaaccgtgtcacattcattctgcgaaaaggtgcaattttcttcactgggatggttgttggaacagtcgttgtttttaaggcatttaagccaacgcgtcccttcgacgaagcggcagaacgtggcaaaagggagctgttggagaaatacacggaggagtacaacgcgttgcaggaagagctgaggcaggcggaagagcatcattggaacggagggatgtcgaagaggcggaagcgagaaaggcttagccgatgacaataataatgatcaatttgggtggaagggttgtaaatcctctgaagtaggatcacattgctaattaaacattttgaatttcaaaaaaaaaaaaaaaaaaaaaaaaaaataaaaaaaaaaaaaaaaaaa

SEQ ID NO: 91130 - DNA, 347 bp, Heterodera glycines
  SCN-specific regions: Sequence locations=1-15,37-327
gcaatgcaaatcaaagtcaagaccctcaccggcaaggagatcgagattgacgtcaaccccgacgacaagatcacccgcgtcaaggagaaggtcgaggagaaagagggtattcctcccccgcaacagcgtctcattttcggtggtaagcaaatggccgacgagaagacgctcgcggatttcaatgttgctgccggctccgtactccaccttgtgcttgccctccgcggtggatccaactaaatccacgctcgtgtcgtttgccttttgccgtttgtcactcgagtccctcttcaccgacagtcacacaatacacttgtatttcccatcaaaaaaaaaaaaaaaaaaaa

SEQ ID NO: 91131 - DNA, 600 bp, Heterodera glycines
  misc_feature (405)..(405): n is a, c, g, or t
  SCN-specific regions: Sequence locations=1-600
cgacggcggcgacgggtgccatcggtgatgctgctgagacggcgacaacggcacggcggcgaccgttgttcgaactgacgctggaggagagcattcgttacgcgatgaacgacccggtggaagattggctcaatcagacgctgtgtctcaactcgcagcagagtttgcccacgtctttgacggggacaccggcgcctgacaaatgcgaattgtattacgtcaacagagactcgctcttctcatttcacaaggcggcagaggtgttcttggccaatctgatgtccatttacgcggccgcccattacaaaaacagtccggacgacctgcaaatgttggccgacgcgccggcacatcacctttttgtgctgatggcacccgtgccggctgaccaaagctccgtgccancagattttggcggttgtccaactgtgcctggagggctccatctctaaacaaagtgtgacaaatgtgcgggacaaaggcaaaaagcgggcggccggtgacctcatcccgtggacactttgccaacactttttggacgacgaattcccaactctgtgcggtgcgcgcattgtccgcgtcgctgtccacccgaacttc

SEQ ID NO: 91132 - DNA, 529 bp, Heterodera glycines
  SCN-specific regions: Sequence locations=1-44,72-169,191-529
atttcatcatgcgcaacaagtggaagaaaaagcgtacccgccgtctcaagcgcaagcgcagaaagatgagggctcgctccaagtaagccccctccttctgagccaggcctaaaggctcccccggccgaccacacgcaccaaacccctccgcgtcgaccaccctcagtcccccgctggtcgtcgcaaacccgtcactttttttttcaagtaatccaagtctccgttggatcctttatctttgccgttttcgattgccgttgctgaagttcctcccgattctccaagtcgacccatgtttgccaagctcccaaaccgctcgccggtctcgtttctcatatttcaatgccgtggattcggtccaaaaacaagtcttccaggttgcgcatggcgcttcgctcgttgtcgtttgctcaaattcccacaagtgtgttccccagggtcgacctgtttggcctcgccactagctcgtgctctactctcgtcgcccgtgattcgtgtttggtccgccttccaagtcgtccccggattg

SEQ ID NO: 91133 - DNA, 605 bp, Heterodera glycines
  SCN-specific regions: Sequence locations=1-605
aacctcgagcaatggcgaaaaggaaaaggaggccgccaagtcaaagcagaccgtcgccgtcttccccgacatcgaaaacgccgaagcacccatccagctgtcgcgcgagacgacccactccaaccaccacatcttgattgcgcccgacaacttgacgctccgcggcacaaagggatactgccaagcaaaatgcaacaatggcgtcactgagggacgctggtactatgaggtcgacatcacaaagatgggaccaaaggacaatgcgcgaatcggttggtccatgatctcaagtctgctgacggggccttgcggtttcgatctcttttcctactcgtaccgcgcccgaacgggcgttctctaccacgatagccgtccccggtcaccgccggctattggcgacttggacaagttcatcagaggctatggtgcgtcgtctagggcactctctctgcactggacgcatgcaacccctgataagtctctgttgacaggtcctggcgacgtcctcggcgtcgaaatatacctcccgaaaccaaccgaacaacagaaatccattctcgactcgcgcgtgtggcggccaaaggctcgatccagctacgaagcat

SEQ ID NO: 91134 - DNA, 388 bp, Heterodera glycines
  SCN-specific regions: Sequence locations=1-229,255-388
ctgactcgaccacctccgatttcacatcaagcggctttacctcctcgtccccaacaaattgtggcactgttcaaatgctcatcggacaccagcaccaccaacagcttccaacaatggcaccgggccccatcgaaacatcgtcgtcattggccaacagtttcagcagcggttgtgcggaggtcggtgccggcggcgcggacgctggcggcggttcgtcgtcgtcggatgagtcatcatcctcttcctcatccgcgtcgacctcaccggttgtggacgaattgtccacaaatattgttggccaagcagtcccagcagcatcagcagatggacaacaacaacagttccgaaaggcctcactgcagcatcactactcaccgatgcgtgtgca

SEQ ID NO: 91135 - DNA, 545 bp, Heterodera glycines
  SCN-specific regions: Sequence locations=1-229,251-316,340-379,402 -474,496-545
cccgcgcgccatggccaaaaacgctaaagcttacgtgtccggcaccaagttccgcatggccctcggtctgcccgtcggcgccgtcatgaactgcgctgacaactctggcgccaagaacctctacgtcatctccgtcaagggcaccaaggcccgcctcaaccgcctccccaaggctggtcccggcgacatggtcctcgccacggtcaagaagggtaagcccgacctccgtaagaaggtcatgcccgccgtcgttgtccgtcaacgtaagccctggcgccgtagggacggtgtcttcctctacttcgaggataacgccggtgtcatcgtcaaccccaagggtgaaatgaagggttctgccatcactggccccgttgccaaggagtgcgctgacctctggcccaagattgcctcggcttccggcactgttgtctaagcttcctcattcctcaaggcctacatgctcaacggcatcgttgtcttcccggcgtttgtctgttggatgtgtggattttgatggctggagacacaaatacacctttgtttgt

SEQ ID NO: 91136 - DNA, 475 bp, Heterodera glycines
  SCN-specific regions: Sequence locations=1-475
tgagtccgatcttttcgccatggccgccaaattccaaacggacaatggggaacccattgagctgaaggacgattaccaagacactgacccatcgccaaaggccattccgacggaagggaaaagccgacagagtccgacgattgattttgtccatgggtcccccggctcacacaaagacttcaaatatatgatgctgccccttcgcgagaaagggctgcgttcggtcgcattcaattggtcagggatgggctacactttgttcgaccgtcgtctccgacttaccaattccgagagaaccgcctttgctcgctctttgatcgatcagctcctcccctctccaactgagttgatctttgtaggccattcccgcggtggtgagaatgcccttcgattggcccgtgaataccctgcaaggactaaggcacttctcttgctcaattcatgcggctgtcgacctcacaaaggcgttcgtccc

SEQ ID NO: 91137 - DNA, 343 bp, Heterodera glycines
  SCN-specific regions: Sequence locations=1-343
cggttcggacgattttgcgaagttgcgtcgtgctgctgactactggattattttggcatccactctgaaagggctcgaggaccacgtcataatcaatattgccaacgagtggttcggttcatctggacaggctgcacgttgggccagtggctacgcctcggtgctgccgtccctgcgggccgcatgactcacgcacctcatcatcgtggactctcctgtgtggggacaggacgccatcagcatcacacagcaagggcgcgtcaattttgaggcggatccagatcccaatttgatcttctccatccacatgtatgatgcagctgccccgtatgctgcgaccgtg

SEQ ID NO: 91138 - DNA, 561 bp, Heterodera glycines
  SCN-specific regions: Sequence locations=1-143,191-491,513-561
atttcgataaattgattaaaaaaatttccttgtaaaggtgaattgttcaaggatcatatgcacgctatcggaagtggagcaaaacaggctatttctgtgagcaaaaatatgcttttttattccttatatacttcattagcatcttttttaaacattaaacatatttaaaaatattttttaatattaattacttcttaaataaatggaattttgaggagtgcgaatggcaattccgttatcatcgatggaactgctcaacaccacaagagctgaaggaacacattggtccaatacataagaaaggaactcgtgaagcggctttcacatatgctattctttctgccggtgtcacacatgaaattggacgccgttgtcgtcttggctttctgcgaagttgtggctgttcagaaagtgataatgcgccaaatcgcgtgggcttttaacaaaaattgcacctaatcaaaatcatctgcatttgatagttattattctggttttaaatttatattttggcagatttaatcgaaaaactggcaaatatctaataaactcttgtgggac

SEQ ID NO: 91139 - DNA, 623 bp, Heterodera glycines
  SCN-specific regions: Sequence locations=1-13,35-623
caattgtatttcaatttcatttttaaatccattttgccgcactttcgcaaatgccaaaatcgaaacgcgacagagttgtttctctcacaaaagtgaagaagaagagtcgcgagggcaaagaaaacattttgaaagaggtcagagaatgcgttggtcagtacaaacatttgtttgtcttctccacggagaatttgcgctctgcaaggctggcggaggtccgccaacatttcaagcagaattcgcggattttcttcgccaaaaacaatttgatggccgtggcattgggcagatcggcacaggacgaacaggcgaacgaattgcacaaagtgagcgcacttttgaggggccaaagcggactgatgttcaccaatgcgaaggcaaaggaagtgcaaaggtttttcgacgagcacaccgaggcggagtttgcccaggcgggcgccgtcgcctcggcggacatttcgctcccggccggcccaatgccggcggaattgcacttgcacggcgccatggaaccgcagctgcgcaagttgggcatgcccacacggctggaaaatggtgccattgagctgttagaggcgttcactttgtgcaagacgggtgaccaactgtccgcggaccaggcc

SEQ ID NO: 91140 - DNA, 155 bp, Heterodera glycines
  SCN-specific regions: Sequence locations=1-155
tttggtgttccagaagtagaccgactttagcagttctattccgcggttcatcatgttctgtgcgtacgcctttagtgcgtacgtagcctccacatggaattggttcaggaaggcgctgcgctgcagcattttgcgttgctgttgagcgctgaacc

SEQ ID NO: 91141 - DNA, 620 bp, Heterodera glycines
  SCN-specific regions: Sequence locations=1-70,92-332,354-620
cccatcgtatttaacgtcgcgcctataagtgcctggcgattagttttttcgcaagaaggccaagagttggctgctctttctctctctccgccccattcagtggcacttttcttcaactacggactggagaaccttagacaacttaaaggcattgaaaggggcgacattttgatggacgccgcttggcacaagtcgaccagtgcacttaaatcgaccacaaaatttttctacactttgagcaaaaagcgccgcctctgtcgccatgccattgcctacgaactttctaatgaaattcgcgatgagatgagcaccccaataatgcaatcggcggtggacgaggaaagggaccgaatgatcgccgcagcggcgtccgccgtcgaagaacgaacggagactcttccgtctggaaatttggaggaacggagtcgaaaggaaattgaacttccggcgccgactcggcccttccctcggcatttggtcggaagtggacaatcttctggcaaaactgcgcttggttttgggacggccaacctcaagtcactgatcagctctttgaaggcagaaggcggaaggtcggccggcggcaccacagacggaggacacaaaacgccgcaatcgcc

SEQ ID NO: 91142 - DNA, 620 bp, Heterodera glycines
  SCN-specific regions: Sequence locations=1-620
gaaccttggcgcggacgtgctcaaattccgttacttcatcggctattacttgcagtcggaggaggacaaaggccccgttttggccgtctccaaatgggagacgcattcgacgccccgctgtgtgatgccaccggtagaggcgagcactgcgggcatttgccgtgccaatttgcgcgacattttcggcttcagcggcggacgcgaattcttcagcgacggatgggtgctgacggacgaaatgcaccaaattttgatgaccgtttccggcgaggcgctcaaattctacaagcagaagcacatcagggaggagtacatgctcaaaatggtgccgtttgacttgcgaaggaacagaaatgacgcttccaatgccgaggatgacgaagagccgaccgtgactgccatggacgaattgccgccgctgacccatccggctttgccgagccattctccgactgagattgccgtaagatcaaattactcgccagtcccgtcgaccgggactctcaagctgactttgttcctccgtctcggtcactttcctcccgaacttgtctttgtcgtccggtcgctccgctctctccccattgcctttttcgtctgacaatcgttgagtgtcctcc

SEQ ID NO: 91143 - DNA, 361 bp, Heterodera glycines
  SCN-specific regions: Sequence locations=1-129,151-328
attgtccgacgtcgacaaagacggacatttggactcggatgaatttgccctgtccaactatttgatcaatttaaaactcgaaggccacgaactccccacagagctgccaaaacatttggtgcctccctcaaagaaagcgatggctggcgatgcgtcgtcttccgacaaccaaatttaccctactttggatgagtgatggggcgagaattgacctacagatttctatgttttgtactttgtgactgtgaacaactccttcggcagtttcggcggcactatcccaatcggtttccctttttgtcataatatctaataaattaaccaattgaaaaaaaaaaaaaaaaaaaaaaaaaaaaaaaaa

SEQ ID NO: 91144 - DNA, 469 bp, Heterodera glycines
  misc_feature (446)..(446): n is a, c, g, or t
  misc_feature (448)..(449): n is a, c, g, or t
  SCN-specific regions: Sequence locations=1-53,159-159,182-351,376-446
tccaaaatggcaaaaattacaatcattaaattgaacgggtttaaatttaaattaacaaaaatgattaaaaagtaaaaaattaattaacgaaaaaattaaactaaaaattgccaaaaaagggcaaaaaaataaatatataaaaaataaaaataatagtattttttaaacttaaaaattattgcaagaaatttctcaaacgccctccggccggagaaaaagggaaaagtgccatttttggagtggtgccatttcttgtggtgggaaaaatgccaacaaaaaatggcacaaacactcactcattctaacgactttaattgagggcttggtggtggtggaaaatggtgaaacaataggacaacaacaagaacaagaactggggacagagaagaagccccctgtatgggttggcacatttttaatttggcacaatttgtggcgaaatgacnannaaaaaaaaaaaaaaaaaaaa

SEQ ID NO: 91145 - DNA, 630 bp, Heterodera glycines
  SCN-specific regions: Sequence locations=1-197,219-630
ccaattccccgacgccgttcttctgcccgtgctgggcaaccacgactcggcacctggcaattcgttcactgaccatcccgcaaaacagcaaatttacgagaaaatgttcataatatggaagcaatggattggccaagagggaaaggagagttttacgcgtggcggatattaccgcgtcgaaacatccgccggactgtttttggtgctgaacacaaacatttactacgaatcgaatccgctgagaaaggagcttgtggagccggaagacccaactagccaattcgactttctgcaatttgagctggaaaaggcccgccaaaagggggtgccggtgcacatccttggccacgtgccgccgggcgcatttgaagaatattcggtgaacaaactcgaaatggagcaaatcccgcaaaaatacaatcaaaaattggtcgatttgcttgttgaatacgcgccacaaattggatggattttcttcggccattaccataccgacacttttagagtgattaagaattccgacggaaaagcagtgcagcgatttttcacagcgccggcacttacgccggcatttcagaagaataacccggcatttcgtgtggccgactacaacactgacacatgggaatt

SEQ ID NO: 91146 - DNA, 609 bp, Heterodera glycines
  SCN-specific regions: Sequence locations=1-255,277-609
gtccatcgatgtcgttgccgattctgacgatcgcctccaattggatgctctgcctgacattgaccaccagccaaagagtgcccatccgaagaaaaggaagcgccttttggtggacgaacagctccaattaggaaatcaagaaatgatcgaccgttttaacaattacggcgatttgttgcgcacccgtgacgacttgcacagggaaatcattcagcccgacaagcccaccctttcgcaactgtttttacccgcgtccctatcacatcaaagcattgaatcccgaacttttccctctgtttgacactgtccgcgctgaacaccgcgaacgaccgctgacctttgacgaagcgcaggccatgacattcgaagatatgcaaaaacgtcgtttggaattcgatcttcagtcgtggcattccaacgacgaaccgacgccgctgcggcaacgcgtggaagagagttttggggacgcaggcggagagcagagacgcgaagaaacgcaagggaaagagaaagtgtcggtgagcgatgcattggtcgaaacggcggacaaagaaaaagaggggaccgcagaattggcagcacatcgtccgtcgtctgtgctggaagggg

SEQ ID NO: 91147 - DNA, 565 bp, Heterodera glycines
  SCN-specific regions: Sequence locations=1-151,175-261,294-565
gtggtgcgcatggagtaccgtatgctcagcgacgaccatctgatggtgccatttcccagtggtgtaccgattcgacgcagcctcggcacccttgggggaaatctgaccgaacaggatcgaaagaatgcgccgctgacgatggcccagtgcgtttccaaagggtctttcattaacattgcgcaaatgatcgccctggttggccaacagtccatctccggcaaacggccttctgacggatttgagaatcgctccggcctgacgcccaccgagttcttcttccacacaatgggcggaagggagggcctcgtggacacggcggtgaaaacggcggagaccggatacatgcagcgacggctggtcaagtgcttggaaggccaggatttggctgtcaactatgacaacacggtgcgcacctccaccaacgaggtggtccagttcacgtttggcgacgacggcctcgacccggcgtacatggaggcgaaggatggccgcccgttggacttccaacccatgttggctcaagtgcggaacatcaccagcaacagcacctgtcttggccaaatgc

SEQ ID NO: 91148 - DNA, 622 bp, Heterodera glycines
  SCN-specific regions: Sequence locations=1-383,405-622
cacatatttaatatttatttggcccaataattgtgctaacatttctctgtctaatgtctctgatcagcgtccaacggtcgccctcgccgattgacgaaccttcggctgtgaacgattctgactgcgaaagtgaaggccaaaggaccggctcttccggccaaaaaagtcgcacgctcagcgaatgctttttcactgtgcgcggcacggctgtcattctgccgcaccattcgaccaacgagtcgtccgcgtcgttggctgtccgctgctgctcaaaccgaacaaacgcagagggcggcgaagacagtatccaggctcatctgcacgtaatgctcaatgctttgcgtccggaggactcactgacaatggtcgtccgtttgcagtcgccttccctcgtctccccctcgtcgccccacgtgcgctatttggccgtcctctccacccaattcgacgccaccgagtcgcgcgaggctgcgctgctcggcttccatttcattgggccgtccacttccaccgcccctcgcagcgccattggaattgccgtgcccatcagcacttcctccactatttgccttgacggcgacggtggcatcaaaattgaggaggacaaacagccgaactcgtt

SEQ ID NO: 91149 - DNA, 331 bp, Heterodera glycines
  SCN-specific regions: Sequence locations=1-331
tgtgcgcccgtgcaatgacatatcgtaccatgaggcgatatgtggggctaccgaatggactagatcggacccccaaccgacccattcttttatcaaacgttattagtcattgattcatcccatacgtgccccacacattctgttcttcgtttgctcagtgttcgtgccaatgtgccccgcgcgattgccacaggcccacacttcctgccgttccgtctgctacgatgctctacatgattgcattaaaattctccacgagtgcaactttccatggtcccccgtgatccactgttgccgctttcccgcttctcccgagttgcgcatgagtccc

SEQ ID NO: 91150 - DNA, 615 bp, Heterodera glycines
  SCN-specific regions: Sequence locations=1-6,29-247,269-615
gtccaattaagccggaaaaaggaaatgtttcggattgttgcaaaacgctcgttgtccaccactcgccaatggcttcagcagccgacccatcgtccgccgtcctccgcgctcagcgctgagccgttcatgaacgccacatcaggtgtgtacattgagcaaatgtacgagagttggcagctcgaccgtggctctgtccacagatcatgggacgcgtttttcaccaatgtcaacgcgggcgccgcgccgggccaggctttccaggctcccccgtcagtcccgtcgcttagcaccgttccgcacgccacggttgtgccgcgtgacatgcgcgaggtgcagccgcaaacagcaggccaagtgatcccggccgatgaactgacacgtgccatcaatgaccatctcaaaatccaagtattgatcaggagtttccagactcgtggccacaacattgccgatttggacccgctgggcatcaacagtgcggacttggatgacacaatcccgcgcgagttggagctggacttttacggcttcactgagcaggacatggaccgcgaattcttgttgccacccaccacattcatcgggggcgaacgcgccacattgtcgttgcgcgaa

SEQ ID NO: 91151 - DNA, 606 bp, Heterodera glycines
  SCN-specific regions: Sequence locations=1-185,207-606
gtttgagaaccgtacgaaggaactacaggacatttgacttcgctataatggatttagtgcttattgtgcagcaatatattaatgaaatggtgcgattagcaggaccagggatgaaagccattctaatggacaaagaaacgacgagctgtgtttcttgtgcctatgcccaaagtgaaatgatgcaaaaggaaatttacctgttcgagcgattagattccgttgtcattcgcgagcctatcaaatttttaaagtgtgttgtttttgtccgtcccacacaagaaaatgtgcaattattgtcggaggaacttcaatctccgaaatattcgcagtattatatttatttttcaaatcggattccaaaagcggacgttaaaatattagcggagtcagacgaacaagagactgtgagagagttgcgtgaattttttgtcgacttcgttccgttggccccacatttggtatctctaaacatttctacggcatacgaaacccaacaattcggcatttccgcttcgacttttcgacggtgtttgcaagcattggttgcattggcactttcgttgaataaaaagccaacgataagatatcaaaagacatcgcgcgatg

SEQ ID NO: 91152 - DNA, 299 bp, Heterodera glycines
  SCN-specific regions: Sequence locations=1-239,261-277
ggcacaaacgcggatgggacagtgacgtattggcgctgcgtacgtacgaattcactgcaggagggcggctgccgtggctctgctcggactgatgaattggacaatatcatcggactgccaacgccacacaaccatccggccatacctgagtttttctaatgcaattgtgatgcaaaaaccaccacacaacgaaggactccgtgcgaagaagtgccatttgttattctgttgctattttatgtatttgaatccattttattgtataaatgcaaatttgaaaaaaaaaaaaaaaaaaaaaa

SEQ ID NO: 91153 - DNA, 622 bp, Heterodera glycines
  SCN-specific regions: Sequence locations=1-622
gtcagatgaaaccgacttcgccattgttatgcaaattttctttgctgacaaatcgtctcttttcgcttcaaaatctcatcaaactttttctttgaatgggacgttcgccagtgccaataaattgaaggacggagaaaaggtatttttacatccgctctctgaaaatgctttaaatcggtgtgaatcagttgtgattaatcctttggataacggcgactgggaaaaaattgtgtcttcaaccgtataaatagaagaactcctcctcggacagctccgcgtaattcagacgaatatgcgaatttgtgtccattttaaaaatgggcaaatggccaattttaccattggagaaattttcccccgcgttcaaatggccaattgcttcgcaaatggaaattccctttctcatccgcccgcttttctgatggcttatggcactcgtcttctcgttaatgcacctcattctgctgctgcatctgatgagaaattagtggagggaaacgtaaaaggaatgcgaaaagaaagcgaaagggcggcggaagggacggcgtcacttggaagggcttttgtgccggggattggttccgaagtgtccgactgtttttactcatcgatggtccctgct

SEQ ID NO: 91154 - DNA, 623 bp, Heterodera glycines
  SCN-specific regions: Sequence locations=1-623
gagagagaggaagagcagcaacgagaagagagagcggacgaacagcaacaaatgatgctgcagcagcaacatcatcaccgcaatggcgtcaccagtgacggcatcagacggacgtacgctggccgtgccagcataggcagcacagggacggcgagcggtgggcgccagcacccggtgaacggcatttgcgaatgcaagcattgcactgaagcgctgaacgacctgcattcgtcccgtggctacaaaaatgccgagtctccgaactcgacgcacagtgagggttctgccgacagtggacgagcaacgggccatttgacttcgtacagtccgtttgcagatgcggcagccgagctgggacagcaagcagcggacaatttaccaatttacgagttcgaagtgcccaacacattggtcggactgatcattggcattaagggcaaaacgataaaggagctgtgcactcgggcggacgtgcgcatgctgatacgaccacaccacacgcaaggcaaatttgacacccaccagctttgttcagtggaggggcgtcgagacaacattaacaaatgtcttcacatgatccgacttcgttttccgccgtgtcgctttcccgacctgaacttgaa

SEQ ID NO: 91155 - DNA, 601 bp, Heterodera glycines
  SCN-specific regions: Sequence locations=1-601
caagaagtgagttcggaaggcggcttccctaattacaaccgcaaccaatattttaaaagcattatcgacagtttgtcacagaagggacttctcgaagcgaatcgtcaaccgcccatcagtcactcgacactcagttttttgatggaaaggaaaaaggacccaatgtcaatggtcaacatttactgctcggcttcgggccaaggttgtgggaattttcaatggtggttttcctaatcgagactttagcaaatttgttttcatcactgaattgagaagtcggcccgtttatggcttttgcgcagcgtcaaaaaaggaggccaaaaaggcttgcgcattgcgacttctcgacattttgatgacagaagaacgactcgaatgtgtcaatttgtccggacggaaagtgaggaaaatgccgccaaagccaattccgacaaaagcagcgaatgtcgaacaaagtcaacagcaggaaaacatgcacttgtcattctctgatgacatcgacttggatgccattcggaaggacttcgaacgccttaatccgctcccatcggccgctaatgaaagtgaagtttttgctcgactgcgctcaaccgccttcaga

SEQ ID NO: 91156 - DNA, 602 bp, Heterodera glycines
  SCN-specific regions: Sequence locations=1-602
ccagttaagctatttcatgtcacattatatttctgcagaaaatgagcccaaagctgtcgaagcatctcaaccaacaaatcgtgtttttataaacaatttgacaagtgatttggaggaattcaccatctacaaatattgcactgcttatggtgagatcacaaaatgtcaaattctgaaggactcaaaaaatggaatgagtcgcggcttcggctttatcacttacgccttgccatcgtcagctcaagccattttaaatggtcgtcctcattacattggacaccataaaattgacgttcggcccgctttcccaactagtgagattgttgtttccacgatggtttcgtcgtcctcttcatcatattgcgaccaatccgacgatttgccaaaaatacttcagtctcgacgtttgttaatcgtctacaatatcgctgaggcaacgcgaaacgatttatctgaacccgcaattttcggctatctcagctcttttggcattgtcaaagaaattgtccaacaattctcaacttcgtcggaggaagcaaagcaaaatcccgtcaatgagtattggatcgttgattttcttgacgaactttcagtcgaacgtt

SEQ ID NO: 91157 - DNA, 577 bp, Heterodera glycines
  SCN-specific regions: Sequence locations=1-219,241-396,418-577
cttgtgtcatcgttcctctcctcgtggtcaccataacaatttgtgcagcaatgaacagtcggacagaagaaacgctttggctgtgtgcaattgccagcgcgctcggtgccttcgccaaaatggtggccatcatcgctttctccagcattttcggtttcacccgcgcgatgggaacgatggaaggccgacggagggaagtgacgaaacaatcgcatttactcagcggcagaggaagcccttgaaagagaccgatggctaacccactttttcatcgtccttctgatcggcgaaatacttctgatgctaacgatcgcatgcatacgctgtaatttgaagttcctaaaacagtgctttcgactcgacccctaatgaatggcgtaaaacaccaaataattggcgaatgaatgtgttttgatctccaaatttctgttttttttttagtgtatattattacattttccaaaatagcgacgaatagtctcatcaaaatgatgaattttcaggccaaaaattgttaaatagcttaaaatccatgccctagtcattattatttattgcattcaaaagacgctttttt

SEQ ID NO: 91158 - DNA, 608 bp, Heterodera glycines
  SCN-specific regions: Sequence locations=1-20,53-197,219-608
cttttgcatgcccctgcccaacccaatgacccaatgacccaatgacccaatggccatgcatacgaccctcgcccgactcgtccaaaccgccggcctgacccgaccggcctggcgtcgtctcacgcccatctctgctgccattcctgccggcaatcctccttcaccaccgacctcgcccatcgaaccctcccgccacatctccacctctccccgcctcctctccggcaacgaagatggcgactcgcgctaccctgccatcgccgcgggccacggcccctggccttttgcctcgtcccctgcccagctgcatctggccgtccgcccgctcgccaaatcctacccgtcgcacctgcacatccaagtgcaatggggcgaccaagacgcatttgggcacctcaacaacgtctcgctgatgcgctactttgagtctgtgcgcatgcaatacctgattgacttttcgcgccacttgcccgccggccagcgccactcgtttgcgcacccgacgcctggatacccgggcccgattgtggccaatgtcacgacgcggtatcgcgcgcaggtgcattatcctgacaccctgacgtactttttgcgggtgagtgagaggg

SEQ ID NO: 91159 - DNA, 542 bp, Heterodera glycines
  SCN-specific regions: Sequence locations=1-243,265-280,302-542
ggttcatttcccagatcaccccccaattttgccttatgtattttgtgggcacccaaattcaaaattggacctctcaatcgttggatgaacttgagcagttgcgcatttcggcgaatgccaagcacataaacaggtttcagtccgtgttggctgaacgtccgggcattgtcagcgacgactttttgactgcccgagaggaaacagtaatttgtcgaatcgtaagcgaatccgggataagatttgttttttattttaagccagaaatgtggccatcagtgcgttggattgctttttcttatttcaaacgattatatttgcgagaatcggcgatggaatattatcctaaaaatgtgaggatggcctgatattatttggcagctaaagtagatgacactaaagcttccattgacaattgtggagacaatgtgagaaacggcgcaaggacaggcgacacggagaccatattaacaatcgagcagggtgggacgcttaaacttaaataccattggaccgaacacccgccgcgccgcccgttggaaggg

SEQ ID NO: 91160 - DNA, 397 bp, Heterodera glycines
  SCN-specific regions: Sequence locations=1-397
gtacctaagtgaacgggaaaaagcgctgagtgttcgctatttgcatgagcgtgatgccatgtttgagcgtttttcggagtggacggagcaagaccagacggacttctgcaaacaccttctgcagagcatgtgtgaccaccagcacggccaaattgaccaatttttgggcccaatgcttcaacgggacttcattgctttgttaccaaccggattggcggagaatgtgctccatttgttggacaccaagtcaatgtgcgcctcggagtttgtcagccgcccgtggaatcgagtcattgatcacggattgttgtggcatgagcacatcgagcgtcaagtgagcaacgacgcgctgtgggccggactctccatccaacgctgatggaagaagtacttcttc

SEQ ID NO: 91161 - DNA, 501 bp, Heterodera glycines
  SCN-specific regions: Sequence locations=1-4,28-501
tgtgcattttaatttattttatttcaccgcaatttctttcctaactctccgccaatgatttttcttcttttttgttttatggtgttgtttgccttttgcggccactcaaatggccaaatgactgctgccaaccaaacttggcttgcctcccaacaggcattggcaagaaacacgggcagatgcggctcggtgagagaagcggcggacagactttttgtttcgtgaaatttcagttttttgtccgttttggcgacttttgctacttgcgctgccgacaacgcttcggcgatgacggagccaacggcgactgtcccttgggtggaggaccgtgccttatggtgaacagaaacgtgaacatttgtttgcgagttgctttcagcctcagacagcagtgaaagaggcaaagaaagaacgaaaacattggggaggaagtgatcggcagaacaaatgataagaaaaatggaaatgattgtgattttgtgaattgaattgatcaaaaat

SEQ ID NO: 91162 - DNA, 605 bp, Heterodera glycines
  SCN-specific regions: Sequence locations=1-605
atttccccgttttgttcttctttgccactcattgaccgattgtttcgatggctcgagaacgcattgtaacatcaaagaaacgacgtcatgatcgcgacagttcggactacgtggaggaatcgaagcggcgatgcgacgaagcgcggaaacggcaaatcgaccgggaggaccgcgcacggaggcgttctcgggagaagagggagcaggtggagaaggagtacgaatactacttgcaaattgcgtgttcggagtccaaaaaggagtcgcaaaaaaacggcggacagcagcacaatttcgatgctaatggaggcgcacgtcaccatcgcacacacaaccagcaccaccactcggcaattcagggcgaatgcggtgtggttgtaagcgcatcgccagcacatcggctgccgattcaggacgacaaagatggacatttgatctactcaaatggggacagaattgacaacaaatttgaaatcgtgaagactctcggcgagggaaccttcggcaaagtcgtccaagtgaaagacttaaacaacccaaaggggccgcaacgggcgctgaaaatcatcaaaaacgtgtccaaatacagagaggccgctcgactg

SEQ ID NO: 91163 - DNA, 604 bp, Heterodera glycines
  misc_feature (532)..(532): n is a, c, g, or t
  SCN-specific regions: Sequence locations=1-149,172-604
gaacaatgcaaacagtggaggaccaccgcaaatgcgcgggggtggcataacgcagcagcaacaaacggctggcaatcatccacagcagcaaatgctaggctgcgccggacagccacaggacccgaaggcgcgcaagttgatccaacaacagttggtgctgctgctgcacgcacacaagtgtcagcagatcgaacggtctgaaccgctacaaaaccgtgcgccctgcacattgccctactgctcggtgatgaagggcgttttggaccatatggtcgactgttcggccggccggcagtgtcagtacgcgcactgcgcctcctcccggcaaatcattgcgcattggaagaactgtaacaaggacgactgtccggtgtgcaacgttcacatcaacgagacaatggtggtcgacccgcgacaagctggcattatgctgagtgctgtcggttttccctctgtaactttggctcaaggcgcgattggccaacagcagcagtcgatgaacaatgcaaacagtggaggaccaccgcaaatngcgcgggggtggcataacgcagcagcaacaaacggctggcaatcatccacagcaaatgctctgcgcgggcag

SEQ ID NO: 91164 - DNA, 615 bp, Heterodera glycines
  SCN-specific regions: Sequence locations=1-523,547-615
cggcggtgctgcgctgagccgtgcgtcgcctgggcaccgatgcattggcggcggcgccgcgtgcgatgtgctgacgatggcactgccgacgagcaatgtgatcggcggtgaaacactacatggcactcgtggacactcaacagtacgaggcgtgccaccaagaggcagtgacgcggtgccatgccacagacaattggcacgaaaataccaacaaattgccgggacaggaccaaaaagtggtggtggacccaggaccacaggtgcttgcttgtctgtaccattcaggcttcgatgagacggacccgttgggcaaagagtgcgcgttgtatgttcgccaagtgttgcgcgagcgtgcggcacgcgtcaatatgctcccggacattgaggagaactgttgcgacgcactctcggaatactgcttccaaattgtgatgcttgacaattactgctcgccaaaggttgacattgagtcggagggcaaaacggtgcacagttttctggtacattcgcaggagaaggacgaaggaaagaatggactccactatttcaaaacgcaggagcgcgagcgcaagaaggcggagaaggacaaaagtgtcaaacaacgccaatggcaca

SEQ ID NO: 91165 - DNA, 616 bp, Heterodera glycines
  SCN-specific regions: Sequence locations=1-616
gatatggccgatcaaaccgacgtttttggggttgcttcgtcaagcattggaaagccaatcagagttgaacttgggacagggagcagaaaaacaattatttccggcaatttactaacgacagacccggagagcggctcaatagttttggtagagaagcgtcagcaaaataaaacatcggatcaggggaagtgcagccaacgattcattctgattcccggcagttctgttcactctgccaaattggttacaattaatgaagggacaattgggacggtaaaaaaggatggacaattggaggaagggacgaagagtaatgccgaactgcgcgagaaggcggacggaattgagtcgggggacgaagcgacaatcgaaagccatggaaaaagaaccctgtccgaaactgtgagaatctttgacgaattcgcactttcgaggcgcctttgtctgattgatgcactaaacaaatatggcatcaaattcagcgaaaagccacatgttttagtacaaaatattgacaatggacagactgagggacaaatgccatcgacggtaatttctctgcagagcggcggcatcaaaatctatccgccgtacggaaagaatgatataatcggcg

SEQ ID NO: 91166 - DNA, 247 bp, Heterodera glycines
  SCN-specific regions: Sequence locations=1-38,60-226
atcgtagcagccccactaattaatgtgaaaatatgaaaaattattttttattttgatgatgcaacgcatttgttttcatttctctcctttatgaaaagagccattcattcttcattcattgatcatttgtacacattatacacacaaaattgaccacacaaaattgatgatcggactagtataactttctgtaatatttttgatcacttttaaattttgattaccgaaaaaaaaaaaaaaaaaaaaa

SEQ ID NO: 91167 - DNA, 510 bp, Heterodera glycines
  SCN-specific regions: Sequence locations=1-369,391-510
tggaggtcgacttggacttggacaacaaagactacaagaagacgttgaaagtcacttggctggccaaacgtgccgaaaacttcgcggtgaaaacggtccgttttgatcatttgatcagcactccgatcattggcaaggaggaggactggaaggagttcgtcaatcgcgacagtgagcattttggcactttgttggccgagccggcacttcaaaaagtgaactgtggagacattttgcaaattcagcgcaaaagcttttacatttgcgacgcgaagacagccaactcaatgacactcatcgaaattccggacggcagagagacgaaaaacgcagcgcaaaaggggccagagggaaaagagacgaaaaaggaaggaaaagagacgaagaaggcaaagattgttaattgagacagtgtattcatgtggaagtattcgcaattgttttgttgtttttatttggtgatttctggtgttgattaaaaagaaagaaactgtaaaaaaaaaaaaaaaa

SEQ ID NO: 91168 - DNA, 330 bp, Heterodera glycines
  SCN-specific regions: Sequence locations=1-21,45-114,136-330
atctatatctattccaacaacaaatatatgatgagctcaaactaaacaaccaataaaaccaatactaataatagcgtaaattattcctaaataaccaaaaagaatttttttacctgtatagaattggatagttaatctaactaaaccaaaagcaggtaaaattaaaacataaacctctggatgaccaaaaaatcaaaataaatgttgaaaaaccaaaggattacctccacctgttctatcaaaaaaatttccattaaaattacgatcaactaataaaagagtaatagctcctgccaaaacaggtagagttaaaattaaaagaaaaaaaaa

SEQ ID NO: 91169 - DNA, 545 bp, Heterodera glycines
  SCN-specific regions: Sequence locations=1-249,271-545
gacaaatttcccactcagtttaattaattttttacgttcaatggcaacaacttcctctgaaaatgaccagccccaaacatcggcgctattggccccggcactcacaaggggaaatccgttcggtttgtccacattaaaaataaaccggcgccgacaagagggcaacccggtgctcaaatacattcggaatgtgccgtacgaatggtcatccgacgtaaaatgcgattttgaatgttctggtaattgtgggcttctttacctggccctgaaataccacaaactccactgcgggtacattgagactcgtttcaccgatctgagggcgtaccccgtgaaggttctgttggcttacgtcaatgtcgaagacccttcctttttgcttcgtgacctgaacatgttctgctaccgaatggacgtttctttggtcctttgctattccgtggaggaggcggccgaattcatcgaaacgttcaaattcactgagaatcgaagtgccgaaagcgaattggccagaatccaacagaacaaattgcaaagacagcaac

SEQ ID NO: 91170 - DNA, 224 bp, Heterodera glycines
  SCN-specific regions: Sequence locations=1-201
cgccgcaccggcaaggactgatcgacgaagaggaaatggagaaactgcccaaagaaccgctcaaaatctcatccgggaaccaagttaagcagtccaaaaagagaagcagcaccgcaggatgaaaggggagaaggaaaaaggagtttagagcgtttagcctttgtttttttttgtttcattttttgtcgataaatgtaatgtaaaaaaaaaaaaaaaaaaaaaaa

SEQ ID NO: 91171 - DNA, 202 bp, Heterodera glycines
  SCN-specific regions: Sequence locations=1-202
atcccccaaaaaaaattaaaaaacgggcgcgaagcgcccgtcatgaggccgccaagcggccaaatgttctcaaaaaattaaaagacgggcgcgaagcgccagttcttaggccgcgaagcggccgaatgtccccaaaaaaattaaaaacgggcgctatttttccgtcatgaggccgcgaagcggccgaatgttctcgaaaaat

SEQ ID NO: 91172 - DNA, 580 bp, Heterodera glycines
  SCN-specific regions: Sequence locations=1-518,540-580
gtcaagcagagataactccatgaatgacagcgtctactgaatgcatttctccgcctgaaaatgatgccccgtcgtctcttgctgctgcacaccttccgggcaacgtcgcccttgctgtgtgctttgggtccatcgttgacagcggcgctcgtccgagggctgcgcacatcttgtgtcatgaacagcgcagctgcgttgcagagcccaggaacttcacagccgtcatccacaagtcgcgatccggcttctgctggtgcaagctcggcggcagccgatcctcgcggaaacctctttgctgaacgcgcatccaaaaccgcacaagctatccgggatggcttctttacttcgatttccaaggccaaccgggcggtcatttctgcttccgacgccaacgctgccgacgcacccgtcacaggaatcgcctccatctcgccgtccgttgtagatgtgaacgccggccaccaacactcgatcctcgggatgaccgagccaatggcgacgccgcttgcggtctccacgctcgctccgccagcaatcccagatttcaccgttgtcagcgccggcctgggctccatgatcc

SEQ ID NO: 91173 - DNA, 516 bp, Heterodera glycines
  SCN-specific regions: Sequence locations=1-235,259-516
gtgcgcctattcacaatggtgtcattatcacgtcgccgttgcagggaaacattgtgcatttcgtatttcgggacaaagactcgccactcttcgcaatgccacggggactttttgtctgcaaaaatccatatggcatgaaaaatgcacaaattattcgactttaaaaaactctggagttcggcgatacaatcattttcacggccgaagaacgaacgaacacagtgttggattacgagaagggactgcaagtgtttgagacggactgcaattatggcaaatatttggtgaaatcggtgtgcattttgccacccgccaataaagacccttcgcgctgttggtgtgactatttcggttggattgatttaactaagaagcaaagtgaagagttgcacatgcgcgccatggcggacgtgcccatttacacttgggtggccattgagatcctcagggacagagttgtgccgaaataccacgattttatcgaaattgcggtcgatgagcgcaaaaatgtgtggg

SEQ ID NO: 91174 - DNA, 614 bp, Heterodera glycines
  SCN-specific regions: Sequence locations=1-614
gtttttgtcattttattttctaattgattatacataataagttgattggaatggtggaccatccgcgacgcatttttaagcaaatttgcatttgcgccgatattttgttggactgtttccgcctgttggcacctgccaaagtcggcttggcattggcgttggtctccgaccgcttcgatgtgcttgcggacacgcatttccgaagcagaaaatggccaattggaaatttggggatttgccgggggaaaaacggcgccgcaattcacaaccaaaagggcggcgaaggtcgaacggcagcagtgaaacgactgctgccaattccgcaagtgccgctgccgaacggcgtggtcggattcggacgcattggcctcggttacatcgacggcactgtcattgcctttctccgtcgcattcggcgccttttccacacaaacggcgtcactttggaactgagcttttcctcggttgagggccgcagctgcgacgcttttgcctcttcgatttggccccttttgaatgccgcggccatcgtcgaaatgcgcttcaaagtcaacaacaatttgggctatttgcgctcgcgtctttcgccctccattctgcgcgactgtgccaat

SEQ ID NO: 91175 - DNA, 286 bp, Heterodera glycines
  SCN-specific regions: Sequence locations=1-286
gattgaaaatgagacagcacctgatgactacgcggcttcctctgctgatctgcgtcatcgattggcttgtggattggccgaaggaacagaaatggtccaccaaattccgctgaatatgaacggggacattaccggactaatcagcttcgagaagggatgttacattgcccaggaactcgttgcccacacgcatctcactgccattgtcagaaggcggctgatgcccttccgaccaatcgatgacaaaaatggacgcccagatttccctagacggatttctgctggg

SEQ ID NO: 91176 - DNA, 605 bp, Heterodera glycines
  SCN-specific regions: Sequence locations=1-517,587-605
ggccagtgaatgaatggatgcgccgcaaccccaagcattagcagagcctcagccttctcgcgacaacccacccgctctcgcacttggttcttctccgcaagtgcgcacgtctgcagtgcagtccatgtccccagtcggcaggatcgacccagcatcttccccgttgtttgcatccaacctccctgtacatccaattccaagcccgaaaatgccgtcgtccaccgcccgctgtcacgtctcccgccggccacgcctggcggtcctcgccggactcgcgctcgcggtcatagccgtcatttcggtgcaatcgccgcgcttggccgtcgccgtcgctgcgcccaacccgcagcgcagagacggtgggatcctcgaccgcatcttgcccaaccgcgacggtggcggcaatgacgactcgtcatcgacgccgaccactcctttgcctccaccatccgggaaccgcaacggtggcagaaatgccaacgacgacgacattggcattttgccgatcgtcggcggaaaccagagcgaaaacgaaaacgccgacaataacaacggcggcggcagtagcaacaacaacaatggcaacgggggtggccgcaacagtg

SEQ ID NO: 91177 - DNA, 605 bp, Heterodera glycines
  SCN-specific regions: Sequence locations=1-53,95-134,162-162,215 -331,353-359,398-542
ttccaaactccaccctcccgtcaaccatggctaccgaacgcgacaaccaagtctacatggccaagctctccgagcaggctgagcgttacgacgagatggtcaacttcatgaaggaggttgccaagctcggcgtcgaactcaccgtcgaggagcgtaacctcttgtcggttgcctacaagaacgtgattggtgcccgccgtgcctcgtggcgcattgtgtcgtcgattgagcaaaaggaggagaacaagggcaactctgctcaagtggacaagatcaaggcttaccgccaaaagatcgaggccgagctctcggacgtgtgctctgacattctcgccgtgctcgaccagtacctcatcccctcggccgaggctggtgagtccaaggtcttctactacaagatgaagggtgattaccaccgctaccttgccgagtttgccgccggtgacaagcgcaaggaagccgcgtcgtctgcccatgatgcctacaagcacgccacggacattgcccaaaccgagcttgccccgacccacccgatccgcctcggtcttgccctcaacttctccgtgttctactacgagatcctcaactcgcccgaccgcgcgtgc

SEQ ID NO: 91178 - DNA, 465 bp, Heterodera glycines
  SCN-specific regions: Sequence locations=1-268,290-465
gattgttgccagagtgcgtatttgatgcaaaattgttgtccaccgctctgtcatcgcgcgtcccaaaagtgttggcatcggatttcccatcaccggcacttcacactccgtcgtgctgccattgaccaattgttaaaggccaacgagcgtcgcttcatcctttctgatgaccaccagcagtcggtattaagagtggacgttgcccaagtcgctgcaaaccgaccaatcgaggacttttactccgcttcaaagtgtctctattccaatgcctttttgtttggcatttttgatggccatggcggagcggcgtgtgcaaggcacgtgtgcacaaggttgttcgactatatttgttgctctgcgctggacaaacaccgagtggtgcaaatccccgtgggggaacaaatccaatggcttggggccaatgccccgcacagtcttccacaagagaaggacgacgcccatctc

SEQ ID NO: 91179 - DNA, 615 bp, Heterodera glycines
  SCN-specific regions: Sequence locations=1-615
aaggcttggagctttatgaacgacggtctgcggacggacatgtttttgcgctacaccccggagacaatcgcttgcgcatgcattcaactcgcggtccgaacagtggaccaaccaattgtgttgcccaccgaaccctttgcatggtttgaactgttcgatgccagtgaccgcgatgtgcgcgccatttcacagaccatttgggagctgtacacgcgcaaaaaggcaccaaatttgaaatgggtttcggaccatttggagcagttgtaccaaaaagcggtggttgagccggagaaggcgcgcaaggagaagacaatggtcgaaatgcgagacatcaaggaacagattctgcagcgcaaaagtgcgatgcttttcggagcaggaaaaaccgtcgctgacgacagatcgccaccgaaacgtcgtcgccgagacatggccggacaaaatgtcgccgagacaaaacgtcgccgggacagaacgccaccgagacaaaacgtcgccgagacaaagcgtcgccgggacaaaacatcgccgagacaaaatgtcgccgagaaaaaatattccaaaaattaattcgaaaattgttcttaaaaaccatttttttcgctaatacactca

SEQ ID NO: 91180 - DNA, 555 bp, Heterodera glycines
  SCN-specific regions: Sequence locations=1-555
gtcttttttgtacaatattcgagtcaatgtcctcgcttttcgattccacttgggaaggccatctccaacatatcaaattttggcgcagcgaagtgaaacgatcactgggcgagtccatttcgaatgtccaattggtgaagggagcggacggaacaatggcagttgttggccttgcgactgcaccgggcgattcggcacacgtccaaatggtcatgcaagccgaactgcccgacatttctttgggctacgacttcgagcaggacgagacaaagcaaaggccgactttggaattgcagccgctgttttcgcataaaaccgaagcggagcattcgacggacgcatcgcctcggaaaataccgcccgaattggcgttgcattacgaaagaatgcgtggccaaatggtggacggagtggacgacttcaaattgcacgagaaaagcggcgcggtgctcttcaccaccgccaaagaaattagcatttttaagggcggcgaaatcaaaaacatcgctcagtggcgtccctcgtcagcggtgctcaatgtatccttttgtgaga

SEQ ID NO: 91181 - DNA, 253 bp, Heterodera glycines
  SCN-specific regions: Sequence locations=1-253
caaggcgaagagcaaggacggcggaagactgttgcgtgaacagctccatatgtacggtgttgagctggcgttaggacgacgaaaacagagcccattgagctgcttctcaagtttggtggagcaggaagcagtgcagttggccacggactttcgtacaatttgtcagcgcgattatcccatccaagctgttgcgacgcattctcttgctggtgttaacaatggtcaagatgcttacattccccgtatggaattg

SEQ ID NO: 91182 - DNA, 428 bp, Heterodera glycines
  SCN-specific regions: Sequence locations=1-152,174-181,206-358,380-397
gttttgcagaatatatgatcaaattctgcaccaaaacgtgtttaaagtgtggcgaggctacgacgagcaaagcgaacggcgcaaaatctgtggcggcggtcggaccaccgcccatcgaattaatcattgaaccgatgatggagacaaaccacgaaaaggggagaaggagcagtaacagaaacaacagcagcagcggggggaggagggaatgtgtggacagaggcgaaagatgcatccaatggaagggcgatggactgtgcgatgccaaaagtgggacgactaaattcaacagaggacagcgaagggcgtgtgccaaaacgtgcggcgattgcaaatgatcagaagcaaaagaattacataaatgtacaattacttattgtgctttgcataaacacctaaaataaaaaaaaaaaaaaaaaaaaaaaaaa

SEQ ID NO: 91183 - DNA, 527 bp, Heterodera glycines
  SCN-specific regions: Sequence locations=1-332,354-527
catttgagttcggtcctctttttgccactgttacttttgctttccaaattcacaccatcatcagtggccactgaattgacatttgaattgcccgacaatgcaaatcaatgtttttatgaagaaattaaaaaggatgttgactgttcgttggaatttcaggtggtcactggaggccaatatgatgttgatgtggtgttagaagatccgaatggcaaagtgttgtacaaggaggccaggaaacagttggacacccacacgtacaaaacagaggccaacggcacgtacaaagtttgcttctccaacgagttctccaccttctcacacaaggttgtgtacctggactggcaagtggggccggacgagcagcacaaaatgatgccaattccgcgggccggcggtgcgcaagcgacgcaaatggagcgcagcgcggagacaatcagtgaccggctccaaattgttgacgattatcagacgcaccatccgctgcgcgaggcgacctcgcgcaagcgggcggaagatttgaatga

SEQ ID NO: 91184 - DNA, 611 bp, Heterodera glycines
  SCN-specific regions: Sequence locations=1-110,132-260,282-504,526-611
gtttgagaaggaccattttttcgcttttttatggccaaaaaagggggcggaaatgcggcggaagtgcccgactcattggacgaaattaaccttcgcataaatcacacagccgatgagtctttggaaagtacgcggagaatgttggcctattgtgaagagagcaaagaggcgggcatcaaaacgttagtgatgttggacgaccagggagaacaattggaacgcgtggagggaaatttggaccaaataaatacggatatgaaagaagcggaggagcatctgaagggcatggagaagtgttgtggcctttgtgtgttgccatgtttaaaaggcaacgacttcgagaagaactcggagtacgcgaagacgtggaaaaaggacgacgacggaggagtgatcagtgatcagccgaggatcaccgtgggcgactcgggcatgggcccccagggcggatacatcacaagaatcaccagcgatgcgagggaggaggagatggacgagaacattcagcaagtgtccacaatggtgggtaacctgcggaacatggccatcgatatgtccacggaagtgtccaaccaaaacaggcaattgtcacgaatccaagaaaaggcgct

SEQ ID NO: 91185 - DNA, 352 bp, Heterodera glycines
  SCN-specific regions: Sequence locations=1-352
ggacccatccgtgaaagggatgattactttccctcaagacgaggaaggttcacccgtgacagttcatggcgaaatcagtggtcttgagcctgggctactcggcttccatggccatgcctacggagatttgtccaacgggtgcacttgcgccggcccgcatttcgatccaacaaacaaaacgcacggcggaccgcatgatcaaatccgacatgtcggtgatttgggcaaagtccatgctgggcccgagggaattggcaagctgacattttctgaccatttgatttcgctgtgcggagccaacaacattgtcggacgtgcgcttgtcgagcaacaatccgaacgacaatttggg

SEQ ID NO: 91186 - DNA, 262 bp, Heterodera glycines
  SCN-specific regions: Sequence locations=1-262
gaagcgcacttttcctaaatttgtctagcgtggagtagacttataactgcttctggatatgaatgggaaacaagtccaccaaatgattcccgcccgtcaacgtcggaagatgaaccgcggattgtgcctacagcccaactcttggctcgatctgctgcgaaatgcatgactcaattgtccccagctgatgattgcggagtgcgggaagactcatttgcgagatatgatcgtgctgccggagatggtcggctgtgtgggtgtg

SEQ ID NO: 91187 - DNA, 607 bp, Heterodera glycines
  SCN-specific regions: Sequence locations=1-361,383-424,459-607
ttaagatttttttggggttccctccccggacgacttgcccaccagccgagtctaattgcttggcacattgtgtggaaaattcgaagaattttcaggcctcgaaattaattgtgattgttgtgattagtcgttcaaaatgggcgccacagaaagcgttgaacacagcaaaagcgatctgcagcagctgaagggcgatatattcgtcaatgggagacctctccccgaccaaattcgccaacgaatcgtcgctttggccatggacggcatgcacccgcgggacatttcgcgcaatttgctcgtgtcgagcggatgtgtttctaaaattcttgcaagttgtggcaccatcgatggccgttccggaccccaaatgctgagtcaagaaatcgtcgagaaaataacgctgtataaaactgaatacccgtccatttttgcttgggagatcagggaccggctgaagcaggacagtttgtgcacggcggagactttgccaagcatctcgtcaatcaacactgtgcttcgttcccatgcaatattgtgaaagcagcagatgaaaagcaaatttgacgaaatcatgaaagaaaggagagggatgaatcggcaaacaaat

SEQ ID NO: 91188 - DNA, 261 bp, Heterodera glycines
  misc_feature (235)..(235): n is a, c, g, or t
  SCN-specific regions: Sequence locations=1-216
gtaaatacaacatctgaacagaccgaatgcgaatcgagttcgacacgcttttctcatgaaattgttttggatgacgatggcgtcgactgtccatccgttgttagagacgaattgccggcgaaaaagccgaagagaatttgaatgaatagaaatgaagaccttttatttcttttcgggtattcgttttgtttatcgtcgctcttttttacggtgctcaataaatttatacatttanaaaaaaaaatttttaaaaaaaaaaaa

SEQ ID NO: 91189 - DNA, 352 bp, Heterodera glycines
  SCN-specific regions: Sequence locations=1-285,316-326
gctgacatggatatttggtcattggttggctcaaaattgaaagtgctcggtgaagtgaatctctctaacgaaacctatcgcggcattgagaactcagagaaatattgtggggcgagctcgcttatcacggatttctttaacgtgatgaattgtggcgatgacaacggagaaccggtgacaaaacgcataaaaccgatggattttggagtgcaaagaatgcaataggacatctgtgagccattgtaaagaaagagtcttggaacttttaattgtttcccaattgtaattcctttctttatttatttgctttaaaaatacaatatgacaaaataaaaaaaaaaaaaaaaaaaaa

SEQ ID NO: 91190 - DNA, 614 bp, Heterodera glycines
  SCN-specific regions: Sequence locations=1-614
atttcttatttatttttcataattgaatatggaggacgttgaccgaatgattgttgaccatctggtcaatgacttgcgctgttcttttgcggacaaagtgctgaaattggctgattttgattccgcgcacattgtggagggcattatccgctgcatttggcggtgtcggcccgaaagtgtcgccacttttccctccttccaattgcccaacaatcccattgagcggtttcgtcttgcgtccaaaatttcgcgtgaagttcaggcaattggcgtccgtgaccatcagattggctaccaggccctcttgtaccccaacgttttcgacagtcggcacatttttctggcacttttcgagcattttccaaaggaaacagtgaaaccgacggacgaaaagccactgagtccaattgaaaaactgagggcggaagttggcgttgtaatcgctgaccaactgaagggcgaatggacacccgaattttgtcgcttttacgatttgcaacggatcggccgtttgtggtttccgtctggcagaaaagcggaggaggaaaagcaacacagcagcgatgtttggacgacggtcatttgcacgggacaacagccgaaggacggccaaa

SEQ ID NO: 91191 - DNA, 532 bp, Heterodera glycines
  SCN-specific regions: Sequence locations=1-532
cggtgatttgttggccaattctgttaaggatgtgatggagacattggccatggtcgactacccgtacccggccaccttcttagcaccgttaccaggatggccagttaaggaggcgtgcaaagcctactccacaaggctgggttcacagcacggtctggcgatggcggcacatgccatgctcaacctgttctacaattacaccgggcaacagaaggatttgtgcctgtgtggcaatgattgtccgggcacattcagtgagcttggcgaccctgacggatggccttggcagtcctgcactgaaatggtgatgccaatgagcagtcatggcccacccaccgacccattcagtgcctcctgtccttaccatgtgcgcgacagcttcagatggtgccaggaccattttgccaagttgggattccgtactgaactgttccggcctctgtggggaatgattaactacggcacagaatatccaaccgcaacctacattgttttctcccacggatggctggacccgtgatcaggcagtgcg

SEQ ID NO: 91192 - DNA, 617 bp, Heterodera glycines
  SCN-specific regions: Sequence locations=1-617
gaattgttaaaatgagtttggttgcccgttttttacgtccgtccaatggttggattttttcatcggttttcagacagcagcaactgttgcttctcatcgcgcgaccgtatgcaagtgatgccattgcaagtgacggtggcaatgaaaaaggccgaaatggacgacactcatcagcggaggacacccatccatcttcggcgcccgcagcggacacgcaacatggccagggctggatttcgcgcattttgaccggtcccgcgggggcggaagggctaaagcaaagccactcgtctatgctttctgttggcgactccatctacgagctgcagacgcatgacgctgttggtggagacagagacaaatatttgggtgcttataaaaagtatgcccaagaagttagtgctgcgacgccgggcgccactttgttcggcagttggcatgtgctgttcggcaaccaagaccaggtggtcaacctgtggcgctaccaaaatgggtaccccgatttggacagccacatccgggcactcagctccaatacatcagtgaaaagtgccgagttagactacgccagactgtgccgacgacggcgtacagtcatcaccaagccgttcagttat

SEQ ID NO: 91193 - DNA, 316 bp, Heterodera glycines
  SCN-specific regions: Sequence locations=1-246,268-316
gactcacatggtcctcggcattgccttcgtgtgctctctgatggctatgatcgccacagttggctgtctgccatctctgtgcgcagagaggaccccactgaacagcaaactgcgctgcggagttgaggtcttccccgtcaacaccgagtcggactgtcactgtgttgacggacgagtgaggggagcttgacgacgtcggcgaatccccgttgatatcccctggaaatccgtctgccgtagggaacgggcactgggcggacactgggagcgcgatggcctccaagagccgagcggtcccaactggccgcccggggcg

SEQ ID NO: 91194 - DNA, 537 bp, Heterodera glycines
  SCN-specific regions: Sequence locations=1-3,27-180,203-246,268 -372,394-509
caggaagcagacgaagaggaggagaacggggagtctcaggagaagcatctcgactcggtgctttacgacgagggcgcatttttggtgcttccctcaggtgctcgcattggtcaccggtcgttggtccgatactttcgccagcgtttgggctatggccttggcgacggtggcagcggcgattggaactctaagcagcagcagcggcaactgatgcataatgccaaacagtcgcgcattttgaagcaattgggtggccctgctgtggggggcggttgttgttcggttgccgttttagaggcgtccgttaaagcgcgtgcgcgcgatgtttcgttcatgaagcggacggtggcgcggtaccaactcagacgcgcgttggcctccaacaaattgttcaaatcacgcggccgaaatgatcaacagtgatcggaagcaaatcaatcgcttgacgaatattattgttgatatattacgagaatttatttgtttacacatttcccaaaatattggagaaaaataatataatcaaaaaaaaaaaaa

SEQ ID NO: 91195 - DNA, 609 bp, Heterodera glycines
  SCN-specific regions: Sequence locations=1-42,64-241,263-609
gcggcattatggagaagaagatcgtctacttaaagctgttccaaattgtgttcactttgaccatcatttggcaactcctttcactgcgccaattctgcggcacttttgccgacccaaaaggcttcctcaatgaaacagttcgccattgcaaaggctattcgctcatcggaaaggactcaaaaactggcaaatacagctcaatgttcaacaaattgttcacccaattctttatgagcagcccaactgcagaacagcgacaccaattcatggacgaaatggccgccaaattgccccccgctggacgccattgtattccaatcatgattacgccttttgactggttttttgactgggtccgcctctacagaaatcccctcaacaatgacactttgtttcttttttcaaaactatttttcaacgcattggtgtcgcttggctgtctgtgcattgtcatcatggaaatgttacgctctgtggaagaatatgaatcctcgggcattttactggccttcgcttctgtcttgttttggggtcactctgttgcgttctcattcaatttgctgttcttttggtcgcacttttggacttgcttcaacttccgtgcggatc

SEQ ID NO: 91196 - DNA, 621 bp, Heterodera glycines
  SCN-specific regions: Sequence locations=1-69,91-103,125-244,309-621
cactcgcatttttctgcgtttttttcgccaatgcccaaaatccgtcgtttgccagcgaatttttcccttcttcgccgggtttgctgctgcccccagtgccgggggatgaacagaaagcaaagaatactccgacggaagaagaactgatcggaaaattgctaaagtcgggcgcgggattgcccccgggaccaccggcggatttgccgagcgacggggaggaaaaagcagcgaagacgacggacggagcagcggagggacagccccaacaaccgcagcaacaacaacagggccaacagcaacagcagcagacggacacggaacagcccattcagccgatgcctccggcagtcgttgccgaatcgccctcaatgcctcagggcaccgatggcggcgcgcccgcggcaccgccaaattacgtgcaatgtttacttaaaatcgcgccaaaagtgtgcgacccgggaaacattctgaacgcacaacaaaagcaagagattgaccaaacacttgcagaattgaaaatggccacgagaaaggaggacgcgaaagacgaatgtgccaagagtgggctggaggcgatgttcatcatcatcaaacactcgaaccttctcgacgaacagacga

SEQ ID NO: 91197 - DNA, 625 bp, Heterodera glycines
  SCN-specific regions: Sequence locations=1-202,224-435,458-625
acgaattggagccaaatgacttatcgggacggagatcgcccgcaacgcaaaacatgggtccagaaacaaacggaagccaacaaatccacgccgactttgaacctttcttcttccggcaacggcggtccatcagtcgaaggacggacgagggacacgcatttgagtggggacgaattggctgataacagtccgcaaaagggacagcaacaaattttgaatcagacgttcaccaaatcgtcgaccaaagagtacgacagcgcgactctcattgcgcctgtctcaaatggcaccgaatcgctcaacaatcgcagcggggggttggtgctcgaggacgtctgtgactcaaattcggagatgacgccggaaatgcaggcaaagcgacgcgcgattttggccagccaaattcgacgcaaagagcgaataatggcgaggagtgaggagaaagagacggaagagatggaccgactgcaggtcaaaatgcagcggatggagcaggcggagatgcgcaggatggagcgggagcaaaggcgtcagaaactgctcgaggactacaaaaaaaagaaagtggaacaggaatttatgctaaagcccggctcggatcgggcgtgcgtttcgtccacaattt

SEQ ID NO: 91198 - DNA, 655 bp, Heterodera glycines
  SCN-specific regions: Sequence locations=1-547,592-606,629-655
ggaacaccaaatcccaactgatgagcggacagagtgcacagaaagacggaaagatcgccgccacaattctaatcgacccggtgactcagaagagtgccaacattaccatccgaacgccggcgcaacagttgcgcatggagcagatcgaagtgccgtacaaagtgcgccctttcgcttttgattcgccgcggagtgcgcaacagaagcattcgctggctcagctggtccacccattcgcttcaattcccccccccatggaccggttgaaggggcaaagggaacttttcgaggatttgtctaccgggcccccctctctccaatggtataccggggggggcaaaaaggggggtcaaaccccccccatttggggtggttgtaaaaaaagtgccccacccccccaaaaaaaaaaaggggccccacccggtgaggggtggaaggttccccccaaagaaaaatatttgggcctaaaaaaaccccggtggtttcccaatttttttttttaaaagacaaaccccccccgggagagtgggcccgcgggttttttttgtgggggccaccaaaaaaaggggggttgtttctttttgggggggattttttttttcaaaagggggggggggggggggggccctaaaaaaaaacaccggggggttggggg

SEQ ID NO: 91199 - DNA, 618 bp, Heterodera glycines
  SCN-specific regions: Sequence locations=1-618
gcaatccatcgttggtcaactattcactgtttcctcgcgaggaacactcccacgaagtcgtgcaaacgtcgggagaggcaatcatggcatttccacccgagcaaattgagcaagcgattgaggacgggcgcagcagcaactctgaagtgctgttagccgcgctgcaggacgtgcaaaagtacatgaaggagatgggacatgctgcttcaccacatgaagcagttggtaccacttcgtcgatgcaatcaccgaccatggacacgccgccgccactttctgccgaagatgcacaaccgatggacaccagtgaggaattgggcaaggagaagccgaagaagcggctcaaagtggagctgaccccgcccagagagacaaagcctcatcctcgaatgtcgttgaattcgcgtctcagcaaccacactggcgacgaagttgttgacaatgagagtcattcgccggcggtggcgacgccgccggtgccgaaaagcaaaaagcgaaccgccgcctcgctcaagcagaacgacagcggcaacaacaagtcacttagcacattgattgaggcggccaaaatgatggaaggcggctcttcatcggaagagcatcaccaggacggagtca

SEQ ID NO: 91200 - DNA, 524 bp, Heterodera glycines
  SCN-specific regions: Sequence locations=1-524
tttcgagtcaccgagcgcatggccaattattacggagtcaatttgttgccatgccttacaggcaactgcgtggatccttcgttgttttggtctgcttctcctcctttgagttcagcgccaagccgtccctccacctcagcgtctatcaaaagggagccgccgtccaacgtaccatctccggcgcattccgtggacacaacagcacggaagcctattggcggaggacaacttaagcctgctgatgacatccctcaatttacgcacttctgtgggcaaaaaattgagtctgtgctgagcgcttactccgatttgttggagtctctgaaagaaccgccactttctccgccgttcactgttggccagttcgtgctgttccgtcatgataaactcggcatgtgccacgggacagttgtgcgtcaggacagtcagcatttggttgtgaagcacttggtcacgcaagacgcacactatgtcaagatggaggccattttcgcctttccccaccaacttttgaaggagtgttc

SEQ ID NO: 91201 - DNA, 438 bp, Heterodera glycines
  SCN-specific regions: Sequence locations=1-387,409-416
gggattggcgaattgtatcggtcgatgttcgtctccgcccaggtcaaactccttcagagatacgttcccgaactgaggccggaagacgtggagaggggattggcggggattcgagcgcaggcgatggatgccgaggggaatttggtggacgactttgtgtttgacagcggagaaggacccttggccaaaagaatgcttcacgtcagaaacgctccgagccccggggcgacgagttcaatggcaatcgcacaaatgatagtggagaaaagcacggagaaattcggcatttaattgctcacacataaaatacggatttaattgggcaatgggcattttgcacttaaatattaacttttttttgttttgccattccaatttttgaagctatttttgtggtaaacatttttatcccttccaaaaaaaaaaaaaaaaaaaaaa

SEQ ID NO: 91202 - DNA, 621 bp, Heterodera glycines
  SCN-specific regions: Sequence locations=1-390,413-621
gttacatgagaggttccgtcgcttcaattgatttgaacacattttttgaggtcgatcgcatctgctcatggattttgtcaaacaaatttcaaaggactgctttacaactgcccgatgaacttctcgaacattcattccatctcgtagaagcggttgaacatagggtggaatcggcaggaacttgggaagaacagagggggaggctgtatgtgttggccgacacgtcctatcgaagttgttgtctggatgagattgcggctgaacatgtcgcgtgcgactccatcgttcactttggagacgcgtgtctaagtgcccgcagcagttccattcccgcgctatacattttctgcaggcacccattcgaattggaaaaattcgtcgagcagtttcgaattgaattttctgaatttggaactgaaaaacagtgggatgactgtttactgttatgtgaagccgcctatacacacattcaaaattcacttggaagtgccatttctcgcattcttccgccgtctgttcgtctgttcaattttgaagtgtcggagccaaattcgccctcttcctccattctcgggcgccaggtgccggtcggattcgtcatcgatcagtgttctgagaaaa

SEQ ID NO: 91203 - DNA, 269 bp, Heterodera glycines
  SCN-specific regions: Sequence locations=1-61,85-149,177-246
attttgttttgtgccacatttgtatgccattctccgccattgattagaaattttgattttcttaaaaaatatatttttttaaatgaacattttgttttgtgccacatttgtatgccattctccgccattgattagaaattttgattttcttaaaaaatatatttttttaaatttttgtgaattgttaccaccacttttcgttttggcaattttgctgatctggtcacatatataataaatgtgcactttataaaaaaaaaaaaaaaaaa

SEQ ID NO: 91204 - DNA, 627 bp, Heterodera glycines
  SCN-specific regions: Sequence locations=1-316,339-553,575-627
gtttgagataaattaattttaattctctcagtatttgatattccttttatataaacgatattttacttcaaaaatcggacatgggcgatgatttggtttttgcagtgcgtggttctttcgggtattctttacaatgcggtataaagtctcctacggaagtgattaacgaaaatcttgatcccaaagatagttcttgtcgctgtttcacatttagcaataacggcgtctacttcgcttattgtaattcgaatagcactacaatcgtcgaatcatccactggccgaaaatgtttttccgcagatttgggcaaaactcaatgcattattttttctcctaaagacagttttatggtcacttatgaaccgtacgtgatctacgggtctcgtaagaattccgatgggtccctcaaaactccgaaccccaacctccgtttctggtcagtgccaaatggcgagctgttggccacagttgttgcagacaaacaggcagtttggaagccttacttttccgctgatgagtccttaatgttgcgggtgcttggttcggaagttcatttcttcaaaaatggaaattttgcaaaggctgcacacaaagttgtggtcaaagacatcgcttccttttcgatta

SEQ ID NO: 91205 - DNA, 651 bp, Heterodera glycines
  SCN-specific regions: Sequence locations=1-13,37-651
gtcctccaaccttcgccctcctcgtcgtcctccacgggcagcactttgggacagcagcgactgatcgaccggtgtgcccaccgtgcgcagcacaaacaacgccgaaatcacagcgcgacagccttcgattcatcttcgctttggcatcggttgggcagtgcgctgtcgggacagaacgaaacgcgcggcggcggcactccgccgttcgtcagcggacttccggtgcgccaagtgcgctatgaccacgtgcatcgtcgcggggctttgttctgtcggacgggcagttggttggaaatggtcggagagccgggcgaacggatcgaagtgcgcggcacgcggagggaaaacagcaaattcactctgctcgaatttctggcagtcgcttttggcctggtgtccattcggtcagtgaccaaccgccactttctgtgcatggactcctcgggacagctgtatgccgcacctgccagccgatactcagccgactgtgtgttcatggaggaaatgatgcacaattactacaatttgtactcgtcttgcgtctacggaagtgcgcgaagtccgtggtttgtcgcattgcgacggaacgggcaacagcgacaaagacggcacagccgaagacgggaaaagtcctccccttttgtcattgtg

SEQ ID NO: 91206 - DNA, 578 bp, Heterodera glycines
  SCN-specific regions: Sequence locations=1-181,204-490,512-578
gtttgagatattttttcacaatgaatgattcatggataaaaaaatatctgtcgtcgccgcttcaatcaacgagtttttcgtcaagtgtccaaacttcgtcgagttttacacaatttgataagataaatgttcagaatttgagttttacgcctttgagtgttccgttgccttccccgctccaaaatgttcaacatttgggccttactccattaagcagaaatgctagcattcacagagaaaagaatcgaaaacgccctttctcaccgctggaaaatgaccttgggtcggtgtgttcaatcgccaaaattaaaagtccaaaaactccgcgtcatgcagtcaaaattctcaaaaaaattgactacgaagaccgtgcttcttgctatttggtgcaatggaattgcggaagtgcggaggaaaagggtccttcgacgacgtgggaatgggccaataagctgtcaccgaactgcagaaaattggccaaagtttttgagcaatcaatcgcaaaagacgcgaaaaaagcgtgggaattcaccgactacgaagtggaggccattttggacagaacggtgcagggcgaa

SEQ ID NO: 91207 - DNA, 591 bp, Heterodera glycines
  SCN-specific regions: Sequence locations=1-591
caatccgaagaaagcaaataaagaaatggagaaagcgatcttcatctctgccgattgttggctcgaagtgttcgatttgcttccgccctttcaacttggccttggaattgctatgattagccgccaatttgactattacgtcgacgaacattttaaaacgcgcaaatggaaattgggcaaaatgaaaattcgacgcaaaattggacagaatggcgcaaatgaaatgaaaattgtcaattccgatggaaaagaattgccaatccctcaaaatccgttgccgaacaaagtcatcggattcagagccattcagatcatcttcatcgaccaaaatgtgatcacttttcttggccggtttgaccgctttttcgcttcatgtacaacaatgttgttcattaccactggaaatgttcgcgtttcggagttcgttctgcacaacatttggccgatgttcaaggacacaattcgtctgatggatttgaattccatcgcttttcgtcaaatgcgtcaattggccccgtcaatgctcaacgactgtccatcacttcgctttttcaatttctatgacggcatttccctcgaatttccgcccga

SEQ ID NO: 91208 - DNA, 624 bp, Heterodera glycines
  SCN-specific regions: Sequence locations=1-97,119-624
caacattgtcgactcgttgggcgagccccagttgctcgacgacttgagcgaccattggacgtccgacaaccacgtggtcgagcgcgacaacgtcatcatggccctgcaagacctggccgcaaagtaccgcgtgcgcgtgtcgattgtgtcgggcgacgtgcattgcgccggtgcgggcgaggtcggcccgcagatgggcattgccgtgacgcgcgaccaagtgcccgcgttcatgacccaagtcatttcctcggctgtgggcaacgtcagtccgccgtggttcgtcatcaagggcctgcacatggtcagcaaacagcgtccgattggtgggtccgattcgctcgtcgagcgcatgatcaacgtgttccacaaggacgtcaacggccgcaacattgaccgcgacgagcagtcgctcatgggcaggcgcaactggatgtcggtgttgcctgaaggtgccggcgcgagcgacgagtccaagacgttggcgttcacgctgcacatggagaagaaggtgggcgatctcaagggcgagacggttgattacacgattcgcgtgccgcacgttgtcggcaagttgcgcccgaggatggccgagttgcaggagcccgtcggcgagatgcacat

SEQ ID NO: 91209 - DNA, 165 bp, Heterodera glycines
  SCN-specific regions: Sequence locations=1-99,126-165
acttcgccacgctccgcaacgcaccgctgctgccgcagaaagcgacaccgatggtgaagcagaaggatggattgccgctcttgacgattcagatggcgccaacgccgacgccgacgccgacgatgaccaaggatcgacgtccgcgcctcagcagggtagtgccga

SEQ ID NO: 91210 - DNA, 439 bp, Heterodera glycines
  misc_feature (1)..(1): n is a, c, g, or t
  misc_feature (8)..(10): n is a, c, g, or t
  misc_feature (21)..(21): n is a, c, g, or t
  misc_feature (49)..(49): n is a, c, g, or t
  misc_feature (51)..(51): n is a, c, g, or t
  misc_feature (62)..(63): n is a, c, g, or t
  misc_feature (71)..(71): n is a, c, g, or t
  misc_feature (85)..(86): n is a, c, g, or t
  misc_feature (92)..(92): n is a, c, g, or t
  misc_feature (94)..(95): n is a, c, g, or t
  misc_feature (100)..(100): n is a, c, g, or t
  misc_feature (103)..(103): n is a, c, g, or t
  misc_feature (127)..(127): n is a, c, g, or t
  misc_feature (142)..(142): n is a, c, g, or t
  SCN-specific regions: Sequence locations=1-439
ngaacgcnnngagaaggaaangcgccgaggggacgaggaaaggcagcgncngcgccacgagnncgaggggnaccgccccgccgcnncgcggncnncgccnaanacaacggggggcacgcagcccaangagggaggaggaagnccacggattttttttttgggcggcggggcgatggcgcgccattcgcctatttacgacccggacttggaaaacggaaagagcccactgatcaaagacgaaagtgacgggaaaacgttgagggtgagattcgacggcgcccaatacagacctgaggaagtgacggggaaaacgggggacaaccggttggtggtccatgccaaacacgaggagaaaacgccaagccgcacgggctatcgggaggacaatcgggaaggtatgctgccgcgcgggaccaaccctggaacagagcagctcaac

SEQ ID NO: 91211 - DNA, 241 bp, Heterodera glycines
  SCN-specific regions: Sequence locations=1-139,161-174,196-241
aacgatgtcgagcatttccagcggcgtcgacttaaccacaaaataccagcgactcgccgttgaatatgttaaggtgcggaaccaagtggcggtgcttaagtcggctttggtggaagaacagtcgaaaagggccgatttgggcaaggaaatggcacagagagagacgaaactgttcaaattggagggcgaaagggactcgctgctattccgcaacgaacagttgctgaaacgggtggaggga

SEQ ID NO: 91212 - DNA, 514 bp, Heterodera glycines
  SCN-specific regions: Sequence locations=1-199,222-514
tttggccatgtccaccgtttccatgcttttgttggcactgttttgggaatggacaatgccaatttttggtgcccaacactctgtggccatccttttgctcacttttctaatggcattggtgtcggccacttcaaatgtgctgtttctgcctttcatggccactttccaccccaattatctcaccgcttatttcgtcggcatgagtttcagttcgttggtgcttttttgctcaaactgatccaaggtgttggcaattacgactgtgtaccaaatggcaccgcgaacagcacacttgttgctgtttacatggaaccgttgttccacattcggctgtacaacatggccatgttcgcttggatgtgtgccgcaaccgcttcgtttgcctttttgtattggaatgggcggaggaaagcaaaaaggacgacaacagcgggggcaaaggaccaacaaccagcggaaggggaggaggacactgaagaaggcggctccgacaatggcacgacaggggacggca

SEQ ID NO: 91213 - DNA, 393 bp, Heterodera glycines
  SCN-specific regions: Sequence locations=1-393
tacaagcaggaaaaggatgacaagcgagtgaaaaacttggataaaatgctggttgaatatgaagtggaacgtgccaagaaggaggagaacttccgtgcccaacttttctcggaaaatgccaattttgaggaaattccgttgccgttgggtgcgcctggcgctatggacgctgccaaaacacccttttctttgccgctgccgaccggcattacccctggggacgtgccgctgccgtcgggtgtccaactgtttgcggcgatgcgggccagcattttgaagaagacgggcgcgacggcaccgtcacaaaaacggcacaaacatccgccaggccctccgcccggtctgccgcctccgctcgccgtcgccgcttcttctgacaacgacggggaagac

SEQ ID NO: 91214 - DNA, 548 bp, Heterodera glycines
  SCN-specific regions: Sequence locations=1-193,215-548
gtttctgacattacactgctaaaatgggcaaacacaaaaagccgttcattgaccgcaaaagtgcagtgaattattctttacacaacaaacatttggaggaggcgcagcggaccagtaatcgtaaaagtgttgcgaattttcgtccctttgataaacactttgaggatttttatgagggatatgcgaatgaagcggaggaggacggagcggaggaaatgcatgacggagaagggcaaattgagaccgatcctgcgcttttctcttctctgctggcggatgggcaatcacagcgatgtggcgaagagcgttttcagcgggagctgcctgatcccgaactgaagagcgcggtgttgcgctatgtaaaagcgatggaaattggcaaaggaagggccgagccgacggaggacattttggtggacaatgcgaagagaaaccgttgggattgcgagtccattctctccattcattcaaacatttacaatcacccgaccgaaattagggagccgatgaaagtcattgggaggcgaaggggggggacgacgactaat

SEQ ID NO: 91215 - DNA, 513 bp, Heterodera glycines
  SCN-specific regions: Sequence locations=1-513
taattatttctcaaatgacttctcaagcggcggaacaggaactcgaccaatgtttgaaggataagtgttgcaccgccaccaatggcaatgggcacgatgccggcgacgacggcaccgccttccaaagtttgcccgattttgccgaaacggtggcatttgtgcaccaatttggcccactgttcgagctcagcccgttcagctttgacgatctcgcccaggcactgcaacagcttcaccatccaactttattttagtattgcccgccaaattcgctgctcgacaatttgttcgccgaaattttgcattactgtggctacaaatttgaccggtccaccctgtacaacagtttgcacaagctgatcagacgcgtcaaccggtggacagcgacaccatttgaggccgatttgttgtaccaaaaaagcggtggtggtggtccccaaattggggccaacaaatttgggcgatcgaaacaaattattcatcaaaataataataataataatgaccgaatgg

SEQ ID NO: 91216 - DNA, 663 bp, Heterodera glycines
  SCN-specific regions: Sequence locations=1-663
attttgtttgttttttatttgttatttccttttttgttcttcgtctttcccctcgtcacaatgggccgtgctcagttcgaatacgacgaagtcggcaacacattttactatgtgattgtgtccttttttgctgtcatccttttcccgctcacccattttctgtggccatcgctgccaaagaggacggaggtgctgaagaggggctgccgttgcgagggcgacctggtcaagcggtttcgcaaagagcatataaagccgtgggagaaggcgaaatgcgtgatcaaagggtttgttctgctcattctgtgggcactgttcattctgttggcctacaaagtttcacaattggaacagacatttgaggagtatgacccgtacaaaatactccaacttgacgtggacgcggatgttggcgagatcaaaaagaagtaccgcgagctgagcaagcagcaccacccggacaagggcggcgacccggtgacttttgacggcattgtcaaggcgtacaaagcattgacggatgaggagtcgcgcgagaactggcgcctctacggcaacccggacggacccaaagccacaacctttggcattgcgttgcccaagtggattgtcagtgagcaatacggcggttgggtgctcggcttgaacgtgttcatcttcttg

SEQ ID NO: 91217 - DNA, 530 bp, Heterodera glycines
  SCN-specific regions: Sequence locations=1-462,499-530
atttaacagtctcctattctttgatcagtgatttaacagtctcctattctttgatgtgatttgatcggtctcctattatttgatcaattatctgatcagttttctgttcaccacctggtgttcgtacgttctttccgcgtcgtcaggaaaataaatgcatgccaacccaaagtcggcaattcgcacttggtttcgcaccgtcaccaaaatgttgtccggcttcaggtccttcaaattttagtttggcattaaatgtcatgaaattcatgcttagtcagtccccagcataggtcgattttcaccggatttcgctaaaaaatttttgacaaatttgatcagcttttttcactttattttccttaaaaattcaaaacttttccgctggcgcctataaaaacaaaaattttattgaaatttccaaaataaaaaaaacaataatttgatattttcctccaattcttcataaaaattctatttttttttttaatttctaaatttggaattaatctttcccgagggtataaagagtg

SEQ ID NO: 91218 - DNA, 499 bp, Heterodera glycines
  SCN-specific regions: Sequence locations=1-96,118-256,294-450,473-499
gtttaaaaccttctactaatcaaaaaactgtcaataaatttgtatctgtattttgacaattttggtagaaaaaattgaaaagcatggctaaaaaaatttttggtgagtttttccaaaattgttttatcctttgaaattttaaatgattctgatttcattttactgacaatttatcattatcactttcctttcctctgaattccatttgtctcaaattgttctactgttttttaacaaaaactatccacagagtaagtaatattttattttattttaaattttaattatatattcctcgcaattcgatgtttcttttttaaaatttgactccatttgcctacttaatttatacacttatacatcatcacatgtttttttgcagacgctcaatcactctcccgattgtccactttcgaactctgatcgctcttggtttctaatccgtgtactttgtttggattttgtgttgtgttgtgctttctgtttcatgttgaaaccc

SEQ ID NO: 91219 - DNA, 618 bp, Heterodera glycines
  SCN-specific regions: Sequence locations=1-474,496-533,556-618
ggggaattatttttccaaaaactaatttttcgaattttgttttaattgtccaaaaccgatttatgcatgcaattacccaaaaccacaacataaatgggggtcagtcaaatttgactaattgtaaaaatatcaaattagttgtgaaagcttttttggagggttttctatcgggttggctgaagataaatacgggcacctattttgaccaatgtaaaaccccgaaagcaaatttgaataaatgttgaaaaagggagacaaccatattaccagtctaaaataagtttggaaatataaaagtgagttcctcttttgattttaatgctcctaaacccgaataatttcctcatttgtctcactaaaatttaaatgggtgtaagaaactaacgccagtcgaacggcgattcaaaattccaccaattgtcacttcgggtctgtcgtcacttccacaaaaacctgtatcattttcgtcgtctgacgactgatcactgcccaccagcgcaagggtaagaagcaaaaccaaaataatactgaaaattgggggaagttagactagaaaaaataaggtttgaaaaccctatcaaagtgaaaaagaacggttgggttgaagccgaacacaga

SEQ ID NO: 91220 - DNA, 489 bp, Heterodera glycines
  SCN-specific regions: Sequence locations=1-141,164-171,195-489
catccgagggggaaaaacattcgtaggggacggaacggcgtactacacatggagctgctgaactgcatttcaccgaaacttaacgtcaccaggaaaagcaaattttaatcgaactttttgtaattttttgtgtaccaatttcaagaagttcccagaaaaacctaagattgcattaaaaataaaattcagaattcggctattaagttaaaaaaaatttatcggcaacctttgttctgcaaaaaaattttctaacaaaatttcaagcaaaaaaaaatggatcgctgaaaatttattcaaaaatgttttacatgccctgttccaaggtcaggcattcgtctaacaataaatgttcacttttagccaacccgttggtggacaaacttggcacgctgatcactttgccgttgtccgaaaccattgaatttgaaagtggctttgatgggtcgtcgtcagcgacgagcacaaccgcatcagtgttccttgtcgaaa

SEQ ID NO: 91221 - DNA, 617 bp, Heterodera glycines
  SCN-specific regions: Sequence locations=1-382,405-472,507-520,543 -546,568-617
tgtatcctcccattcattacacagcagatttaatagtcgtccccatcgccacaaaatgaccgttccaaggtcaaacagagccgtgctcttggccgccgtcgttttcgtcaccatatttctcggtctcgcgcatttccatctcaagactccctccgagtcaacagcagccgtaaagagcggagtcgacgagcccgcgccttttgtccccgagaaagaagccgccgctgctgtcccgactttcgtaccctgagaagatgaggagattggcgcgacacccgctgttgaggtcgtagctgagacgccgaagcctgaggagcatcaccatgctgttacgcctgacaagcctgaggctgatcctgcggaggagcctagcgatcctgaggagattgctgaggctgaggagcaggctgcgaatgcctctcctactcccgctgctgctgcttcgcccgccgctgagccggagaaggagcctgaccacgaccatgaccacgaccaacagcacgaggaagcgcacgaccacgaacatgaacatgaacatgatcccgaaagtgaagaagagttcatccccgaaaccgaggttgaggaaacacctgaaactcccgccattcccgaagcgc

SEQ ID NO: 91222 - DNA, 656 bp, Heterodera glycines
  SCN-specific regions: Sequence locations=1-351,374-381,413-656
atagaagaagatttaagtgatacatgcttttatcgagagcccaattggtcctcttattatatctaaaaagtgctcgggaccttgatcagcggttgctcctttgagaaaaaataaaaaatagtgatcaaaggcgtctgattggcttctgtctaaaatattttgttctatgttaaacgcaccatcatgaccgggtccattgtggcaccaatccaactcagtgtgcccagcgtgccgacaatgatcgacccaattgtggtgccggccatgaggacggtgcgccaatcgtggcccatgaacacggcacaaatgaagcacctaggcaacaaaatcattggtttcgtgcccaatgattgttaaatttctatatattttttctcagagaatttaacaaaatgaaaataaataaaattacggttttttccatttcagttagccatttttgccggaaatttttagggcttttcataaaaaaattcaattttttaaatttctaagtctctcagtctgtacacgtacatgcacaacagtgtggccagcccggattgccatgcgtcggttggcatattgtcgatcaggtcgaggaaaatggactcgtcatggaacacggaggcgttcagatcagcgtaacggtccacaacagaacgccagtccattag

SEQ ID NO: 91223 - DNA, 605 bp, Heterodera glycines
  SCN-specific regions: Sequence locations=1-137,159-183,208-605
tcgggtgatggaataaaagtggtatttgcataagagcaaggccaccattcaagtacatttggggaaatccattttgcttttaccaattcagtacccgtcttttctcgcattaattgtgttgggtttaagtgacttagatcttgctttggattggcattttgcaaaataccacaaattagattcaccattttttgaaataattcctttgtttctttattttggtaaatagctcttgccgtcaattgtgcagctgctgttgagcttttctcgttctggtctaaaggtttttcctttggccaccattgttctcttttgatcctatgggttgtcttacccgtaattatcctaaattgccacgaggggactgcaaaaccttgatcgcttaatttaagcgtgtgaccgcatgattctacactcttagcattctcttggaatgatagagcgaactgtgaattttttgatatccacattctcttagtgaatttcccattttctgttgttactttattgtaaagacacgctctttgatgctccgtggaatcgaggtttcaaattagaatcgcattatcctcccatcgacatgaacccttttgaaaatttgcatt

SEQ ID NO: 91224 - DNA, 447 bp, Heterodera glycines
  SCN-specific regions: Sequence locations=1-447
ctcaacaaatggaacccgcccattgtcacgtgttctcttgggaattgaactcgcgcactccgctttgctatcgcttcaatttgggcattagtagaagtgtcttttccaactgtgaattaaattccaccaatatcaaagtgaacagagccggatggctggagaatttcaggccaacaaatggaacagttttggcacggttcggaaaaataccttgtaatatttctttcatctttttagtttgtctgttgcgccgaatttgccaaatgtatctgcaattgaaagtgctgggaaaaacgcattttgggtgggccgtgagaatggcacgatagagagggtattaattttggatttgaatgtttgggccaattagtatattcagtggacttctattaacgaagcgcatggcactggcgggagtgagtctttttccctcctttggtccctctc

SEQ ID NO: 91225 - DNA, 479 bp, Heterodera glycines
  SCN-specific regions: Sequence locations=1-231,264-479
tgaaggtcaacgaactgagaaacgtgttggagaagcgcggcatggacaagactggcatcaaagccaatctgatcgaccgacaaagccattctgatcgaccgacaaagccattcggatcgaccgacagagccattctgatcgaccgacaaagccattctgatcgaccgacaaagccattcggatcgaccgacaaagccattcggatcgaccggcttgaccaggaaggtagccaaccagtgttggtggtggtggtaatgttggtgtcatcggaatgctcatgcggctgttgtcgtcgctgttcatgacgcaccgacccaactacgattggccaaaccggtgatggtggcggtgacaacaatcacagccatggaaatgatggtgctcagcaaatggaccaagatgagccggacatcatcatcgagacgtccaagagggcgatcaagatagagttttgagggtggtgtgctgatcaatctctc

SEQ ID NO: 91226 - DNA, 605 bp, Heterodera glycines
  SCN-specific regions: Sequence locations=1-15,37-159,181-605
atgtaaaaatggtacttaaatttataaaaaaaaaatgctgacatttgctaataatgttacggttttcacatcaattacggataatacggtcgtatcagcaagctttatgtggaatgtttcaacgaacgcgagaagtgtttaacggtcatcggagggggcaaaatggctactgctttagtgcatggattagtttccgctggttttatcgacaagtccgaagtgaatatctgctcaagatccaaagaaacggcctttcgttggacggtttttaaagactgcgactgactgggaacggtttttaatttcagacacaaggttaccaaaatgcatatacaaatgatgaattttacagcaaagtgaaaaagccacgtggaattgtgattgtcgcagtaaaaccacagatctttcccgggtttctcgacgaactgcgtaaaaatggttggcttaactttgttgggcctgaagtgctttgtgtgtccataatggctgggattgcacttgacacctttaaacagcagttgaaattggttggtttcaatggccatgccgcccgttttatgccaaatgtgaattgtctcgtttctgctggtatcgttttggtctgt

SEQ ID NO: 91227 - DNA, 628 bp, Heterodera glycines
  SCN-specific regions: Sequence locations=1-278,300-628
gttgttgtgcttcgttggacggagtgttcgcttttgctatggcggacaaaaagttcctttatttgggcagagatccaatcggcgttcgccccctcttttatggcttcgctggtcaagctttgctaattggttccgaggttaaaagtattgagaaactctgcagaagggtcaactttttccccccgggcttttgcgcacaaattccgctgggctcaacattctcaacagataatcagcaaatcgcatttcaacaattctttcaaatcccttcaattgtcaattattccatcagtgcttttgatgcaaaagcaattatccgcaaattgttggttgaggcggtcgaaaagaggctaatggacaatcgccaatttggctttatgctctccggggggttggactcgtcgctaatcgccgcgttggcaactcgcttcctccactcgaatgacttttgcgcttctccgatcgcattttcagttggctttgaggactctcccgaccttgtgaatgctcgtaaagtggccgagtatttgggcatttgccacagagtgttggtgatcagtgctcgagagtgtgtcgaggctattcccgaagtcgtcttttccttagagacattcgatccgctcgtcgt

SEQ ID NO: 91228 - DNA, 344 bp, Heterodera glycines
  SCN-specific regions: Sequence locations=1-39,61-278,300-344
gaggaatgaatggaggaaacgagagaattgtaaaaaacaagagaaagagtgagtgagagacaaaagtcaaagtgacaaagggaaggaagaaccgagttacatgttgaaattacttgaagcttccaaacgatgacgggctgaatcaaagtccatggcaaatgcgattggccggacaaagcgacgaactccaaaaactcatccaccaaaggcgggtcggaagacgaatcggtgattgactggtggtgaacaaagtgatttgtaaatgattagtcgaagctggtttagggaaaaggggggagtcgaaacaccaccccgaatagaaaaccatcacaatactagtgatg

SEQ ID NO: 91229 - DNA, 517 bp, Heterodera glycines
  SCN-specific regions: Sequence locations=1-517
ccaaagtcaaacgcatcggttcactcattacaatttcgaactgcttcaactcccttcagttcggaaattgcccgaccattggtgttccatcgcttattttgagttagatactcagtcgggcgaactgttcaaagtgccatggcaaatcaaagaggttgcaattgacggcggaatggacccttccggcgctttgtccgctcgcttttgtttgggcgcacttgcgaatgttcaccggagcatcggaacgggcacgaatgcacattggcaaaggggtttcgttgaaatttgctgacaattgcgaggccgtttttctcaaatgtctctcccaaaaaagcgttttcgtacgaagaggcgactcgattgttcacaaaatttgcccgggcgtcgagcgaaaagtgttcgaccttcgctgggcgtacgtcgaaatgtgccgtcgacgggaaaatgcccaactctccgctattgcccatgcgtacgccgtcgccggctttccctcgcaaatgccctcgtcttcgct

SEQ ID NO: 91230 - DNA, 434 bp, Heterodera glycines
  SCN-specific regions: Sequence locations=1-144,166-434
tgcctctgcgatttgtccgttcgcattccgacactttcggtggctcgtcgactcatttggccatgaccgatccgatcagtgcggccaaatacaaaatcaactacttcctattgccaaattttattattcactcgattggcctttcctctctgtgggccctttggtattacttgaggttcaccaatgtttttccttaccaccaccgcgtgttttattgccgtgacgttgaccttttcaagcctttttttgcccccgaggactttgagcttttcgtctcttatcccctcctttacgttctcggctttaccatccctccaataatcatgcttggtggcgaactcatgttctggcttttttccacaaaaccgcgaaaaggcgtttacgccacttgcggcgagtgcaaaattgcgctgatcactccccggttgtttcgc

SEQ ID NO: 91231 - DNA, 369 bp, Heterodera glycines
  SCN-specific regions: Sequence locations=1-32,75-369
aaacagcaacaattccattggatgactttttttaaaattaaaaataaaataaaattaaaactatcaacaaaaatgtgagtgcaaattggtaaagcatgtacaaagcattatttgtgggacataaagcaacaattgttagttaaatcttgtcaaatggaagtccgcttgagaatatgagttgtgtgaatttgcgtgccttttgtatatcttaagtgcgcgacactaaaacgtgaaagtacatgaaaaatgatatccatcacattttgtagtaacagatacatcatagcaattgtcgtgagaaaaatgtgtgttatatatccaacggattcgctcagttgggcccgtcaggtttgggccggcacgtttggg

SEQ ID NO: 91232 - DNA, 568 bp, Heterodera glycines
  SCN-specific regions: Sequence locations=1-568
aacacgtggcggaaccgcacccgcaaatactgagactgatgaacaacattggcattgagtcgagagaaaatcaaaaatgccattcaagcggacgcctatgacaatttccacgcgatttatttgcttttgttggaacgccttcggggccatccgctgtcgcgcagccattccgcctccagtcatgccaatcatcctctggtcaactctccctccgcaacttctttgccctcgccgaccgcgccacacgcacaagcagtactcgcgagtccgaccacaaaggcggcaccggcagttgttctgacggagtcggcaggaggaggagacagcggagaacaaagaccaccgatcattcggggggttacgattcgtcgccaatccgatggcattgccattgtgggcggtgccgtgccgtgccattgctattgttgcagtgctgcccgagcacatccgatgctacagtcaatacagccgcaatacgcgcccttgggcatcatgacgcgatttgcgcaacatccgcagacgcgacgggacagtgacggaatcgcaatgcaatttgcatatcaaatgc

SEQ ID NO: 91233 - DNA, 598 bp, Heterodera glycines
  SCN-specific regions: Sequence locations=1-24,257-540,563-598
aaatgcttaatttatcaaactaactataaattattgtttaatttctataaatagatttttaaattattttataattaaaaagttgaaaattgcaataaattcattttaaattttaaacgaataaatatatttaaaaattttctaaattttacatgaattgtcatcggattttaatttaaaaaataaattacctaattagctttaaatttaaattaaaaaattttaatttttaaatttaattttataattttaatttctctgaccgcaaatcgtcgcattggttcattgagttggcaaaaatcgcggcaaaattgggcaaaattttctgtccgatttgtccggtggttgaacagcggaaaccgcgtgctgaccaactcgtcaacgcgtgccgcttccgcgagcatttgggggcgcaaaaaattgtcgtcggcacggcgcggcaacagcaaaacgaacacgccgaacggatggccaaggccttgggcgttgaaaaagtgctcctttgaaaagtggcaaaattggttacaattggccaaatgttgttgatcggagtgtcagtgttcccaattatgtccccttttcggcatattttttattg

SEQ ID NO: 91234 - DNA, 612 bp, Heterodera glycines
  SCN-specific regions: Sequence locations=1-263,289-304,328-612
caattaatgacattttaaatcgagcaactttctcgtcctcattccaatttcgtcctacagctccaacataatcagtaaacctctcagcccattcatcaaaagcaatcaccgaatcttcaccaaatacttccaaatgtccaatcattccggttaaagtgttaactctgccaagttcaaaactgtcttccgcaaacggatcaagatattcctcgttgtcttggcttaaattggcattattgcatgaattaaaacgaacatgagaagtttggtttggtgttattttgggtttgacaatttcagcaagtgtatcaattttagcatttaaaattcccatattcgtgtttacttcccctgccattttatttaaggcccttgtgtttgcatatgcccttcgatttacaattcgaaatgatctatttacagcttcctctaggcgtagaacttctatgtgggctctttccaaatcgggaacctttaccgacgttttaccattccaaaaatttcggtcaatgattgttatgtttatttcttcatccctctcttgactggtggccctagagccagtctttcttgagtgtgacataagccacaaaaatgtgcactgattgctat

SEQ ID NO: 91235 - DNA, 577 bp, Heterodera glycines
  SCN-specific regions: Sequence locations=1-15,38-577
tttttcccccgatccattctccccctccaaatgacacctctctggagggactttcactgcttttgttccgaaaatattacatgctcgccgcattatgcttcggctcctttctcttcatcattttgatcaacgaaaaaaatcattttcaccacaaaatgacaccaaatcacttaacaaataatgccaaagaaattttcggggcaatctttgcaacgattgacccaaaacgaattgcggaaaatttgcggcaattcacaaaagagccgcacgtggcggggacagaagcgaataaaagggtaaatgaacaaaagaggtaaaagactaatgcacgctaattgactaaatggaggtggctgagaaaattgcaaagatttggaagcaaaacggaattgaagacgtgcattttgtctcctacgacgtgctcctctcctaccccaacttctcttctcccaatcatctctctgttctgtccgccaacggccaagtcaatttccgcacggacggagtcagtcccgaacttatggcccccaattcggaggacctgcgctcgtccatccaatgggtggcatattctgcc

SEQ ID NO: 91236 - DNA, 367 bp, Heterodera glycines
  SCN-specific regions: Sequence locations=1-337,359-367
aggcaccattgggatgtgcgcgtgccatgatggagtttacgcgcctgagcagtactatttgccgcgtgccatccgcgacattccgccgctctacgacaaggagtacgctgatccgatgtactcggatttccctctgaagccgctctgtttgccgcccgtgcacgggatgaacaagcggctggtgtattgcctggccgaatatgaaccgctgctgtattcggccgacatgacttttgactagtggataccaatggtcaaagacattcgcaagtcgaattctgcctactacggattcgttgtgctccacggcaccgactcattggcatataccgcatgcgcattgtcatgtatgatggaaaacttggcc

SEQ ID NO: 91237 - DNA, 543 bp, Heterodera glycines
  SCN-specific regions: Sequence locations=1-543
gctggttggatttttacatctgaaaggtcttgtgagggcccggagccttctttcgaagggcatccaggaccaacatgggtccgccgcagagatgcccacttattggacagcgatggagacgatcgagccatgtacatggtcgggttgagctggcacaatctttgccattcagggagcacacctttggcccaattaatgagcccccggtcgtctgtgtttcgcaccactacatcctttaaagcggactcctccacggctgaccactgctgaaccctctgggtccggactaggccggattgagcgcaggcatttataggaatagttataccgttttgcctttgaatcgctaccgccttaccacggggggccgcgggattggttcggttttggccgcaccctccctctcggacctcatcaggggctggtatcccggcgtgggtcggcgtcttgtcactgcgggctctaaagagagccatttgggttaaggtttctctttccaaatcacaggatatcatttcgctttgatcgcttttcaaatgtatt

SEQ ID NO: 91238 - DNA, 604 bp, Heterodera glycines
  SCN-specific regions: Sequence locations=1-330,352-465,496-604
gatcatttgtcattggttggcatcgtttttaagccctatgctgtcgcccgggggcggtgggggtcaaatccgcccattctctcccctttccccgctttccgcccatttccttcgcttttcgccatttccttctgacgcctcttaattattctccatggcagagcattaaatagcccaattttgcccatttgtgctaattaataactgataatttgttaattaatgcccacggcatttgttggagtgcagcgccaacagcaaatgttgggcacaattttggaggaggaatggatggacgaggagctgttttcgggtgcacaaaatgaagagcagcggaggccatggcacaaaaagcagcaaaaagcgaattttggggccaaaaagacaaagggcggcggcggaaaggaaaggggacgagtgggcaaaatggtcgactggtggatgggacgaggagaccaatggccgaacgaagcggaggaggaggagggagaaaagcgggacaagcaacagatggtcacgctggccaagaccaccattcagttgagtccatcgtgggaaagggacggcacaaaaatggcggagaacggcatggacagggacacga

SEQ ID NO: 91239 - DNA, 328 bp, Heterodera glycines
  SCN-specific regions: Sequence locations=1-328
ccattaccacgagaattacctctccctgctttacctgtccatcagaatgctcttccgttccattgaattacttcaagcatgttggataagtcgatgtctccaaacgcatgattacgatttctatgactggggcgtcttcatggacttaatcggagggaacgcgtggagtgactcgggcaatttcccccggttgactttttgtgacatcgacgtacgaattgtgggcgcaatgcaacggcacactgtccagtgcattttggagatcaacattttgacgtaaaacgcgtttctgttgatgtggcataggtactccctccttctgatgatt

SEQ ID NO: 91240 - DNA, 571 bp, Heterodera glycines
  SCN-specific regions: Sequence locations=1-101,123-249,271-365,387-571
aactgcagttgttcatgaaaacgatggccatggtccggaccaggacggtgttgatgctgatttgttggacctgtctgacccatatctctacatgaaattgtgtgtttggaatgcaaaaaatattatgaaaaaacggccaattttattgcattttttggcaattaggagtgagaagcttctggaaacaaaaattcacattctaaaaaaacgaatgtttcttgccagtaaagactgttttaccgtaacccgtaattgcaaacttctttaaaatccgtaattcgttttcagccgttcttttttggatgcggagaaaaagaaaagcgccgcactgttggccaaggaaagtccggcggcggcgagtggcggaaaaaagcagcagcagagacagcaccacatttcgatcagcaacagcagtacgacgacgacgaacagtagtgatcagcacaaccaacaccaaaatcagacaggaaataggacaaggtgggggacagtctcagaaggcaccagttttgggatgattagcagtgggggactcattgggtttttcgggattgcggcttgcttggagtcg

SEQ ID NO: 91241 - DNA, 617 bp, Heterodera glycines
  SCN-specific regions: Sequence locations=1-327,350-617
atgaaacgcgtcgcattggcccgactccgttgccaacttttgtgccgccttcacgtccgccaacttcgcgacaaccgacattcaccggactgaactatggcccggattgggccgaaatcgagcgcgagcgtgagagggcgcgggcacggaaattgcctccaaacattacagtggaaagagtggcggatgggttgccgatgagttggccgacacaaacgaccacagtttcgaacggttccaccagaacattccgtccgcccttaacacatcggccaaaagcggcacagccaatgccaacgacgccgaggccatatttttcgcagacaacagaagggccaacaacatggagcagtacatcgacagaaacgtccgccgatcgcttcgccaaaatttcttcaacgaatgtgccaaagggcacaacgtcaaagtcggcaaaggaatttggtgaaaatggagaggaagaagaaacactgtacgacgacagcatttgctgggaaacgatgatcggacaggagattgtcaagctggtcaccatggacctgtacattacgattatctccattttcctcatcgaatttgtgcgtggggtgtggatccggtactgctccacctggtgg

SEQ ID NO: 91242 - DNA, 319 bp, Heterodera glycines
  misc_feature (165)..(165): n is a, c, g, or t
  SCN-specific regions: Sequence locations=1-319
aacctgtacacttgcaagggacagctgcacttttctcctccctttatgctacgacgaatatctcctttatcgtcctcttttcgggctcgacgattcggccggcacgctgggtgcaatgactcccccaacgcccgcctcgctgcttttctccttttggcccgatanaccccatattccccctttcgaggctatcgttggaggtatctgccgcgtgctttacgacactctccgtccgctggtcgtccacaacccgcacctctaaacactgggacaactgtgcactcttttgaaggtcaaaatgatcgacgagcgctgtgcc

SEQ ID NO: 91243 - DNA, 535 bp, Heterodera glycines
  SCN-specific regions: Sequence locations=1-224,246-535
agaggatacccctggttttgaattgattcgaaacggaacgaccagcatcaaggtgcaatttaatgagcctataaaggacggcgggtatgagatgatcgttctgggggaatttgattcgattttatctattaatgctaatcgtgtgctcagtagcgacggaagcatatgatgaattcttatgagattgaaatatttctatccaaacatccgacaacccgaaaatattttatcggggtttttgcttccgacaagatgccaaaattgaaggacaggcattttccgtactgttttgtggcgaatactgaccgggcgggcacgataggtgaacactgggtcgcctgtttgtaaattcgccgacagaaattaaatattttgattcattgggcaattatcccaatgaagatttaagttcataccttaacttatttgaacgaattctcattaacgaccgcatcgtccaacatcaattctcagatgcgtgtggtcaattttgcatttatttcttgacacagcgctgctccggaatcccttattg

SEQ ID NO: 91244 - DNA, 515 bp, Heterodera glycines
  SCN-specific regions: Sequence locations=1-515
caagattgtattaacgcacttcatgtacgaatttcggacaacttctcgcagattattgcctttttgcgcaactctttgtctgtcaaatcagaccgaaggaccggccgtgtcatcagttggcttgagtcggtgaagtgttccgtggttggcctcgtctcgtccctttgctcttccgacggcgattgcaccgccgccgcctccgtttcgttggatcagctcagagcacgcattttggaggtgtgccagagtcaatgtgacagcaccgatcagcaacagttactgctccgccagtgccttttgctcgccctcgccgatttgcgacggttgcgcaatgtttgtgcggctgacgacacttttgtagacacattgagcgaacattgcgagtccgtctttctgttccgttacgttggcaggcattgcgcacaaatggagcaacttttgcacgacgaagcactctcagtcaaattcatcttcctcaaagtggccgaatctgtcccgtccattgtttttgggac

SEQ ID NO: 91245 - DNA, 496 bp, Heterodera glycines
  SCN-specific regions: Sequence locations=1-496
agtcagcctcgtcaagaatccgcaccacattctgttcctttatgatgtaccgttgcggacgttttctgcttttctgaagatgttctgcgcgtccgatgtccagctgtttgtcgatgtcccttgtgaatgcagtaatgaagtcactcaatgatggttgagttcacgctgaaataccaaaaattaatgtttttctaaagtattttttgtacagcgaattggccatgtgcggcctccatgccgttgtttgttcgctcaatttccatttgcgccctggtgtgcacattccaaaacgagattgggaagcgcggaggttggacgttgtcttgttcccagcatcgaataagctgtaagctgctttcttcggacaatgtaaccgtcggagttgatggttgtggtgaatgcagtccgaattgtattcgtccactgcctgtccttatggacgcctgggacacagtgaacgctaaattatttagaattgtattaattaccatgaaaa

SEQ ID NO: 91246 - DNA, 531 bp, Heterodera glycines
  SCN-specific regions: Sequence locations=1-69,126-355,380-531
caattttgaaatgctatccagggacccctcccttcgccatcacttcctcgtccccagcgaatagaaccctaaaaatacaattttttgattgaaaatacttttatttaattaatttacattaattactaatacaaattacgctcgtttattctgtgtccctccctgtacaccattcgttgtcctcgaaactgctgatttcattttccggtctcctttttggcgaacagtcgacgatagaatgggcgttcgttcgttctttgctttttgctttggtttctccattttctcatttcatttttccttttcccccaattcattcgttatttttgttatttttatggtaattcttgagcatttaatcaattaattaattaattctcgttttgccctctctttgcaattctacaaaactttgaaaacaaattttgttgacgtttttaaccaaaaattgacgaaggaaagggcagaaaaaggtggcagcggagaaagagtcagaataaatcgctgacgaagtttgaaacattaattatt

SEQ ID NO: 91247 - DNA, 615 bp, Heterodera glycines
  SCN-specific regions: Sequence locations=1-462,485-542,564-615
gccgaccgaacgcgcagttttgacgaccttgagtcgaagctggaaactgagtacatccaacgctttttgggccaactgacaccgctcgaggagagtcggctgtgcgaactgaagtacggtctgcaaagcatgcacaagggcaaaatgccgaacgacgcgcatttgctgcgttttctgcgcgcccgcgacttcgacgtgcaaaaggccacgcaactgacgctgaactcgttgctgtggcggaagcagttctaaatcgacagtcttttggacgactttgtgcctccggcgcttttcaaaaaatatttccccggcggatggcattacaacgattctgagggccgtcccctgttcatccttcgactcggccaaatggacattaaggggcttttgcgctccgtcggacttcagtccatcgtgaaatttactctctcaatttgcgagcaaggcctcaacaagtcggccgaagccacacatcggctgggcaaaccgatcagcacatggaaccttcttgtccacttggatggtctgagtatgcgtcatctgtgggcggccggtggccagggcctttttggcatcatccaaattgtggaagccccattaccgggaaaccagggg

SEQ ID NO: 91248 - DNA, 344 bp, Heterodera glycines
  SCN-specific regions: Sequence locations=1-212,234-244,266-344
cattcaatttttgaatgactgcgtttcttcgttggggcaaccattgccgtatgttatttaatttacaagtgccatttcgtaatgtgctgagttttttttttttagcccgctgtgcctgatcgtcgtttcgattgatcatcgaccagctcagcaaacgccagcgggtccgctcgcggtctccaactgcgtcctgcgcaccggcgaagggcagcgtgtggaagcctccggatggcagcagcatgctggtgtgctggcttccctgtccgtcggcaccgcatattggttgttcaactgtgtcgcgcggccccgctacaagcagctggactgctggttccgcattgggg

SEQ ID NO: 91249 - DNA, 414 bp, Heterodera glycines
  SCN-specific regions: Sequence locations=1-414
cagtaatcgcacaaatttatgacgaatttgtgtggacgggcgacgaattgggcacactgagtatttttgagcaggatgaacaccaattgttgatgacgaattctgccgcccctctttataaaattgacaccatcgaaatgctggaagaaagcagtcaatcgaaaacttttttagcttttggtcatccgccattaagtcgcttaatcacaattgcttcttccttgtcgtcatcttctgctgtccgtcacatcgtcgccttccgcgagcgtcggctgatcattgtcggactcactgtggcggtgcttttgtgcccttggcacgggcgggaaagtgtgccgcaactcatctgctgcatccctctaaatccaattccatccctcggtgcttctgatgccaatgctgtacatttgttct

SEQ ID NO: 91250 - DNA, 523 bp, Heterodera glycines
  SCN-specific regions: Sequence locations=1-58,98-275,299-424,446 -479,502-523
gtgaagcggtgcacaaatatctgaaggaaaaggtaaacacagcgaagggacaaaacggaaaaaataaataaattagcaaataattatttaatttttaggaattgcttctttatttaattgacgaaggaacggacggcggcacttcggccgggaaaatgtcgccgaaggcgcgtgtgctcgcctccgttcgtttgccgctttttcctttggcacgaaatcacaaaattcgcggtacttttcctcttttagacagagtagaaaaaaggacaaaaaagtatttgtttttaaatatatcaaaattaggcagacgaatctgtcatttccgaggcgtccatcgatgtgtcaatttattggaaattcgcttatgcttttgatggattcgaaaatttaaaagtcgaagaaaaagtaaatcaaaagaattcatttaaattgaatttattttaaggttccgttgagaacattcgctcaattaactgaacaaaatgggccaaaggaaaacggacaaaggaaaacgcagcgaatt

SEQ ID NO: 91251 - DNA, 509 bp, Heterodera glycines
  misc_feature (496)..(496): n is a, c, g, or t
  SCN-specific regions: Sequence locations=1-509
ggatgacgatgttcgagcgatgcgtcaacaagcacatccaattcatcatgctggtggatgaaaagcgcaaggacacccacggactgctcaagctgtcggaggcaatgcacaaagtcaccacgcagcatgtgacgctggagaaagcgaatgacgttgtgcggaagaaccagcgccaaacgctggagaacatcctgaacaagctgaacatgaagaactttggcctcaactacgtgccggtgatggagccgtcggcgtgccgtcgcttttcgctcgaaaacggaaatgtgcttgtgatcggctacgatgtcaaccatcctgctcccatgccgcaacagacccgtcgtttgttggcatcgcagggcgaatcgcaattgagctcgcttgacccgtcatgtgtcgggatttgtgccaacatggctcctgattttaatgcctttgttggggattatttcttccaggaatcccgccgagaagccattgaccaaatgcagttggntgatcgcatgaag

SEQ ID NO: 91252 - DNA, 613 bp, Heterodera glycines
  SCN-specific regions: Sequence locations=1-613
atttaagttcgagtcctattatgtgattgaatgtttcaacgcatacatggccaaccgttgcttcaaatgctccaatggcatcgaaaaagtcgactttccgacttttgccgaattgcgagcgcatatgagccaagtccaccaattgtccttttgtcatatttgctgtgataatttgaatgtgcttaccaaggataggcgggtttacaccagagaccaactgcaacggcacatggctggcagacttcacggggaggcggacggctttcgtgggcatccaacatgtcaattctgtgaacaacgcttttacgacgatgagcagcagtaccgccatctgagaaaggatcactatttttgccaattttgtgaccaggacggacttgagcagaatgttttttatagaaatcagcaccagctgaaccagcacaatcggaaggtgcaccacccgtgcactgacccagactgtcttcatgtgggcattgtgtttcggactgataccgaactggacgtgcacagggctaaacaccatcgagtttgcggtggcagtcgagcaattccactggacattcaattttcgaggagcggttcaactcgcggcggtgcgccgtcgaggggc

SEQ ID NO: 91253 - DNA, 546 bp, Heterodera glycines
  SCN-specific regions: Sequence locations=1-437,460-546
ctattcaaaaatttggtaattgattttttaagtcaatcacgacctgcactaatatgtagagaacggcgttaccagtttggagagcgagatgagatcgaaatgtggctttacataattcacgaggctaaacaaaaaaataaagctgcgttaatttgcgatcagcaattttgggaattgtttcgtactcagaggctgcaatttgagacgtcatctgtctcaatcgaaaaacagtaatgattttaatgggaagaatatatccgaaaaactggaataactactaaatctttataaatatcggaaattgagcgcgataattgaatttttcgggatgactaaaaacctaaaaaaaattcagggaccttgacaaactcccaaaaatttatcgtggatatttactaatttctgaacgctattaatcgggaccattgaagaaatagttcacattttttattgtttttactccatgtctctcgcctttcttataacgtggttaatttttagcttccggcgatttatgaaaccaaatatactcgaagcaagactgaa

SEQ ID NO: 91254 - DNA, 427 bp, Heterodera glycines
  SCN-specific regions: Sequence locations=1-99,121-260,394-427
gtaacatcgcaacagttgagccgaattggagcaaacgtttacattggcagtgccgaattcagagaattgccaacggatgagcgaatgaaataccaattaaaggtggtgccggaggagcagtcaaatggcatttgcatatgcgaaatgaatcggaagtgcggctgtgttcaggtccattcagaaccgttttccctgctgctgccaaattcgtcgtcctccgatcagtccgatttcgtctcccttttgcgtccctccgtgccctttttctctgtgccctccccctcctcccactctttcgccctccccccgcttcttctcgcctgtctctttctctctctcactctcattctgctggccatcattcttctccttttggtccttccccgttctgctgatcaatcgggggaacgcaaacggcgcattttat

SEQ ID NO: 91255 - DNA, 663 bp, Heterodera glycines
  SCN-specific regions: Sequence locations=1-663
ctcagatcagagaaaaattgaagagcaggaaaatgcccatctccggcactaaatccgagttggtcaaccgtctgcacgagtcattggtggcggaagagaaactgctcgaagattccggccccggtggtgacaacatcgatctgtctggagtaaatgtggacgaagtgctcggtttggacgacgagaaggacagtgccgtatcatccgcttccgaaactaaaccaaatgacagtttgttgagtctgtgctcaccgctaaacgaatcgcctgagctgaaaaaaacggaaatattgtcaccggcgaaaaagcaactgacagtgaacaatggcatcgcaggggcacagccgacgaatacgggggaggacgggcaggaaaagcatagcgaatcggagtcagcgactgacgaagacaccggcgttggaaacaaaacgcagtcgaatgataatgagcggaaagttcagctcaaaatggccgctcgcctcggcgttccgctgggcgaatcggaggcaaaacgcgcccgcgcgacgcgtttcggatataatggatgcggcggggagaatgagctataggcaaagagagcggcaaggcttggagcatccgaataaatgccgaccaaaagaaatcggcatcggaggatgacgagaacatgctgaaaagagcaga

SEQ ID NO: 91256 - DNA, 291 bp, Heterodera glycines
  SCN-specific regions: Sequence locations=1-291
ttttttacgaagtttcgcgtaaatcccgccaaaataccggtgtaaattcgagatagtcggatgagcatctctctataacacacaaagtgtcttccgaaggcggtattatccacttactgctgcgaaacacctcctcccccaccccctcccgccccgttgggcatgagaacccctcgggggtttatgacccaaattcttccccccccccttccattccgttgcgggcacagacttttttttttcatcctccgacttcctttgctctggttgggctgtgttcccattccttcg

SEQ ID NO: 91257 - DNA, 620 bp, Heterodera glycines
  SCN-specific regions: Sequence locations=1-620
ataaaagccaattttacgtaaaagggattaatggaagatgccagcagcagcagtttattgggcgagaataaaactatcgagcttaatgaagaagcggattttagcgcgccaatgattatccgaaatgaaagcgaagacaatttgccaattaccgaaagccttgcggaaacaaatgattcgcctcagcaggagaccgattctctgttgtcattgtcgcaatcggaaagcgatgttgcctctaagccaaagtcaaaaacgccgagccgcgctgttttggcaccggacgttactcacgtgccaattcaggcggcggacattgtcgaatacgaatggccaagcaaatcgggcgacaaattcttcctccaggagcaaatatcggaactgctcggcattaactctttcaagcgcaaataccccgaattggtacgcagaacggtggagccagcggaacgcgactatttgctgaaggaactgagggcgaacatcgcactgcccgcccaccacctcaccgcactgcaagcggcggatgtgcacgaactgatggcatcggagtaccctttcgaatacgccgaatacaaaaagtgtgcaatgagcgcgtgaaacggacacttttggagaaa

SEQ ID NO: 91258 - DNA, 541 bp, Heterodera glycines
  SCN-specific regions: Sequence locations=1-541
gtttgaggtcgtcctccgtcctcagcactcagcgccgaaccgtccatgaacgcacctccagtgtgtacattgagcaaatgtacgagagttggcagctcgaccgtggctctgtccacagatcatgggacgcgtttttcaacaatgtcaacgcgggcgccgcgccgagccaagcttaccaggctccgccgtccgtcccgtcgcttagcaccgttccgcacgccacggttgtgccgcgtgacatgcgtgaggtgcagccgaaacagctggacaagtgatcccggccgatgaactgacacgtgccatcaatgaccacttgaagatccaagtgctgatcaggagttttcagactcgtggccacaacattgccgatttggacccgctgggcatcaacagtgcggacttggatgacacaatcccgcgcgagttggagctggacttttacggcttcactgagcaggacatgtaccgcgaattcttgttgccacccaccacattcatcggggcgaacgcgccacgctgtagttgcgcgaatttacaaccg

SEQ ID NO: 91259 - DNA, 335 bp, Heterodera glycines
  SCN-specific regions: Sequence locations=1-24,46-335
gaccgactgacgaatagggcatttgagccggcaagtgccagtttggcctcttctcatccgtcttcgcctcctcgggatgcttcgcatagtctgccgtctctttttgacgacatgaacatcaacagcagcggatcttcgttcggacaagaacgcctttgttttctgccgacgaccgctcgtccgttaaacgagaatgtttttgcggcttttaatcggcagccacacattacgccacaggccaacggatttggcgatcccccgagaacttataattcgtctgaaaattcgcgccaaaatgggagtcatttctcctccgcctttcaaaggcacgggtc

SEQ ID NO: 91260 - DNA, 459 bp, Heterodera glycines
  SCN-specific regions: Sequence locations=1-459
aagggaatggccatcggaaatgggtatatgaacgcgaatttgaacattgacacttccgctcggtttgcttatggacacggaataattgatgagaaaatatggaacgaattggagcagcggtgctgtagaggatgcattgatggctgtgatttgacggcgttgaaagactcttgcgaatttttggtggacgacattttcgaattcctttggcacggcggattgaatccctacgatttgtaccgcgattgcgacccgagcccgggccgaaattacatccgcatggaagtgctcaaaaatgggctcgtccctccgaaaatgcttcgccgtttcttttccaatgtgacacgaaacttccgccggcgtctgcgagataccggacaaggagcacaaaacgttgggacaccgtccgaggcaagtttaaaacgatccggattgaccacatatatggaatctacccga

SEQ ID NO: 91261 - DNA, 466 bp, Heterodera glycines
  SCN-specific regions: Sequence locations=1-209,269-327,349-373,415-466
tgctgctctcgcgacggacaatgggtccggaatgtgaaaagccaggatcgaggccgatgacgcggcccggaaggagtttccatacattgtgggccggccccgtaatagaacgtcatgagacgaaatggaacaaaaggactcaaagaagcgaaacaaaccacaaacgacgacgaggattctgacacttcaaggcccgattgagcaccgaatcctccccaactgggaccacatggaaaatatctggccccacaccttctacaacgagatgggtgacacccccgaggaacaccccttgctgctcacggaggacccgctgaatccgaaggccagcagagaaaagatgacccccatcatgatcgagactttccacacgccggccatgtacatggccatccaggccgtgctgtccctgtaatcctgctgacgtaccaccggtatcgtggtgaactccgctcatggtgtaacc

SEQ ID NO: 91262 - DNA, 529 bp, Heterodera glycines
  SCN-specific regions: Sequence locations=1-151,173-284,335-529
gttacctcccacgcttcaccaatgaacttttcacggtggcagaggtgcactctgagcgttcgccagttgtttatcggttacgtgatgacaataatgaaattattagtggttggttttatgcaaatgatttatgcaaaacgctagaagacaaacagcaaaaaatgtatgaaattaaaaagattttgaagaaaaagaggcagaacggtgtggattatgcatttgtgaaatggaaagggtatggcactcgctttattagttggattcccgtaaattcaattagcgagaaaaatatataaaaagaaataaattaataaaatttataaaaaaaaaaaatgccttcaaattctttttatgttgttcttccgtcaaacaccaatattaaaggaaataggacaaattctttccgagtgcgtttaccgcgcaaattgcaatttaattcggaatgggaggtgggtcttgccgttattgtatacccccactcttggccttccataggcaccgtggagcaacaatttgttcagattgagtg

SEQ ID NO: 91263 - DNA, 311 bp, Heterodera glycines
  SCN-specific regions: Sequence locations=1-311
ttctgtccatgtgggaacagaatgaactgcaacataacttctcaggttttattttgcttataataaatcaaagtgttgttacttcttgcattttttggatttttaaatcccgtaaaatgcaaaagtaacaaatgactcgtgttttatgtttgtaaatgccgtcgtccgaataaggacgggaacagggacacgcaaatgcaaacattgcgtaaagggtaaacccaaacggctgcgatttgcgtccgaaagcgtcccccaatgaggaaaagcgttcatttgattaacgaattccaaaaaatcaaccaaatctc

SEQ ID NO: 91264 - DNA, 412 bp, Heterodera glycines
  SCN-specific regions: Sequence locations=1-412
tcgatctcaatttgtttgtgcatattttccctctgaaatgcctttgttgattctttcgtgccaattaggtatataaaacataggtagattttttccttgcgtatcaattgaatggctcctggaaaatgcgtcagtgatagaaagtatcaatattcctgctgctgggattttcaagatcgctctcactggcacctatttcggcaaaacccggaccacggaccaaaattcttttattaaaccgacagctcaaatccttgaatttcgtatttttgtttgtcaaaagctgcttaaatacacggaaacaaattgaaagcattaattgctgcatttacctaagcctttttatacgaaaaagactaaattcccaagtttggattttcgacttttgtttcatcaaatagagagcaatttg

SEQ ID NO: 91265 - DNA, 578 bp, Heterodera glycines
  SCN-specific regions: Sequence locations=1-354,382-399,421-529,551-578
cgcttattctggtacacgtcagaataattccgcttattctggtacacgtcagaataattccacttattctggtacatcagaataattccgcttattctggtacacgtcagaataattccgcttattctcagaatgattccacttattcttgcacgcgtcagaataattccgcttattcaggtacatcagaataattccgcttattcttcaaaatttgttgctgactgacggtgccgctgagcccaaaggaaatttatgaagttttaggtgaattatgaacagaattagtcgacaaattatgattcgcaatttagagccaatttaaagtgtaaaatggaattacctgaaaagttgtttaaattaaataaaaattaattttttccttcgcgcttcacctcctcttctttatgtttcatgtttttgcccgcattttctgctttaaattattgaaaataatgagaagtattttgatacaatcgtactaaaatccctgtggtaatagtacaaaaaaaacaatatttacaaaattattgcttcgtgctttcgtggcattggtcctgatttttccactctcttcg

SEQ ID NO: 91266 - DNA, 579 bp, Heterodera glycines
  SCN-specific regions: Sequence locations=1-294,316-378,405-579
tggcactgaaaattgcttcgagtgattgtcgttggttagtatttgagcagacggaggagtcgccggaagtttcattggggcacatcttacaatgagcagattttttgatttacgaatttaacttccaactcactttcctccatccagactggcttcaaccattgttcgaagacacctcacttttagaaaagcggctggatcgtgtcgggataaattgaatgccagtacgatagtgccacgtttgaaaaccgaagaacagtttttgggaaggggcggtgggggcaactgaaagggatagccaacatatcgcctgaaacacacctcgaccatttctgccccgtcgatttcgtcgcggtaagcggccgcgccgacagattccaaaagtatgaaaaacatttcccaatgttcgctcgcgtgtaaattggcagcatttgcgcggaggagctgatggagaccgaaagcaatttgacgggagaacagaaacaattcgggtggtcgaagtgccaacagttcacagcccatgaaatggagcacttcgtcggcacaattgctggcgcggtcctggacagtctgctgatt

SEQ ID NO: 91267 - DNA, 593 bp, Heterodera glycines
  SCN-specific regions: Sequence locations=1-207,229-593
ccgagttgggcatgttctgcactgctcaactcgttgacttctaccagtccatcgagcatcatgaactttacgtgctttacgtttacaagctgtacactttgcatcgcaccgttggcaattgggtggaggccgggctgacgctgaaacggcacgccgatttgttgcgctggagcacttcacatcggcccgagtcgttcctttgcgggacggcacggaaaagcggtgggaccgagtttggcacggagttggagttgaaggagtacatttacaaggagatggcggaactgttcacccaaggcgagcactgggaattggccattgaaacaaatcgggaattggccaacatttacgagacggccacctttgactttgccaaattagccgatttgttggcacggaatgcggcgctttatgataaagtgacgaaaacactgcgcatggaaagccactactttatgatcgcattttatggcaaaagctgtccctcccatttggtcaacctcaaatttgtggcccggggccgtcccctggagcaatggggctgtttcaagcagcgatttgtggccaatttctccgacttcaaatttgtggac

SEQ ID NO: 91268 - DNA, 499 bp, Heterodera glycines
  SCN-specific regions: Sequence locations=1-11,81-238,260-373,395 -413,448-464,486-499
gtctcaatccccaacagtaacagcagcaacaacaacaacagcagcagcagcagcagcagcagcagcagcagcagcagcaggacaacaatgttcaattcacgacgaaaatcggattttagcgctttaaattgcaacagacacagcgaaaagaataatttagcggcattaaatgcgatcggtgcgccttgctccaccgtttcgctgcagcgaacctcgtccgaccgtcgctttgcgatgccctcctcgctcacctcgccgtccatcgcctcgtcctccctcgtggccaacaatgccggcggtagggtctccgccgcaatggcatccaagcgccgccgttgctcgcgcgtgatcaatttcggctacgcatgtgccatttattttttggacgaaccgccagaaatggacgacgaagacgaatatgaggaggaagaggaagaagccgaagggatgggtgttttggcataccaaacggtggagggggcacaatcgacggacaatg

SEQ ID NO: 91269 - DNA, 458 bp, Heterodera glycines
  SCN-specific regions: Sequence locations=1-458
acgcggccaaattggacagatgggtctttgatagggttaagttgttttttgatgaaattcgttccgatgcgaatgccaaaagtcgccttttgggcctccgtcgtgccatttttttcctccatttgctcggccttgacaccaatgggcatgggcacaagccgaactcggaacagtacttaaaaaacattgccacggtcgacgagggcattctcggcattgttcaaatggttgagggatttttcggcgacaatcgcactgcttttttgttcacagctgaccatgggatgaccgattggggctcacatggggacggaactgacgacgaagtgaatgtgccatttttggcttggggtgccggcattgagccgagcggtgcgagtcgcaaattgtccttggcccaggtggacttggccccacttcagtccgcgctggtcggaaccgccattcccgtgaacagc

SEQ ID NO: 91270 - DNA, 638 bp, Heterodera glycines
  SCN-specific regions: Sequence locations=1-608,630-638
ctcaatttggccatgggccaaaaaacaggaaatattaacaggcacgggcctttttgtggatatcgtcgcgtgcattcccaaatgttccgttggctttgagcgtcgcgaagagttggccaaattggctgttcagcatgccaccaacagcagtgatcagatggaagacggcgatttgtctttggtttcgttcggttcgtcggctttgcccggggcgctggccgattattcgccacgggacgaagccaaaagcaattacctaagcgaatacgtctccaaaacgatcagtgcggtggaatggctgatcaaactcgaccgactcaggcaggaggaggcgatcagaagggcgatggccaaactaagcgcggaaagggcaccaaaggcggaaattgagggatgccgggcatcggacgggcgaatgacacgaacgatttcgctgccgacatcgtttctgccacccctccatttgtccaacttcaatctgatctcttctaagcaaatttcgcctgagcatgttcagcaaggcgatggccaaaatcaatcggtgccattcgccccttggcttacggcatttcgccaacagcaaaaccaatcgccatccctaacgatggccccctcacaaatggtcaaaagcagccaaa

SEQ ID NO: 91271 - DNA, 635 bp, Heterodera glycines
  SCN-specific regions: Sequence locations=1-72,94-161,183-313,335 -531,553-635
aaacggttggcggctgaatctctcgaggcttcaaatggcaagcggcgaagtgatcacgacggagtggaaaatggggagaaaagaaaacggaaagaaccgctgactgcggaagaaaaggcattggaagagcggaagagagaagtggcggaggaactcggagagcatctaaaggaaagaaaccgagaacacgaacgtcataaaatctacgaacacgaacaaaacttcaaagcacttttggttgatttgataaagcacaccgatatcagttggcacgacggtcgaaaactgatgcgaaaagacaaccggtaccagaactgtgaactgctggaaaaggatgtcaaggagcgcctgtttaaagagcatgtgcgcgaattggagaggaagagacgcgacgtgtttttccaacttttggatgagcatcaggacatcacttttacaactcgttggcattcagcaaaaaagatcattgctgaagatgagcgttttggtaaattgaagatggatgataagaaattggaacaggactacagagaatggatggacagacgacggtcacaagcattggacgactttgaaacactgcttcgggagacaaaaatcatcacttacaagtctaaacagatgatagccgagaa

SEQ ID NO: 91272 - DNA, 638 bp, Heterodera glycines
  SCN-specific regions: Sequence locations=1-47,69-340,362-638
gagcaaagaatgtttttctttggtctataaaaatgatgagcgaagggaccaaagaacgaaggggagagaaacggaggagacaccgctttcgagacgcaacgacacccatttattgctcgaggagctgttctccccccagtgtatccatgtgcttggccaggtggatgcacgggttttggacgatgttcacgtcaaattacgctttgtgatgccaaaaattggccgcattcgcttccgtcgtgttttttatgatcacatcccggcacataaaggacaaaaatgtgcctatctgataagcaacccgttggaaagacgacaacttcacgcttttgtcactaaactttttgttcttctttttaatgctgaacttctcgatcattccaatgtaaaaatgttttgtgaaaacatcgctacgactttcattgatttgagaaatcgcggttttttgatgtcacgtacccaaattttaaaaggcattcgatttgatcagattctttggttgaaaggactccattttcaactgaagcagtccatcgtgcttaatattctcaaatccttcctaaatctctttactcgcatttttacgtactttttttaatagaacccaataaaataatcccttcccaatttcatgtcct

SEQ ID NO: 91273 - DNA, 554 bp, Heterodera glycines
  SCN-specific regions: Sequence locations=1-5,27-554
ctaaaccaattgtttcccaaattaaattgccacttaccctgtatgacggcagcggaggagcttcaggatatacgtaagctttggcgtgaaaacgcgcgcagatccaacaacgagtattcggattgattctcagaactgagttcactttgcttcggactgaaggaatccaaaatttgcttctcaatgaagcaaccatattttccattcctgtatgtttcctttctcgatgaatgtccatgataattatttccacaattggacaatttttattcaaatatataggatgaatagcataatggtccatgccactattttgcatacgcccctttgctctccaaattccgttctcttggaaaagattcaaatttaagatcgtctcattagatggcggaaaggctttttgagcttctttccacaaatggacttcggcacgttcgacttcatcaatcgttagaggatttatttgcttactgaatgatttgacctcataacttggcttaacagctgaaatgataattttattcgctgattttttgaaattttgaacggctctt

SEQ ID NO: 91274 - DNA, 642 bp, Heterodera glycines
  SCN-specific regions: Sequence locations=1-188,211-258,281-642
gattaattgtggaaaaaattcgtaaccaaaaatccactactttttccgttgtgttactaaactaagaatttgacaaaactcgacaaaaacgggcaaaaagcagttcgttgcatgccatattaaaggcataaaaaatacaatttgaaccaaaatttcatcaaattcgtccatggcatgcacgtctgttgttgacgttttcaaaattctgattgaataaattaggcttcctgatccgatgcgagggaaggctttttttgttttaaaaatttgttatctttttagactctatattttatgaaagattttctctccgatccccgactttcttctacctgaggatcggggagcaacccttatagaaacaaaacgggaaatacccaaaaagcgcgaaattttgcgtgaatatccctgaaacatgcaacaatttttaaaacttacccaagtccagcaagaaagagtgtaattttcgcggcaacattcggattccttgtagccctcggcccagacacagtagttgacgcaggacaatgtttccaggcaacccggtgaagatttgtcaatcgtacatttcagtttttcagcacaactttcggtgtcgtagtgttcacggagcacctcaaatattataaagcatttaaatat

SEQ ID NO: 91275 - DNA, 504 bp, Heterodera glycines
  SCN-specific regions: Sequence locations=1-148,175-361,420-504
gcacatttgggcacagttttggggattaaaatttaaagcatttacccaataacttaaaaaaataaaacaattctatcattaactagcagttgttagacttgaatttttttaacgcttacatacattaaaaaggggggggggtgtcgacaaaaaattttttggtttaatttattttattgattgatggctgcgcatttgcaaaaaatattgggcaaatggcaagaaatttaaaaaaaagtatcaggttacgtatttatttacaggcataaaagaatgcaaaattctcttaattcttccttaattgtcctcctataaaaacattaaaaaaagagaaaaaatccaaaatatttctagtttttccaaaattatttttattttataagatttttaaaaattttctatttgaaaattttttttttgagttttgagggtaagctatatgacgggtggtgggggctatctgctcccgttttcccctccgttttttcaccccttctcatttgc

SEQ ID NO: 91276 - DNA, 623 bp, Heterodera glycines
  SCN-specific regions: Sequence locations=1-5,27-623
attttaaatttactttatttatttttgcttgttaaggaattgaaaacgcgcagcaatttgcacgacatgtgggaaaagtgatcacttcgagggtaatacaatgtttttggggttcccaatggattgacttcaaaggtgccacctaatgctccgtacgcaatgcgacttgttcagaccgtctacaaatgtgtccaagcacacactgattcggtcgccacagtgattaggtgaaggcatcgggtggggggagcggagatggttggcaaaccggacggaagacgatgagggaaagaaagggcacgaacgaacattgattgaccggcatatgccatctacatcagaaacgatcaatcgtttatttcattcagagacgcactcaatccgttgaagacgagcattctgagccaatcattcaaaaatcttaccacatttgtcgaccaaacgtttgagcaggacgaacgcagagacacaattgtagtggagcaagttggtagaacattctaattaatctgttcattgttgaaatttctttctcccctggtttctctttggatgcgtaatcccctcaccttttttacagcttaacgccactttccgtgccgagttggccagcgtggcttggg

SEQ ID NO: 91277 - DNA, 649 bp, Heterodera glycines
  SCN-specific regions: Sequence locations=1-52,91-210,232-445,472-649
cggaggcggcggcggattgataggcggcgatcgacggataaacggcggaagaacgccgacccacacacaaaacagcagcagccaacaaattcacttcagctgatcactccgaacgccaaaaatggacaacgaagcggccgggacggtcggagaagcggtggaggacgaggaagtgatgacggacgcggacttcgaacgcgccatggaacagctgagggaggagggcggcgaggacgtcaacgaattgttcatggcaatgagtgaaaatcgcatcatcagttgggaggaagccgaacacattttgggcaactcgacaaatgaaccggtaaaatcgtcgcttcctcagcagacgcggcccacggagccggacaacgacacggacgtggactggtgcgtacaacggctgatgaacaacgacccgaaactagtggagataaacctgaacaacatgaaaaggacacccattcccaaaattaaacgtgtgatcgaagcgtgtcgcgacaatgagcatatggagaagctgtcgctcgccaacatgggactttatgacacggatgtgcagcctctgatcgacattcttgaaaacaacgccacattacggtgtataaatttggagacgaattatttgagcggagatttctttgcccgg

SEQ ID NO: 91278 - DNA, 630 bp, Heterodera glycines
  SCN-specific regions: Sequence locations=1-104,147-263,287-451,473-630
aaatgtcttgaatttcatgtcccaaaaatcatttttgtccattccttttgttgttctgattctcacgctttcgtgcatagaattcaacgcaaacaatgaaaaccttaataaaaaatttaaaaaatattaatttaattttaaaaattcaccgaaaaaagtaggcccattgagagaatgacgaacaggccggaaacgttgtgcaaattcagtgaaatgcgctgctgcttaaccgacgaaccaacgccatggcatgaggcacccctaaaattttggaatttttgggcaaaattctcctcgccgccgcatcactttgagcgccaccattttgtctgaaattttaatttaaaaaatcgtatttattccccacttttttcattgcgataattccgcgtttttggtaaagcaaaatttggcgagagattcgatcagtccattcggaatctgtaagtagagagaagacagcaaggaaagattaaaatttgaaaaattttgcaccgtacttttttgcagtgcaataccgtaaccctttgagccgagcacaccgccaatttgtgtcagattacaattctgctgcacttcgtactccagcgagctagaatccatctgcaataccaaaaaattaattgggat

SEQ ID NO: 91279 - DNA, 637 bp, Heterodera glycines
  SCN-specific regions: Sequence locations=1-71,95-575,634-637
cgaaacgggcacgtgctgtttgatgtatcggcgctcaaatggttcatagatgaagcgcttgaagcaaatgatctgtgaagggcaaaaaaggggagcaatcaatcgatgatcaattaatcaatgattaatgaatcaccaaaatgtcgggcaatcgcgtgaacatcagctgcttgacaagcgttggtggcgcagacggcggtggcgttgcggcagatggcggtgtcgttgcgttgctgcactgtgcacagcgtgagccttcaatatcttccggtttgatgaaatccgcgagacaattgttgatggagatcagcggcacatccatgggcagttgaccagcgtccgacgctcccataatgtaatgcgattcatcagtgaagcgctaaaaaagcggcaaaatgtcaaatggggttagggttgtcctcctggtactgcttgaactccccacctgggccaggctgatacaaatcatgcgatcgccctgtccatcttcgtccttgtccttgaacaatcgcatgaagcaccaaatgtcaattttgtcgagcggaatgtcgcgcagcgtcttctcgtcggatggttcatcatcgtcgtcctcgtcgaaatcgtcttcatcctcgtcatcattttcttcttcgttttc

SEQ ID NO: 91280 - DNA, 494 bp, Heterodera glycines
  SCN-specific regions: Sequence locations=1-494
atcacagccaatttttcttcgaccccaattgtcccgaaacgtgttctccattttatttggatgcgctcttccgcaaaggccatttggtcattcgaatgttggagaaaaggttacccaaggagcagttcgttaaggttttgcaacgaattctttccctgggggttcagtacagtcagaatttgtatcggcctgtcgaatggacgcacatgctaattaacacggcgatgtttttgcgggttatgactgatgttactgggaaggaattgccttcctttgtcgaacaatggatcgattttggtggatttgttaattttcaggtttcccacattttcaaccgcaaaagaaatatcattgaattggagctgcgtcagacagttccgcttcgagaaggatgtcggaattacaccgggcctctcgcgatcgttgttcaggagcttggagggctttttgctcacggtatgcggagagacggcggcgggtctcggcagggcatc

SEQ ID NO: 91281 - DNA, 636 bp, Heterodera glycines
  SCN-specific regions: Sequence locations=1-281,307-421,443-636
ggcacttttgaccagccccatcattaccaacggcgtcaaaacatgcacaacagtttgttttcggccacgtatcagcacgccaacaacaaatggatgatggcagcgatgccggccgaggaactctccaccgaagtaattgtgcaccgtaaggctgcgcaaaggcatcgacgacggacggtgtcgaaaagcagcggcggggacagtgacaacggctcgtcctcccggtgccattccaacgccaatttgcacgcctttgaggagtcatcgctggagggcaaagagggaattttgtctgttacttcaaatgctaacgatgatgagatgacggtggggaaaatggacgctgaaggaatggaacaagcgccagtttttgaggaggaaactcctgcgctttcggcgctgagagattcgcttggccttggagaaacaacggcgaagtcagtggcgatagacatcaaaccaaagcatcgtctggcatcgtttgggtcgccgctgccatcgctcggcacttcgctgcaagacgaattattactagctgctgctgctgttacaggaaaagatgacgacgacaaaattacggtggaagagttggcacgtaagaaattctcccagcaaggaatggctttaaattccaaa

SEQ ID NO: 91282 - DNA, 592 bp, Heterodera glycines
  SCN-specific regions: Sequence locations=1-206,228-551,574-592
gatttttcgacaatttttgagacgctttttggtagcgaatcatcgctttgtgccattggagtctttttgggttggacgtctcaactcagttttgcattcgactgtttgtggagttggcccctccaatttttccaccggttttgcaaatcatttggttcaacatcgctttttttcttcacagtccgatggtttgaacgtcttcgaacttggctctgagaatgactttgacgatcgcgttctccaagcccaacagcccgtcatggtccaattctacgccgattggtgcggcccgtgtcagaatttggcgccgagaattgaggccaaagtgaacggacagaacggagaagttttgttggcgaggattaatgtggacagttctctcggttttcttactgcacaattcgatgtgacttcggtgcccaccgttgtgtgtttccataacggagaggtcattcaccgctttgagggcgacgtcgatgattcatatttggacgaaataatcgcgcatttgaaggaaggaaactcggaaaatgacaaagaaattatttgatggaataattgcttttattttataagtatttgttttaattgg

SEQ ID NO: 91283 - DNA, 626 bp, Heterodera glycines
  SCN-specific regions: Sequence locations=1-233,256-562,592-626
attcatatgctgaattttaccgtgcttattcgatacaaaaaaaataataaaactgaattaaaaatttaactgtttttgttgtgatagtatttaatgaaacgaatgttttttgtcttcgttttttcgggtggcgtccccaagcgaagcaattccattgattttcggtgttccctccggcggagtttggcagagaataatgggctgcaattgcgcaccattcattctattcattcacattttcacattgattctttccctcccataattttttattttctttcaagagattttgttatatttatttatttaaaaccgactgagaaattttttagttttttagcaatatttttagcagattttcatcaaaaaaattcccaattttttgactttagaaaagtttagcaagaaaattaggttttccataaaaatttcgggttgggtaagtaagtaccccgcgaccccccccccccctccagcaggccggggcctgagtttttttcaaaatggtttaaaaaacaattaataaaaaatcaattaaattgcttaggaggaacttcgaaagtatttaaaaataaaaatttattttaaaaagagaaaaacaattctttttccgatcgactaaataa

SEQ ID NO: 91284 - DNA, 616 bp, Heterodera glycines
  SCN-specific regions: Sequence locations=1-616
aatatttgtcgacaaccgcccgtcgacagaagaaaacatggcaccagacaattgcgaggactttgcagaaggacatcgaactgttcgagccggacccgactaacacacaatcggctttcgttggtgccaaccaacaaccccaagcggtgggagcggcgactgttggcagcgaaacgggcgacgaagcgacggcgaccgcagcccaacagtcgacacagcagcaacaccaccgatgcgcatttgcactgcgcgagcgtgacctgttccgcattggcccaatgcatgaggcgattatgcagttgtcaaaacgccacacgtccaccgtttctgctgccagtacaccgaccgctgtggagaaagaactgctcggcttgggcacttcggaggcggacgtgctgcaatccggcgctttgtccgatctcaccggtgggccgaaaacacgtggtgccagcaaacgaaaagcggccgccgccctggcggtgtcctgcacctcttcggtgagcggtggaccaactgctggggcagcaacaaatgtactgctgccagcaatgagttctcctcaatgcaattactcggtgccgccagcggagtgtttgttgatgtgccgtttaatcgt

SEQ ID NO: 91285 - DNA, 568 bp, Heterodera glycines
  SCN-specific regions: Sequence locations=1-568
ctcaacactgccaaatatggcgatgagttatgccggcgatgtctccgcttacggtgtcaccaacaacccgcacgacacacgtcgcatcacgggtggaagcagcgcgggggagggggcactgatcggcgccggcgcgtcattgtgcggcattggcaacgacattggcggctctgtccgaatcccggccgcaatgaatggcatttttgccctaaagccgaccaccgttcctgaccacgtcgtgcctatttttggaattttgcccaaaagccttttatacaagccggccctgaacatgctcagcaatggaccaatgtgccgctacgcctctgacttgccgttggcacttgcggtgatggccggcaaaaaggtggacgcctttcaacaggatgtggactttagcaaagtcaaagtgttctacatggacgatctgaacgtgttgctcgcccaagagcttcaaaacgcgcagcaacttcccgttaaaatggtcaaatcttattttgagttcaaacacaatgtgacggtccaacgagtggaggttccactgatgtcacggttcctccaactgttc

SEQ ID NO: 91286 - DNA, 630 bp, Heterodera glycines
  SCN-specific regions: Sequence locations=1-556,579-630
gacattcgagccaagatgaatatccaaagttcacgttcagtgttggatgaccaatggcacactttgctagttgagcgtgaagcgggcgctgccgtgctgtatttggacggtcgacttgaggcgcaaaatcggaccaatttgggcaccattgaactgcttcaacttcaatcgccactgtacatcggcggtcttccacctgagcttgttccccttgctgcgcgacttttgcctggcgttaagcccgaatttggtggatgtttgcgcgaattttcgctcaatgatttggcattggaggagcccgttgccgagaaggacattgcccaatgctcccaattcattgaacagggcattttctttggcaaagatgggggctatgccattctgagtccacaatttgtggttggcttgtcgttcagctttgagttggagttgaagccgcgcacaaagactgctgtgttgctctccgtcggtgtccttgaatttctgtccctgcaactgttgaatggcacgggcaaatttcgcgagggacaacggtggcggcatggaatccggtgctctacgagccaatcagtcccaacttcgtggtgtgacgggccttgggatcccgatccgaaccttcaaaaaaaaaga

SEQ ID NO: 91287 - DNA, 665 bp, Heterodera glycines
  SCN-specific regions: Sequence locations=23-80,102-665
ccaagtttgagtttgtacagaaaaggtcgttatgtggcaatgaattggactgatgggttggcaattggcaatctgtgcaaatctcaaaagcatttggcactttccactctctcccaatttgcggccgctttcaaaacgaattttgtctccaatctgtccaaatttcacagcttttcaaactttaacactttcatataaaagtgacagacgaaagcgaaaaatgaaattcattaaaagtcggaacgatgaaaaacctcacgacttttgtgttctttttgataattgccgcacttccgccgattgtttctccagcccaatctccgccttatggccaacttcaaattaagggaagcaaattaatgagttcgagcgggaaagaaatcgtactgagaggaatgtcacttttttggagccaatgggacccaaagtattggaacgcggaaacagtgaaacaattaaagtgcaactggggcataaacatcctccgcgctccgatgggcgtcgagggaagcgacggatatttgcaaagtgcggcggcgagtgctgcgaacactcaaaaactgatgacaattgtggacgcgtgcataaacttgggcatttatgtgataatagattggcattataccagtgggaaagcgtacacggcaccagcggtggactttttc

SEQ ID NO: 91288 - DNA, 522 bp, Heterodera glycines
  SCN-specific regions: Sequence locations=1-522
acaacccgggccttaagtacaccattttcacaaaacgagttcctgccccgtttgagacgatcagtttctcaaatcgacagattatcgagcaagtcgtaaagggtcgcttcaagcagcagaccaactctctcgacttgagcagctttcagaacgacccgctcttcgaacggagtcaactttcttatggactttttcacaaccacgtggtggtcgccgttgccaatttaatcgcgcgaaatttcccctcaattcgtggcattcgtttaaataacaacagtctacgcactttggacttcctgagttgtctcgtctacgccgcaccaaatgttgttgaattggatttggcaaacaatgcggtgagtgaatttcacgcgttaatgaattggacaaattgaaaagttggtccttggaaagtgtccactttgaaaacaacgaatttgtcgcgagttatcagggcaatttcgtcgcatattcacaagcaattcatcagtttttccctcgtgtcacatatttggatggacg

SEQ ID NO: 91289 - DNA, 592 bp, Heterodera glycines
  SCN-specific regions: Sequence locations=1-367,389-592
aatgcaccgccatggtcgaggcggacattctgtgcccgaccaaacatttccccgagttggcgtgggctcgtgaattgcctaagtctgactcccattacgtcacgaatgtcgaatttacggaaaaggacgaatttgggatggaagtgcggcgcaacggacggccaatgcccgtggagtatttactcgtcgacgtcccctgcggcgtccgtttgcaagaagtgcacaaattcactgttccggagtcagtcgacgaaacgtttcccatcgaaaatcgcacaatcgtcgaccaacaccagaatttgcgcgacttggccaagtacgtcagtgcctttgacttgcccgatcagtttctcaccatggcctccgacttccatttcctcctctttctgttcaccaaccatcacgtggaattcagcgtggccgagttgaagtcgctggtggcgtcggtgcgcaaaagcgacgcccaaggggcgaaagaatgggcagagcgaagtgaaaattggggcacgttgcttttgctgagtcaaagctgaggtaagtgaccgacagaggccgacgcggttaatagtgccgatggtaccccccccccctt

SEQ ID NO: 91290 - DNA, 512 bp, Heterodera glycines
  SCN-specific regions: Sequence locations=1-195,217-284,306-512
ttttaattcattctcaatttacagaccccgcagagctctcaccaccaccgaaggccaatgagagtttggagtagcgcagcgaacttttttaaatgtttttcgtacgtttaaatttaaaatttctttgtgctcctcaaatcagcaaagtgtcggaacattcaattttcagatttcagtatattatacaatttgtactttattattatatacacattctgaatgttatacaaattgtggatgatttggttggatgatcagtgatcgctccgctattcgccttaacgctctctcccacccatttcttcaatttccgttcattccccgcatttccctctgatcaaattgcgcaaaactgcgccaaatcctaaaaaattttaaaaaaatgttttgacagaattaagaaaacaaaattaaacatttgaaagtgttaaaaaagctgatttgagcctgaattgcgttctggcattgcatttcagcaatgccccaaaattttcactattcatgaatcgttt

SEQ ID NO: 91291 - DNA, 520 bp, Heterodera glycines
  SCN-specific regions: Sequence locations=1-126,148-520
caccaccacggccagcagtcctccgttggtgccgcttgctcttccacccaatcctccgccccttcttcaagtcaatcggaacaggctgattcaacactccatccggaagagcggaaacgcattttgcatttgcatgcggaaaagaatcgccgttttgcgctgaaggaaggcttcgagtcgcttgtgaatgccattccggtagttgagcagacgggcgttaaatgcaccaatgcggtggtgctgaacagggcggcacagcacatcaaacaattgaagagcgaacaggatcagcagcagatgaagttgagggtgttgcgggagaagattaccaacatgaacgaacgaatcgccctaatccagtccaatttgccttcctcatcaaccggtggttcacggccttgtgaagctcagactcccagcatgcgcattcaagtggaacaattcttcgaacattacaaaaaggaacgttcccgtgaagattaccgcttttggctgatgggtgaggtgctcaagcctattg

SEQ ID NO: 91292 - DNA, 642 bp, Heterodera glycines
  SCN-specific regions: Sequence locations=1-642
cagaaacaaacttgtccacttttacaattttggaggcaattctacaccacacaataatttgcaccatggcttgcccgaacatttgcttcaccagtggcgccattgatttggacaccaccaaaaatgagagcgtctgttccatggaattgcccgtttattgttttgacgtggtacttgcccgtctgaacaaacggccgtcgcccaaatgtccgccgaccattcccaacgaatgttttccgctgtttgtctcatggaaaaagggccacgcgcgacagttgcgcggatgcatcggcacgttcagtcggaacttgccgcttcatgaggggctcaacgaatacgctcaaatcagtgccttccgtgacaaccgttttgacccggttggcctccatgagctgccctcgctgcactgctccgtgtcgttgctgctctgttttgagccggccgacaactaccgcgactgggtgatcggcgtgcacggcattcgcattgagtaccggcaacaccaccgggcactgaacgcggtctatttgccggaaggggcctatgagaatgggtgggaccatgtcgagacgctgaaacatctgatgtggaagggcggtttcaggggcgacatcaccgaaggccaaccacaaatggggctgg

SEQ ID NO: 91293 - DNA, 610 bp, Heterodera glycines
  SCN-specific regions: Sequence locations=1-248,270-610
gattcaccgcctccgtcgactctttgccattatcagcagcagccgaatgcttcacttaaatcgcacattttcgatgaaagcgactgctctttctcagtgcttgaccagcgcctgctcccttccgcggtggaatatgtgcggatccgatcggtccaggacggatacgaagcgatcaaagagatgaaggtccgtggcgctcctctgatcgcaaccgttggaatgttctcattactcgtcgatgtaactgcttcttctactgctactgctgaacacttttgctccgactctttcgtccaaaaaacatttcgccaatccgtcgaaaggaaatgccaaatgcttttgtccgctcggcctaccgcaattaatttggcaaatgccttccacgaactgatcgactttctaaagaatgatgaggacaacaacagcgatgctggaactgaaacggcggcggagattaatcggcggcttaaaatacgactgaaacattttgtgttggattggcagtcgcgcgaaagtgctgaaaacgcggcactgctacacaattcggtccaggcggtactcaatgaatgtgcggcaacaaaaaatgttggacaaaatgacgacgacaaca

SEQ ID NO: 91294 - DNA, 648 bp, Heterodera glycines
  SCN-specific regions: Sequence locations=1-179,227-240,262-315,345-648
ttcaagtatttacaatgccgggctgtatgccaatcgccatgcccgagcatttgatccctttcgaccccggccatatcattccgtgcccgtttttcacacgtactgtgaggaatatcgtagaacagaccaaaccggacgttgtatttatggtctttcggtagtacatttaaatagaaaggaaataatataaataattattaatttacatattttaaattaaaaaattgttcgcttattaaaatacttaattaattaacaattttttgtttgctgtgaatttataacgattttttaaaccatcaaaactaccgaaagattaaaattaacatttatattaaattttaggtggtataatgaagttctgaatgtcccatttaatgaaaatgggactacaaaaaatgacgaaattttgaaagcatttcgccatgaattgcggcattttcaaaaattcgtcagcaaccgaatattcgtctcggccccaacactgcaattcaaacatgacgtggccaaagagttggccaaacggttgtggcaacacgctccgcttggcgacctgcaactatcgcttcgggagcattacgtcacaaatcgcttttcctatgcccgtctccgtctgttgaactgtccaaaatgtgtccaatttgacct

SEQ ID NO: 91295 - DNA, 368 bp, Heterodera glycines
  SCN-specific regions: Sequence locations=1-329,351-368
gcaagctgttctatgtcccccaacgtccctacatgaccatcggctccctgagggatcaggtcatttacccggaccgtccggcggacatgcgtcgccgtgggttcaccgacagtgcgctggaggcactgcttgaccaagtgcagttgcgcaacattttggagcgcgaggggggctgggagggccaacaggactggatggacgttctgagcgggggcgaaaagcaacgcattgcgatggcccgcctgttctaccacagtccgcagttcgccattttggacgagtgcacttccgccgtgtcggccgacgttgaagacgccatctaccgacgatgccatgagttgggcatcactttggtcaccgtttcccaa

SEQ ID NO: 91296 - DNA, 547 bp, Heterodera glycines
  misc_feature (163)..(163): n is a, c, g, or t
  misc_feature (166)..(167): n is a, c, g, or t
  misc_feature (356)..(358): n is a, c, g, or t
  SCN-specific regions: Sequence locations=1-37,114-115,163-363,422 -444,466-547
cattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatnggnnacgtgcaagtggtcgtgacgccgccgtcgaagccccgtgataaccccttcaactccatcttccgtgccaaacgtcaactgcccggacactgccagtgcgctggcctccaacagccaagcttgtccccccctggtccggcccggcccctcccgaaccgccctggaacagcccccggcacccctcttaagnnncaggagaaacccgaaaaacctggaagaattgggaaaacccctttctttttggcccccaaaaaatccccccccccctttttctctgtggggcccccccgcccgcccccaagggaagagggaccccccccacaaaaaaaggccccccccaagaacacattggtcccccccccctgcggggggggggaggga

SEQ ID NO: 91297 - DNA, 550 bp, Heterodera glycines
  SCN-specific regions: Sequence locations=1-11,33-122,149-550
ggcgtgtcaaagcttaccgcttcgtggcttacacgaccgtttctttctccatcatctcacttttgtcggtgtgcttgacactgccaatgctgaagagttacgtgtcgaacgtgggcatgaaaatggactctgagctcagctcatgccagcacaatgccaaagacatttggtccgaagtcagtcagctgaaggggctgcctctgctggtctccggaaaccgtacggcgcgtagcgcatacggtagcggccaagagtgttgctccggcggtgcccaaggccagcccggccaacccggacagcctggcaaccccggagagcgcggaatctgtcccaaatactgtgccgtggacggcggagtgttcttcgaggacggcacccgaagacgttgaaaaaagctattctgatcaggggaagaaaaagcagaaaatcagtagcgattgccctcccctcccccgtgcccttctcctccccattttccactggctttcttttccttcctttttttattttggttagcttttccaattcgcccaaattcccccccccctcc

SEQ ID NO: 91298 - DNA, 456 bp, Heterodera glycines
  SCN-specific regions: Sequence locations=1-456
aacagtcaggagtctcaagtggcgtctccagtgaaagccggaaaagctactacgaagacgacggctagcggaaagggcggcaaagcgaaggcggacggaaaagtgaaggcgggcggaaaaggggcgaagaaggcgggcggaaagggtggaaaagtgaagattgctgcgagcggatcgaagaacacgcgctctgctcgtgctggcgttgcatttcccgtcggacgtatccatcgtttgctgcgccacggtcgccatgctcagcgcattggggccggaacgcctgtctatatggcatcgggtgttggaatacctggcggccgaaatgctcgagctgaccggcaacgcgtgaaggaaaaacaaaagttgcgaatcaccccgcgccatttgcaattggctgtgcgcaacgacaaagaattgaacaagcttctcgcggagggcaccctttcatcggggggg

SEQ ID NO: 91299 - DNA, 544 bp, Heterodera glycines
  SCN-specific regions: Sequence locations=1-544
atgtattgccatgttggggccagccctgtcactacagtatgctgtccagcagaacaaatcaacccatgtgctcaatcagttgagcaaggaattgggcctaatcaattggagcgctttgccttcgatgttcaagcgcaacagtgcgtgccgttcgcttatcgtgggctgaagggcaaccgaaacaattttctgagccaagaggagtgtgaggtggcatgcctgccaaattcgtgcccttccggaagtccttttgtgggggccgatggacgggcccaaagctgcgcagtaagcacggcgatgagcacatgtcccaacggttattggtgccacgttggggcgaatgctgccacgacaatgtgttgccctgaggcaaatgccagtccctgccaattgccaatgtccacgggggagggaccgttccgattggatcgcttttacttcgatttgggctccaaaagttgcaaatcgttcatttacaagggactgaagggcaaccagaacaacttcctctctttgcgcgcgtgtcagctcaactgtctccccc

SEQ ID NO: 91300 - DNA, 411 bp, Heterodera glycines
  SCN-specific regions: Sequence locations=1-411
ccatttgtcggcccaaactgaccaccaccaccacccgtccaatcatcgacaacattgtccaccgttgcctgaacgttttgtggccggattgcgttgcgcttttcaactgcttgacatcaacgggagcggaaaagtgccatttgaacagatttgcaagaaatggccagtgcattttgccgatttaccagtgccatcaaattttttggaatgtcttcgtcgtgtgaaccccagcgaagaaatggtcacttttgagcagttcatcaagggtgcccaattggcactcagagaaagaatgaacacggcaggccgattaaagagagtccaaagtgaaggcaaattgtttggcagtgatttggaaaatggcaaaagcggagaaagcaacagagcaaaaagtcgtggtgccccgtcctc

SEQ ID NO: 91301 - DNA, 635 bp, Heterodera glycines
  SCN-specific regions: Sequence locations=1-108,130-375,415-635
ggtgcgtgagaaatatcaaacggatttctatgttctggacaaatacccattggctgtccgccctttctatacaatgcccgacccaaatgacaccaaatattccaatagttacgacatgttcatgagaggcgaagaaatcatttccggtgcccagcgtgttcacgactcggcaatgctcaccgaacgtgccaaactgcacgggatagacattgagaagattcagtcatacatcgacgccttcagatttttatgcccaccacatgcggggggaggaattggtttggaacgcgtgacgatgcttttccttgggttgcccaacgtgcgtttggccagtctttttccgcgcgacccgaaaagaataacgccatagaaggaagaaattgtttttgaacaaaaaataaatattgttctggtctcacattttctggattcaccaaatcgaaactcaatgacctctctcttcaagcgaaaatttaagtgaaggattgcacaacaaaaagctgaaaggatggagaggcggcacttgtcccaatttactcttctataaagcccaatctgccgattttttctataaccttaattaagtaacgcaattggcttatccatcctttgggtgttgttcgttttccgcttct

SEQ ID NO: 91302 - DNA, 639 bp, Heterodera glycines
  SCN-specific regions: Sequence locations=1-133,155-639
aaatatcgaaaggcattggacgaggatcaattggctcgtcaactgtacgaattgatctgtcgttatttcctcgcgacttgtttgtgtcccagcaaaattgccgaaatgaccattaaattttccatcggacccgagacctttaaaagtgtcaaacatacggtggtcgtccagggctttctgttggtcgtcccatggatgcgacccgaattttgtgacacggaacttcccacagaagcgaccaaacagcttaatcagttcatcaagcaaacattcatcgtcagcgatgttcgtcgtctccaaattgaaaatcccaagggcggattgtcagaagcaaagctcatttcgcaaatggcacttttggagttgggcaattacgacacaatcccggaaacattgagcaaattaatgcagaaaaaactggccaatgtcgttggccccggccgttggattgtgcccacttccgaaggccttcaaaggctcgagtcttttcggcaagatggcgttgacacggacgggaacactgagcaagtgtcggacgacgttctagaagaaagggacgaagatgacggcagcgatgtcagagaagtgaagcagcacagcgacagaagggcgagaaaacgcgtccgttttgatttgacc

SEQ ID NO: 91303 - DNA, 201 bp, Heterodera glycines
  SCN-specific regions: Sequence locations=1-201
agaagctaaagtggaaggagatgccaatattttatgcaaattgagtgcaccgagtgttaaagttaagactgaagttgacctccacaattcgcaattaaatgccgatcaattgtacgaatacgccaagaattgcttcaaattcaaaaacatttgcgttttacgctttcggaaatggtccgaagctcgcaatttttataagca

SEQ ID NO: 91304 - DNA, 596 bp, Heterodera glycines
  SCN-specific regions: Sequence locations=1-596
aaaataattaatctcaaatggctgctttaatgatgctaacatttttactcatgagttcatttgttgcggaaatggcaaacgctttgaaaatattaatcgtccaacaaaattacatgttctttcgaagtcattttggattcggtttaaacttggccaaatatttggcagaagaaggccaccaaattcatatgttgatcccaataacagatgaaacttataaattaaagaataaaaatgatgaagcccaattgtatgtgcggtattttgtgccgaaaaagacgaaaccgttgcataagcttattatggagggagacaaaggcaaaatgagtgacagaatttacaaagaaattgccgaggactttgaactgatggacggattacgtgccgaaaagttcgacgtgggaatggcagaggcattctgtttgacggagtattcgttggcacttttccactttctgcaaattgcggtcacaatcgccacccaaagccagccgatgtcgccgtttcagctgcatttgatgggccatttgagcaaaatgaaacagtcggaaggaatgccgacggaatttatcggaatttctacaatgaattttttt

SEQ ID NO: 91305 - DNA, 644 bp, Heterodera glycines
  SCN-specific regions: Sequence locations=1-392,414-419,441-486,508-644
ctcagaaattggttattcctgtgtcaacgttcttcacacctttaaaggaaaaaccaacggatcaaccaaaacaacctccacttgaatatgatccaattttctgtcaaaaatcgtcatgtaaagctgttctgaatgcattatgcatggtcgactaccggacaaaagtgtgggtgtgcccgttctgcaaccagcgaaaccctttcccgccgcattacgccgccatttcggaggaaaatcgaccgccagaactacaccctctttttacgacaattgagtacacgttgaagaaggcgaccactttgcccccaatttttctgtttgtcatcgacacgtgcatcgcctcggaagagctcaaagcattgaaggaatcgctgcaaaaggccatttcgtatttgccggccgacgcactcattggactgattacttttgggagaatggtggaaattcacgagctcaacgtgaaaggcatggcacggtcttacgtgttcaagggaaccaaagaagcaaaccccaagcagttgcgtgatatcattgctttgcaaattggccttccgtctgcgactgtccgtcgtcaatcggctgcttctacgcccgttcctcaccacccaatccaacaaccattgataaacggagtccaccccgga

SEQ ID NO: 91306 - DNA, 620 bp, Heterodera glycines
  SCN-specific regions: Sequence locations=1-413,435-487,510-620
cagatgcagtgaaattgagcacttttcggcgtgtcaaatccggcacacattcgtcagactttgtggaaatgcctttcacgggttcggattttgacgtcagaccgcttctccatcacatcactcatgccagtttgccagacattctcgacattggcctcggcttcaccaccgacgtgccattgtcctcgcccctttcccattcgcttctttccctccaaaatggcactttgccaaattttctcttctattgtctcatagaaatggcttcagaactccgtttacgacactcaaaactttttttttcttcgaggcctttgcttttgtcaattgacttggccaattcgttgcccctggacaaattgctggaggcatttgagacgaacgaattgccggcactttgtcttttaaacaccgaaaagaaaagttttcgctgtatgacaggagaaaaaaacattgagaatttcaccactagcaatgccccggcggattttgcacagcgaatggccactgaaaagtccaaagcatttgaattcctcggcaacggcgtcggccccacgggggactttccttcctcgtcgcatcccttcgcaataattcaaatcgaacatatcggcgcattg

SEQ ID NO: 91307 - DNA, 604 bp, Heterodera glycines
  SCN-specific regions: Sequence locations=1-77,105-304,327-604
cgcaaagacgcccccctcggccatcgcatcggcccggcgcccagcccttcgtcggccagcgccagttccacactcactcatttccaatggaaggaaggaaggaattccgcagagcgaaggacggcatacgaagggatctgtgcgattccgtcgcagcaaaagccaaccgacgctttttacggaatatttgcgcgacttttcgataaaaatacaattgaattggataaaacggagagagacgacgacataaaagacaattacatgatgtatttcattagcaaaagtgaagaacatccgacgaacatcagcagaagaaaggaaccaaacggagaaaccgacggagaaaggaggggacggtcattgagcccaaaagtggaaagacaaacgcgcacgtcgaaatgttccgttgctgctcatatgagcatcccggtggaccaattacagccaagaaattgccgaatgtgaatcaaaaaaatgatggaatggacaaaaaaacgctaatggacgaatagtgaaaaaagaaaggacgaagggatgcgcaattggcaacgacaaagaaaaacgggtgtcatgcaactcgtacaatgggtataggctaattttg

SEQ ID NO: 91308 - DNA, 325 bp, Heterodera glycines
  SCN-specific regions: Sequence locations=1-325
tcaagatagttgctcccttttcgcccaaagccaatcctttcaatccggactgactgcacgaccctgatatccccgagcacccacctcaccagtacaacgcagacaaaccccgcaaacaacttgcaatgaactgcatgcgactccatgtaccccgtgacctatgggacaaaactcgcaaaattttgcgactgaacccccggtttccccaggagcacccggccagcccggcaccggaggaggacagctgcaggccggagaggccagcccatctgcactctatggacagccattacaatccgcagagcccggatttactggacagtcc

SEQ ID NO: 91309 - DNA, 657 bp, Heterodera glycines
  SCN-specific regions: Sequence locations=1-489,511-613,636-657
cggcagcgcagtggtggccggtcagcgagttttttccgtgtattggacgaacttaaaccgaagggcatcaaagtggtcgggtgcatgtgtatgtgccgcaacagcatcggttcccattcgtacacttgcgatgagataatcacttcccgcagcggaaagcgcgtccacatttacaacaccgacgccgaaggtcggatggcaatggccgacccattggccgaggccaaagaaaaagccatgaaagcgaataacccacatttgttcaccatcgctacgctcactggccatttgatactcacttatggccattgctccgccgcgatggacaacggaccggcgagggcggcaaattacgcggaacaattgaggaaaacgggcgacgaattcggacaaccggtggaagtgtcgcgactgttcagtgaggacttcgactttcactctgcgaaatgcgaagcggccgatttgatgcaatcgaacgctttgccaagcgtgagaacgccacgagggcacatgggccccagcgcatttctgatgcgcgtctcgcgcatccaacaaggtgggcttgactcggccaagccgttgaaatcaccccatctggacattgggatatccatggggggaaaacccaaacccttcggtcacccttcccctctgctc

SEQ ID NO: 91310 - DNA, 395 bp, Heterodera glycines
  SCN-specific regions: Sequence locations=1-395
gattctaaaggcatttgtcgatccgtgctgtcctccgactgcgacgacttcgacttggtcaattcgaccgcctcccctctcttcgcttacccttgcgttcgcctgattcccattggccaaatcaaacaaattttgcatgacaaaatcacttcttctgtatgaggaagaatttcaatgcaaagttgagggcgatctttttcgctccgaggacgggttgctcaattctctgctcagttttgagcattttgctcgcaaattacgaattgtcgagaggggatggcccagcggattccgaatgtggtttcgcgagaaaagcggatggatatacgaacggtgttcgctcgttgcaaggataaagggggggtttgcgcaaagcgacgcacactttgacatgg

SEQ ID NO: 91311 - DNA, 556 bp, Heterodera glycines
  SCN-specific regions: Sequence locations=1-179,202-556
gggcggtgttggtcggcgagactgacatggagggagcgattgtaaatctgattctgaaccaaaccgacattggtcaaattgagcaagtatttctagatcctgatttcgatcttgaagatttttttgattaatcccaattattttgcatttaatataccaaaactatagaaatcattgccccaaaaaaccaccacaactccatcctgctgggcatgaatggtgggaacgaagcggcgtcgtcctcgtcaacttcggcaccaccaaatgcgaccatgctgcagctcaatgttccaaaaaatcagcagttgttcatgctcaatcctccaaatggacccgtcgtcaacattggtgaccacattcaaggcgatggtggtggtcaacagcagtcaacaagtgcctccacgccattgccggacaaaattttggacgacgacgacaatttaccgcctcctctgttgacctcggtgattgaacaggacggcgaagaaattgttttatgatgcttttctgtaccttgttttgtttggatctctttgcctgagaaaattcattttac

SEQ ID NO: 91312 - DNA, 526 bp, Heterodera glycines
  SCN-specific regions: Sequence locations=1-229,251-389,411-415,453-453
gttgggtttaagccgactactgagcctactcctgctgttaccaccgctgtttctgttgctccgttgagtggcactttaaccttcaccgcttcgtccatccctattagcggcagtctttttggtggtgcttgtcgacccggaacaaacacgttatcgaacttggcggccaaggtcactgctaagaccactgaacctgttggatttaaaccgacttttgagcctctgcttcctgctgttactactactgctgtttcggttgctctatttaatggtgcttcaaccttcaccactccgtctgtccccattggcagcagtctttttggtggtgcttctcgtccgggaacaaacacttttgcgaacttggcagcgaaagcagctgagtcgggtggtggttttttgggcggcggaggcgtcactgcaaaaccgatccaatttggtcaatctgcatttggaaccaatgcaaaggatttcaagcttttccaacaaccgccttctcagccttcattcagttcaaatattcataccg

SEQ ID NO: 91313 - DNA, 636 bp, Heterodera glycines
  SCN-specific regions: Sequence locations=1-636
agcagaggacggaacgaaggcggaaaagggacaaaacgccgaaaaaggcgatggagtggcgaaaggggcaaaaaaggaacgccttcggaagcttttcggatgctgagtttgaccaaaccaacgaacaatacaacgcattagtggaggaaatggacaaacagtcgaaattgaacaaaagtgtcttcgacgatttggacgaagaacaacggcagaaactcgaagggttccgtcccggtctgtatatacgtgtcaaagttgaggacgttcctgcggcgtttgttgactgtttcacccaacctttccttacattgtcggaggacttttgccggtcgaacaaaacgacggatacgttcaggttcgcattaaaaagcaccgctggtacgaccgtttgctgaagtcgcgtgatccgctgatcatttcgtgcggttggcggcgcttccaatcgatggtcgtttactctgttcttgaccataaccaccggctgcgcttcttcaaatacacgccgaaagaagccttttgtcacggcgctttttgggcaccttttgtaacgcaaaacaccggctttctttgcctccaatcggtcgacgaggaaaagaagggttttcgcattgctgccagcggcgttgtgttgggaat

SEQ ID NO: 91314 - DNA, 639 bp, Heterodera glycines
  SCN-specific regions: Sequence locations=1-400,423-639
ctttatcaaacaatcccttaattaattatgtcttcggaacagtccaaacttttgctgcagaagcagttaaatgagttgaccagaaatccggtggatgggttcagtgcggggctcgtcgatgaaagcaatctctacaaatggcaagtgttcattatgggcccgccaaattcgccatacgagggcggcaacttccgtgcagaactcgttttccctaaagattatccgctgaggccgccgacgatgcgatttgtgtcgaggatagtgcacccgaacattgaccgagacgggaatgtgtgcatttcgattcttcatgagcctggcgatgaccgatttggctacgaaaaggcgtccgagcgttggctgcccgtccacacggttgagaccattctgatttcggtcatttcgatgctttccgacccgaactttgacagtccggcaaatgttgacgcagcgaaaacgcaccgcgagaatccgacggagtacaggcgtcaggtcgcgcggtgtgtgcgggaaacggaagagcaataggcaaatgcgtcggagtgaacggatggcaaccgaactgaggggggaggacactgacaaatgaccaaccgaccgacccttttgacccccccccccctctcgtgtcaattttcg

SEQ ID NO: 91315 - DNA, 421 bp, Heterodera glycines
  SCN-specific regions: Sequence locations=1-421
gcccctcgatctgctcgcatttacgctcattttgcctttgcttccaccactaatccaccatttatcaaaacaacaccaaattaaatctgatccaatttttgctgagtttgattctggtgcgcatgggcttcaaacttttctaaacgatccttcgattgaacgaaataatggtgttttcgttggaggaattctcggatcgctgttttcttttctgcaggttctctcatcgcccattgttggctcattgtccgaatcgcatggacgaaaatcgcttcttttggcagctgtgattggctcactgatttcatattgcctttggtctctgtcatccgaaagcttttcaattttctttgttcctcgactgatcggagggttaagcaaagcgtccgacccggtagcgatcgcgattgtcactgacatt

SEQ ID NO: 91316 - DNA, 513 bp, Heterodera glycines
  SCN-specific regions: Sequence locations=1-144,166-513
gtggaaaacgaaatgttgcgttacaaagtgatccgatcgctttatccggttctgtgtttgatcgcttccctttattatgcattgatcaatcgcgtgttcacgctgatcagtcacttttggccaaagagcaaagtgacgtggacagagggcgaggcggaggagccgcttctgttcatgtcggccaaaaaaatggctgagaaaattcggcgtaaagagatctcctcctcccaattggtgtccctttacattgctcggctgtgccgtgtccaaccgctgatcaatgccattgtgatggacaattatgaagctgctaaagaggaggccgaagcagtggacctttacatcgcatcaatggacgatgactcggaggaacttcaaactcttaccaccactaagccattgcttggcgttccgttcacattcaaaaacaacatggacgtcaaagggttcgtctccgttgctggctttaacaaatttttgaaaaatgcgccagccgaacgtgtattcgaaagt

SEQ ID NO: 91317 - DNA, 619 bp, Heterodera glycines
  SCN-specific regions: Sequence locations=1-262,285-619
ttatgaatgactttaccactgtggcgattgcgcttttaagccgttattcgaataatctcctaaagaaggatagtgaggcagcactaagcggtgaaattgttggcgatgaacgggaaactgaaaatattgttcgtactttaattaccatcatcgattcatttgaagaaaatgaattcttcgcgcaaggactttaccgattgagcgggtctttgactacgcaacaaaatgcacttaatattatcgaaaatgccaatggacgggaattgaaactttacttcatttacgagttgaatgccacggataaggcgtcttgcattaaaactcttttgcgtaaaatgcccgacactcttttcccacactgtcaacgtgttgctctgctcgacctttctggaatggtcacttcgtacggtgcgccatgcgaaagcgacgaccgaattttgaaagcactgcaaattctcgtctattttatacccgaaacgcataagcaatgtttggaatgtttgctgatccatttgaaaagagtgtcggctcattccgacaaaaacaaaatggacgagtccaacctcggcctgctcttttcttcctacgtttttccagtccaacaacagaaatacgaatc

SEQ ID NO: 91318 - DNA, 641 bp, Heterodera glycines
  SCN-specific regions: Sequence locations=1-338,361-641
gggaaaagcatttgcattttgttcgtcttgcggaggaagcggcgcgttacgacgaaatggtccaggggatgaagcaggtgattgaattggatgccaaactgaacgaaaatgaacgcaaattgttgggcgtcgcgtacagaaagtcagtcactgggcaacgcttcgcttggcgtgtcattgcgtccgtcttggcacgagggaaaggcacgaagagacagctggagatggtcaagcagttgctgaacaagctggagcgcgaggtggaagagaggtgccgtgaaatattggatttgttggactgggttctgatcaaggaggctgcagatgatgaagcgaaagtgttctacttgaaactgaaggctgaccacttccgctatttggctgagacacggacggtgaaaaacggtgttgcagagaaggcaaagcaagcgtaccaagaagcgttcgacctcgccaagaacaaactccggccaatgcatccgattcgtctcaccgtggcgctgaactttgccattctccaattcgaagtgcagaaatcaccagccgatgcttgccaaactgcccaacgggcttatgacgacgcgacttccgatgcgcagacaacgggcgagagtatttgcgcggagtccgtcacgatcatg

SEQ ID NO: 91319 - DNA, 301 bp, Heterodera glycines
  SCN-specific regions: Sequence locations=1-44,73-156,181-301
gggcatggcggccgcttcttcagcttctggcaccagcagcacgacctcctcctcctcgtcgtcctcctcctcaatgattccgctggacattggcctgtgcatgttgccgattgcggagaattggtgcaacacgcaggtcaaggtggtcaagcttaactacatgtggaccattaacaacttttcttttttgcccgacgaaatggggcgaaactttgaagagttcgacgttcagtggcggcccgaaacaaaactgaaaaggtgcctgggcatcaaaccgaaagggctcgaacaagaatccaag

SEQ ID NO: 91320 - DNA, 547 bp, Heterodera glycines
  SCN-specific regions: Sequence locations=1-197,220-226,248-547
agaaatgccggcggaattgcgaagcagcgacatgttcatgaagaaggagaaattgcatttgacgatcaatgtgctcaaattgttcacaaacgaagagattgaaaaagtccgcaaatttttgcatgaacaattccaatccgacaaaatcagagatattctgcagggctctggcggtcagttgcgcgtcaacttcaaaacattgcaaccgatggtttaccaatcgaaagaacattgccgagttttatttgcataactcgaggcggtcgaatcaaacactctccaacttttggccaatacgctcgacgacgcattgacaaaagccgaattggtaaagaaacgtcaaagcgaagatgtgttactgcacatgaccggtctgaacactaaatacttgctccacctttgcgagatgcgtggctctaccaatgctgacgatccgaacggatacgtttctgtgcactccgtcaaaattcccgaggcagcaaattggaatgtccgaaatccctcccccattatttccattggcaatgtgacctatataatattaatt

SEQ ID NO: 91321 - DNA, 318 bp, Heterodera glycines
  SCN-specific regions: Sequence locations=1-286
ccggaggcgagggaccgcctgggcccactggtgcacctgggctgcccggcctgtctggcaacattggtcagcctgggcagcccggagcgcccggccaacccggcaaggacagcggctactgtccatgcccgccccgctcttccgcgatggcactcaaaaagaaaatggcggcggtcaaaatttttttagcgaaaagagcagcttcaaactgtgatgctaaagataatcccattattggatgttggcgaaattaaattcaccttcttcgtaaataaattgcatttttaaaaaaaaaaaaaaagaaaaaaaagaaaaaaa

SEQ ID NO: 91322 - DNA, 511 bp, Heterodera glycines
  SCN-specific regions: Sequence locations=1-131,153-511
tctgtccaaaggccttcctccatgacatctctgttggccactgcaaacgctttacgctgatcggaaaggactcaaagacgggcgaattcggcgctgtgttggacgagcgcaaatggcacaaccaactgttcatgagcagcaccaactttctcccaatcaaagaacagcagcagcaattcatggacgaattggccgccaaattgccgtgccctggacgccactgtattccgattacgacgccttcgttttttttctggactgagaagaacagaaatctcttcgacaatgttatggactccttttccggccaactgttgctcgcattgtgctcgcttctcaccattggcattggcttcgcccggatgttacgccctgcggcagaatatgaatgcttcgactattgcatggccctctattctgtcttttgctggtgttgctctgcttgggcctcatcgtatttgctgctctattggacaccttattggtcttgcatgaacttccgtgcggatga

SEQ ID NO: 91323 - DNA, 544 bp, Heterodera glycines
  SCN-specific regions: Sequence locations=1-108,130-414,436-544
gtttgagacaaacgcgcaaattctatttgaatatgtctggacacgttaatatgcagcaggaatgcacagtgtatttgcgaaacttggatggaaaagtaaccgaaaagctgctggaggaactcttcgtccaggttggtccggtgaattttgtcaccataagagaccctcaacagcagcacaaaggcccacattcggccgacacgacgcccaaaacctcgggaaatcgttacgcctttgttgaatttgccgatgtcgaatcagttctgttcgcctgtgaagtgatggacgcggtcgaaatttatggacaaaaactcaaagtgcagccgagggataacacacttcagagagccattttcacacaaatgaacatgcacaccgcttcctgggaacggcaccacgcacccgcggccgactcatccgttgcggggaagggccgtccggcaacacgtcactcggacatcggcgtgtacaatgagttggagcgacagtcccctggggcggggggaggacagcgcatcgtcacattcaatcgcagccacggagg

SEQ ID NO: 91324 - DNA, 640 bp, Heterodera glycines
  SCN-specific regions: Sequence locations=1-189,211-640
ctcacaccgaatcggcactttccttggatggcattgtcgtcactcccgccgatgaacacaaacgagaaaagctggcgctaattacactgcttaactacttcagcagtttgagcacgcattgggcacagttactgcgcccatttgcaacgtccatcttccaactgatcccattgttttcacactattccaatgaaaatactgatgaagaattgagagggtgttgtaatgcgcaattggtgcgttacatgggcctttcaactgtggcctcggcagcggacttggaagaactgttcgccacttgcacaacattgcgcgagcgggcgtcttggtggaagagcaaagtgtgcctgttgcgctttctccaagtgttcgcgttcaccaatcagttcttcatcagtgcccatccaaatggcttttcggcactcgagcaactgatcatcgactttttgtgtgacccccgctttgatgttcgcgtagcggcagcagaaacactcgggggactcatccgagccgccatcattgcagtggaccaacaattcctggccaaggcacgagacatggcgaattcgactgatccaatcacacgtcactcgggcgtcctcgcactttccgccatcgttcgtgctttcccatactcagt

SEQ ID NO: 91325 - DNA, 641 bp, Heterodera glycines
  SCN-specific regions: Sequence locations=1-641
ggaaaattgagcagggccaaatcgattggagcacagccgaagcattggcaatcggaacggcacttttgcagggaaatgatgttcgactaagcggccaagacgttgggcgagcgactttcagccaccgccacgcgatgctcgtcgaccaacggactgacaaagtgcacgtccctctcaatcatatcgctaaggaccaacaaaacttcttagagatagcgaacagtccgttgacggaagcggcggtggtctgatttgaatttggattcgccatcgaaaaccctcaccgaatggtcatttgggaagcacagtttggcgatttttacaacggagcgcaagtgcaaatcgacacgttaattgcgaacggagaaagcaaatggctccttcagaatggcattgtccttttgctgccacacggcatcgacggggcgggccccgaccacagcagtgggcacatcgaacgattccttcagctgacgaacagccgcgaggaccaacgaccgccggacggcgacgacgtaaacctttcggggggaaatccgagcactgcggcgcaatatttccatttgctgcgaggacagattgtccgtccccttcgaaagcctttggggattttctcaccccaaatgctgctccggcccccc

SEQ ID NO: 91326 - DNA, 575 bp, Heterodera glycines
  SCN-specific regions: Sequence locations=1-575
cagtcgttggagaaccaattggccaccaaactgttacattgccaacggttggaggagaaagagagagtactcaccgaaaaccgagtgacacttgagcacgaattgaggatcagagaccaaaacaatgaaacattgcgcaaaaagggcattgaattttcacaattggcaacggacctccgcttgagattggaccgattggacatccaattcactgaacttcgcgagagcgtaataaaaaaggcatcctcatacgaagcgaatgccaacaaaattaaacggcttgaggaagagaaaagttcgttgaaacggaagttggaccgagcaaaaagaatggaaaagtacgaaaatgtggacgaattgctgcaggaggaaaatcgcattttgaaggagtctctgacctgtccaagttgcaaagtgaatcggaaaaatgccattctggacaagtgccatcacgtgttctgttttgaatgcatccgccttcgctatgacaatcggcggcgaaagtgtccgaaatgcaacgccgcttttggggccaacgacttccatagaatatatttggaatgaacgatgggaaa

SEQ ID NO: 91327 - DNA, 539 bp, Heterodera glycines
  SCN-specific regions: Sequence locations=1-23,45-299,333-539
ctgcccatggtgtgcagtaccaattcccctccctgcctcagccctctcctcatacacaaacaacccaacaacaacagccaacgactgccaatctccactactctcaaagtcaccaacaacaagcagtccctttccaacggaatttgaatgtgttatcgcatccgatgcttttccaacaccaacagaacgtccaactgtcccaacagcagcaacagatgggcacacaacaacactccgtcgtttatgctggtgggcatgcgatgccaacccaacatcaccaacaatactctgctgcttacccattgttgcaacagcagcagcagtcgcaacagttccctccttccactggcgctgcctttgcccccatggtaattccgctgcaaaacgacccaattgcagtgggaattagacaacaacatcagcaggtttaccaacacacgcccagtcattcggctctacaacacggaacgtcacatgccgggggttacttggctcaacaaaaatagtcggcggacgtttggttgaccaattctctttgt

SEQ ID NO: 91328 - DNA, 628 bp, Heterodera glycines
  SCN-specific regions: Sequence locations=1-180,202-628
gtcattccgaagatatcggcagattgtttagcaagttagactatgccggcatttccctgttgatcattggctcatttgtcccttggctactacgcattcttctgccgagttctcccgatgaccatttacatttcgatgatcttccttcttggaattgctgcgcttgtcgtttcattgttcgacaaattttcccaacccaaataccgccctctccgtgcgattgtttttatggcgatgggattattcagcgttgttcccgctcttcatcttttggtcactgatggcattgtgtggatgtttgaaaaggcttctttacactggttgattttgatgggaatactgtaccttagcggagcgactatttatatggtgcgcttccccgaaagatgcttccctgggaagtgcgacattttgtgtcaatcccaccaactgttccatcttttcgtcattttcgctgccgccgtccattaccacggagtgttagaactcgcgatgaagcggttgcaggacggttcctgctcggaacaactgatttcccacagcggaagtgacgaggcaaccattcagtggttggacgaccgattacgaccatattaattgaccaaggaagacgcatttgcattctgtt

SEQ ID NO: 91329 - DNA, 583 bp, Heterodera glycines
  SCN-specific regions: Sequence locations=1-583
cgaccaatccgctgaattctgacgaacggaaacggcacgagttcatcgattgtttggccatcgaattgatacgcaccgaactgcttccgtatgccgcggcattgccacgggaattcatgcagcgcatcatcgacattctcaacagaggatccattaacacaatggactcgcatgacgttctcgcttcagacgcttaccagcagcgtgccgacctttcccgcgtctgtttcgacgctcttttgtcgcttactcaaacggacgccgccgcttcttccgcgacgacatccaagccgaagtcgccaacgccgagtggcggcggtgttttgcgcaattcaaaccaaacgaccgccgcgtgctcttcgcttggcgcaacagccatcgcgtcgttgctgcagcgttgcagcaaagtgcttaatgactatgccaaagatgaacaaacggccggccattttcgacttccgcaagagcgcattttcgaggccatctccgctcttcaggcgatcaccgctctcatcgagggcttttcgcggaatccgaacaacccgactctttactcgcacctcgtcaccctccacccgtcttt

SEQ ID NO: 91330 - DNA, 445 bp, Heterodera glycines
  SCN-specific regions: Sequence locations=1-445
tcaattgcttagaattatgcgagaccaaattcgctcctcaggcccaattaccgttgatgaatacatgaaaatatgcgccacttgtcaacttggttgttaagcttgtcaaaacgaaaattttggagagcgcggtgacctagtaacttccccgcacctgactcagatattcggagaatgaattgcgagtagggctgttcatgaggtggaaatgacctcttggaaggaccagtggccattcggcaaactcgggtcgggctcgggcgaattgaaggacgacgggctttgtgggctgcgtcaatttgatgtattacacaaggttgaagcttatatggttaaaaattccaagcgtttagtggaacgccaacgacacactttgaggaagaaatgtggcgaacatttacttagaaccattcgatggtaccattcattggatgatgtgccacaa

SEQ ID NO: 91331 - DNA, 653 bp, Heterodera glycines
  SCN-specific regions: Sequence locations=1-127,152-653
gcaagacccgtgaagtggaggcgttacccaccgcaacacccacaaccacggacgaagacgactacgacatctcaatcgactcgccaccgcccaccgcccaatcgggcggcctcggcggcggcccctcagctgctggcccgcctggccttctcggcgcgggcggcgggtacgcctgggaagaagaatacaagcgatcctgggacgccctgcaagaagacgaagacgggtccatcactgcgtctgtctcttatttcacctcgcagctcaaacgcaaacgcctgctccgcgacacgcgcattgtgcaacgcgggctcgtccgccatttggttgtcgtcgtcgacctgtcgcaagcgtgccgggacgtcgacttcaaacccacaaggatcgagcaggtgtgcgtgttgctggacgtgtacttgagcgagttctttgaccagaatccgctcgcgcaagtggccctggtcgtcacgcacaatgagcgcgccgtgcaggtgactgccctgagctcgcacccgggcgaccacttgcgcaaggtgaaggagcggcactccgcgctgctggcggccgaagcggatccgggcgagccaagcttgcagaatgcgcttgagatggccacgggcattctaggacatgtccccgcgcatggcacgcgc

SEQ ID NO: 91332 - DNA, 286 bp, Heterodera glycines
  SCN-specific regions: Sequence locations=1-286
aggacttgtggccttgccaacggcggttgtcccatgacaaatcttttcccggttgctcattctgttgtgcatggcgatcatctccaccttttccgcagatatgctgggccaatgatgcgaaatattattgcgccgcctcccgggttaccggactcactgccaaagaccgtacgctgaaattgggcttaaggccctcgggccaaaaattacaactatccgatcgattgtgcgaaacgtcacccagcacggggccaccagcgttttactgctgctctgaggcaaaaac

SEQ ID NO: 91333 - DNA, 643 bp, Heterodera glycines
  SCN-specific regions: Sequence locations=1-109,131-514,536-643
attgagcatgggaaatttaatatcagcggaaattcaagggaacaagccacaaaaattcatggaaatactaccgatgcaaagcgaattgacgatgacattctgccaaactcagtgccaattattttgccttcactcatatttgatcagcagcaacattctgctcagaaccggtccattcatcgtcgttttaccacctctacaaccagcttcaccacctatccggcacaacccccatcgtacccgattgaacctgttggccaagctatgccatcgctaagctacccaatcgggccaccacagccgcctgtgccaccttcttacccaatagtgccgcaagcgccttttgctggcacaacgagtccaacggcatgtgaatgttgctgttgttctgcctatcgcagttgtccatgccggccgagctgcccgccatgttgtggtggaacgcatacaacgtcaaccacagtaccaccaacaaagcccacagaagagacaaccacgactacaaccaccaaggataaaacccccaaaaccacaacatcaagcagtacaccggttacaaatccgctattacatccgtacaatccatgctgtctttcattgatcatcaattgtccaaacaacaactgcaattgtccaccgtcat

SEQ ID NO: 91334 - DNA, 584 bp, Heterodera glycines
  SCN-specific regions: Sequence locations=1-17,66-584
tccgattctccgctcgactcctcctcttcctcctccttttcctcctcttccccttcttcctcttcatcgtcaatcttcgaccaattagggcagaacgacttggacttaatcaagcagaaaaggcacatcggagacattcagcaattgtgggatgaggacgaaatgaacggtaaaatgcgaaatgccctcaagccgacctcatccaatcggtggacccaaattcgaagccatgatggcaaatttgtgatccctttcataatcagcggacagttcacgatggaagaacgacagaaaatccaaaaagcaatggctgcgattgccaacaattcatgcgttgaatttcggccaaggaaattcaacgagttcgattatgtggacattcaaaaccgaaaagacgaggggtacctttaaagataaaatcgaattcgagatccaatttctggattgggctgtctgattttaaatgcagttgctacacgcaagttggccgagtgcggggccgccaagtgctaatgttggagtcggggtggagcaagccgtgcgggtccggctgcattcagacgttccccggctgtgtcaaacac

SEQ ID NO: 91335 - DNA, 642 bp, Heterodera glycines
  SCN-specific regions: Sequence locations=1-642
gttccttcctgttattatttcaggcattactaatggatcaaagcaaagaccaacaaatcgcacaattgaaggccattattgaagagctgaaggctggaaaacataaggcggtcactgaccagcagccccaatcatcgtcaaccgcctctgccaagtcaccatcaaagccattcaaagagaaagtgaaaggacgtttgacatttgaaaatggaagcgcggctaattaccccgtgtcttttggagaagtgcagcggcgcgttgagtcgccagaccgaatgaaaatttcggattttctcactctttttcacctgcgcaaaacaggcagcaacagcgtcgatctgcgtaaaagcattgagaagtccgggattgaaattcaaacaggacaacggcaacacagcgaggacacctgcttcaccttccttcttgaagcagaagccgtcaagttggctgaagactttgccaaactttgcatcagcaattaccccatcaaaccaatcgccaacgaaatgacatcaggtgaaaatggtggtgagagcggcgctaagccatacaacaaggaagagttgaaatcaattgggcgttttcttgccgaagttttggctttccaacaggcggatgagagtccccacccgcctgctcatc

SEQ ID NO: 91336 - DNA, 541 bp, Heterodera glycines
  SCN-specific regions: Sequence locations=1-541
ggacagacgggaattctgggcgaattcggactgagaggaatcgacggaaagccaggtcggcctggacagcccggacttgctggattgcccggcccccaggggctgccgggccctaaaggcgcgcgtcatccagacgcattctccggactgccaggaccacccggagagcctggatatgccggaatgaggggtgaaattggtccagaaggaaatcgcggcattccgggcgacagagggcccgatggcttcccgggaatcgcgggaaacaaaggcgaccagggcatggaaggagtgcccgggctgcccggcacaattggcctccctggccggcaaggcccaccgggcatccccggaccaagtccacaattcatacaggaaatgcatgctcctaccggtcggccgggtgacatcggactgtccggcatccccggctaccccggcgagccgggcgacgcgggccttcctggcccacccggaccggcaggatacccaggcgcgccgggtccgcctggagagtcgggaatccctggtctcccgggtc

SEQ ID NO: 91337 - DNA, 603 bp, Heterodera glycines
  SCN-specific regions: Sequence locations=1-14,79-603
cttcactatttgctccttttcccgctttcccttctcctcccatttgcttttcttcgctcccttctcttcccgtgcctttgtcaattccttctctctccggactcacaattgtggtgagcttcgtttgtctgatgtcggcagccgagtgaaactcttcggatggatggccgccaaacggatgaacaaattcgtcctcctccgcgactcctatggttcagtgcaaacagtgttgccaaaagcgctcttttcgtcgctcaaaaataccaactttgaatctgccctttgccttgagggagtggtggcggacagaggcaaagaaaggaacgacaaaatgcccaccggcgacatcgaagtggtcgtcgacggacttgaagtgctcaatccttccgatgcgccgttgcccgtcgatgaatcgtccaacgaatacacgagaataacccatcgttacttggatttgcgttcggagaaaatgcaacgggcaatgaggctaagagcgagagtggtcagcaaatgccgtcgcttcctggaggacagttgtggctttgtcgaagttcaaactccgaccctcgcccacacgacgcccgggggtgccgcggaattccc

SEQ ID NO: 91338 - DNA, 638 bp, Heterodera glycines
  SCN-specific regions: Sequence locations=1-638
agctgatggaggaactgaccgagctgccggtggtggtcgagttggccagcgacttcatcgatcgtgagacgcccatctttcgtgacgatgtctgcttttttatcagtcaaagtggcgagacggcggacactttgctggcattgaggtactgcaaacctcgcggtgctcttctgatcgggatcaccaacaccgtcgggagttccatttgccgtgagacgcattgcggagtgcacgtcaatgcggggcccgaaattggagttgcatcgacaaaggcgtacacttcgcaaattttggcgttggttatgtttgcgttgaacatgagcgaagatcgtatttccatgagtcaaagacgtgcgaatatcatcgacgggctcaacaacatcagtgaccaaatcaagcaggtgctcacccttgaccagcaggtgttgcaaattgcaaaccaaatctacaaggagaagtctctgctggtgatgggccgcggttacaacttcgccacttgtctggaagggtcgctgaagatcaaagagctctcctacatgcattgcgaaggcattctgagcggtgaactgaagcacgggccgctggcgatggtggacaaagacaaatgcattgtgatggtcatctgcaacgaaatgtgt

SEQ ID NO: 91339 - DNA, 385 bp, Heterodera glycines
  SCN-specific regions: Sequence locations=1-127,149-385
tgccacaatttttgcgcgcattaaccggatttcagcgatcacagacccagattgggcgatgattgccactcctacgttccttccattcttcacattttgcccgagtattcgaccaccggcgtgtacaattgaggaattgccaaagattgacattgtcctcatctcccacaaccattacgaccatttggacgtcgtcggcgtacgtgagttggcacaacactttcctaccatcatttgagttgtgacgatggggcttaagcaattgccgctacacgagacgaactcaccagttgggcacgaaatgaattgtggtgaccgtctggaactgcgattacacgagagaagctctgaagtgttcagggtgccggcacagaattgcttacag

SEQ ID NO: 91340 - DNA, 579 bp, Heterodera glycines
  SCN-specific regions: Sequence locations=1-18,87-155,183-431,453-579
cacgagacgagcacttcgagcaataacagcaacaccaccatcacagacaacaacaacaaaccacaaccagcacagcagcagcagcagaaccatcatcacatgttgctgagcattcagcaagcgattgttgcggctgctgcaatggcagcaacggtacaacaccaacaacagcaacaacaacattttcggcaacagcagcagaacggcacaaacaaaagcaatgctattgttggggatgaacaacaacggcacatgccattgcaacagaacgtccaaatggaagtgaaggaacaactgattactgtcgatgaagaaaaggacgagaacaaaaacggagtggacaacgatgaggacgattcatcgccgtactcaaatggctgctcaggctcgggcacaatccccggggcaccgccaacactggcaatagcctcctctgaagagaaaggaggacaacagcaacaccagctgagaacggcacagaggcaaaggggaggcggagacgacgcagtccaaatccaatgccaagcgaatggcgccactccgcactttttggccagcagtatcattccaatgcgtccg

SEQ ID NO: 91341 - DNA, 540 bp, Heterodera glycines
  SCN-specific regions: Sequence locations=1-349,371-407,437-540
tcgtcagaacagcgcgtcggctgcttcaagaaatgaattgtcgaataaccaccgaacttcactttaccaactccaaaatggcacaatcgctggacccaaaagtccgtcgacggcgtccgatgggaccgatgaaagtgccggcaattggtagcagaatcggtcgttggccgaccaaatctctgaaattgacagtggcattgactctcttcgccaatatcattcgccgtttcatttcgccgcgactaatggcccacaaaagcatttttcggatcggcgaaagtctttgggcgccgtcgtggaaatggcggcggtccctttgaccgatgggacgacggccagcggaaactcggaagttgacaaatgtttggcaattcatttggacagggcgcagcaggcgattagggtgatttgccaagtccagcaaagtccgtttgagtacactctcagcagaatgttgtaccgaatggagagtactgaaacggtcgcactggagatgactttggcattggcacaaaatgcggcggtcaattgccagccgag

SEQ ID NO: 91342 - DNA, 607 bp, Heterodera glycines
  misc_feature (216)..(216): n is a, c, g, or t
  SCN-specific regions: Sequence locations=1-6,28-607
tcttcctttcccttcttccgcttctccgcctctctctgccattcctcgcgttcgtttcctcactctgtccctttccttcgtctccgtcgtgtttttcctgctcactttggcattttctgtgctcattctcaccaacatcaatgccctgcacacggaagtgatggtggacatcgagcagttcaaaggcgtcgtaagcaaagcgtgggacggaatggntgaacttcaagcggcggacggaggccaaaacaacgggaaaagtgccggcaaagaaaacgcacaaacgacgattgaccgacagaaaagacagtacggcacaatgccatcgtacagctcagcctatgttaacaaacagcagacatgcaattgcgctgcccgagcaaacaaatgccccgccggacctccggggcccccaggcgccccgggattgcccggggagccaggaacacgtggacaagacgggattccaggaatgcctgggatgagtcagagtttcgacagtggctatcaagatggctgtgtccaatgccccccgggcccaccgggcgttcaaggtattcaaggcgtgccggggactcctgggtctgacggacaaccaggaacacccggc

SEQ ID NO: 91343 - DNA, 612 bp, Heterodera glycines
  SCN-specific regions: Sequence locations=1-42,64-612
aatgcccgtactacaactgaatgcgctggaccacgatgggcttcagcagaagaagcttaacctgccaaatgcgccacggcaaccagacatcttgcttggaatggatgtttggcacgagctaaagattcaaccaattgaacaattgccaagcggcttcacaatttgtcaatcaaaaattggcaatattatcagcggaaagggtcgaatcgaactcagccaaccatccaacgtctctttcgtgatgatggttttcaacaaggaatcgacaggcagtaaaccgacacacatgcagaaagccaaacaacatcgagagagtaaaacattgagaaggcatcaaatcaacaagctcttgtccagcgctgcaacgttacgatcaagacgcaagcgagaatcggtgcccaacagcacaacaccaatcgtgattgatctttcttccgacagcgaaagaaactcatccgatgtcgagatcatacaagacccagtcgcgggtcaacaaatcagctcatcgaacaaacattcaactgctccattacccaaggcactgcgaaggccaacagcaacaaagcagagttcatcaattgccaaacgaccagcatcattccgcaagcaaac

SEQ ID NO: 91344 - DNA, 639 bp, Heterodera glycines
  SCN-specific regions: Sequence locations=1-532,554-567,590-590,621-639
gttacattctcattgaagaatcgctgatgggagacgaaattcggtgggcaaaatgccaaactgaaaaaaaacatagaaaaaaacaaatcagacaagtgtttgcccgtcatgccacctttccgcagccaatcacaacagcacaatcgcaactgatcgaactgtcccaaacggcggacggagaaggcggcggagagtttgtcaattgggacgcaccgtcggttgaaaatgccgaacatttgaacggggcaaatttggacatttccatcggtggcaccggccttttgcttggtgccggactgaccgtcaaacgatcggtgcgaaaatgccacggggccgagtgcgttttgggtaattatcgctgaatttgaattgctaaatgagtgataaagccgaaaaaaagaaaatgggtaatttttaatgacagcaagcttcaacgaagtgatgtacacaagcattgtggagtattcgctgatcggagctgcggtgatgttcattgtgtggaaaaacatcggacaacgccaaaaaaagtcggagcaaaaggaaaacaaaacaacgaccgcaaaagggtaataaaataattgaaaaacagcaattatttattaattaattaatgtttaattgctttttgagttatgttag

SEQ ID NO: 91345 - DNA, 589 bp, Heterodera glycines
  SCN-specific regions: Sequence locations=1-39,63-131,156-171,200 -226,248-589
gataaattgatgatgatgttccatctctactcattagtgttttgtttccttttcttcattttggcactttcttctcactttggcacctgcgctggtgccacggagggcgacgacggcaacgaccaaaatggacaacaacaacaacaacaacagcagaacagcagattttcaagcagtagcagcagcagtggcagcagcaacggatgccaattcagcattaataatggcatcatcagtgacgggaaaggctactcgcgacgcatgacaccggcggaggagcaacagatgggcaattatcatgcgcaggttgcgcgcgcaacggaggaattccaacagcaaatggcacaggcggtgcaggcaccgttccgcggcggatttggcattccaagcattggccaaacgccccaactccgtttgccccagctgccatgcttccgcgtggacagcagcagcggcggagacggcgcgcaatcgtcgcaaaacgtggcggcacaaaattttagcggaaatgccgctggtggtgttgacgaggaaaactatgcctctgtttcggttgaagaatgaatttctctgttcttctaaggatcgg

SEQ ID NO: 91346 - DNA, 601 bp, Heterodera glycines
  SCN-specific regions: Sequence locations=1-359,383-601
ggtaaaccgcccgcgcaaccaaacgcacctgtctgtactgctggtttctggcctcggttgtggtccattccagcagcgggtcatgcgcaaaagcgtgcagaacggtgcggagcatgcgactctcggcccgcattacctgttgggagtgggaagcgtgtgcatcaattagacaatgattaacggatgaatccatccatccatgttcccaccttcatacgccttttcacacgactttcggaatgtaccctccacaccggtggcgccaaatccgtccaccatgttgcgggtgagacggaacggcacaatctgaaattgacaaacgagaaggagtgtgattttttgtattagaattttatcgcaaaatttaaaaaaaaaattatttggaaacaaattgtaacggaatgactgtacctcgggcaccttcagatattcgcccttgtcaaagagaatgttgaagtccacgtggatcaaatcttggaagggtttctaattgcatgattgatttcatataattttcggtttttgaataaataaatcgaaaaaccggacaacgaatttttgggtgcaccccaaaatctcgccgccaattttcttataaaac

SEQ ID NO: 91347 - DNA, 73 bp, Heterodera glycines
  SCN-specific regions: Sequence locations=1-50
ggctcagattctttccgggctcagaccgaacaagcagcgataaaggtgccaaaaaaaaaaaaaaaaaaaaaaa

SEQ ID NO: 91348 - DNA, 492 bp, Heterodera glycines
  SCN-specific regions: Sequence locations=1-88,121-492
tcagacccggccatgttgggtgccgtgccgcatcagttccgctccccggccgacttccccgccgtggaaggcgtcgcggccggccgttccaccgccctggccgcactgtgccgcattgtgtgtgccaaacggagcagggaacggcttgacgacgaacagcttgcctttttcttcaccatcctccacgaggctctcatttcgaactaaccctgtcaaaatcaattttttcctgctgtgcgctacattatcgatcgtgaccgtctcatgctctgtgccctgctttaccacacttcggatgaattgttcaagttggcgctgaacggtgtgcaaattctgctgcccaattatgtgatggccattgacattgtgcacaccgagtcgatgaaactgcgattgcacccttcggtcagtcaggcggaaatgcgtgccgcctgtcttcgcgcattagcttccgtgttggcatggccctcagtgtttggcagcaatttaatt

SEQ ID NO: 91349 - DNA, 508 bp, Heterodera glycines
  SCN-specific regions: Sequence locations=1-240,262-508
gggctatcgtatgataccaagattgtgcaatttggttgcgtctgagaaaagttatgagttgttttaatcaaaaatttaacaaattttgcactttttgtccttcgactcaccacggtatttgcgtttggaaatttaaatggagtatttcttttaatatatatgtacttacgtaactcgaaacatataaaatggagctgctgagcttaaggggggggggacaaagtgacgccgaaaaacggacaaaattattttttaaaggacataaagcgttttaagccatttttgagttctcagatcaacatgaaggagtgatctgatcaagttggtgtaaaatttggtcagcatcaaaagttagcctagcaataattttttaaattctgctaatttgaaattgagttagtgtctgttaaagattttgcttcgttacttttgtatcgccaaaaattaggtcaatttggttgtgacactataactttttgagggattaactaatcacgatccttttttc

SEQ ID NO: 91350 - DNA, 536 bp, Heterodera glycines
  SCN-specific regions: Sequence locations=1-41,63-67,89-119,141 -145,167-171,193-197,219-223,245-300,328-536
gcggacggcaataacaagagaaatgggcggctggcaataacaagagaggcggacggctggcaataacaagagaggcggacggctggcaataacaaaagaggcggacggctggcaataacaagagaggcggacggctggcaataacaagagaggcggacggctggcaataacaagagaggcggacggctggcaataacaagagaggcggacggctggcaataacaagagaggcggacggctggcaaaaagaggtaaatagcgggaaatgaaaagaaaaacaccgtttttatgtagaatttttacgattttatttgaatattttttaccaacccacttataaatattatagaatgtatttcaaagttttttttttaattttgcttcaattatgtcatgttcaaccacaacaaggcaagttttgtagtttaagcaaacaaaaaatcgaaatcaattttcagaccgattagaacccgataagaggacaacgaaaagcaaaacgatgactgtttttgaaggctataaaatgcgtactgata

SEQ ID NO: 91351 - DNA, 639 bp, Heterodera glycines
  SCN-specific regions: Sequence locations=1-639
atttaaaaaaaaattctaatcattttttcttgttaccggcataaagtaaccaatccaaagcgcggccttagcgcttggatcaaacgcacaacccaaaggggtttattgcgttttcatcaagcgtaagagcaatgagtgagctcttgcgtatctccattgcaccaatggtggtgcgtctcaagatgtacattgagacagcccaagaaaacttgggcaaagagctgacggaccaaagtgtccgtgcagatcttcttgcagagagacaaaatctctgcaaaaccatttctcttcttgagaaatacaatggaaaatgggaagccattttcctgagagtgaagggacaagctcttcaagatgaagagcaaaattacagagacttcaaaccagaaggcaaggccttcatgcattgggtcgaccaagcccgagggcttgtcgacaccattgaaggggctttaggcctctcggagctgggggatgcaattccccagccaaatcagccagcacaagttgtgcagcaggcaccagtggtgcatcagcgtcatgatgtgacgcttccgccgataacattgcccaaattctcgggggaaccccgagaatggcctttgttttggaagctatttgagacttccgttgaaagtc

SEQ ID NO: 91352 - DNA, 297 bp, Heterodera glycines
  SCN-specific regions: Sequence locations=1-255,277-297
gagggattatgacgtatgagctgggaggccggaagcaatggcaaaatgaaaaatgaaacaaacgctgaataaaagtgattatagttgttgctccaaaaaggaggctaaggataaattaatattttaaaatgaatttgtagcaaaaagtgcgacctaatgggaaatgaatgccaaatcacctcccaacaccctgccaaaccaaagctaaaatgggcaaattcaattgtgaaagacggcacggcacgcgaataacattggcatttgaatatgaattaaattaataccaaaaataaacaa

SEQ ID NO: 91353 - DNA, 624 bp, Heterodera glycines
  SCN-specific regions: Sequence locations=1-47,71-480,502-624
agtaaaaatgttgttgtattaacagcggattcctcggcttctaacaccggtggtggtgatggtgatggttccgcagctgtgccaccgaccattagtagtggtgccaccagcaccggcgccatcaaaaatcaaattaaaaaaagccgcagtgccggcggcgtcggcgttggcaataaaagggtgccgccgacgacaatgaccgcaccggtggcagtgtcgccgccatcatcaactttttttacaattgaaccgccgcaacaacagtcatcaacaacgacgacggcggcacaatatcaaaaacacctccaccagcaccaagcgcgagcagtatcagcaacatcatgcacatccgaggagtctgaagagagtgtgcccgattcgtgggaagagggacgtgccccgttattgaggcgatcgccccgctcgccgctggccgacgacgacgacgaatgggcggcgccgtccgccgatgacagaaccgccgggcacgaaggcgtcgcaggcggcacggcagtcgcggatgcggcagcagctgccgacgccgccgcttcaccaaaagggcggcgacgcattccacgcgagcgacgaaaagccgggtacgccttcctcatgctcgttttttgc

SEQ ID NO: 91354 - DNA, 638 bp, Heterodera glycines
  SCN-specific regions: Sequence locations=1-545,567-589
cttaagttaaaaatttaagaaaattatattctgaaagagaacaattaaagctattgaatgataccacgaaatattaatttggttgaatttgagccaagctattaatttaattattttgcccattttttgtttttaaacccattggcagttttaagaaacgcgccagcacccaattgaaaaacatttaaaattatgtttttgaacatgaagggttatacgccctgtggtggactcgaacccgcgagccttacaaaccatggaattctctaagctagggttgctctccgacccgatgcgggcaattacaaatctcattgttgtactctctaaatcggatgaatctcttttggaaatgaatttcttagcttttatttttagaaaatttctgtttccttttttcaatttttaagaaatttactccccgacgaggatggttcagtcatccccgacaattttttcggggaatttactccccgttccccgacttttctctccccgagggtcaggaaggtggtatgggcgttgtctttagaggttctcccatttcttttatcccactttctcccacactccgcttccttttggcaccaaaaatattcaaaattaaattattattattataataagttatttttatt

SEQ ID NO: 91355 - DNA, 575 bp, Heterodera glycines
  SCN-specific regions: Sequence locations=1-575
tggtcatgtgcggtccgccggccccgtcgtcgttcgccgttgcccaggccatcatcggagtgatggcgcatttctatcgggacgaaaaagtgaatctggacgaccctttggtgtaccaccgactcgtcgaagtgcaaaaattcgcttatgcccaacggacaaaactcggtgattcggtttttgtgaaaaatgctcggcttatcagtcgcaatatgaccaaacacgctttttccaaatggatcgcttcgctaattcccgaaaaggcacagccccttcagtactattcgttggatttgactggccatgtgcccgaccacggcacttcgcatgtcgttgcaattgaccacgagggcaatgccatttcggcgacgagcacaataaaccaattgctcggttcgaagcgcgtttcgccaactttaggaattatttggaatgatcaaatggatgattttagtaccccccatatgaccaatttgttcgggattcctccttctcccactaattacattgtgcccaaaaagcgggcaatggcctccatgagtccgatgattgtgtacaacaaaaacactgaaaag

SEQ ID NO: 91356 - DNA, 633 bp, Heterodera glycines
  SCN-specific regions: Sequence locations=1-138,169-508,530-633
catccattgatttagcccctattattggatttatcccgcttttccttctttcgctcctccccttctgaactcttatttatacctctttttgcccccatataattattctgccaattttccattggcatggctctctctgcccttctcctcctccttcctctgcttctcaatgtgcaaaatatcccagatgagtccgtccaatcggatgtgaaagccgttgattcggccatttcgtcgctggaacaatggaaggacccgcgcaattcgttggcatcactcgactcacagctgacagagccccaacgagcactggccaaaatgttttgggaattggagaccatcgaaaaggaaaagccgaaggcaccgccacaattcgacttgggacttttcttggaagctttggaagcgatggtcgaaatgaacgaagaagcaaaggaagtgaagctgagaaaggacaaactgaccgaatgggcaggcggagagaaagcaaacgaagggaaagaagggaagacgaaggaggaggagacagtgccggaagtgagagttaatgagaatggaaaggtggaagtgacgaacggcgccggaggggacggaaagatggaagtcaagcgaggaaaggacgagaacggaaac

SEQ ID NO: 91357 - DNA, 657 bp, Heterodera glycines
  SCN-specific regions: Sequence locations=1-657
aatgggttttcccattgccatggctcgtccgtccgagatgaagtatgccgagaggattggcattggcgggagtgaggtgggtatgaccgcgatggtcatgttcccccacttttccggcacccccgggtgaagtataagccgttgagtctcgattttgccattgtttgtctcgatttcgatccatgcgctgagctgtaggtcccattcgatgcagctgaactcctcgaaaaccgtggtcgaggtggggacagccgcccaccggtagaacaggcacgaagctgatggaagcccacaggaattgtgccagaagcttgtgctgctcatgcacattgaatggccaggccggtgattgagttcgttgagttcggggaccatcacccgactgttcattgtgctgcagttgttgtcgcggcacgacccagctgatgggcaccttttcactgccacagtcgagattgtgtatgatcggagccaactctccgttttggggacacaaaccattgtaatcgagggcaacctgagtcgaaccgtccccaagagctcgtcctgctgcgttctgatcacaaacgaattgacctgatcggctggcagtaaggtgatgattgtggcggcagttccggcacatttgaagtctttggccgttcgggcacagtcctc

SEQ ID NO: 91358 - DNA, 539 bp, Heterodera glycines
  SCN-specific regions: Sequence locations=1-220,242-539
attcaaatgggctcaatgttattgagagaagcggagacgttatgggctcttcgctctccccgtttcatattgtcgtatgggaacaaaacaatatttggatgggtccaagatttgccgatctcgtccataccggtgccaaatttactccgtgcattagaagggacgataaaatttatgaacaaattactgaagaacgaaagactgaagccgaaagcaccggctgttgtgttgggctcagtggttgtttccagacatcagagtgttcggtacgtaaacttgctaattgattgtctcgatttttgtccagaaacaatttgcgactctcttgaaatggactaacggcacttttcccgaaatgaattactctcgtgttgtttgtggccaggatccccgatactgtgctcgcccgcgttcagtacatccttatgtgtggggactgaacatttcgaattggccgatttgcgaaaagcattctccatcaatacccaaatccgaaaagcatatgcactgtacggtcacaggacggccttgctgcattc

SEQ ID NO: 91359 - DNA, 579 bp, Heterodera glycines
  SCN-specific regions: Sequence locations=1-78,100-122,151-579
gaaacatcgctcgtctccatcatggcggtgaacaacgaaattggcgtgcggcaaccgctcaaggaaattggtaaagctttttaatttgaaaatttttcagcgtttataaaaaaagcttaaaaggatgtttattttattttttatgggaaaagcaattttcagttggtctatgttaaatttgattcatttttttgagaaatttttacaacttttgggaaatgttgaacaaaaacaaaaataggtacttaactccgacagtatacaaatgcttcgtattgtctgaattaggacccacacttcaaggggagctgaaaaacggtggtcatccctggactcgaattcaggggatacagtcaaaaattggtcccatttttaaaattttttttaaggttcctaatttaaaaaagcactggtctttattttaatgcctttttcttccaaacccaggcgaattgtgccgcaaaaagaatgtgcatttccacacggacgcggcccaagcagttggcaaagtgccattggatgttgacgaactgaagattgatctgatgtcgatcagtggacacaaaatttacggcccga

SEQ ID NO: 91360 - DNA, 380 bp, Heterodera glycines
  SCN-specific regions: Sequence locations=1-380
atctgatcgcacttggccaaaccaccaacgaggacatcaaagggacattcaatcgcaaattgcacccgcaggtgaagaatccgtacagcagcggaaattgcgtcaaaaatctcatcgccacactttgcgcgccggagaggccgagtttgctcgaccgtcgcggttggcttccccccgaaaatttgggcccgacaatttatttggatggtgccgttttggacggattggccctgacggcaaagcggcggttggcgccaacgtacggcacaaccaatgccatcgccacagccaacgacggcaacaaatcgctgctggcggtggctaacggtcgggcgaaagggaacgacgagggacggaggagagggggagggggaggagga

SEQ ID NO: 91361 - DNA, 635 bp, Heterodera glycines
  SCN-specific regions: Sequence locations=1-36,58-635
gatggtgatggacaaatacggcccatttggcatttgttttttgcccagcaatcaaagtcattgggatcgctttccacaaacaattgaccatcggccaatggatgcgaattgcgcgaattggtaatgaatgataatgatgataagttcgtcaattcgttgtccctatttaattagtgcgcgaaatcgtcgccaaaaagtgcggcggtgctgcgctgagtccctttctgaagtttatgctcggcacttatctgccggtcaccgaactgctccaatccatcgtactgaataaggtgagtttttgggtttggcattctgtcgaatttaggcttttcatccttttcccttctcagctcaaccaacgtacagtgaatgacatcgatgcaaattgggtgggcgaattgcgtgagagaattgcgcgtgtccgatcggacccgaccaggaaaagtcacttggcaatgcttcgttcactgcacagtgaattgtatttgctcagggaggacttcatcacgcgcaatttgggtgagttaattcattaaaggcaattatttaagttaattgcctttaatgagccaactaatgttacagaagtgccccgctcccacacgccgaccattggcggcgaattgcacagcgat

SEQ ID NO: 91362 - DNA, 157 bp, Heterodera glycines
  SCN-specific regions: Sequence locations=1-51,73-157
atttaatcaaaaatgagggatggcgttgatcaatagagaatgtatgcaaattgatcacagaggatggggaaaatggcactggtcaacagaaacatctgtgccaattgatcgaacgagaatgggttggagatggcactgatcaaagggaaaaaaagag

SEQ ID NO: 91363 - DNA, 619 bp, Heterodera glycines
  SCN-specific regions: Sequence locations=1-36,97-97,121-168,192 -269,298-619
aaagccaaattaaagtgaaatgcaataatgtaagaccaattgggtttcgtctgagcagctctgaaagctttttccgctccaaaaaataatcaagccaattggcggtcggttcgtgttgcagaaaattgagttgcacatccatcgaaatgattaacaagaattggatagataaaaaaaataaaaaataaattgacacgaataatcagaaattggccacggacaaaaatgaatagacagaaagtgatttattaggcccaaataaacaaatgaataaaattaaaattttacaataaataagacaagattaggtaacccaacaaaattcacataacatcggtcccacgtctttctaactaaacagaaaatggtacggatatccgtgatgtttgctgcgaaacactgaaagcaaaaggctgaagaagaccacaaccagtcctattccgatgcatgccataactgaattgaatcaataaaaaacggtgccaaatggtgaaagatccccacgctttcttttcccggggtccgttttgctggaggcagcatcatttaacacgacgacgccaagggtgacggcggcgtacaatgagagaacgatgtacgtctcggcaatgagttggta

SEQ ID NO: 91364 - DNA, 565 bp, Heterodera glycines
  SCN-specific regions: Sequence locations=1-311,370-565
tctcctgctgttcccctcttccgtccaccgaatcgtcgtccccaatgccaaccctgggcctggtcgtctgcttcttctggcttgtcctcaggcgctttgtccttcgtcttccaattgttcattcgctccgcctcaatccaaaattgccccgcaggcattttgcatttgcgctgggggatatttttgccattgaatggttcttgtgtcgagtgtaagtcttagcgcagcgtgccattggccattgctttgtcggttcagtgccctcccttctcgaccggctgctccccccacatgatcaggtcccgccgatgcttctcttctcctctcttctcctcgtgctcctttccgctcttctctcacttctctgctgtgtccaattgtgccgtcgctcaaaatcctccacccattgcaccgatgtgcacgaacttatggctatcgcagcggaggcgggagggccggtggtgtcggatggacgcggcggacattgcggtggcaatcggatcagcggcaatcccatttatgagccccttttgttgtcgtcgttgcctcaaattccacggcattt

SEQ ID NO: 91365 - DNA, 659 bp, Heterodera glycines
  SCN-specific regions: Sequence locations=1-64,107-249,272-403,425-659
taaaaaaaacattcaaaattagcgtcgtcaaaattgagtgcaaactgttggacacctgtgagccacagcaacaacaacaacaacaacagcaacaacaacaacaacacccgtttggacaggacgagttgttgctgatgggcgacatgggcacatcgacggaaatgttaaaaccgatggcattttgcaaaggcatggcacagcaacagacacggcgccaaattcgtgccgaagtccaacaaatgactgtgtttgaagtgcacctacaacagcagaccatgaccacagcaacaattattcaaaatggcacttcccacgttatgccatgttcttccacggcaccgtttctgaactcggtgccgttgccggccctcgaaatggacatcaacggcggcactgccgagtaccaacaacaacagcggcacggtggcagcaattctagtgccgaaaacaatggcacgggtggtggtgccaaaatgcagccaagacaaagacggaaagtgcccgagggtgagctgtgtgccgtgtgttccgacagggccaccggttatcattatggggtggcaagctgcaacggatgcaaaacattcttcagggcgaccattgtctctgaacacagttttgtgtgccagtacagtggcaattgcgacgtgacaaagaac

SEQ ID NO: 91366 - DNA, 637 bp, Heterodera glycines
  SCN-specific regions: Sequence locations=1-130,152-193,216-637
gtcaattctgaaatgataataggtagtttatattatgtctatattaaaggatttgactttgcatacaaaaaatctaaacaatttagggtaaccttcgaattgatgtcccgacggaaaaaaaagattaaaattttctttacatttttctagtgtaaatagatgaattaatcacgaattctagctcggtttttgcaaaattaataaatttaaaaaatcaagtactggatgaaaagtcatatacaaagtcaatgattttgaaaaattcgagcttggattcgtgatcagctcatttatttaccctggacaatgtaaagaaaatttttgtctcttttttcggttgggacaccaattccgaaggattacccaatttatgcttgcatggaaaaataaatcttgacacaaaaaatacatacctaaacagaaaatatacaaaattttaatttacttttgtatgcaatttcaattgaattgtcgagaagagcacggaaaatgtctttgacaacgttcaggtggggatagcccacacatttgtaaatgctttcctcgtctatttcagccgatgttgacaaagccgtgctctgtgaccaattcgcatttgatgatgccatttcatgcatttgctaaaaacctgaagaat

SEQ ID NO: 91367 - DNA, 640 bp, Heterodera glycines
  SCN-specific regions: Sequence locations=1-431,453-640
gccaatccaagctgaagggagagagaggaggacaaaagataaatgccaaaaacataaataaaaatggcaaaaagacgcacagaatagaacgcttttggctcagttgggtttcgtcgagtggcaaaaacacgcctaaagcggaaaaattaaatgccaatgatgaatgaattaaacacgtgcctttgaagataaagccctgttggccaatcttctcgtcacggatactcggggaatcattagcagctaaatgagggccaaagattagcgtaatggaatgactattcgtccaaaacacacgaaaaccgcaaaaggttcaccttcctccaaacatttgcgcaggaatgaatacaaacgggaaaagagcagctcgacaaactttgcgccctcttccctcgcacaaagccatctgcaaattaaaggcttttttggggtattttttaacaatttcttttacttcaaaagcgtcggttggccaatgatttttcgaaaaacttcgacagccaccgccgcctcccacgaattggtgggcatccagagaaggtccagcaaaatggtgaggatcagttcattttgggaggcctaaaataaagaaaaaaaggaattgctttaaaaactaaattaaaaaaaggggaggggaaac

SEQ ID NO: 91368 - DNA, 559 bp, Heterodera glycines
  SCN-specific regions: Sequence locations=1-559
tcgtcacgtttcgacggtttagtggacacgcattttgatggcaaatcagaattgaaaatttggaggccaatcacaattggcaagggccgtcgtgtcacatcggcagcatttatgtgcggttacaagtctgtgccgtttctgtcgcccgacagtccgctgaaactatttgtcaagggcaaatctgagggatttccattgcccgaccgtctgctgtccaacaaaattcgcattaaatgccttcaaattaagcacattgatcattccgtgatcgcttttctccatgccaacaagcaaatttgggacaaaagggccaccaatttgcgcattttcactttttactctaacaccaacatccaaccctttatggatgtgttggtccgagaaattttgcccatttttgcgccaaccattcaacgtttgcaacttctcgacgttgatctcttgatcaaatgccacagtgcttggcccacaattttgccggatctcactcggctgaactcaatcgatgctcatctgattttgcccagtttgggcgatgaccatttggacgcgccaactg

SEQ ID NO: 91369 - DNA, 646 bp, Heterodera glycines
  SCN-specific regions: Sequence locations=1-255,278-646
tataatttttgaagatgggcatttgtcaaagcattgaagaaaaagctatggaccttaaaacgaagcaaatagaccgagaacttattcaagagcatcttgacgcacaaaagattgtcaaactattattgcttggtgctggcgagtgcggtaaaagcacaatattgaagcaaatgcggttattttttaaataattgctttattgaagataaattaagtgaaaaaaaaaaattaaaacaagcattcatatgctaaagtattttaattatttgtttaataaaattcatttctttgacaatcagcattctacatgatcatggcttcacggatgaagaacgggaaaaacaaaaatcagcagtgtacaacaatacagtttggctatggccactttactccatggaatgcaaaggctgaacatcccatttcacaatccacgaattgaaaatgaagcaatgatcgtaatggaggtggtaaatcatgggaaagaatcagagccattaagcgatgaattagcacatgccattaaaacattatgggcaggtaaaggaaataaaattgtaaaaaaatggatattttgtaacgatgaaatttaaaaaatggaatatttagataggaacattagagaaaaggtttatcctcgagggcagga

SEQ ID NO: 91370 - DNA, 646 bp, Heterodera glycines
  misc_feature (528)..(528): n is a, c, g, or t
  SCN-specific regions: Sequence locations=1-646
tatagtcttccgtcagtgaaatgtctttgttgttctgattgtttgtcatgtaaagctcagaattccaatttatccaaaaacgacaatgttttgcgacaacccaattgcctaatttcttttgcttggcctgtgttgtagcaaactcattcaaattccgcaccctcccggcgccaatccggtgattctgccgttgaaggaaagtgaatttatgtcggagaaaaaggcaaaggtgaaaatcttgggcgagtccaattggtctgccgaattccctttggacatggccggcagcagtgggcgtgtcatttgcaaaggcatcgccaaaaagaagcgcgcatttgagatgactgtcgatgtccaattgggtcagtccggcctcacaaaagtggtgaccattttgcccttctttttgctccaaaatgacagcaaagttgacatcgaagtgcgcgagccgcacttgacgaaatggattgtggtgccggcggaatcagtaattggtttttggccagtggagaaaaagaaacacaaaanattagtggcacgttatgccaagacgaaagaggaatcggtgcaattcccaatcacagaggcattcgaaggcttttgtcaaatccggaataatctgatcggcctttacgtgatcgtatct

SEQ ID NO: 91371 - DNA, 654 bp, Heterodera glycines
  SCN-specific regions: Sequence locations=1-654
gctaaagccggtcaaaatgtctgggcaaggctcgggctttaacaatttaacaagaccctgtccgcttggctcaaagaagcccgtttaaccggacgacctgaacccggtagtttcaaaatttagctggcgcgggctcgggtggtccatgaaagtctgtcgagcgccagacccggcccaattatattgtataatcgtaatataatttaatttttcatgaccttttccagcaactattgcctcccctcttttggatgttggccaagttttgcggaccaaaagcaccgaatctttgccctttttgctttgcttggcaaatttggcggttgtcgatttcccctccgtttttaagtgccttagtactccagttcttttccaggtctgtgtccaatggttgttgtacggagttttggtcgacgatttctacatgaaagttcccaacggaatcgggacgttcatctcgaccatgcagttgtctctgttcatcgtttaccccagaacttacaaacaactcacagttggcaatgtttaagtgtgtccgaacgttgccaaagccatggaatgtttcgccgtgtttgaattggctaacaaacaataagcaaaacctagcagagctgtgtgtccgttgtcagtgcattcattacctccgtccatagt

SEQ ID NO: 91372 - DNA, 547 bp, Heterodera glycines
  SCN-specific regions: Sequence locations=1-113,136-547
tttcttgcgcctttttccatcttcgtcatcttcaactttgtcggcaacaaatgaacagtcacaaattgcgccatcacaaccgttgctcttcagcgcttacagaaatttgggtcttctgtgttattcaaatggtgaaccgaacaaattgcatttggtcattgtcgcatctgctggttcaccgccaacagcaaaaatattggaaaacccgccgaattcgtcgcaacccataaaaacttgtgtactcttcaaacgaataacaactgttgtcttatcgccaaaattgcccgaaaatgcgcagttcaccaatttgttggtcaatgccagcggcagtcgtgccacattggttggcacccgaatgatttttgtggtcgaattggacaccgacttttggcatcgtcccccatttgatggtccggactgtgtggaccatttgagacccgaatattatgcaaaatgcgatttgctccatgtgggcctttttgtccgcaatttccacccgccgttcgttgtgtccgttggtttgagcctgtctcggattttttggaaa

SEQ ID NO: 91373 - DNA, 633 bp, Heterodera glycines
  SCN-specific regions: Sequence locations=1-79,106-352,374-532,554-633
tatggcacggaaagacttccgatttccaacatttttggggtcggaattccgacttccgaaatttttgatgaaaagtcggaaattttttaattttttttttaaaaactagtaagttttctacaatttcagtagttaacagcccgtgaccttcgccaccttcgccagctgacactaattagaagtgacaggtggtggaaagggggtgccaattagtcactaattgactgaccggggtgcgctaattggtatggtcagcagtgagaggggtgacaattaattagttaattgggggggggggaaccaaaccaaaacctattgaacggtttcaaattgtcttgtacttttttgacagaaaatttgcttgatttaaaaagtgacagacgaggggaggggggaaattttttgattggaaatttttgattggtcaccagtgacagatggggaaaattatgatttgtcataaagtgacagatgaggggaaattcaaattttgggagggggttcgggaattcaaagtgacatttgcggggaaaatttaaattttgctgtgagttgtattttgatagatcaccaaactgacagctgagggaaaattcattttttttagttgtagtaccactaatgacctattag

SEQ ID NO: 91374 - DNA, 545 bp, Heterodera glycines
  SCN-specific regions: Sequence locations=1-462,484-545
ccttcgttgcctttcaaaatgatatgtccatcgcccgtagggttttgttggtcgctgaccttcactccatttcgacaggccgacatgaacctgcccaattgcggttgaactgctttcgcacattggccacactgctcgcttgtggggtaagcattggtcgttgagtcaaccaatccctcagaatgttcaatttgtcggtcgattcggagaagactttgctggtccaacagagtcgtttgcccgaacacaccgaactgatgtggattttgggttcaactacgactgtgacgagtttgacctcgatgtcgcaatttaaagacaaattcagagggtttccccaaggcgctgcccccctcggcttgcttgcctatccgttgttacaagcggccgacgttttgacgtacagagccacccatgtgccggtgggcgaagatcaaacgcagcacatggagcttactcgtcatttggctaacaaattcaattcgcgattccattgcaatttctttcccgtgccggaaaaagttctatttgcgaagcgattcgcc

SEQ ID NO: 91375 - DNA, 621 bp, Heterodera glycines
  SCN-specific regions: Sequence locations=1-80,102-199,224-227,249 -265,290-621
caatcgcaagcagctcagaagtggatgatgatgggaccaacagcagcttttctgacgacagaagaaaaataaataagttgttcattttgactgtagtgaacattacggtaacagtggcagtgatcattttctttacgattgagaatgcgcggatcacttctgagttggaatttttgaagaaatttgttggaaaaatggaacaacaatattggaatggtggtcaacagactgaattttgtaccaaaatggacaccgacaaagacatgataaaagccattgaaacaaaactcatcgaattggtggaacatcaaaagaaggaagaaatttttattggcgttttgaaagaccgatttggaaaggatggccaacagagggaattttatgccaaaatgaacaccgaaaaagacatgatcaaagccattgaaacaaaaatcatcgcattggaggaacataaaaagaatgaagaaatttttattggcgttttgaaagaccgatttggaaaggagcttttaaaagctgtgcacccggacattcgcaagaatattgttgagaagttttcgtacccaaaacaaaactattgggatgccaatgccagtcacaatgatctcgaagtctttggca

SEQ ID NO: 91376 - DNA, 588 bp, Heterodera glycines
  SCN-specific regions: Sequence locations=1-50,72-111,139-161,199 -506,528-539,561-588
acataaaattgtaaaaaagaaaaatatgcgcatacatttttccaaattgttgatgaggataaaattttcaaaatttttcttcaattacgttaaatttcagtgaaagccctctcaaaataaaccaaaatttaaattttgctatcattcaatgcccctaaatgttttctatttttctataaaatttatttcataaaattcgttactttgggaatatttgtgtcagtatttgaatgggacgcggaaaatgccatcgaataattcaagtgccattgaacgcagtaaaataagaaagaaaaaaaatgaaggagaaatgaacgaaccttatgctgtcgctgatgaaaggtaattaatattaatgagggggcataaaataattaacggcaaaacgatgacccaacaaaatggaaaagaactgaaacattatttgaattgtattttctcttttcaatcattaaccaataaattatattgctcggacattacttcgtttcgaattgaaaatttgcgaaaaaattatttacataaattcttccaatgcaaaaacttttgcatattttttagtttagtttattaggccccctattattt

SEQ ID NO: 91377 - DNA, 651 bp, Heterodera glycines
  SCN-specific regions: Sequence locations=1-651
ctttttcgtttaatgtattattctatgccaataattcagcgactgtcacatgaatccgccaccaaaacgtgggaaatattcaatgattgtagacgatgatggagaaacggttgggacgagtgaactgctgaaggaagggtggaaacagtgcgactacgtcagtaacagggcgaggctgagatgtcagaatgtgcgcaagccggagaacttgaaggagtacgggttttgtgaggagcaccggggttttatcgaacgcatcagaaaagagggactgcgagccaaacattgtttcgactcttctttcaactcttgtcaaaatcttcacctgacagatgacatcgatgagacgcttttgccgaaacacccggccgacttccctttcgtttacgagtccttatattgcgacaatcgcatcgatgacaatgacaaccctttgagccgtgctaatgtttttaccaagcgtgaaattgctaagcaatacgtcagtgcattgaggcgtcaagacgcatcgatccaacaaatgcgcatcatttatcaggaaaaacatcgcaggacattgcatcaaatcatggagctcaggggaaaatcgcatcttacgaaattgaacccgaacagggattctcagaagataaaacggattttggctatgcg

SEQ ID NO: 91378 - DNA, 622 bp, Heterodera glycines
  SCN-specific regions: Sequence locations=1-572,594-622
cgctttctttgacgacgaacggcacagcacgggcaaattgtgcacgcgcttcgccaccgacacgcccaacgtgcgctacgttttcacccgtctaatggtggtcatttcgtcggtggtcactttgctgggtgccattgccattggattcgtcaatgggtggcaattggctctgattttgttggcgataattccgctgattttggctagcggatattttgagatgcaacagcaggtgactgaccaacaacagaaaatcaaaattacggagttggggagttacaaatgttcagtttggcaagaaaatgcgtgacaccgaactgcttgaagacgccgggaaagtggcatcggaggcggttgaaaacatacgaacggtgcaaagcctgaataagcagctgttcttccaccgcaaatacgcctctcttttgtctgccccccatagtgccaatatgcaccaagtgcacatctacgggttcgtgttcgctttctcccagtcgttgatcttcttcatgtacgctcttgccttttgggtcggctcccttttcgttttgaatggcattatgcgcccggcatcagtttttcgcgtgttttttgccatcgctttctgtggccaatccgtcggtca

SEQ ID NO: 91379 - DNA, 548 bp, Heterodera glycines
  SCN-specific regions: Sequence locations=1-68,91-343,367-460,503-548
atccgaacgagcgcagtgcggagattccaaggtgaagccgaacgcactgaaaagacgctaatggaaagcaatggacagaaaagacgaacattcccatgcactgtttgaacattggcaacggggccaaagtgccggaggcgagaacgatggaccgagtgccacgtttctattcatatcataattaaggaaaacagcagagccaccagtacctgcaggtatttcattgctacgccagcgttgaaacacctcaaattggttttgattttgcggttgtcgtccccccccccgccccatttcgtcgtaccaataattgagtttcacttccgttacgggttttgcgctttcaattccattttccccaacttccatcagttctttgtgctgttctcgcgggtccaaaatgttttccttttgctcaacaaaaagttgaaaatgacgagaggcatctgcaaaaagaataaacaaaaatgtgtacaataatttaacaatttccattaaaaaatgcattaattcatttcaataattgaagtcagtgccttcatcgctct

SEQ ID NO: 91380 - DNA, 574 bp, Heterodera glycines
  SCN-specific regions: Sequence locations=1-7,29-174,196-217,239-574
aatgaataaaaataaatcaaatgttaaaaattcacaggtgattaaaatatagtgtatatgtggcacagaaaatttcctactcagaactcattgcttttagtaaacccctgaattcctttgccttattaatttgcacctaaattcgcatttttggagctcaggttcgaatccaacataaaaataaatatattttaagtaatctataatgtaactaaatcatttaaaaagccattttttacactaaaaaatgtatgatagtttttctttagtagaaatgagcaaaaaaaataatgaatgtaaaggttgggaattaatcaatgccaagcaatgcaaaggctacggcggttatcattaaactgtaatttgattaggtttcaattgcgaataatctattgagccggcgtctctatgggtttcctgaccaaatccgtaattaggtcctgtctagctcgggaatctcgacaagtccgtcgttatccgtatcttcattaaaattataatttcacaaccaacttgggcaagccgagcagcggcgacggacccatcagaagcatgacaatgaccattcccactg

SEQ ID NO: 91381 - DNA, 555 bp, Heterodera glycines
  SCN-specific regions: Sequence locations=1-232,256-555
cattttgccgtcgtcaattaaaccgcacaccgatttgttggatttggacccgcttccactcactgcgctgaacaacccaccctttcaaagcttgtacaactttgaattcttcaaccctgtccaaacacaagtgttccacacgctttacgctactgatgaatatgcgctgatcggagcgccgacatcatccggcaaaacattgtgtgccgagttggccattttccggctcttcaaccaaaaacccgggaaaaaatgcgtgtacattgcaccgttgaaggcgttggtgcgcgagagagtattggattgggaggacaaatttaatcgacggcttggctatcaaattgtggaagtgtccggcgacaacacgcccgagccacacgaactaaacagggcatccattctgatcacaacacccgagaaatgggacgggatcacgcgctgtgcggacacacggcactacgtcaaacaggtggaactgttggtcatcgacgaaattcatttgcttggcgttgaacgcggtgctgtgcttgaggcaatcatcaccagaatcaagtc

SEQ ID NO: 91382 - DNA, 529 bp, Heterodera glycines
  SCN-specific regions: Sequence locations=1-529
gacttcgcgctcttcgatcgaatgacgtctttcgaccaactaatgcgcggaattcggcgccgaccaaacgagagtgtcgatgagctcgggaacagaatttcgggtttggtccgccgcgcttatccgggtttaactgaacagcaatacgatgattattcaatcatgcactttataagagccatttctaatcccgagttggctatcactcttgaaatgacacgcagacccggagcgacatttgatgaattcattgcacaagcagcccgagcggaagcaacgcatcggctgccagaaattcgtttaggtcaaatcaaacttttcaacggcaaatgccgaattcgtcatattcatccaataatgtgccatcaaacaactataccagtaattggtccagaccagaaataaacacaaacaagccaaccaatgtcacatgtttcatgtttgcctcccaattgttaggggatcagaaacggctaggattcgaatgttcgttgcccagcctacttttggatacgatcttatctcttct

SEQ ID NO: 91383 - DNA, 534 bp, Heterodera glycines
  SCN-specific regions: Sequence locations=1-157,179-534
agtcacttttgttgctccttggccaactgttgaacatgtttttggtgttggacgcgctgaaggacatgaaagcgtccatcaaaaacgatttgtccacatttcgccgtgcttcgcaattcttcaccaacgattccaacaacctcatctggttcgtggccacacagaacaaaatcaaacagtcactcagagaacgcattcaaaaaattgaagcccacgaggaactgctcgccgatctgatctacatcagtgcacattttcacgagaaccgaatgttcatcagccctgaccaacggcacacgcacatcaaagtgatcgcattttgcctttatttgatggatgccgaagtgtacacacggcttgaccagaagaagcgcatttccatccaaaaatttgacaaaatattcaattccatcgaagtggtgccactgttcggcgacatgaacattttgccgttctccttcgtcaaacagtgccgaaacacgggccaatgtgccaagggcacggggcaacagtgcaaatgctacgacccggcca

SEQ ID NO: 91384 - DNA, 556 bp, Heterodera glycines
  SCN-specific regions: Sequence locations=1-556
ggcgtagaaaatggcgactgcagggcaattgctttttgatgagtcgggtcaaccttttattgttattcgcgagcaggagaaacaaaaacgtttgaccggcattcaagcgctcaagagtcatataatcgctgctaaacatgtggccaacacattaaaaacttctttgggtcctcggggccttgacaaaatgctcgtaagctctgatggcgaagtgacaattacgaatgacggagcgacgattatgaaaaatatggacgttgagcaccacgtggctaaattgatggttgagctgtcccaatcgcaggacgacgaaattggcgatggtaccacgggagtggtcgtgttggccggtgctctgctcgaacatgccgagtctctgctggacaaaggaattcacccgacgaaaatagccgacggattcgaattggcatgcaaaaaagccattgaaaaggtggagtcaattgcgcaacaatttcccatcgatgacaaaaaggcgctggtcaaaagtgcgaagacttcgctcggctccaaagttgtgaaccaatgtttgcgccaa

SEQ ID NO: 91385 - DNA, 205 bp, Heterodera glycines
  SCN-specific regions: Sequence locations=1-205
tgcccaccgattgcaaatgttggacgcgtcgcttcgcagggcctgacgattccacagagaaattgccctggaaatgccccaccccccatcgtcgatggaaattctgaaaattgtgacaaagcgcctcaaactggacatacacgtttatttcgctgtgcttgcccgactttctcccggttatgttggcgccgatttgctcgccttg

SEQ ID NO: 91386 - DNA, 643 bp, Heterodera glycines
  SCN-specific regions: Sequence locations=1-643
cccgtcaccgggtcacagctggcaccgttctgacaatggcacgactcggcacattgcaagccgaattgacccggagggcattctaaggaaatttcaaatggaaaagggcataggaggccaaagtgaaacgtaccgaactgacaacgaaagccgtaacgccccttgggacaatgacagcagccgctggtcgggtcacacccggccgagccgtgacagtcgcattccatggagcagttgaagccgtacttcccctggggacactgctgctgacaggtgggcccaatccaaccggagctatagggaaagcgtggaatggcaatacataaacaattgacataaaataatcgcagtaatattctccgcttcggttttggcgctcacccgcatttgcattggcctgtctttgggtcacaatttgtcggatcttcgcattggcacttttccttgcagttttggccaaatcttccggccctgcacatttgcgtgcagtgcggccccgtgaagccgggcgcacaacggcactcgccgctgcgcgggtcgcagcgagcgccgttttggcagtcgcacaaattagcacagctgaatggtgagagaaaaaagtgacaggaaaaaagtttaaatgggtcgagcaatgatcaaatta

SEQ ID NO: 91387 - DNA, 488 bp, Heterodera glycines
  SCN-specific regions: Sequence locations=1-330,411-488
gggccacgaccctttccattgccttcgctgtttctccatcgccgttgccatttggaacattttgtactgtttgctccaatttgccctgctcggctggcaagttcaggtggtcaaacaatggcaatggcactgggagaatcgggcattgtttgttatgggggcaattgaccaatatcaggcgcgtttcccgggattatacgccatttacacagaaacacccgaaagacggcgagtgaacggtgaacaaaaagggaaaaatatcgtaaatttaatgtgtcattaatttaaagggtcattaatgggttgggatttatttgtacaaaaaaatccattaaaaaatatttatgaaaatgtttaattacattgataaaaagtttaaaatacaaattttcttaataatttttatttatgaaagcccaaaacatttgacgttaaaatgaatgggtaaatatggtttttttgtgcatttctcatcaaaataaagctgc

SEQ ID NO: 91388 - DNA, 427 bp, Heterodera glycines
  SCN-specific regions: Sequence locations=1-427
gtacaccggctacatcgacatgaacatgtcctttaacttctaccaagagggcgtagcactccacaagattgcgaaaagggtccaaaaacggtccgacgaagatcacgtacccggtaccactttcatgagagaccttatttctccgggtggccgtcccgtcgcttataacgttcacaatccggacaacgacaagtggggcagagccttggaagcattccaagccgttttggctctcgagaagttcaacaatgagtcccagttggagctgcacaacctcgctactcaacaaggcgactctcaaaagggtgactctcttgaggacacatacctccgtggagatggccaattgattgaggatattggctcaatcgtcacctatctcgggggcgttggatacggttcgggcgagtctctttctgacaagaat

SEQ ID NO: 91389 - DNA, 620 bp, Heterodera glycines
  SCN-specific regions: Sequence locations=1-458,480-620
acaaaatgcggctccacatcgatggcctaagtgtactgtttccctatgaatatgtttatccggagcaacttttatacatggaacaactgaagaaagtgttggatgcgccaggccattgtttgcttgaaatgccttccggaactggcaaaactgtttctctactggcgcttgtcgttgcttatatgagaaagtatccggaaagactccacaagctgatttattgctcattttttattcctgagatagagaaatgtgtcgaagagcttaaaaggctgtttcgctattataccaatgtcaccggatccgcccccgatttccttgccctcactctctccgctcgtaaaaatctgtgcatcaataaatccgtcgtcagttttcggtatggttcggccgtcgacggagcttgtcaacgtttgacggcgagttacgttcgggcgaaaaggcggctgaatccgaaccttccctgttgttcctttttcgaaaaatttgacgagaaaagggacatgactttgccgaagggtgtttacaatttgtcagacttgcgggggtggggcaaagagcacggcatgtgtccgtatttcgtcgcgcggcacttggtaaatcgtgccgacatcatcgtc

SEQ ID NO: 91390 - DNA, 508 bp, Heterodera glycines
  SCN-specific regions: Sequence locations=1-508
acatgacactttgaatggcaacaggatcataccacaggctcttgacacttacaaagatgtccaactttctcgcggaaaaaccccatcggtcattgaggacttcaacaaccgcattttcaatcgaaacttggagctcaaacaatactgactgtttttttgctcctccttgcacacgcgaacaactgacatgattgagagaactgataactctgtttcgaaggaccgcgggagtacaacgacaattcttatggacaccttgaacaagctgtacgagactcatttggacgcctaatttcatgaccaagttcttgggatgataatccgttttctggagtgccaaaaagagcccaattacttcccctaatcgcaacgcttgggtgaactcaacaaagctcactcagggctcgaattggacgaccgacttcttgaccagaacaacgctctgatggcgtatcagctggcatttgatctttatgaaaatgcgccgcaggagttgttcaaccacatg

SEQ ID NO: 91391 - DNA, 596 bp, Heterodera glycines
  SCN-specific regions: Sequence locations=1-93,115-370,401-425,447 -498,523-546,570-596
atatcatcagtgacgcccgctcattccgtcgttcgcgttctgccgcacttgcacgtttgtcaacgtcgtccacttcgtcgccgtttgcggtgcctccacccatggctgctgccgcctcgtcggacgacaacaacacatcgcttgacaccgaatcaatcactacgacgcccccgcgaacgccgcgccgcggtaaacaacaacaatttaatctttcaccggcaacaccaccggcgaagaacatctcatcaaactccaccaatgggagtggtggtggtacgcctgtgccgcgtagcgctctgcggcgccgcggcagccgcacaagcccacgactggccccagtggtcgagaaaggggataatgaggaggatatagcggaggaagaagaggaaaaacagcaacagaccaacgaggaagtggagcagcagcagaacacagtggaacagactgacaatgagacgaaaatggtggatgaagcggacaaagcgacgactgaggcgcaaaaggagaaagaaagtgaagaggccggtgggtcggaacagaaacaagaggatgaggagaaaatggagctggacaacgacaacgctggtcctgatggt

SEQ ID NO: 91392 - DNA, 607 bp, Heterodera glycines
  SCN-specific regions: Sequence locations=1-180,203-444,466-533,555 -559,581-607
attagattatgcatttatttgcagaaaaggctttacggctctcaatgcgatgggtgtttgtgatcaccaaaaaagatttattgcatttttttgcaattaccctgggtcttgtcatgacagttacgtattacggtatttcattacagttgacaaaaaacattgtcttaaatttcaaagctcctcacaattcttctcaagaatgtattaagggggtcttgatgggataatattgggggattctgcttacccacagaaaaattggttgtttacgccagtaagatttccccgaaatcaaaaagaagaagcatataatgccgcacatgccgtaacacgtgttactatcgaacagtgctttggtatttacaaaaatcgatggagatgtttaatgaataagtgtaggctccaacccggtataaatttattttttgcttttttcacttttaaattaagaaaaattggcaaaagtagcaacagtttgcagtatgcttcacaacattgccattgattgtcaggcaccacagcctgcttttgatgatgatgaaatcgaaaatgagcaacaagaaaatttaaatgatgaaaatatcgcattaagtgccgaagctgttcg

SEQ ID NO: 91393 - DNA, 633 bp, Heterodera glycines
  SCN-specific regions: Sequence locations=1-196,218-633
attcattttgcctattcctatttttcttgataaatgcaagcgccgcaaccgttgccaaatttgcaccaaattttccaagcggtggaccgcgaccggtccggtcagatcagtgcggacgagttgcagcgcgcgctgtccaacggcacgtggcagccgtttaacccggagacgtgccggatgatgatttcgatgtttgacaacaacaacgacggcggcatcagttttgccgagttccaatcactgtggaattacatcaacgattggacccgcgtgttccgcactttcgaccgggacaacagcggaaacattgacaagaccgagctgacgaacgcactgacccaatttggataccgtttgtccggcccgttctacgacatgttaatgcgcaaatttgaccgtacccacacaggacacatcaacttcgacgacttcatccaactttgtgttgtgctccaaacgctgactgccgcttttcgtgaaaaggacaccgacttggacggatggattcgcattcgtaacatgccttttcttcccataatattttaggaatgatgtcaaaattgtttttccttcccagctagtgtcaattttatggaaatcccaaaaattaatgcgaatttacaaatccagtat

SEQ ID NO: 91394 - DNA, 600 bp, Heterodera glycines
  SCN-specific regions: Sequence locations=1-600
ttcccgtctattcttccaaagtccgttcttttttggcccaagtcgatgactctgaaatgcttcgtcccgactttgatctgacgacttacataaacaccattttccctaccgaacaatcgcttgtccatttggattcgtttgtaaagaaaattgacgaagaaattgccaattacgaccgtgaactgtccgaggctgtcgctgaacacgggcgatgtgcccttgaggcaaataacgctttgctgcaggcccagacaacaataacggaattggagcaaaaagtgcaggaaattcgtgacagaacgctttgttctgagaattccgtgcacgaactgacaaaagacattcgacaattggacgttgccaagaaaaatttgaccgaatccatcgccactctccaccatttgcaattgcttctcaacggagtgaatttgctcactcaatgggtcaccgaaaggcgatacaatgaaattacaacggaactgccggctgtgctcaacgttctgttgttatttgaggactatcagcacattgaacacgtcaaacagctgacggacaaagtgcagaaaatccgcgaacaattgaccgtccaattggcagccg

SEQ ID NO: 91395 - DNA, 626 bp, Heterodera glycines
  SCN-specific regions: Sequence locations=1-626
taagcatcgatgaggcgtctcggcgatatcgacgacagtgagagtgttctacttctacttaattccccgcgcaaacggagtcgatttccggccattgccagtggtgcaacaaatgtgaccttccaacagcacaaagtgacgcgggaggagcgtgccaatgcgttgggccgtttcccgggctttcgcggctgcactttgtggttcaccggcctttcgggggcaggcaaaacgacaattgcattcgcacttgagaaggcccttgtgcagttgggcgttcccgcttacgcattggacggggacaatattcggcacggattgtgtaagaacttgggattctcggcagaagaacgagcggagaacattcggagggtggccgaagtggccaaactgttcagcgacttgggaatggtggtgctcgcctctttcatttcgcctttccgcgcgggtcgcgaagaggcgcgccgaattcacagcaaagaaaatattccctttttcgaaatatttgttgacacgccaatcgaagtgtgcgaagcacgcgaccccaaaaagctctacaaaaaagcacgcgccggcaaaattcgcggctttaccggcgtggacagcgactacgaagtgccgctgcaagc

SEQ ID NO: 91396 - DNA, 632 bp, Heterodera glycines
  SCN-specific regions: Sequence locations=1-566,590-632
caaactgtgggggagatgagctgcaatccgagttttggtggcattggaaaaggccatttgatgcgtgaaattgacgcgttggacggcgtttgtccccgcatttgcgaccaaaccggcacacattttcacgcactgaaccgaagccatgggccggcagtgatcggactgcgggcactgatcgaccggaaattgtacaaaaaagcgatgcaagcggagattttccacaacacgcccaacctggacgtgttggaagcggcggtggaggaccttttgctgctcgagtcaacgtcgccagttgcttctacctccccctcggcctcggctgtcccgggtgacgatggtactgaaatggccacgcactgtgtgaagggctgtgcgcttgccaatggccgcttgatcattgcgccgactgttgtgatcaccaccggcacatttttgaacgcggaactcgtgtggggcgcgcaacgaaagcccggcggtcggatgggcgaggcgaccagctcgggactggccggcacatttcgtcgcgttggatttcgcaccggccgtctgagcacgggcactccccctcggctgttggccagcaccattgacttcgcccgcttcaccacccaaccgagtgatgccgtgcc

SEQ ID NO: 91397 - DNA, 529 bp, Heterodera glycines
  SCN-specific regions: Sequence locations=1-332,370-387,411-529
acgaatttgattgagccgacccggcttagacgaattcgttgagccaaactggcttttacgaattcggagagccaacccggcttttgatgtctagcagtttctttgactgcttttagaatgtgccgactcggcttcaaaacaattcacagccaatcccggcttttcggtgaatttgttttgccgtctcggctttttgctttgtcctgaaaacaaaatttgatgttttttctcacccgaagatgtagagcaggtcctttgctgattgcgccaaattgttgtgtatttactacaacaataaaaatgtttggtttttaaccaaaacaaatgttgtcaaataataaataaattatttatttaacaaataaatatgggaggaggacagcagagaataaataataaaataaaataatgaaatggtggaatgaatgggagaatgcccggagtgagggaaaaggagacatatttatggggctggtcaaggggcggggagagagacaataagagagggagtgaaagggaaaaaaaaaaa

SEQ ID NO: 91398 - DNA, 625 bp, Heterodera glycines
  SCN-specific regions: Sequence locations=1-516
atttggtgaatggcttttgagttcctctgatttattttcctcctaattcttttttgccaattcgatggatccacggcacttttgggtccaatctcttcaacatgagttggaattggagttgaatggcacaattagttatttggacgaagcttcgcgcttggcaaccgaaggtaatcggacgctgaatgagattcgaattcgactggagaaaagggacgagttcagaagggcgagcaatgaattggacagaaggcgaagaatggaccatttggaagtgcacaagcgatggaaacagaaatttggggagttggagaaggaaatgaatgagagaatggcctcaattgaaatggaatttcatcggagaatagagcagctggaagaggagagaaagacgcaagacgcacaagtcgagcgagaatggcaccagaaaaaggcggcattggaatcgacggattggttgacagcgaattcgcagcggaacgaaagcgatgggaatggacaaatggaggacatagaaaggagacgggaagagaaaaaggagcaaacgaataacgaagagaaagtggaagagaaagagaaggaagagaaaaaggagcaaaagagtgaagagaaagtggaagaggaa

SEQ ID NO: 91399 - DNA, 575 bp, Heterodera glycines
  SCN-specific regions: Sequence locations=1-543,567-575
cattttttggcatggcattttggcaagaggggggccggccgcacgagattctcggtctcaaatctagagaatttctctgtcttctatgtctcggtcttgaacccttggataagccccgatttgatagaaagtctcgaaaaaggtcggctctcgaagagccataattggcagtgtgatgtcgggaatggaaaattcatggcactcgcgagacgcaagattggcattagcacacctgtccaggcaagaaacaaggatgggatttgtcaatcccgagaatgggtgggggcccagattttcccatttcagtccaatcaaatctctctctattcccatttcagtgccacaaattcccccatcccatttcagtcccaccaccgtgagtcccaacaccgggaacagtccctgcccattgtgatccccaaattggaaaatcctttgggctttcaatacgctttggaggcgcccatttccacgtccattctgaaggaggacgatcggatgacatatgtgaacaaagcaagtgatctgttgaggcgttaattaaattttcattaatagtttttgttcgaaaaatc

SEQ ID NO: 91400 - DNA, 564 bp, Heterodera glycines
  SCN-specific regions: Sequence locations=1-564
acggggcaggctcgccttttaagtttctttgaaagcattgggtggaaggtgtacaccgttcctgagaccgcgtcatttttcctcggtcctggacgcattcgttttcccgacctgagtagtgagcaggctgctcaattccagacagatttgctcaaagcattgatacaaaatgaggatgtctttttcaaccaggccgaattcagtgaagcggaaaaaattatgatcattttagaccggggtgcgatggacggaagtgcttatatcgacatggaatcttggtcagatgtattgtcagcatgtaaggtgaccaacgaacaattgcgtgaaagataccaccaaatttgtcatctcgtcaccgcagcggatggtgcacaatcattttatcaacttgcgaataaccaagcccgaaccgaatcaatggatgaagcaattcagcttgacaaaaagaccaaagaagcatgggttgggcatgaatatctatcaatagttgataattcaagtggttcgtttgacgaaaagatctccaaacttattgctgatgtttgtgaacgttttggcatttcg

SEQ ID NO: 91401 - DNA, 607 bp, Heterodera glycines
  SCN-specific regions: Sequence locations=1-71,93-447,499-531,554-607
tatttaattcaattgttcttcatgacaattcaattcacatagtgaaaacattaaatttacttttttcccaaattgctcaataaacaattttcgttgttttggggagggcaatctgacgattggtactccaatttactgtcgagaacatgactgttttaaaaataattcattcaaacaaaaatatggaacaaagttttgcttttatgaaccctatgaaaaaatttatcttgtgaaatctgatgaagaattaattcaaatcaaagcatggggaactactgaaaaaatattttacttgccaaataatttaaatcaatcatttattgaaaatagacggaataaaagagaagaaaactcttcaatcaatgaagaagcaaccattgagtgtttaaaaggaggcattattattaaagcaataaatgatatacaagaattacaaatttccattgaaaattatacaattataaaaaagaacccccaaaaagaggaaataatttatttacccccaaaacttacatcctttgaatataaacctgtaattaaatttataagtaacccagataaatcaaatgagaaacaaatcacatgtcaatcatctcccgtatgcgaa

SEQ ID NO: 91402 - DNA, 541 bp, Heterodera glycines
  SCN-specific regions: Sequence locations=1-541
gattccgcgaggatggtgattacaactgctgcatcagttcccaattctatgctcctgaacagccgaaacgatattgcacgacaacttctccggatttgctcaactcttctcgaggtcatgttaatggactttgtgaaaggtgtaataagaaccaacaaattattgtcgaacggctgaataaatttgaagctattgatgaggagaactatttcgacgagcttgaaacgtacaagtaccgattgaacaaggcatatccgttgtgcaggcgatgtgaaacgtatacggcgaagaaacttttagatgtacaggcgaaattttcgacgccaaaacgatcggtaaaatcaacgaaaacgttttctacaaagaccttttcaattggcggaaaaacagcttcgattgttggctcggttaagcgctcaatttccggctcaatatttggtgatgaacatgttagccatgttagtagtacgaaactcaaacagcataatcacactgggaaaagactttttgcatccgggttttatacgaactgtgtgaattc

SEQ ID NO: 91403 - DNA, 621 bp, Heterodera glycines
  SCN-specific regions: Sequence locations=1-569,591-621
atgacataagggtagaggctgaccacgtcaatgcacaaaatctcctccccttcggcacacacgtgatggagcttgaacggctccgtacgaccacccctcaacgcgtcgctgcgtgggtcaagcggacggggcacaaacacatgctcataccgccccctcagcgccgggtccctacgcagccgctccttccactcacaggcccacaccgtgtgcagctcacagccgtgttggtgctccagctcccacaaacgccgcaccgtccgctcgtacagatcctccgccgtccgaccggcggccaaccgttgttgccggttggggaagcactcaacacatcctagcaataaatttggatacaaaaaaaatgggggctcccaagtgcgcgaccgtgatagtaacagcccatccactcgatggccatcgggcgaaggggcggctcccgacgccaaaggccgtccacccgatacccgctgtcctcaatgtgcgcctctccaacggaccagctcgcacactgcacctgcgcacccggatgctctagctcaaagaagcgaatgtagcgcctcgactcggcggaagcacgacgtccacgcaggtagccgccctccggggagtggaccaaccggt

SEQ ID NO: 91404 - DNA, 614 bp, Heterodera glycines
  SCN-specific regions: Sequence locations=1-27,49-614
cttcgaaagctgtgttcaagtgttgaagatggaggagaaggtaaattcaatggaaaaaagcgaatggtcgaacgaatggaaggcactcacacaaatagagcccgaacagtacaatcgatacttatactttttacgcactttttcgaaaaccagaattcgctttacagcttttcccacggccctagtctctgggtcttgaatgaattttggaaaatgatgcaaaagacctagagttctgttaaaaaacaagaattttgtctggaattctgtccgggtcccaggaccgtcacaggatttcggctttgggaaatacggggtgatgacgaccttttttcccatttttatgcggcgcgctttttcaataattttttggggaatagtgggtttttgcatggacacacccattaagattgtcaatagcagcagcaaagaggttgtccgtcttgagtacgtgttgccgtccgtcgccccgccaaaaacgtttcattacaccactgaacagttggacaaccagttgcagtgctacaaaaatattcacccagcggaaggtgggattttttttttagtttatacgttttgcggaatttccatcgggttactgtattagaaccagc

SEQ ID NO: 91405 - DNA, 617 bp, Heterodera glycines
  SCN-specific regions: Sequence locations=1-29,51-174,196-617
gcacccccccccccctcacttttttaataagaaaataccaagaaaaaattgaaagtttttagctattttttccaggcaccaaacattcatcatatattcaagattgaaaatggaactagtaaaatttgtttgacgccaatttcagacacttgagacaaaatttgcggacgaattggccacccaggagcgcttctacggcgcggacggcggcacgacagcggctgcggcattaatgagttcatctacctccacttcgtcgtcgtccaacggcggtggcggcatttgtcccccggccgtgccgcaacatcagcagttttcccttagcggaggcagtcatcaacggcacttttgatggattaatgatggcaaaaaaagaaaaaaattcctgcagaaattattgccttattatttttattatcacattattttgacgcatcattccttcctttgtttccatttgttttgtgtcacattttcgcatcaattttagcccaaaaatgattgttcagaaacagtgaaaagcacacacactatataagctattgtaaacaagctacatacaaatgcatgcatctttttcattgtaatttgccagtgtttaagtgatcaatccgtct

SEQ ID NO: 91406 - DNA, 648 bp, Heterodera glycines
  SCN-specific regions: Sequence locations=1-648
gccaaggcatccctgaacgatgtctcccactctggcatgcttcgtcttgccatggtgcgtgggagctccttcgataggtgactgtcctcggtgtcgactgatctgctcgatcgggagatgctctgctccctttcttcgtcctcaaatgtttgcctcatcgcctgcagatcaccgagatgctcagccgcaatttggagcagttcggcaggagttggatgctcccgcagttgcagatacttcgtcgaggctggcaagggggcggccacgaaatcatacaagaaatcctgccgctcctcgggtgctgcacccgcttctgctattcccttatcgaaatgaccttcaaaaatccgagtgacctgtccaagtccccgttccattgccatcagccgcgcggcgtgctcgggcgcttcgcccctcgtgaaatccgagtccatcagctcccgcgcttctgcgattcgcgacgagagtgtttcagccgctctctcaatccgatctcgggccgacctcaccgtaattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcg

SEQ ID NO: 91407 - DNA, 601 bp, Heterodera glycines
  SCN-specific regions: Sequence locations=1-37,60-63,97-143,165 -168,208-357,379-601
gtgttaaaaggctttaataaagcggagacataaagaaaggcccacaaaaagaaaggcgaattgaattttaattaaaaaaatattttatgtaattaaggtccgtgtaaattaattacactaattagaattactctaaataggccttgaaaattattttctgtgtcgttgttttatttatttatttttatattttaaattacttttattgcactttcccccattttattcacatacccaagtgttttccattcagtgtgtaagtgattcggccgccaactcggttaacaccacagccaacaatgtcaccgacatccaacgagggtgtgccatcaatggcactgctggcaccatcgcgggtgctgccagctgccgatgtgctctgcccactcgtgccagccgaaaataggtcgtcataattaagtgcttaaattttgcaaaaaaaattggttctaaaatgaaaaagcttcccgaactgactgactgactattgagaatgttattttgcgtggaaaatccagcatttgcccggtttggggaatatgtgccggattttgtcggatttttaagctagtgtggcgagtgtgcggattttaattttggc

SEQ ID NO: 91408 - DNA, 447 bp, Heterodera glycines
  SCN-specific regions: Sequence locations=1-76,98-447
gaccgccgcggcaaaactcaaccgtttcttccgccgtttggtgcacgtccgacagatttactttgaattcgctgcttggcaaatgctttacctgctggtcaatccgcaaaaggtgtacaggaatttcatgtacagaaaaaaagccaaagatcaatgggcccgcgatgaccccgactttctcctccttttggcactttctttgctcggctcgagtgttctgtttgcattaccgctcaatttgtccttttcttcattttgcgcctttttcctttgggttgtgttcatcgattgcatccgaattggtattgccaatgcaaccgcactttggttcaattcaaatcactttttgcgtcggacgacggattgcgacgtgatcgagcgggcctattgcttccatgtagatttgaatgtttttttctgattgctcattcttctccacgtcatttt

SEQ ID NO: 91409 - DNA, 624 bp, Heterodera glycines
  SCN-specific regions: Sequence locations=1-624
aaattggcggagtgccaaaagtcatttccaaatgtctgaaggatggctcgttgcctttctttgcgcttgggagtcgcgtgccgcaacagtgcgccacggaaagggacgacgaatgtccggaggaatacgagtgcagcttggccaccgacgacaattactattgctgtccggcgtgggatcgctgtccgcccggcgcttctccgtttttggtggaggggtcgcgcaaactgttgggttgcaattggatggccaacaattgcccggatggctacacttgcgagggctccaaagaccgcgcgatttgttgccgcacgcgtgccagccaattgcaatgtccgcacgagcgtgccccctatttgtatgggaagcgcccgttggcatgccccaagggaagcaaacgcagttgcccctccggctacgaatgcacggcctctaaaaacggaccaaatcagcatttgtgctgctctgtggtggaccatcatttgcccgaatgtgtcagcggattcgcatttgtcgacccaatgaatggtaaaaatcggatttgcgacccttcttccgagtcttgccccgttggctatcgctgtaaacgttcgactttggccaacactcatgtctgctgctcag

SEQ ID NO: 91410 - DNA, 647 bp, Heterodera glycines
  SCN-specific regions: Sequence locations=1-457,480-647
ctttcattttgttaactttggtccccatttctttgttcccacacgcgcgcaccagcgaactcagtgcggtgagtgtggagaccatttcgacctgtttaatcatcgaatgcaaatggacactgttcccccggcagtacgcctccaaaagcaaagcgtaacgggagaacagcttggaaagcgcattctcagctgacaacgagaaataaatgcaaaatgggggtagaaagcgaattgaaatttgaacccaaagtgccgtaaaggccagaagaaacagttgttttggactggtcaacggccaacagatgagcaagttcggcgcggagaagccaaaacaaagtgtgaccaacacggtaatccatcagagcacgcatcaacaaaaggcggacgagtggggaaaaggcgtggggttcaaaacggatggcctggaaagggaaataaactcaatgtttttttatttaccttattgtaaatccaaaattcgttttcagaattaataaatgagtggccaggcaagtgtttatcttacctggaccaaaatgagcaggtaaagctgcaattggtcgtcattgagcgcattgtccaaatggtggacggccattgcgcgtaatttcgcgtcgacgtaacggccgtccaaaagttcgcaagca

SEQ ID NO: 91411 - DNA, 603 bp, Heterodera glycines
  SCN-specific regions: Sequence locations=1-34,69-71,94-603
cctttcactgattaatttttgtgtgttaatacacaaatttaaatttaaatattattttaaaattattagtttgatttccctccattttttgccattcctcacaatgtttcttggcatcgatctcggcacttccgcggttaaagttctgctgatcagtgctgatcagagtgtcgttggttcggcgagtgttccgctgaaagtgtcgcgtccgtttgacggatggttttaacagtgcccttccgattggcaccgtgccacccgcgaggtcattgaccaattgcggcattcgaaccctaaggcgttttgtgccctccgcggcatcggtctttcatgccaaatgcacggcgccgtgctgctcgatgcagccggcgtgacgcttcgcccgtgcattttatggaacgacatgctaagtcaccgcgaggcggacgaattgaacgcggacgcgcgcttccggtcgatcactggcaacgcggtgttccccgggttcactgcgccaaaattggcctgggttcgcccaaacgaaccagagatttttgcaaaaattgcaaaggttttgctgcccaacgattacctccgtttttggcttaccggtgcttacttttc

SEQ ID NO: 91412 - DNA, 400 bp, Heterodera glycines
  SCN-specific regions: Sequence locations=1-400
agaagcggccttcaaagacattgactactcttttctggtcggagcgatgccccacaaagaatggatggagcgaaaggaccttctcgcggccaatgtccgaattgtcaaatcgcatggcgaagctttggccagattttccaagccaacagtcaaagtgctcgtggtgggaaatcctgccaacacgaacgctttaatttgcgccaaatacacggccagcaaaattccggctaagaattttagtggcatgactcgtcgtgaccacgaccgtgccatggcacaagtggcacacaagtgcgcatatggaaccaccgttgggatggtgaacaatgtgatcatttggggccatcactcgagcactcagttccccgatattccacatgcaacaattgccgacggtggt

SEQ ID NO: 91413 - DNA, 455 bp, Heterodera glycines
  SCN-specific regions: Sequence locations=1-455
gttcgctattagccaataaattttcaaaagtttcatttgaatcttttttttcaatcacttagattaaaagaaaactcttagaataataagaattgggcaaaatgttaggcctcggatgggaatcgaacccactcgtgcaccctttccatgggcaagctctaccattgagctaccgaggcacatccgccctttcttttatggattatcaagcccgctttccacgttttaaccgcccagccagcttcttctttcagagctatcgaatgatactaagaatgtttaatttggatgcttctagaagaagttttgaagcgttaaagttgtcattctattttgtggtcatgtttatttttatgatcgtgtaaactgcaatagagccatttaattcaattaatcaagtgaatatcggcgcgactcgtgcggatcccttcgcgacggccaaattggacgcacga

SEQ ID NO: 91414 - DNA, 529 bp, Heterodera glycines
  SCN-specific regions: Sequence locations=1-25,57-308,344-529
ccaacagtcggcggagatgaaactgaaaaattaaattgaaattttaaaaaaatttagtagtttttttttacattttctttttgtgatggcctcgtggttttggtgtttttctgaagcggtcccaataaagccaaagaatggcacaacagccgacaaacattggcacgctgtacagactaaaaaatttttctttgattgcatttttcatatgaatttctaagaaaataaagcctatttaactgaaaaagtgccgaaaactgtcttaataatttgctgcaacaaaatgtcagacaaccgaaaagaagccgaataaaaaatggcaaaagcaatgtaaaattaaaatgccaattttcaatttcaattttaaattttattttcctttttttcagtttcatctccggcgacggttggctttgtgtgttcgatttgcttgagccttctcaattgggccttggaattgcacttgtcagcaatcgttttgattgttacgtcgacgaacacttcaagacgcggcgttgggcgctcaaag

SEQ ID NO: 91415 - DNA, 596 bp, Heterodera glycines
  SCN-specific regions: Sequence locations=1-596
aaacatacggcaacaaattttccaccccatcccactgaatgcacaccgcattaaccaagtgtcggttaacgcgcaacgcaacattgacgttcagtacgtaccaaataattgcgttaatgccccgccaaacgtacagcgtcattgcgacattcagtacaccgctcctaaccctgtcgccgcgccatcaaacgcgcaacaaatttattttggaagtagacttattcaaaacattccaatgcaggctcagctttggcagggccctgatggaaaaatgattttggtttacccccaagaccaacagcaacaagtgctgatcgagcaacctaatttggctcaaaatcatcaaaaattcactcgccaggtctttcagattccggaaacgaatcaagagcctagacatttccctacctatccccaaccgaatgttgcgccaagcaacctcgaattcaacttgattttggaaagaattccggatctaaatggaaatgagggtacagattctgtgcgccgttttttcaaaaaatttgatgcatacaccgacggatggccaaacgcgaaacgaatttcggcgttagaaagcaaagtttacaacaaag

SEQ ID NO: 91416 - DNA, 575 bp, Heterodera glycines
  SCN-specific regions: Sequence locations=1-554
gtcgccctcgtctttgcttggtctttcttaattatttgagaatgaatcggtcggaatattatcaaaaattcctcgaaaaaatgtggttcgaattctggcacaaatcggcttcatttaatcataccgcacacttttttagggtgggacgtgaattgggcgtgcctttcactgaaatggatgacattgtaatgcgcattgaagaacgaacaaacaaagaagattttagcatgaggcacatgcaattactgtttgatgatcggattgttgctgtcccatggcttcgcattgactccgtccccggtcatcaaaaattgttcgcctttactgaaatattacggctagaaatgttggatgaaatgattgcccagccatgttacaaccctctcaatcacaatgtcgacaatccgctttactttccccctgattatgaagaatcggaagaaatggaagaaggcgcggaggacgaaaacattgcgaaaattgaaaggcgttggatcaaaaggaaaaagcgcatggcaattacccattgattgaactgtttgttttgttttgtcagattaaaatgttttttgctc

SEQ ID NO: 91417 - DNA, 512 bp, Heterodera glycines
  SCN-specific regions: Sequence locations=1-512
attaagtgaataatgcatgtcatatacttcgacgacttgcttccgagggcgccgatgtggctcatccaattgcccttctacatcacttcctttcttgtgctgctcgtgtttatgctctgccctggcaatatgtttctctatactcttatcgctgtggcctacccaatgtacgcgagcttgttgaccctcaacactcaaaacacatcggaatacacccagtggctcgtttattggtgcgtgttcgccgtgttgggccagttggactttctctttggctctatcaatggccttctgctgctgtacgtgcctttgaagaccgtctttctgctctccttggcctttccgcaaatttatggcgctcacaacatctacgtgaagccggacgtattggacaagatgaagaagatgttgtgatcgaggagacaacgtatcactgtgtaatgtctgtaggatgattctttgttgtgattcctatattgtgtgtatgtattgtatgtggagtaaaaggcaat

SEQ ID NO: 91418 - DNA, 232 bp, Heterodera glycines
  SCN-specific regions: Sequence locations=1-232
gatcaaacgacgcttttcgcccgaggcggtggacaccattttccagacggacgagacggggaccatcgattggattccgatgctgatcagggtccagtgctggcggtgactcgtctttgaactggccgagcagttcccgcactgtctgatgctcaccttcgccatcacattgatcagcgacgcgtgcttcccacacaatagtagcaatgtgaacaccgcggcacagcaactg

SEQ ID NO: 91419 - DNA, 651 bp, Heterodera glycines
  SCN-specific regions: Sequence locations=1-651
caactgcccaccaatgtttggtgcactccgtccgccatcggtcgcatggccaccattttgcgccaaatgcacgcggtggtcagcgaggaaatgggccgggaattgatgggacggcaacggttgatggaccatctgtgcctggtccatggctacttcttcatgttgcgcggcgattttgcctccgcacttgagcacatcctctttatcaaaaccgccaaaacgaccgcaaccaaaaagtgtgccacgccattttcgtcgcgcaaaaatgtgtcccattcgacaaaaattgcggaaaaatgtgtgaacgacgcgttggcaatgtgctcaccgcccgcaaatgtggcgaatctgatgcacttgttgtgcggcgtcaaactgaccaaacgcgagcaaatgaagtgcaaaattttctccgaaaaattcatgctcaaaagtcgacttcgggaaggccaacgaaacgaattccaagcggttgctgaatttttctccaccaatgcgctccgggcgtacaagcgcgtgttcggctttgtgtccaacctgcagttgcagcgggctcagttggactacacgggacagaatttgttacgcgttgtgcgccagcggttggccacacggagcgaatatcgttcatctttctactcgatgctcatc

SEQ ID NO: 91420 - DNA, 267 bp, Heterodera glycines
  SCN-specific regions: Sequence locations=25-125,150-244
tttttcttctccttttgtttctctgatcagaccgttgatctgcggcatcaaattgtacacgacgaaaatggtcatttgtttggtccatttttgcgagtggcctcctccacgttgtgttgttaactcctcctcattctccgcctcctcccaccatatatttaattataattatcacaatcgtttttttttatcacactcttaacatgttttttgtggttgaccagcaaataaatttttaatctgcaaaaaaaaaaaaaaaaaaaaaaa

SEQ ID NO: 91421 - DNA, 598 bp, Heterodera glycines
  SCN-specific regions: Sequence locations=1-249,271-598
gttttgcttctgaattttgccttcatattctttgcatttttgtcttcaatttatgccgaggaagaagatcccaaagttacgcataaagcatttttcgacatttcgattggtggcgtcaaaaagggacggattgtgattggtctctttggtgaagtcgtgcccaaaacggccaaaaactttttggaattggccaaaggcacccatggctacggttacaaagattcaaaattccatcgcgtaatccggaacttcatgatccaaggtggtgattttacgcgaggtgacggcactggtgggaagtccatttttgagggcaaatcatttgaggacgagaatttcaaactgcaccactatggcgccggatggcttagtatggccaatgcgggccccgacaccaacggatcccagtttttcattaccacggtccatactccatggttggatggacgccacgttgttttcggtaaagtgctcgagggcatgaacattgttagagaaatcgaagacggcgaaactgctggcggagaccgtccaaaaaagacgtcgtgatcgttgacagtggagagctaacagtcagtgaaccgttcaaagttgcacg

SEQ ID NO: 91422 - DNA, 379 bp, Heterodera glycines
  SCN-specific regions: Sequence locations=1-310,333-379
gattgagaatattggtgtggtcggcaccggcctgacgggcagtggcattgtgcaaattggggtcgagtcggccgtccaaacgtgcctgatgggccggactcaatagaagtgtgatcagacccggctgaacatcaacaccggagtgcaaaagttgatccataagcgcatggcaaatgacactgccgaggcacaacagcaggtgggcccggcgaccatggaaagccttgagctggcgaacaacttggatgaagtggacttgccagatgccgacattgacattgaggcactggttgaacatctgaaggtgaagcagaagatgctcactgaattggaagccaatgtcagcgagaattgtctgctgggcaccaacacttcgacc

SEQ ID NO: 91423 - DNA, 648 bp, Heterodera glycines
  SCN-specific regions: Sequence locations=1-623
ccatttaaaaaaaaatctgacaaaatgaatttttctccgatcactctgtttctgctctcttcacttgccattttctatgcagcggttgcattccgccaacaaacggtcgccgttcgcggccgtttaatgtgtggggataagccattgacggacacgaaagtgaagctgtggaataagaacaaaattggccgtgatgatcagctggcggacgtgaaaacggacgcgcagggaaatttcgcattggacggcggcgtcgggtccattttcggcatgaatgtgcacctgaaaagttgggcactccatttttgtaaatgcgaaattcgcgcgaatccctaacattttttgccagtttatcacgactgtgatcgtggcatccttccgtgccaacgcaaagttaacctcggcattccgggcgagtacgtcacgcggaccagcaccgttcagcgatggttagacgccggcacaatgaacatgcagctgaagtttcatgacgaatcaacttcatgcatcaactaatttaatgtttaagaggatgagatgaaaaaaaattcaatttttgaagcccttgaaaaacgttttaaaatttttgactttgtcttcattatataaacttattaacaactaaaaaaaaaaaaaaaaaaaaaaaaa

SEQ ID NO: 91424 - DNA, 631 bp, Heterodera glycines
  SCN-specific regions: Sequence locations=1-65,87-631
attgtttgttgcctaaacatgaatagaagacgaaaatttgcacccgtaccgaatatggtggcagcacagcaacaacaaccgcagcaacctatcaaaacagaacgggcgccggagccgaccggtggcgagacggtgccgccggaacttgaccagcaactacaggcgttgcaggcggtgaccaacgtcggagggaccagcggaagtggtcagcaggtcggagcagtatcaactgcagcacaaccacaaaaacagggaccgagcagcgcaagcagtgcaccgactgcagcggcgggaccacttattggtgctgttcccttcaagacagcagcgctggccctggcaacttcggcggcatctgtgttgccaccggtggcatcactgctcaaccgctcgccgccttcgtcgcccccgttgcaattgtttgccgagacggacccgatgctgtgcggcggcggcggtgtgcgacaacatttgtacattgaccgacacttgcaaccgcgggcatacacaccggaggcgctggccgcgctggacaatgccgtgctgactgctgctggccaccaacgcgatgcggccgcagttgttgcccaacaccagcaactgctgcagggacaaggacagctcggtgcaa

SEQ ID NO: 91425 - DNA, 615 bp, Heterodera glycines
  misc_feature (517)..(517): n is a, c, g, or t
  misc_feature (545)..(545): n is a, c, g, or t
  SCN-specific regions: Sequence locations=1-615
gttttaatttgacaaatttaatattttaactaagccaccaaaaatgcgtttgtcatttctccgtgccagcgagaaacattttggcaatttgtcgaaggtctgttttattatttggtctatatgtctatttgcatggagaattcttataagtcataaccatgactgtattatcaaagcaattcaagctcatttcatgtagactcgaaatgcattcaacattttgattaagtccaaaaagttcactgtcatttagactattaaaaattaatccacgggatgcaattttctattgttttaggcttacggttggtattacgttcgcattgctccggttgaacagaaagtatggaagggctttttctttgatgcgtttgttaagccggtcaaagagcagttgccccactggtggatgttcttcttccccgtagtcacttactttttggtcaccgactgggccaagaaagagtaccgtcgtctgggacggatcaaagaattcactgacgaagaatgaatgtcnaattggccattcggactgttatttgtangaaagaccaccgagtcgacagaatataaatcgaaatgttttggtactgtcaaattgtgtgttatgtccaa

SEQ ID NO: 91426 - DNA, 620 bp, Heterodera glycines
  SCN-specific regions: Sequence locations=1-620
gtccaattaaggtaaattttactgacattgattatgaggtgtttaccgaagcggcccttttggctcgtgaaggacattcgccctatgaacagcctgagtaccgttacacgccattgatcgcttggctattggtgccaaatggacaattcgccgattttggaaaactagttttctgtgccattgatgttcttgtcgcattcctgcacttacttatattggaaagtcggcaacaaaatcaaagaaatccttcctcgcaaaatgaaggcaaaaccattcattcatcatccgtcgtcttccgtcattttggcgtccttttctggctgttcaacccattcaccgccatcatttccgcacgtggcaattgtgatgcgatcatttgtgcactcgttttgttggcactgtttttactgatccgtgtgtggcagcggaagaacgatggcataaccgccacatttctgcgcttggcactggcggccgttgttcacggggccggtgccacccattttcgcattttccctctcatttatttgccttccatttttctgtcttttgctcattcgtcacaaaatcatcagcgtcgtcttaccaaatgtaatgacttcaaatcgttcatttggatg

SEQ ID NO: 91427 - DNA, 633 bp, Heterodera glycines
  SCN-specific regions: Sequence locations=1-633
cccctttctctgttctcgtggtacaactcgcagcagatgaccactgcgcagttaacgcatttggacctgagccaggccaaatttggctcaagcgacacactgctgcgtctgctcattcggtgcgagtcgcttcaggctttgagtttggagtcgtgcgaattgctggacgaggagtgctgccgggcgatcgccaataattcggcgcttcgtcacttggatttggtgtacgctaaacgcctcactgccgctggggttgaagtcattttgcgcgcttgtcaaaaactcgtggaactgaatttgtcctgggctgaggtggatgtcgatgccatgctcgccgtctgccgacttatgccctccggcgttcgtcggctaaatctatccggcttccgacagctttcgtcactaaatgaccgcagcgttgcccagctgtgcgaagtttgtccccatctcgtagaattggacctgagtgataacgcgttgctaactgaaaattgcttggattccatttgcaaccgcctcaaatacctccgccgtctcacactgtcgcgctgttacggcattgaacctatggcatttctgcagttgaacacccttgacgaactgaacattttcgggtgcattaccaatgacggg

SEQ ID NO: 91428 - DNA, 652 bp, Heterodera glycines
  SCN-specific regions: Sequence locations=1-37,59-652
agaacaaagttttagattacaaaaaactaatttgtatttctctgtttctgtctgttgtaccatattatgattgattgattcacattgccaaattggtgaacaacaaacactatcaaaatgttcgaattttgcattaattattatgatcattaattatcacaacccccccccccatcctaattaattattattttttgttgcctaattttcacgtcactctctcttttcttcccctcaagattgtctcctctcattacgtcgctcttcgtcttcatcatccgtcgtcgtttgcccacaacatttcgcaatttgctcttctcctccttcatccaccacggcaccatttcccccctcttccgtgcccaccgaagagacttggtggcttttttcccgctcctcccaatcatcatttgctgatcccgaaagcgatgatgagcgattgatttgattaatcattaatttatgttttggcacatttttgttgccctttttttgtttgtttccccccgcccattccccgaaatcagcgacaaattttgtgcccttttcataataatcccgatgtttttttatttacataaaatgtatgtttattagacaacaaaaaacagactctctctccatctctctcccgtgtttctctgtgcgcata

SEQ ID NO: 91429 - DNA, 488 bp, Heterodera glycines
  SCN-specific regions: Sequence locations=1-265,288-347,369-488
gtcgagaatcccggggggtcgccgtcggcacgggaccaatggcaccctccatcggaacagcagaaattcttcgctggcggacggcaccaatcgccgattcaacggactctttcttttgggccgaggatgggccgttacacaaccaaaacgatcagccaaatatcgaacatttcctcagcccattgacaattccgttcacaatcagtagcattgctcctctttattcctttttctagtcaactgatttttttactatgaattgagctttcctttccctctttttctcctttggaattacattggtctctctcttcccattttcatttttttgacaaattcctcatccgttataaatttgtttctaatacaattaattgtccatgtttttccatgtgttcatctccggttttgtttggggtcgtcacttctcaccgattttctttcttttttcccttcattttcctcctttctttttgaacacctctctt

SEQ ID NO: 91430 - DNA, 208 bp, Heterodera glycines
  SCN-specific regions: Sequence locations=1-54,86-130,165-208
tgttctctggattgcctcggcgtgctctctgttgcctatcatcgccacagtcgccactctgccatctctgtactcggagatgagcaacatgaacagcaaagtgtgcgacgtactagatgccttcctcgtaaacaccgactcggcctggactgacttgatggacgcgcaagcggccgccgacgcccccgctcaactccgtcgagaaccc

SEQ ID NO: 91431 - DNA, 642 bp, Heterodera glycines
  SCN-specific regions: Sequence locations=1-478
agaaattcgagacgatgaccggcatgcgcattttggaacgctatggaatgacggaaacattggtgtccacatcgaacccatacgagccgattaatgccagaacttcgggctcagttggccaaccagtgaagggggttcaggcccgaataaacgtggacggagtcattgaggtgaaaagtccgagtctgttcaacgggtatctgaacctgccggagaagaccaagcaggaattcacagcggacggcttcttcatcaccggcgacatgggcgaaattgaccaaaacggcttcgtttggatcaaagggcgccaaaaggatttgatcattacggggggactgaatgtttacccgccggaagtggaggacgtggtgaccaacattttcggcgaaaagctaaaggaatgcgcaattattggtgttccgcaccccgactttggcgaggcggtcgtcgccgtctgcgaaccttccgatgccttcgcagaaaagctcagcggcgttgcgcaccaattgacggacgatgagaagagtgccttccgtcaaacattggcaccctacaaaattccaaaggctgtccaatatatgccgttgccacgcaatcaccttggtaaagtgcagaagaatgttctacgcgcgatgcccgaac

SEQ ID NO: 91432 - DNA, 652 bp, Heterodera glycines
  SCN-specific regions: Sequence locations=1-652
ggaaatccgtggcaacagcaacacgcgttgcgaacttattccgatatcgtcatcttccttatttgtatagtctccatttccgcgcttcactgtacggtggtacggtaattcgaccactgttctttgaattcccatcggacaccaacacacacactttgaatttccaattcatgtggggcccagcaatggtcattgtgcctgtcgtgaatccgaatgttgattctgtccatggttatttgcctgtcaacgaaacttggtattcgatgagtgaagcacatgagtacagtgcgcgaattatgccaggattttcaacattcaaagcgccaagagacacgccgttgccaacatttttgaggggcggtcatattattccaagacaagagcccgatttgaccaccactgcttcacgcaaaaagccattccaacttctgatcgggttaaagccacttgcttgcccgtgcaaattggtcgccgctggggaaatgttttgggatgacggcgaaacaattgtggacgatttcggcaaccattcgtactatcgttttgagtttagtaccacccgcaccgcccattggacaccattgttgtgaatcggacgcacaattcaagcgaagacccattgccaagctttgaacaaattgtcattcttggc

SEQ ID NO: 91433 - DNA, 489 bp, Heterodera glycines
  SCN-specific regions: Sequence locations=1-489
caatttcgattgggcgtaagacggcggagtactcactgcactcgcataccaccgacgggacggactttggtgcaagtctgtaccatcgggtgcaccaaaatttggagtacggtgtgcagatgggttggaagatgggcgacgccatggcgagttgggcgattgccaccaagtacaacatgagcccagaattgacccttcgtgcaaagatggaccacaactctctcgtgtccgtttctgccgtgcacaatctgaacggcacgctcaagctcaccctttcctcacactttgcaatggcagcgttccctgacgcgcaaaacaaatttggctttgggctcgagtactgtcccggcggcacgtgctgcgcgaaagataaagaagatgcataaagaaagagggagaggacagcgagagacctattagacaggaatttggaccacatatatttgttctgttttggataagtgttagggataaacatgtgtaattccc

SEQ ID NO: 91434 - DNA, 585 bp, Heterodera glycines
  SCN-specific regions: Sequence locations=1-116,138-585
ctgatctcttgacaaaacaactaacagcggtcgaagaatgtaaatctgtcactgcgacttacaagccaattcgtgtttccgacatgcccattcaattatgcgaacatggccgtgtcatgcccggcccgtttattcggggtgaaataaaggcggtgaacacttcggctgcccgacgcctgatcagggaatttaatgtgaacacgactttgtacacgggagctaacatctgtgtcaactgctgctcaagacttcgtgatcaccaagaaactaggcgaaggggacggacagaggcgattttatactaccccgaaggcgctactttgtttatcaaattgaatggggatgagaatgatgggaacacaacaaagggcaagaaaaccaccactggaccatccgcggcagtgacgcgtcgagcagcgtcaaaagggctaataaaaattcgaatttgttcggatgagacgatcaatgccctgaagttgcgcatttacgagaagatcgaccagtctccagtcgaccagttgctttacatgggcggacaagtgttggatgggaatttgacgcttgagagggcgagggttcctgcaa

SEQ ID NO: 91435 - DNA, 587 bp, Heterodera glycines
  SCN-specific regions: Sequence locations=1-297,319-587
catccgagggcggatgggaatttgcaatggtacaaagagcgaatgtctgctgaagaatttgatgaccaaactgatttgcccgaattgcagaatgagtacaaacgatacaaagacataccggagagagactcatttgaaagtttatgccgtggcgaatttgaaattccaccagaaaatgtcacacaattgaactgttattataagaaagacaagccttttctgaagttggcaccccataaagtggaaattgtccgttttgaaccattggtcgttctttttcgtggtgtcatttcggacgccgaaatttcagtgatcaaagaattggcaacaccaaaacttcgtcgggccaccgtacacgacccggccactggacaactcgtgttcgcctcatatcgaatcagcaaatcggcatggcttaaggatgaagaacacgaagtggtggcacgggtcaacaaacgcatcagtgacatgaccaacctgaacctggacacggcggaggaattgcaggtggccaattatggcatcggagggcactacgacccgcacttcgatttttcgaggcgagaagagaagaaccaattcgactc

SEQ ID NO: 91436 - DNA, 651 bp, Heterodera glycines
  SCN-specific regions: Sequence locations=1-651
gtttgagcagcacaataaatagccgtttaatttcttatcaaatgcaatcactttcacatattcttttcacatttttctcaattctttttgctgctcattgtcaaagcgatgaatcaaaaagcgcgggagcgcaaatgcaaacggtggacgaaaataagattcggcacggcaaaccgttgacgagcattgtcaaatacccttttatggccactgtttggcaaaatgaccgcaaactttgcaccgcgtcaattgtcagtccaaattatattttgtcggcgggccattgctttgtgaaaatgtccgaggaaaattacataattttggtggggacagtgaacgcgaagttggagaagggcaacggacagcaatttaaagtggagaaagcgcacgtgtactcggagacggtgttcggccaagacattgccattgtgaagctgaagaattcgattgatttctccgacaatgccactcagccgatcactttgtcccggaggtccaattttacaaaaactgacctggcattcattgccggatggggacgtatcaccgactggagttctccggtcactctgcaaggtgccaatgtgctgatttggccaaaggatgaggcgcgttgcgacggcattatggagtcggaagtttgcgcatttg

SEQ ID NO: 91437 - DNA, 598 bp, Heterodera glycines
  SCN-specific regions: Sequence locations=1-598
gtttgagccaaatgtttcccgctaaatacaaagcctttcgactggaaaataaagtcgcggtgatcacagcagcgacaaatgggattggattggcaattgctgaacgattaggccacgagggagcacgtctggtggtcagcagcagagacgaagacaatgtgaagcgggcgatcgatcggctcgtctcttcgggactgaagcgttcggaccttgccggttgcacttgccatgtgtccaattcggaggaccgaagtcgcctgctgaaactgaccatccaacggttcggaagcgatttgttggacgtggacgagtcagcctgggacaaactgttcgacgtgaatgtcaaggcgggcttcatgatggccaagctgttcgcgccagaaattgaacagagcggtggagggtccatcgttttcaactcgtccatcggcgcctatcggtccccccagggaatcgctgcttacggcatcacaaaaacggcactgctaggtcttaccagagctctggcagaatcacttgcacccaaagggattcgcgtgaatgcaattgcgccagggattatcaaaacaaaaatgagcaaagcgctttgggaaggcat

SEQ ID NO: 91438 - DNA, 622 bp, Heterodera glycines
  SCN-specific regions: Sequence locations=1-57,84-135,165-283,306-622
tgttctcggaattgccacgaagggctctctgttggctatgatcaccagccccgacagtctgccatctctgtactcggagatgatccctatgaaccgccaagggcgccacggatttgaggtcttccacgtcatcagcgactcggcctggactgacttgatggacgggctgatggccatgacggccccgtcgaagccgcgcgataaccccttcaactccatgtaccgtgacgaacattaactgcccggacactgccggcgcgctgtcctccgacatgccaactgtccccctgtggcccccggccccgcggcacctgctgtacacccgggacaccctggatgtgcgtgacctcccggagagcctgtatacggtgtgcaaacctggccaccgtgcccgctgcacaacatcccctgcccacgctatcctgctggtcccacccgacgcccccaaggactagcaccgcccggactgctttgatccgctggaccacctgggaccccctgctccaggcggatgaccctgcaactactggtaacgcccggaccccaacgacagccaggacaatgccgacatcccggatccgctggccaaccctgacagcctgcatccaccgtagtcgtctcc

SEQ ID NO: 91439 - DNA, 540 bp, Heterodera glycines
  SCN-specific regions: Sequence locations=1-117,139-444,466-503,527-540
gtgccgggcgttctctactcggccggggacttggcgacgcgtgggcgcaacaattggcgcacgtccaccgctgacggtgacaccatccaggaattcgacttgccgccccagggccagcctgaggaagtccgggcccaagcgcaggctcagttggacgaacaacgcgcctcttactttgcccaagttaccgaggaactccgcccgaccattcccaccaagttttgggcgtagaccatcactgaactgactgatttgaagagagaaatggtaaactcgatcccaaaaaaacaaaaacctttgcttcaatcaatttgctatatattttctcttcactgtttttattgtattcaattccattccgtttttcgattctcacgatcagaacaccttttgttaatttaaccaatcactgccaacatttttttcgttgttttcactcttaaccattcattcactgccatcattgtacacaaatatcatctcatcatttcttttgttttgaattattgaattgaaccatttatcactttcctcctcttc

SEQ ID NO: 91440 - DNA, 525 bp, Heterodera glycines
  SCN-specific regions: Sequence locations=1-225,247-525
gggaatttctcctcgaggattgaagccttgaaagcggcatttgccaatgcttcatctcccgtcaatttcattgttgtcatttggcaattgccgtctcctgttgacccaaatttggcatttgatcggatcaacgaattgactcgggaacaattgacgttaaaaaggatgaacggtgtcggccattattttttgatccgttgtccaattgcgcgagacgagagcaaatggacaaaatgggaggaggaagcgattggctggcgaatttatgatcaatggaacataattgacattcggattaatgatgagggcgaaatcggagatgggccttaaaattccttttcttgaaagtttttggagttttgtgatttctgaatgatgatcgacacttttggaccattggcattttgattgacacttatgtaataaatcccgcattcttccctgatcagctgacctgactcaccattcaccatgattgatcaatattcacattcagcattttgatcataaatttggcattttgaa

SEQ ID NO: 91441 - DNA, 638 bp, Heterodera glycines
  SCN-specific regions: Sequence locations=1-129,151-215,237-355,380 -393,423-472,506-638
gggcggcagagtggagtacagaatcaaatggatgggctatgacgacagttggaactcgtgggagccgagcaaaagcgtgaagcatttggatgtcgtcaaacagtacgagaaggagtggaaacagcaacaccagcaggagaaacagcagccggtgtctgcaaagcgttcgcttcgtttgtcgcgcaccgaacaaacaccgaccacaaagggcactactccgtcctcatccgtcagtgtgtcgaccaagcgcattcgcgtggtggtccgaaaggagcaggacgacggaccggcgcacgtggaacagaccgagatggacgctgtctcggtggagaccaaagagttggcgcccaagacgccctccaaaaagaaaaagaaacgctcacgctattgagcaccgaagaagaagaagaaacagcagacagaaagcacgatcaaaaaacatcatttccaccgtttcgcctatcgcttcttgatttttttaatttgttttttatttatttaatttcacttctcagatggttttcgtcttgttccttaaataccaaaaaaatcccttcctccaatcaccgccattttttttgatgctcctttgaacatcaccattatttattctgcgatgcacttacgaattagtgttg

SEQ ID NO: 91442 - DNA, 214 bp, Heterodera glycines
  SCN-specific regions: Sequence locations=1-60,82-214
ctactgcaaagactgcgacattatattcaacagatcttcttcgaatgacgcgtcggccaacaaattcaacattttgaagaacggaaccatccaatcgccgccggatccgaccgaaatttccgtatatttggacaaatatgtggttggccaacaacacgcaaaaaaggcgatgtctgtcggcatttaccagcattacaaacgcttggaaaacaat

SEQ ID NO: 91443 - DNA, 331 bp, Heterodera glycines
  SCN-specific regions: Sequence locations=1-27,49-331
gatacacccattacgcgatgtgaatttggactttggaaaagctgtgagagaggacgcgaggcccggcatagacattcaggcgcaatgccgtgttcgaattctcgatcgaccggccagctatctgatgaacgccccagaagtgctatacccgtgggttagcatcattgacgcgtcgatgaaattggccatttgcaatttggtgttggatacgaccacacggcccaatttcgtggccgattatttactctattttatgaatagatatcgcgacttttcctacgtcgactttataacaatcacagagccctcctacgacatccaacaagtgctc

SEQ ID NO: 91444 - DNA, 618 bp, Heterodera glycines
  SCN-specific regions: Sequence locations=1-57,79-80,102-378,400-618
tcccacagtccaggaaaaaaatatggatttccatataattggactccctagtaatagcaacaacaaaagaataaataaacggaattttgttttgtttattggtcgtttttagaccgtcgtcatgttattctggggactttatctgatggacccggcgacggtcacaaggaaggaggcgcgatttatctttgacttcaaatggttcaactatgcactcgtgggtggaaggattgatttattgcaaaaatccacttgttttttttactccagaattaatgtccccgtggaaagtaaaaagttcattaggaagaaaaatctaaactttattttcatcgggacaccaattctccaatattaccattttttctccgaaatctcatgcgttttgttttcgtttttggtaatcctaccattactggtcaatccttccatttcagcacactttccccctcttcgccatgcttctcgacttttccatttggcaccatcgtcgcccctcaaaagtctctgcgctaaaggcgatcttgtgtttctccctgttttacaccatccacatccactgtttctatgtctgcttcaacttttgggcttatcccatccttgcccaaatgtccttca

SEQ ID NO: 91445 - DNA, 613 bp, Heterodera glycines
  SCN-specific regions: Sequence locations=1-52,75-129,151-164,195 -525,561-613
ccgtcattatcatagcaccaagatgtgtacagcaaaaaatttgctggcggagatatattttttaattttttaatccgtcccttccaaaatagaaaaatcccagaagaaattacacacatgtgtgctttgattttttggttttattttacagtaatacaattttcattttttgttaattttttaaaattttaattccctaattatttaatacgctaattaagtcgccctgctttaatgagcacgaatgttgcgcgaaatgggcagccgacggacagtgcgaatcgaacagcgaatacatgagccaattttgcaaagccagctgcaaaaaatgccaatattcgtacaacatgcaagaggaatgtgctgatcgtcataaaaattgcaaagctttgtcctaccaaatgaaatgcgattcaagctggatggctgaaaactgtcgaaaatattgcaacaaatgcaatgtaaaacgtatgcaaacatgcgctggcggttccccggggggagaaaaacgtaaaaaaaattcggaaattaattttattaatttttattaaaatatattagccacgctttcatatggcggcaacaatggtggctttaaatcaaaccaatgcta

SEQ ID NO: 91446 - DNA, 568 bp, Heterodera glycines
  SCN-specific regions: Sequence locations=1-111,133-568
tgaacaattggcccaaaattcctgacttcagcaggacatgacaattctgccacacaactacaactttgacataccgaatacaatatggaaaatccggacaattgatgccaaaattgtagctttgcaatttcccgagggcatcacaatgtacgcctgcgtaatcgccgacattctcgagaagcacaccggcgccgagttcatcattctcggcgacgtaacttatggagcctgttgagtccacgatttcactgcgcgtgcgctcggactgtcagctagttggtacactacgggcacagtgtgattggtgccaattcacgacactgttggcatccatctgctgtacgtgctcgccaacattgacatgggcacggcccatttgctggacacactggggcacaattttttgcacaccgccggagatggaatggaaaaagtgcctaaattggcattgaacagcaccgtccaatttgtggcgacacttcagattgtcaagcgtgagttggccaaagacagtttctacattgtcatcccgcagtgcagtccgatgagtacgggcgaactgctcggc

SEQ ID NO: 91447 - DNA, 331 bp, Heterodera glycines
  SCN-specific regions: Sequence locations=1-50,73-129,152-331
gcaaattgtgctccggcaacatgtggcgtgcaggtcacccgctgccatccctacttccaacgagacccacgacgccccttccaagcgttacggaggctgttgctgtggctgcggagtgtctgccccgggcccgcccggaccccctggcccatcggtacaacccgaccgacacagacaacccgtagggtcacgacagcccggagtaccaggccaggcagctcctcgcccgtacccatcacgccgtggatgcatgccgaagtgagatgccgcccagtccggagtcgccggacctcccggaccccccggatgctacggacagaacggccaaccc

SEQ ID NO: 91448 - DNA, 651 bp, Heterodera glycines
  SCN-specific regions: Sequence locations=1-24,46-651
tgagattaagcttaaatggcgaataaaataaattactaaaaaagactcgtggcaacagtcagcagatcggccacataaaatgtccagtttttttcatggtcatcagcggacacattcgcaagcacaacagctgatccctcgtggtccctctgatccggatgatccttgctcgactgcttctccctacgactctgatcccgtcctcatcccttcctgcgctttcccctcggggaccgatcggctccctcaactgaccaactcgcgcattttgcccgctggccgggcttccgccatgcgtttctccaccttgggcagtgattgttcttcttcgtattacggactccccggaggggtcgaaggcgtcgaagagccaattacgacgagaagtgtccttcgtgccaacttccgagtcgttctcggttccgccgcgttggctttgcttggctccgtccttttggtgttcggcagttgtgtaatgcttttccccaacgacatggatgtccacggatggattttcctcgtcgtcggagtgctcttcgccattcccggcttttaccacgtttggtacatcggctgcactctctgcggacggcccggctacagtttcgagaatttgccaactttcacaaagcccaactttccctactaaca

SEQ ID NO: 91449 - DNA, 628 bp, Heterodera glycines
  SCN-specific regions: Sequence locations=1-51,73-176,198-628
taatggctgtggccttaagcaagtgccaatttactcctccgaaatgggcgctgtgaggcagttttgagtgaacctccaattttgaaaatggtggaggatgccgggacgagggccggtttcgaccaaatcgacgcattggcacgggaagcggaggaattgaggcagaaattggagcaggaaaggcacaaactgaacgacatcccaatacaacaagcagctgaacggttggaacttctgtcccaattggccatcaaacagcggagagtgctaaagggccatggcagtaaagtgttgtgcatggactgggcgcaggacaaacggcacttggtcagctcctcccaggacggcaaagtgatcgtctgggacgggttcaccaccaacaaagagcacgccctgacaatgcccaccacttgggtgatggcttgtgcctatgcgccgagtggtcaaatgattgcctgcggcggtttggacaacaaatgttccgttgtgccgttggacccccaggaggacattctgcagaaaaagcgttctgtcgccactcacacttcgtacatgtcctgttgcactttcatccgttcggacaatttgcttctgacgggcagcggcgattcaacttgtgcaatgtggg

SEQ ID NO: 91450 - DNA, 641 bp, Heterodera glycines
  SCN-specific regions: Sequence locations=1-219,294-512,536-641
atttctttacactgaaactaattacgatgatgctccgcaatcgcgatttgaacgtgcagccggctgcaggtgcgggtgctccactgcccaagcgccagtcagctcatttggtaaaggtggttggtggcgccagcggccgtgcttcatctcagtcttccgccgggtcggaccgggactccaagtacgagccgaggccaaagcgtgcatgcagccagaaggacaaggaaaacagccactacaacaacaacaatcacaacaaaagcagtcataacaagtccaaaaagaacaccagcgggggcaccgtcgttccggtcacggctttttcacggtcgctgctcatcgattcggccaagaaggacgtgaccgttgtgtcaacggctgtcgatgccggcggcggtggggtgcttgccgcaccgattgttggccgtaagagatcgtctgcgttgctttccacgcgtgattcaaatgttggcgaacacatgtcttcaacgcagaaagaggagaagcaggacgatgaacagaagatggagcaggacagtggtgaacggcagcagcaacaggaggagggattgttcgactttgacaaggagaatgaccgcgacatgtctgccttgtcgcagtacgcgcaggacatcttcact

SEQ ID NO: 91451 - DNA, 624 bp, Heterodera glycines
  SCN-specific regions: Sequence locations=1-548,573-624
gcgatgtccacggcccaaggcgaccatgacgagagaagggacgcgtcgtcgcctccccctccgccgctcgcggcttcgatccgtccaaatgcgatggcggcgtcgtcctcgcgcattggccattctctgctgggcgagggcgcactccgtccgtcgcccttctcccaattggccacttcctccttcattcagccgtcccctttggcggccattgttcagccgcgcgccatccaagagagtaatttccgtgccttggaaatgtcaatgcatgcccttctcatcaaccaaatgctcttcgccaattcgttcgcttctccggcccttcgttcctcccggcatcgcccctttggctacggttccatcccttttggcagtgtttcccgtcgcggacccgtggacagtatcgtggacagcaacatttttggagtgcccgccggggccagtcaaatccaactgatggacgaattggaaaatgaatttgacccattgtcaaataatcgtagggtgtgaaatgtaataaattgggtttctccaatcaaccgtcagaccattttttcattcttctcctcttgcgttgaatgaatttcacatactcaaaaacagctttatttgcattactatact

SEQ ID NO: 91452 - DNA, 629 bp, Heterodera glycines
  SCN-specific regions: Sequence locations=1-629
ctgtgcccaatttggcacatcggtcacttcttttcttcaaattgatactaccgacccaattgctctttcggaattgcgtttcgatgtccttccccttttgctggccaatgcttggcctcttcgacgaaacattcactttcttagacgattggtctttattctcgcttattcttctaatctaaactatcatcttgtgcttgatcctcttttgatgggcttgtccaagtgttcaactcgtgaaaatgtcttcctttgttgttcccctgagaatgtcacaattaccgacgtcaagattttcctcgttcaactttcttcctacatgaaactgtgcaaactgtatgatgaaggcgttttcgttttcccatggattttccattgtgcgcccaatgttcagcaacaacagttttggagctacattaattctctgttggatgggaaacaggaatcggaaagtcttccgactttggtatcaattacgacaagaatcgcccaaaaatggtcaaacgaagcgatgtcgaagaagttagaggacatcaattctctgatgacgagactaacccttcacaaccgttctttagccaaattattcgcattgaaccaaactggttctcttttttagcattttcact

SEQ ID NO: 91453 - DNA, 469 bp, Heterodera glycines
  misc_feature (452)..(453): n is a, c, g, or t
  SCN-specific regions: Sequence locations=1-397,419-469
attaagggctgcatgcaattaagaattacgtccttttcgatgccatcgttatctcttaaacaagcatggtaataaatcacacctggcccatgttgtaattccgtgccattttcaattggcttaatgttcaattggcgcattggctttctgatcaccctgctcatgctcatcactaattgcaattcatccgtctgatcatctagcgcttcttgaacagttccattttgttgtccaaactgatcatcgcgcttcttctgttcatcaacattccgttctttttgaagtttggcactttgttcaattgcattttcctgttgttgttctacaagtactgctccattttcttgccttttgctttgattttcatgccgttcttcatttgtcacattttcaccactttttgtcccattattttgttggatttcttgaataaattggcccatttggaaaannaaaaaaaaaaaaaaaa

SEQ ID NO: 91454 - DNA, 491 bp, Heterodera glycines
  SCN-specific regions: Sequence locations=1-60,83-110,135-491
cccctccctccgctgccattcgccgcctttcgtccgtttgccgtgccgagtgaatgttcgtcctccgatgtttctgttcctccctccgtcactcccttcccgcctttgtcttcccttccttttcctccttttttacgcctatttcggcgacggatttcgtcggagatggcgcgacgattcattcataaaccgaacattcaaaccgaggcgatacaaattgacactgtccattcgcaatcacaatgtgacggatgtgcgtttcttccgactgattggagttgataacacagccgacttttacgtggccccgggcgacactttcaccaacacttacaccgttaacagaaaaggcgcctgggttttgtttgttgaatttcccggaaatcgatacgcaaaatcccagcggaaaatgatctcacgcgactctttcccccaatggatgatggaagtttatctgttcccacctgacaatgtcggcttctctgaatggt

SEQ ID NO: 91455 - DNA, 247 bp, Heterodera glycines
  SCN-specific regions: Sequence locations=1-247
cattctgaccaggcaaatcttattgacttcatgcggatcttacggcgatgtgctccaattgaggagcattctcgagcttcgtattagccacttccagtttttctaccaaagggccatgtctttggaccactgcggtgaaatgctttcccgaactctttactcacgtcctcttttcccctatttcacggtgaccattatatgtggaattaccatggatggccgtgatgacctttacagttacgacccc

SEQ ID NO: 91456 - DNA, 328 bp, Heterodera glycines
  SCN-specific regions: Sequence locations=1-328
cttcaccttcaactccaactagggatggaatgatttgagggacgctaaactggtgttgacgcttccggcaaagcaccctgtgacgacatatctctccaacttccgtgccaagcgtcaactgccaggactctgacggagccctggactcctacatccaaggtgtcctcctgaccctctcggctccgccggaactcctgcacagcccggacaccctgaaatcgcatgacagcccggacctgtcttataacctaggcaattcgatgatccttgtacacgccagaacataccctgcactgcatgcaatgctggaccacacggtcccctcgga

SEQ ID NO: 91457 - DNA, 325 bp, Heterodera glycines
  SCN-specific regions: Sequence locations=1-6,28-130,163-163,186-325
gcaagagactcacattgttctcgggattgcctcggagagctctctgatggatatcatcgccacagacggcactcaggcatctctgtactccgagatgacccaaatgaacaacaaagtgcgcgacggagtggaggccttccgcgtcaacaccgactcggcctgcactgacttgatggacgtgcaagtggacgtgacgccgccgtcaaacccccgtgataaccccttcaactccatcttccgtgccaaacgtcaactgcccggacactgccagtgcgctggcctccaacagccaagctgtccccctggtccgcccggcccgtgcgga

SEQ ID NO: 91458 - DNA, 529 bp, Heterodera glycines
  SCN-specific regions: Sequence locations=1-529
ccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtcaggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcgcaagagaagtccccggatcagagcgcctacatgtgagaagatgcaacaacgaccggcggatggatgg

SEQ ID NO: 91459 - DNA, 633 bp, Heterodera glycines
  SCN-specific regions: Sequence locations=1-27,50-96,136-633
cgtccatttcgtccgatttacacatttcctttccctccgttctgtcatccaactgctgccactttcaattgcccttcacggcaatggctgatgacattcctcctcctcctgctgttgctgctgatggtggtgatgtcgtcgttgatttggagcaacatgttcgccaactcatcatgtccatcggccagggaagcgaggacgcagtgcacgagctttccattctgatcgagtcattcaaccaggagcagctcgtcgactttctggagattatggcaagaatgtacgtcgagagcggattcagcgttgacatgccgggtggccaagaaggaatcaccatgttgatggtcgctgcgtcctctggaagggtggactttgcgcgctacttgctcgcccacggtgcaaccgttggacacttggacgccaccggaagcgtcttcccactaatgctagctgccgaatctggtgaagttggaggtgtgccgtctgctggtcgaggaatgggcagctgaagtcaaccagcaagcaattgatggcacgacacctttgatgagcgcgagcagtgagggacgactggacgttgtgatttatctcatcgatcatggcgccgaaatccaacatgcgaacgccgaagga

SEQ ID NO: 91460 - DNA, 640 bp, Heterodera glycines
  SCN-specific regions: Sequence locations=1-555,577-592,616-640
gttgagcgaatcgaatgaacgcctccaaatccatctgaaggagcgaatgcaggcgcaaattgacaagaacaaactgatgcagcggcttgaccaggccaagaaaatatttgatcagacggaacgtttcaaagagcggttgctgcgtgagaatgacgaccttcgcaacgacccgggcaaagtgcaaacgctgggcgagcaggaatggaagcgcattcagcaggcgaacgtgttggccagcatccaacaggctttttccacctcttcttcaatgctcaatgtgaacgaggcaccgccgcctgcgctggaccaatcgacgactgatcccctggacgcaataaacaacgaaattcggatgatccaagagcaaaaacagcaggcggaacgcgtcgctgcggaacaaagccaagaatggccaccgaacggcaccgtttacgagtacggcaacaacaacaacgcgagcaacggcggatactcaccacggcaacaacatgatcagcagaagaagcagaagatgcgatctcataaataattcatgcacatgctgtttttaaacttacttaattgatgctccaaatatgtattgattgtgtttaaattgaacaaaacataaacaaatgcaccacaaaaaaaaaaaaaaaaa

SEQ ID NO: 91461 - DNA, 595 bp, Heterodera glycines
  SCN-specific regions: Sequence locations=1-2,24-595
ccatttgcccatctttttccttttcctctctgtccgactcccttttctcttctcttacccccaatttccttctccgtttgcccatccgccaatgtctccaatggccggcattgagccaataatgccgacgaattttgcgcttgatggtttcgcccgccatgtgtccccctccggcggattcggcggcggagcgacaacgcacccaatgaactcactgatcatccgcaacagcccttaccaaatgccaatgccaacgatgcccggaggggcgagtcccttcccgatgagtcagcaaatgggcacagacggaccgcagcagccgatattccccaatgggatgagcattgacaaaaatggcatgggctcggcaaatgccgttcttccatcggacattccaatggatgttttggttggaagacagatcactcaaaatcgcttggatgaaatgggccaatcggtcgtcggttcggcggcgatgaatgggcggcacccctttccgttgggccctttccttggcggctcaaacggcggcgggggaaggaatgcgccgccgttcggcgcgggaggcggcgccttttctggcgactcactgaca

SEQ ID NO: 91462 - DNA, 587 bp, Heterodera glycines
  misc_feature (574)..(574): n is a, c, g, or t
  SCN-specific regions: Sequence locations=1-245,268-484,506-587
cacaactctcaccgcgataaaaccaaaaatgttgggaaggaacattggcaacggacgggggagacctttgggaagtgcacataaagccgtgggaaaagccgtggatgggtcatcaagtggcgattcttccgatgacgactcatccatcgaccagcacgtccaattggccagcgaaagcagagacgtaaaactaaatggtggtggtgaatcgacaattatgaaagggacggggcggagaggacgtcgcaaaggccgaacgagggacgagtcttcaccagacttggccacgacaacagtggccgaagattggactggtggcaatggagacccggagttatgtgcacacaaaaaatgccaaagaccgctgcatatgtccatcaattgggtccaatgcgatgactgcgacaagtggttccattccacgtgtgtttttggcacaaactcaactcccgaggacgatgccgatttccactgcggatgtgagaggaatacaaagaaaaattcaacagaaacgacacatagaaaaagtttatcattgtctcccccgacataatgtctctttgggagtacaagntttttttcttgat

SEQ ID NO: 91463 - DNA, 646 bp, Heterodera glycines
  SCN-specific regions: Sequence locations=1-584,615-646
gtgcgaccccttcctcaaagtgagccgaatcaacgcggacggcacgtgagcagaacagacggacaaataatgggctcgacagaatggtactgatcaagtttcagaatgcaattggcctaccgaagtcggtaccacgaacagaatctgaaccccaagtggaaaccattcgaaattctcacgcagcaactttgctacggggacagagaccgaccatttctgatcgaatgctttgactgggaccaagacggcgaccatgatttggtcggggcatgccaaacgacggtcaaccgactgatgtgcgggatggacaaggaattgccgctgatcaacgaaaagaagttgaagaagcacaagaagtacgtcgactctggtcagattcacttccatcgcgtgttcctttggcaagactacacttttcttgacttcatccgtggcgggactgagttggatttcaccgtcgccattgacttcactcgttccaatttgcccatgaaggaccaatcgtcgcttcaccgcttcgaccacagcaaccgcccaaaccaatacgaaattgcgatcggagccatcgccgaaatatgccaacattacagcaaaaacaaacttttcaatgcttatggcttcggtgcccgaattccttctttggatg

SEQ ID NO: 91464 - DNA, 634 bp, Heterodera glycines
  SCN-specific regions: Sequence locations=1-2,35-91,161-365,388-634
caaatgtttaaagacaaaaaaaacaatccaaaaatttttttttgttcaacggtcctaggcatgttaatagcacttaggcaattgaaaaagcaaaattttctttttttttaaatcatgaatttgtaaatttatatttaaattattttaaaattaaaaaaatgagttttcaggaaatgaaaaaaattagctatttttccagtaatttatttttgtaattttgcaagaaattttaagtgtagaaagcgaataccaaaatttctcttccattcgttcattataaaacgccaacaatttgagtctcatttccttgggtagtttctcattaatcgctaccgtgaagatggaattgtcacccaaattgtgccaaaaaataaagggattaatggaaacaaggagaatagcctgtgttgttcctgtacctgtattttcatgtacttttgtacagaaaaaaaaacaggtacatgccatttttggaacacagataacaggtacagttaccggaacccgtcagttgggcgcccgcactttttccaatatagcttttttatttgttatccaaatccaacaatcttggtatcattcgaaagttattaacatgctctcttagtcttacaaaaagcgaaaagattttcaa

SEQ ID NO: 91465 - DNA, 604 bp, Heterodera glycines
  SCN-specific regions: Sequence locations=1-604
ccgtctgatttcacttggtgcgcctaaggaccagaacgaatcgcacttttctgacgaagaagaactccccgatgtgccgttcaatggcgcaagagacaaagcttgctatgccgcaactaggctaactgacaatgaaatcaaaaacaccaaacaagcacgaataactcaccgcgttaaggacaccagtctttttccactgtacgaagtttccggagtgatccaagactttgagaccactgccactccggctgactacgatttcgcactcggagacgaacacattgtatggccctctgaaaatatgcgccaaaatggctatgctgactttgtggcagagacaaatttggcgcttcttgtaaagagtgccgacactttgacaatgcatgtggcgccaaatcttccggccgacgcaacttgggcactctctgcaagtgaccatgcccgttctgccgttgaagccatcgccggcaccaacggatgctacctcatcttaccagttggcgctggaggactcgcactgtggattccgaccttggccgaacatactcctaccgcgaggcacgagaaacgaatcaaactgattgatgctcactctaaggagaat

SEQ ID NO: 91466 - DNA, 610 bp, Heterodera glycines
  SCN-specific regions: Sequence locations=1-380,402-459,487-610
cacaaattgacaccgacgaaaacggaggaaagggcggacggagtgccattgagcaaagtcaaaagcgagcgaaaatgggaagtgaaagcaatgggcaaatcaaagaagaagacaaatcggagaaatcagcgagcgaaggcactttggctgaggaaaaggcaaatgctaacggaagtgttggcaatgcctttcttgatgaggtcatccgaaattacatgcccaaaccgcacgcaccgatccaatgcattgctatggaggatgcgcattttgccctgaacacaacgccaatctcttcgaacagtccgtccaaatcgccagtcagaacgggaaatgatcgccttttggaggaaagcatcgctttgatgatgccgcatccgaacagaaaaagggaaggaaaagcatttgcaaggccaaaagatcaacaaaaattcggacaaaaaatggacgaccttttgacagcggatgaagaagaagaagaagcagttttggaacagcagcagaaagtcactgccgaactgcccgcggacgtgaatgcggaattcgctgcccattggatggtcgtggagtgtgggacgaccaaaagtcctaaaacggacgacgaggaacgaag

SEQ ID NO: 91467 - DNA, 640 bp, Heterodera glycines
  SCN-specific regions: Sequence locations=1-640
gcaaagtttctggcgccttataaacaaaccgcgcattgatgattggagtccattggcaaaattttattatgctgatgatacattaaatgctattgctaacgaattggactcttttgatggtcggagggatcccgagcgctgcaatcagcttgttaacaagttacgacaagcgcaggacagagtcttacatatcatctctgagatgttaatgctcatctttccactcgagtctgaacgtgcaactcgtgacttccgcgtcaaatttcctgacgaaataatgcatgataatctccctggtcaactttggtttggagcagaatgtttggcagctggttccaacattgatgaccatgaaacagaaagtgaggcaattcaaccgatggctaaatcattcacaagacacttggaaaagcttcgcgaaatgttgaaggagcaggcacttaaagacccaacctattatcccgacgggataaaaacttctctgaaggtcttcgatcaactttttgctgactttgaatttgcttacgttagtgcgatggttcccggcaaatccgccaaggaatatgaccgacaacttgacgtaacagtgcttttttccgaatgtctgactagggctatcaaaatgcgctacatcacgagg

SEQ ID NO: 91468 - DNA, 644 bp, Heterodera glycines
  SCN-specific regions: Sequence locations=1-542,564-644
gttcaggcactcggaatctgcgcgacaatttggccgatttaaatgcgcaaattgcggccaatcaaaagggcattggccttctgcatgaactcgtccgtgaatattcgctgcccatagtcaaagcgtatatgaaacatatccaacggaacgcagtcgaagcagtgagacaattgttgaaaaatgtggcggaagagagtcagcagaagggacaaaaggttttgagagcgaaggattggatggacgacggaacggagataaaattggaggtggaaattgacagagactcaggcgatgctttgttcgacttcaccggcaccggtctgcaagtccactccagctgcaacgcgcctccggccgttctgatggccgccctcatttactgtctccgctgtttggtcggccgtgacattccgctcaaccagggctgtctcgaaccggtcaaagtccgcgtcccccccggcaccattctcagcccttcggaaaatgccgccgtagtcgggggcaatgtgctcacttcacaacgcctttgcgacgtcattttgcgtgctttcaatgctgtggccgcttcgcagggatgcatgaacaatgtcacttttggcgattcccaattcggctattacgaaaccatcgggagaggggcgggg

SEQ ID NO: 91469 - DNA, 619 bp, Heterodera glycines
  SCN-specific regions: Sequence locations=1-160,182-271,318-486,512-619
cttaattcctcattttgctatttgagttaaatcccaaaacctcaatggaagctccttcaagtttgaatgatttaaacaaatttccgacagtttcagacaacagaaaacttaacgaaaacaccgaagagccttctgagtggaacaaatgcattgaattattggacagaaagaaagagacggacgagaaaatctcacaacaagtgacacttgtggcgaatttgggcaaggcattcgacgagggcattcagcagaacgaaggcgaagaacagcgggaagaaaaggagaaggaagaggttgagaaggaggaggagaaggagcagacgccgactcattcgcaattcgaatttggcatggacagcaaacgaaagcattcttccgctcgtcaccaacagacaaacccaaaaaacaatgccaattcaacgcgtgcgcggcgttccaaacgtttgtattcgccgtctccgccgccctctctgatcagcgaaacgaatcgaaagaagaaaaaagaaaattctgcggacgaagtcggcgatttctctttgggttctctgccgaatgctccgagttcttcgctgctcaaatgggcaaagtgcctccgtcgtcgtcttcgcttttctcgagc

SEQ ID NO: 91470 - DNA, 624 bp, Heterodera glycines
  SCN-specific regions: Sequence locations=1-61,85-108,133-223,246 -316,338-624
tctttattgataccacctccaagacttccctaacccaatttattttgactaaattttccaaaaacataaaattatcattttttggacaaaagctgttaaaacgcacttaaattttcaaaaaattttccccggctgcagctcagagcaaaaaaaaaaaaaattagcctaccaaatgaacaaactgccaagaacaccgccgaaaatgcccaacattgcgaacggaatcagttccatgaatgtccaacgcatggaatagtccacgtgaaacagcgaagtctataaaagaagaagatacactattttttatttgctttccaagaaaacattcacctgatcacttccgaacgggttgacaaaacgaaggataacaccggcgaccaaagcgcagaaaaacgagcgccacatcgttttgagcggaaaataataactcgcctcctccagactaaaaaaaccattggtcaaagagaatgagtagggtttgtttttttaataaataagcctgttaaaccgaaatcatcacctgaacatcactcctccgattggcgcgccaaatgcaacagaaacaccggcggcagcggaagcgctcagaaattcgcgctttttcccctcatttagcccatattt

SEQ ID NO: 91471 - DNA, 640 bp, Heterodera glycines
  SCN-specific regions: Sequence locations=1-640
aacacgaaaaggtgcccgcccccttcgacaaatgtcgaactgcttttgcccaaaagcagtacgttaggtcatcgtccagccacaacaacaattactgtgccaacatgtccgtgccgttgccactggctgctgctgttgaccatcattagcggcactttgatgtcggttattagcgggtccatcagcggcataagtgacagaagccgacggcaaatgccagcaagttcgtcgggcactgtaaattctgtgggcaatcaaacggcaatgtcggcatcgaacgccctttggaaggcacccgacggaacagtgggtggcaatggcagttcaattgggacggcgggcgggccgggcccgagcagtgttttggccggttcgaatgccaaagttggcggtcagagtgccaacggggaaaccggcgcgcttagcttgggcggcacacggtccgagtcgttcggctcgtctagctcaatgctgaacggtaaccaaaccgcgagtcagtccggtacttcgtcgtcaaacgctgtcggcaccggcgacgtttttgtctactcagtgggaaacggaaatttgacaaattcggcccagtcagcagtcccaaaagtggccgccgctggcatgggcggtgccaccggcaaccaat

SEQ ID NO: 91472 - DNA, 367 bp, Heterodera glycines
  SCN-specific regions: Sequence locations=1-367
cgaatttgatgagaaaacgagctctcagtacttcaaaaaggcgacggaacttgccggtctttactcggacattcggggaatccgaggcgatggcaattgcttttaccgtgatgaactcaccgcccaactcgaacgctgatttgaggacgccgaggagctgaaaaggttcaatgagcttgtcaaaggttggcgtgctcgtctgatgaccgacagctgtttccacgaattgaccaccggtgacttttgccattcgatggagcaactgatgacttcgctgctcaatggcacaatgctaccccaaattctgctggacgacctcaacaaggacgggattgccgattattacgtggtcttcattcggctgatg

SEQ ID NO: 91473 - DNA, 656 bp, Heterodera glycines
  misc_feature (529)..(529): n is a, c, g, or t
  SCN-specific regions: Sequence locations=1-362,386-656
caacggtccatccagcagaacacctcgcgattgaacttgcagaaaaggcgtgggaatgactaaggggcagggaacaaattggtggtaatgtttggaaactggacgaatgaatgaatctgccaccttttgcattgaagactccaccattgtttgcaagccgaaccatttaaatttgacggtgaccactttgtacgcgcacatcaccggcttgcagttggtctgccactgctgcttcaacggaccacggcctgttttcatggagcggaatgtcgacggtctggtgttgtcaaggatgtcggctgcacgcagaaactcgttgtcgttggcgatgttgatgcgcaccaccttgcgttccttcagcacatccttgtgatgatgatgatcattccatccatacattttttgtggtgccgcggtcgctcaagtgcattgtttcaatccgaatcagaaagtcgtccttcatatagtccgggttggtcacctccgttttgcagtacggaaaggcgttccacgaccgttcatgcagcgntgtcgaacctcttggcataatcgtcctcagaaaagcaggcacttttctggagaaaaaaagacgaccaaattagcattaattacatttccgcgcctccctcgaaaactcacgtatctaagtggataat

SEQ ID NO: 91474 - DNA, 164 bp, Heterodera glycines
  SCN-specific regions: Sequence locations=1-164
ctttttacttcgccgatgtttgcgcggggcccggcggatttagcgaatatatgttgtggcggaaagccttttacaacgccaagggattcggctttactttaacaggaaaggacgatttcaaattggaaagattcaaagccgcttcatctgattactttgagaca

SEQ ID NO: 91475 - DNA, 509 bp, Heterodera glycines
  SCN-specific regions: Sequence locations=1-71,93-299,321-509
acaacatctgtgtatgagttcttacgcccgactaattttcttaaatttggaaaaaatcaagtagttgatgaaaaatcatagataaaaatcaatgattttcaaaatctgagttcagattcatgaccagcgcattttttaagcctagaaaaaatacctgcgaatttttaacattttaaacaacgatcatttcagttctatacaaaatacaacctttgtgtatttgacgaataaattgaatttatcgaaggatttatgagaacaaaggtaaggagaaatgctgggaattcacagggaaagtcattaaaaataagcattgtcttctataagcacagaaaagttgcgaaaatcatcgaggacagcgcaaatagaagggaaaaggaagcgccggtgggcggcgaaagtgcggagttgcagggaaaggtcgcctgaagaatggggggagggtaaccgtagaatattattcagtccgttgcagatgatttattccgtacaaggtttccccccccccc

SEQ ID NO: 91476 - DNA, 606 bp, Heterodera glycines
  SCN-specific regions: Sequence locations=1-30,78-131,185-195,217 -231,275-399,421-466,488-606
gttcggaccagcagagttgttgcgaattgaaaaataaaatgcaaaaaatgaaatacgaaaaaaattaaaataaaatacgaaacacaaacgaaaaacgaaacgcgaaaggcaaaacacaaaatttgtttttgaaaaattttaaaattttagaataattctaaaatataatcaataaagaaatattcgagatcaattattttcacatttttaatcaaattccataaaatttagaagttgatattattgttattattgttttttacttttaaagttctcctaacatttccttaatcaaggtgtgatctgctaacaaattttatatttttttgccgcataatttttcctaaatttttgtggagtaggaccgaaaggtcatgcttttttgaaactagccaaattttttgcaattaaaaaacaaaatgcgaaacacgaaatgatcaacatccctcccgaccccactcaagcccagcagaaggacaatattttcagtattgtcggccgccaagcacttaacaggccggcgttcaccgacacacctttttggcgatttgttctgcccaaaatatcggcccattttatggtcttccaactaactttttttcactg

SEQ ID NO: 91477 - DNA, 217 bp, Heterodera glycines
  SCN-specific regions: Sequence locations=1-35,60-76,99-106,128-170
caaccgccgcttaagtcccattccaagcggtttgcgttaccagggaagaattgaaaaattttttcatgaatatctcaaaaagtaaaatttaatttttgatgtgaaattaaatcaaatttttaatatcaactagcgcagatgcgctcgcttcgctcgcgcacctcgcattcctttttctttttctctctctctctcccgtctttttatctcttctctt

SEQ ID NO: 91478 - DNA, 560 bp, Heterodera glycines
  SCN-specific regions: Sequence locations=1-115,137-187,209-492,514-560
caattttcgcagaatgcttcgagaaatctattagctccgcaatttccttgctcaacgtctcaattttcaaacgtcgcacattatcacccttcttttaatccaacaattgcaagcaacatttacataaacccatctgttttcaatacttctcacgaccagtcctttgttctcatcaatcagttacaacacctttcctcaaaaagcagccaaaattggcatttgatggtcgatgatttcgttaaaaaaactatttcggttcctccacgcaattacccgaagaatcgttccccatcctccgattcttcctttcccgtttctcacccttcgacgcgatcgaacagtcgaaattcccgaaagacatcgccaccgacacgcaaaaggcgtttgaagcacaatatttcacaaggcaaaagaacgcaaagacagacgaaagaggcgcatttatcaaagcaaacgatggaatgtgcgaaggcaattggacttgacagtgactacctaaggaaaatcgaagaacaaaagaaactgagagaagaaattgcgcgcaaaaaaaaccaacaccg

SEQ ID NO: 91479 - DNA, 635 bp, Heterodera glycines
  SCN-specific regions: Sequence locations=1-414,436-506,528-635
ctggagatattccgttggcagggctcgcgaactttactctgagatgacttccattggcttaatccccttcgaggaagtgttcaattcgctgctttcggctcaaattcccttcaatagttcgtcgtcctctttcgacgtgactcattggctgcatgaaatgtctcgcctcggagtgcgcccatcggttaaaacgttcaatgccgctttgtcatcccttttgcaaatcaaagaaaagggagcaaattcatttgactatgggacggaagaaatggcagcagctgtaactccttcgactgaagaatcatcatacgataaagaacacctgtggaaaaccgcgtctgatttagtccatgaaatgcgttcgcttggaattgaaccgactttggcgacattttcttacactttgaaattggcaccaacaaaaatgagtttggatgctctgcttaatgagattttgacacgattggagtacaagctttcacgctccgaaccgatcgaacgtgttggggatgatgatgcaattttctaccgaaatgccatttcaatggcgcgcatactgaacaacgaattacagatggatcgtctggttaaaatttacagatccgaacacaacaaagtctttttcgagaactatg

SEQ ID NO: 91480 - DNA, 587 bp, Heterodera glycines
  SCN-specific regions: Sequence locations=1-587
gagggcaagaattcgggggttgtctacagcgagatgcaggcgcgagactccgaaatggactcgatgttggacaaaaaaagaaaggagctgttctaccccgcgggaagcagttacggggcgatgacaggcggtactctctctgacatccgcgaactgtgctcgctggaacgggtgcgaaactttcacaagaacttttaccatctcagtaacatgtacattacggtttgtggcaaaatcgaccaccaacagctgctgaatgccatcgaaccgattgagcaggagaacctcgacgccattccccggcagttcgccacgccttttcaagcgcgcactccgccactgactgagcccagaacggcgcggattgtgtgtccatccgacgacgagtcaatcggcatggtcgaaatgtcgtggcacggaccgcccggattcgacttcaaaacaacgcaagcactgacgattctgttcgactacctgacggacacagcagttgcgccgttgcgcaaggacttcgtgcaaattgaagaccctttttgcacatcagttagcttctgcttgatggagcaacgggactgcgaaattgttgc

SEQ ID NO: 91481 - DNA, 515 bp, Heterodera glycines
  SCN-specific regions: Sequence locations=52-308,331-515
ctctctctccccctctctctctctctctccctttctctctctctctctctccatttgcctccgtttccatttcccaatataggcaattattggcagtttaattaaattgcatcgctaacttttcccgtccaaccaattaaattagccaatcagtcgcattccgtcgctaatttgtcttttgaaacaatgcactcattcgcctgctgccgtttcgccgccgtgccattgtttcctccgtgccaatagtttcgagttcactcctcagccgatggccaatgctttggctttgtgccgtgtcctttggcccattctcttcgcttcttctttcgctcaatccaacacttctccgtccaatttccccccaaattcgttgcaaaatcacaacaaagtcaatgactgtgtgtacaattcgagtcaccgcaaaagtgtgttgactgacataatgaaaggctatgacaaaactgtggtgccatcaaatgaaagtgtgacggttcaagtggagctgaccgtacagg

SEQ ID NO: 91482 - DNA, 580 bp, Heterodera glycines
  SCN-specific regions: Sequence locations=1-580
ggacagtgccgggcgcaccattccctcgggcggatttgccttcgtcgacggcactctccactcggaccacttcattttccaggcatttcgtccatttccttctgtctgctggtcagactgatcttccgtttagggcggtccggacccgatcattcgtggaatgatgtctcaacagttgaaaaggccacaacgattgacgcggacgatcaccgaacaaatgtttggcaccaccgacttgggcacaattaacatccaacgagggcgcgaccacggggttcgattggcgaacagcagtgctcagttggccaaactgtgacttaagtgccaatttttgtcaggtgccgtcgtacatgcgctttcggcaattgtgcgggctttccaccgcgacgacatttgaccaagtcgagcaaatcaataaagcaacaataatcgaatggcattttgatttggcactttgtttagctgagtcgtgagataatgagtgtcgaggcacgacagaatttgcagaggatatacggcacgccaggttggtactgttcactcacttattgccagtgcgtacatttgtttgaccttttca

SEQ ID NO: 91483 - DNA, 387 bp, Heterodera glycines
  SCN-specific regions: Sequence locations=1-387
gtccgaatgcgccgtcatcgtcaagaaggcccaattttggcaccgtgccgagacggaggcggcaaagcaggcggctcagtttgcgacgatttgtgccgtcagcgaatcgcagaggaaggcaacatttcacagcgtatcagcagcggacgaagtgccggggatcgctctaaacactcaagcacttcctcgtggcctgacgaattgtcggcaccgaccggtgccgaccagcaattggacatcggcacgggacatgtccttctcgcatttttgaaggagcacatggaaaagccgggcgaagtcagcaaagagtgggagtcggtgaaggactacgcgaacgcagcaggcgaagcgacggtcgcacggcgagcggaaaatgcggcgaaaaat

SEQ ID NO: 91484 - DNA, 637 bp, Heterodera glycines
  SCN-specific regions: Sequence locations=1-637
atttaattaacgtttttaacattaaatgtcggattgtcagtgccatcagcgtggttctattcacctaattattggacccatgttcagcggaaaaacgactgaattgttccgattggctcagcggtacattcttgccggacggaaagtcgcagtggttaaatatgcgctcgacacgcgttacgacgagtcgcacgcatgcacacacgacaaacgcaaaatggaggcgattagtgcgacgaaaatggaagacgcattcgaggaactgaacaaattcgatgtcattggcatcgacgagggccaatttttcaaagacatcgtcaaatacgcgcaagaattggcaaacactggcaaaacagtgatcattgctgcactgaatggcgattaccggcaggagcccttccaaaatgtggcgatgctcattcctttggctgagaaaattgagaaactaagcgcagtttgccgctgtggacagtccgcctcattcacatttcgaatgtcggaatgcacgaagcatgtcatactgtaacatgttaatgatgcattattaatccatgctgaacaaccataattttgcattttcatgtaagaccattttggggtaaacccaacttatccatacccaacgcatccataccca

SEQ ID NO: 91485 - DNA, 661 bp, Heterodera glycines
  SCN-specific regions: Sequence locations=1-661
gggatttatgccgttggaactttatcaagaagttgagaagaatgccaaccaattgcccaaataccaaaggacggattacctgtgcagacgttgctatttgctgaaggagcacaatttcttgttgaatcttaatgtgtctccggtggattacgagtcaatgatgggacatctcaaaatggtccacgaggctctgattttgttgattgttgacatgaccgacatggaggcgtcaatcaaccggcagttgccctcaatcattgggaccaaaaaaccgatgattgtggttggcaataaaattgaccttttgccccccgacttccacaagggttatttgcgccattttctcgcctctctcaaggcggccatgcacaaagccggagtcgcacagcaattcaacattctcaaatacttgctgttgagtgctaaaacgggatttggcgttgaggatctgatcacgaatatttatcaaaaatgggtcagtccgcggggctcaattcgaagtgacatttacgtggtcgggtcgacaaatgcgggaaaatctacacttttcaacgccttccttcagtccgatttgtgcaaagtgagggccatggatttggtggagagagtgaccacttcaatttggcccggcacgacttcttcgctgctcaaatttccgata

SEQ ID NO: 91486 - DNA, 457 bp, Heterodera glycines
  SCN-specific regions: Sequence locations=1-94,116-132,159-224,248 -289,350-457
gtccaattatggagcgatgtcaccgaccaagagtgtccaggaagtgcaacccgtggcattgtcttggttttttctcaccgttatccatgccaagtcgggacggaaaattcttgacaatgtgtccggaatggacgacgcgggccaactcgtggcactgatgggcgccagcggggcgggtaaaacaacgctgctgaacacgttactcaaccgatatctgaagagtctgagcgtggagggtcaagtgctggtcaacggacatttcctggggcggtccatcacttacgtcagagggtacgtgcaacaggacgacttgttcatgggcacgctgacggtgaaggagcatctgatgaggcagggacagcttcgcatggacggacacttcaaactgtcgatgcgcaaacgcgtggatgagatcattgatgagcctgggctgccaaagtgtccgccggggcgtatt

SEQ ID NO: 91487 - DNA, 486 bp, Heterodera glycines
  SCN-specific regions: Sequence locations=1-108,130-434,456-486
aatgcacaaagcgttcaccgacggagtgccctttccggtgcttaaagctctcgaatacttttctatgggccaacaatcattcgcatgaggacgacagtttcggaacgcaggcaacttcactggcacaatgctttgggccgccttcttcgtgtggcttgtccagtgccttttgctgctctttttgccgcaccattttgccaaggccggcatattctgtggcctgttgacattgttggcggatgtgctgttcctggtgttttgcccgtccgatctgctgatccctttcccgtctgctgatgcccccgcatcaatcgcttttctccattttcgccttggtgcctgcttttggatgagcatcgcagcagccattctcgagttgctcttctctgccactctgtgttctctgcaatcacttcgtctgtactctctgaacaccgttctttctgcttctctggacaactctgtcggcccaccaaagtgccgttt

SEQ ID NO: 91488 - DNA, 585 bp, Heterodera glycines
  SCN-specific regions: Sequence locations=1-77,99-340,362-537,561-585
aacgaactgctcccagttgggtggatgataaaaatatggggttttgaggtcgctggtcttcaaaattgaaaaactaagttgttttgacttattgtttggttggggttagacagaattggccaaaatttcaattgtttaggtgtacaaggaacaagttgagggagcgcctacgcctatcaatttgaacgttcaatttggcaccaatgcgcgcgagctcatttttgacatggacgattcaatagccgtggtaaaagagaagatccatcgtgcgtggccagtgacgccagtgccggctcaaatgttgctttacttcgcacgtatggttaatttcataaattgcttttaacaataaacacccacccgttcaggtagactcctcgcggactcaaaaaggctcagggacattaacatctccaaagaccagatgctggacgtgcgaaaagatgtgggagaaccagtgacggattgatcgcccttttggagattattgaatggacaattgatctcttctcgttaatttgatgtttctttccgacgaaaatatttatttgtttgttttgccttcagtcggtataaaattcaaat

SEQ ID NO: 91489 - DNA, 551 bp, Heterodera glycines
  SCN-specific regions: Sequence locations=1-160,182-310,332-358,457-551
gccgacaccacgacgtgagcccaatcagaagaatggacagcacgggacaagggacatcggcggcgagcggaacggaagaaaagatcgtgaaaattcgaaaactgttgctgcaggccgccgacttattgggagaaatggcagacgaattgttcccgtataagaaatagggggacagcaaaaggaatatcaaaataacaaaaaaaaacaaaatacaaaaaataattaattacatacattaaccattatttttgctgcccccccccctttaattgattgcaaatgaaatgtttgggtaaatgactgccctttgccttcagtcattttctctctcccttttcacatctcacacgttaaaatgtctcgccctctctttttctctcattctattttttcgttccatttccttttcttcatctctatctctctctctctcttcatctgtctttcgttttcgcttgcctgaggaaatgccaatactcaccaatcacggcggacggcacaacaaagcacggcacaatcaaaattccaaccaccaaaacaacggacatcag

SEQ ID NO: 91490 - DNA, 574 bp, Heterodera glycines
  SCN-specific regions: Sequence locations=1-106,128-574
gccaagtggcgcgaaatttgccaattacccgccgcttttgacctcctcaattttctcgcctccgaaactgttcagctcagatggaaatccgacggattgttggccaacaaattggcaatggaaaatggcgccattttatttgccgtcaaaaacactccgttcgttgtcgaccccagcggcacagtgtgcactttcctggccaatcacttcaaaggcaattcgacagaaattttacgagcgaatcaaactgatttaatgaccaaaatcgaattgggcgtgcgctttgggaagactttgataattgacgaaatcgacgaacgaattgagccggcattggtccctctcctaaggagggactttcacacaattggcgcgcgattggccgtacaattgggcgaaaaacaggtcgatttcaacgaccaatttcggcttttcctctgctctcgaaatgagcattgccatttggcctctcacgtcagtgccgtggtctccgagatcaatttctccgttactcgatccggcttggcctcccaatttctgtcattggccattgaattggaaaagcccgaactgg

SEQ ID NO: 91491 - DNA, 623 bp, Heterodera glycines
  SCN-specific regions: Sequence locations=1-460,487-623
aagttgatcaatttcatcctgaattgactgttttttctgttcatcattcaaaaattgttgttgttttcttaattcgcgaatttttttgtaatcgtcttgaagcccttcatattttttatgaatatgttcccagtaatctgttggatgactatcaaaaaatggctcaacgtaatccttattttgttcatagctcgtcctctcatattcttcagctgatatttgtaaatcttttttcaatacagccttgttaatatcattcaaattttttcttctgtgtttcattgctgttctcatctttagtgctgtttcatttagttcttgaattgttctaccatctgttactccttggtattttttcatatggtcttgaatgttgaataaatctcttattaattctaatcgaacttcatttaatttctccctatagttaacagaatacatttcgaggaattcttgaccagttctctcctccttttcctccttcccgtcatctctttgccttgctgcttcttcaagcgcctctattcttgctttcttagtcaatgattgattttggagagggtcaatttcctcatcctctatttttctcttcctatgcgtgtccgtttcatcatcacgttctc

SEQ ID NO: 91492 - DNA, 487 bp, Heterodera glycines
  SCN-specific regions: Sequence locations=1-57,94-487
aaatcattgactttaaacttcggtttgtttccactacttgtacttacaacttattgcttatttaaaaacaaaaatttctttatattttttattcctttttttcgttcattaactgcacacagaagagacgcaaataacaaattgtgtatgtgtcagaattatgtataaaacagatggattaaattatcttcaaaaaattttgttaaaaccgatcacaattagtaaatgaatgatgggacagcaattgctttttgttaatgtcccgaactctacaaaaccatcgattagtagtaattaacggttaattagggggaattgcttaattcgaaggaaggcaaaaaaagtgtaatttccgcagcgaaaaataacaattatactacaattttgacggatatataaaaatcctccaattatcccatggcgatgtttcacgcgacggccaaacgggtcgaactccgtctcctttgccaacatttctttggtccac

SEQ ID NO: 91493 - DNA, 581 bp, Heterodera glycines
  SCN-specific regions: Sequence locations=1-581
ttttgttggaaaaacatgactttgatgccgcattgaaacactatgaacaaattttggccacaaacgaacatagcccaagagcactttttggccgtggacgtctccaccaattgaaggccgaatttggagctgaacatgatgatgattcggagaaatttattaaaatggcattgtccgattacaattcattgttggaaaatgaagacaccccaaatgaactattcaagatgactgtgcaatattttgtggaatgtgcaagacaaatgggtggctatcatcataaaattttgcaggcccaaagggcactggtggaccgatttccggacgacgcggacataaaatgcgattttggcgccacatggctgggcatggccaggcccgagaaagcagcggacatttttcgaaatgtgttggacaatgagccgggccatgcgctcgctttggcctatttgggctacatccaaaaagtgcatgaggacgaattggaacgccgggtgcacgcgttgcgccgcgcaatggccacgggcgacgaacgcgtgacaggagacgcgcgaatttatttccccctgggcgatggaatt

SEQ ID NO: 91494 - DNA, 618 bp, Heterodera glycines
  SCN-specific regions: Sequence locations=1-80,102-558,581-618
gtacatcagccagtccaagctggacgacacgctggatgttctgctcagcgacatgggcaccatcatcaaggagaagctgttgtccatcatggatctgacgttgggccgactggcacgttatgacgagggaaatccaatcggtgcacttctgtcaatggcatcgacaaagccgaacacattgttcaacaagatgaggaatttggtgggcgaacagtccagcaatatgcttggcaacatcgccggatgctgcggcggcgccggcactcaactctcgtcccaacaccgaccgtccacggcacaattccaccatttcaacgcgggggcatcggccggaggcggcaccgccgccggggccaacaacagtgcccagcttggccaacagtacgtgaacttcttgcgcgcctcctctgaacagcttcagcaagtgattgctgatgaagtgtgggtgaaccgactgttggaagaatggtatgatgggcaaacgcaaatgctgaacgaatggcttacggaaaggcttcaacaatcactttccaacacgcaactcaccagtttattgctcattgtaaagaaaatttattccgactttgaactgcacggcattgacgaggaacggctgaa

SEQ ID NO: 91495 - DNA, 634 bp, Heterodera glycines
  SCN-specific regions: Sequence locations=1-70,92-634
ttgtcccaccaaaatggcaacggatggcgtagaagaagttcatattgaaccaaaaggtctgctcggattgctcggtgttccccccggcgctcgtgccatcgttgtgttcgcgcacggcagcggaagtggacgactgagtccgcgtaacactcacgtggcgtccgaactgcgccgctctggacttgccacctttctattggatttgctgacgccggaagaggaggcggaccgtcgcaacgtttttgattttcctttgctggccaaacgtcttcaactcgcgtccgaatggcttcgctcacgtccaaacacagcaacgctttcccagggatatttcggagcgagcactggcgccggtgccgcgttgacagccgctgccgcactcactgacacttcgacgcccatcggcgcggttgtgtcgcgtggcggtcgtcctgaccttgcaatgaatgtgttggatcgcgtgtgcgcgccaacgcttctcctcgtgggcggcttggacggccaagtgatcggaatgaatgaacgcgcgttgaacgcattggtcaactgcaagcataagaaactgcacattgtgccaggggcaacccatcttttcgaagagcctggcacaatggaagaagttgtacgccttgca

SEQ ID NO: 91496 - DNA, 495 bp, Heterodera glycines
  SCN-specific regions: Sequence locations=1-147,170-175,197-257,282-495
cttcaacgtgccctggaggcttttgcggtagccaatcagtccaaatttgccaacagttcggcccattcggcaccgtccattgtcggcagccctttgatccctccgcctcttgcgcacagccaatcgcaacaattggccactaatggcgcaacagcagcagcaaccacaatgagcagtgtggagcaacagctgctgtctctgctcaacttttcccagctgagcagcaaaaatagcaacactttgtgctcctttgctcctcacaatttgctttcttccaatggcttttgcctttcctccgcgacgataacggcgacaacgacaacggcaccaacaatagtttctgaagcgacgcagcaaaataatgccatcgtcgacaaagtcaacgaacaaacggacgaagcattggcaaactccgcctccgcagctgctgacccatcggtgccgattgatctttcctccaaccaacagcagtcgcttctcctctcatccgccccc

SEQ ID NO: 91497 - DNA, 581 bp, Heterodera glycines
  SCN-specific regions: Sequence locations=1-483,506-581
ctcagaacagagggctgaccaaagtgggaaggggtgagcatcaatttgagattgcccgaggggcgatttaaaatcgaaaaagcaacgattaggaaccaggagatcaggagaatattgcgaaggcaagaagcggcggcgcaagcggcggccgcggaaaaagcgaagggaccgctgacgacgcggccaccgaaggaagcggaggcgaaaaggaagatcagcgaattggcacggaaagcgaacgcttcgaaattggcggtggcgggcgcaacggaacagccaaaggcgggctcatcatcggcagaaaagccgatgctgcgagagaaagcgcgcgacatggaaagggaggcgatgaagccgaaggagacgaacacggcggaaaaggtacttctgtcgcagagactgcgcgagacgggcgtcgagtcgggagtggcggcgagaagggccaaatttggggacaaagcggcggagcccgcgggggaaaaacgcggcgaaaaggcagtgaaaacggcaccggacagagaggagaagaaagctcaacatactactgacgaaacagcggaaaagtcgaagtttgttccgag

SEQ ID NO: 91498 - DNA, 524 bp, Heterodera glycines
  SCN-specific regions: Sequence locations=1-57,83-143,165-225,280 -305,329-524
ttcacattttcaaaataaatattgattaaaggtttcggttaaacgccatggcatttgaaaaaattgtacaaataaaaaaccaaattttaattataaaatagcagtcgaaaaaaatgaatgaaatttctgcagttcacttttaattgggtactaaaatatttatataaaaagatcggaatagtagagttcaattctggtacgattcacactttaataaaacagccctttttaattcatttacaatttttttttataaaaaaccaaatttataataaattagtacagggttatattgatcaaatctctatttttctcattttattttgctaacaaaatgattatgtaaatgggtcggcatcgtagggtaagactctgatgtgattcatactttaaaaaacagataaatttttagaaatttgttgacaatttttaatattagcttcaaaatatgccatccacattttcaaaataaatattgattaaaggtttcggttaaacgcaatggcatttgaaaaaattgtaca

SEQ ID NO: 91499 - DNA, 256 bp, Heterodera glycines
  misc_feature (229)..(229): n is a, c, g, or t
  SCN-specific regions: Sequence locations=1-256
gaccgagtcggacagtcgcatttgggcctacaaattcgttgcctattcggccgtcactttctccatcgtggccgttctctctgttgtggtcactctgcccatggtgtacaattacgtagcccacgttcggcgacagatgcagcacgagctcggcttttgcaagggctcagccaaggacatttacgtggaggtgaaccatatgaagtcgacgcccgacatggacttgtgngttcaccgaactgctcgtcaaactggc

SEQ ID NO: 91500 - DNA, 274 bp, Heterodera glycines
  SCN-specific regions: Sequence locations=1-53,75-274
agacaaaggttgcttcgacaaattggcggagctcaacgactctgtgaactgtgcattgtgtgtggaaaatctgtcggaggatttcgtctaacgattcgacttggtcgttctcaccgatgcgcccttttccactcagactgaagtgaacggttggatgcgcaaccctcgcaaaatgatcaactcggaagacgcgtttggtcgtttctcacaagcatctgtggactagggggactaattctttgtgcacgattccgacggggagacgtgcaaagag

SEQ ID NO: 91501 - DNA, 515 bp, Heterodera glycines
  SCN-specific regions: Sequence locations=1-515
gtcagagtccagtcaacgccggcgtgtctgaggtcggcgtggatttcttggacaattagccgagtcagagatgagtggcggtcgagaaggacgggagaggcgagagtgggcggaccgttcgcgtgcaggagccgggttttgaggcacaaaaggccatcctcattgaaaacagtggggtgtttgtcgtagccgtcgagcgagcttcgttggtcttgtcggatgaggaaagtcctggctgctctgaacgtttttcccgtcggagggccactccgtgggattgacgaaatgccgcttctgagccattttggtcgacgacgcccgatgaattggaggacgagaatggtcgttccgagaagggtcagcatagtgctgaaacgagccggatcaatgaggggagggggcagcggactttgtttggccatgagggtcttggtctccgattcttcaaacgggagatcggcggaaggggagtcggctggcgtcgcgaacgttaactcgtcgggccattccgtttc

SEQ ID NO: 91502 - DNA, 465 bp, Heterodera glycines
  SCN-specific regions: Sequence locations=1-465
ggcgtttgaaccaataacagttgtatttttgtgatgacagctcttactccagcagatgtgcgtgagcaacatttggcccttcgggtgatgcgactgtccaatcccaaatttcatgagaccatttgcttgggccgcgatccggccgatcctttctcaatggctatttgtgattcgattggcaaattgagtggtcaaagttctgtcgatttgccgcttgattcctacttaattgcaccacatgcgatgttttttttttatctcggggaaatgttcactctttacatttcaatcatcaacattagctctgtcatttgcaaagaaatagccattaaggtcgacattcaaactcagaatcagcgcgtctctctcgaagaactggccttcgccggaattgcccttgagccgaaccaacaaattggccaaattttgaaacatgacatccgggaacttaggcaacacaatctt

SEQ ID NO: 91503 - DNA, 295 bp, Heterodera glycines
  SCN-specific regions: Sequence locations=1-6,29-295
ggacgcaataaaataaaataaattatttcacactcaaataattcatcttaactttgtcttcttcttttgcttcgacaataaaaaaaaacaacaacacaacgccaacaaaggttctctcaaatttttttttgtcgtccaccgaaaaaatgatgggaattgagtgcgttcggagtacggcgccgaggccgtgggacagcgaaagtgaacgctttcatcaagttcaccattcttccgacggctatggacgtgatggcattggcacgcacccgccaatttcaggtgacgcaactgccat

SEQ ID NO: 91504 - DNA, 619 bp, Heterodera glycines
  SCN-specific regions: Sequence locations=1-99,121-136,191-310,333-619
gtttaacattgagtatttttgtttgaatggacgacgaaaactttcatcaagcgaatatggaacgagtgagagaggacgaagatgaaaaaattgcgattggtcgccaaacggaagatggcgaaacggagccaaaggcggagagagagcgcgagaggaaaagcgacagagagagggagcgcaagaagaagagcaagcggacttcgcgagaccgaagccggtcgaagtcgcgggaacgcaaacgatcactttaacgccgacgaagtcgctcgcggtcgaaggaacgccaccgcgagagagagcgaagccgagaaaaggaaaggggcgaaaagaggtcgaaagtgaagagcaacaaatattgggatgtgccacccgctggctacgaacacatgagcccgaaggagtacaaagaactccaagtagtggtcgtccattagaattgcgcaagggtgctgaatcgatggattttttagcatttagcactcaatttggtcgtctcgtcgtttttcagatttaagatactccgccaaatgttaatcgatatgaaagtcttttaggttttaggggaaaacggtgtcctgctgcatttttggattcatcccaacccaatagcttatagggt

SEQ ID NO: 91505 - DNA, 642 bp, Heterodera glycines
  SCN-specific regions: Sequence locations=1-642
aaggaagaccgcaaagctcaactggcctcgcagtacatgcagcgcttggccgcgatgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcaatcatccaatgcaaggctacatgatgggtccagctggtggcggtcagttcggcggcgctaaccaaattgctcgtggaggacctcgctccggtggtggcggaggaatgcgtcagtacgggggacaaccgcgccagcaacagaaccgcatgcctggtatgggcggaggccatcagcagcaaggaatgcgttaccagggacagccgagaggaatgcaacaacaacagcaggctcaacaaccacaaattgcctattcgtcgtatccgcagcagcagagccgtggcggcatagcaccgcaaatgggtggcggagcgagtggcggtggagccaacgctggccatgtgatcacttcttcaacacaccaggagccgttgaacacacagctgcttaccgaggctaacataaccgcacaa

SEQ ID NO: 91506 - DNA, 548 bp, Heterodera glycines
  SCN-specific regions: Sequence locations=1-548
tgactttttacatatatcctaaccaaaattgttcgagaattctgacttcttcctggttactcatggaatttttgaggcctcatatcgaaagatggaaaaaaatatttaaaatactgcttaacgagttgatcgatctgcacaaactctgtaaggaagaaatcccttgttttacatttaccgccctggcagaaaaggacaaaaactgcaatgcctttgttgccgcgttactggaactggttaaagaggacgcttatgcatctatcgacggatctggctcgaatgcgttgctcatccgtctccgcgaactttacccaagtgttattgaaactcttgcgtggactggccttcaaacactcaatgccgaactttttccatcaacacagcgtatggtgcaagcacttcgcgagttaattgaaacgacgggactttattttggagccgttcccaaggcgtcctcatcaaaggaacatttttaccattctgtggcttgcgttggcgatgttttgccgaacgttgatgaccatcctccgccacagcttaagaaaatt

SEQ ID NO: 91507 - DNA, 522 bp, Heterodera glycines
  SCN-specific regions: Sequence locations=1-54,76-123,145-267,291-522
tggacaaaatgctaaaccaaaaggacaatttcacattgaaggagcttacaaatcagacagatgaagagaaacagctttttcagctcatcaatgaagacaaaattgaggaagcagaggaattggttaagagtggcaaagtgcgtgtgaattcgctggacaacagcgggatgaacgcgttggaccacgcgtgtttcaagggcaacgaagcgttggtcgagtttttgcttggaaatgggtcggactcggacaactcgagcgcactcggacggatacacggcactgatgttcgcagcactcgcaggtaacggccgaatatgtcaactattgttggatgctggggcaaatgcgcatgcgcagaacaacattggcaaaacagcagccgaactcgcagcttttgtagggcaacacgaatgcgtgagcatcatctccaattacatcagtttgcgcgacgtggacgcgattctgcatccccagggggcggacagtgccgtcctttacccgcctgagttggccaaattcatc

SEQ ID NO: 91508 - DNA, 287 bp, Heterodera glycines
  SCN-specific regions: Sequence locations=1-287
gaaagatgttaaaaaaatcagtcaccacatcctcctgcaccctcgacaccaaacatttttggtcgcccctgccgtgcaaggcattagcgatacgatcaaaagctgcacgctggtcggcattaaaacaacgtatctgcccgagcaccaattgaacaggagttcgttgtttatgctgttcaacaccaaagaaatcagcgagaagtcgagcttcactcagaaccgaggattgctgagcaaatgaatagttttatttcaacccatgtaaaccaatttgactaagaaataaa

SEQ ID NO: 91509 - DNA, 612 bp, Heterodera glycines
  SCN-specific regions: Sequence locations=1-612
atgcgtactgtagcaacaaataccgtatagccgcgccgcgcgtcagacactttgatttttctaccataccgtatctttaaacagccaaacttctctcgtctaccgtacctgcctgcgtctaccgtaataaatcgaattttaaaattaattttttgtttttcgacgccagttaacccaccaattctctgctaacactcgctgaacccaggccaaacatggccattgtcgtggccacgcttgacgctctgcgctccgccgcttcggctggcggccgctcgttaggcttgtcattgcccatggcattgctgcttctcacgctccttttttggcattggcaccgcgggcgccgggctcatcggcacacattccctccggggccaacgccactgccgttgatcgggaatttggcgcaagtaagtttgaaatggtctaagaggaggggggacaaaatgccaaaacgggagggagaggtgggacaaaatgccaaaaagggtgggacataaacaaagacaattctcggcaagcaaaaatgccaaaagcccatctgagaagtggtgtagagtttgacttatgttaggtctaattttaaagagttaaatttttgtagatcga

SEQ ID NO: 91510 - DNA, 394 bp, Heterodera glycines
  SCN-specific regions: Sequence locations=1-84,107-394
cctggagaacattcgccgaattgaccaattcgccagaaaagtgatcgaacattgcacccatgcggcactggtccatttcagcattgagcagaacaactggctgaagacggaggaggacggcccgctgttcatctacgaacggcttgaccaaccgctgaactcaatgattgttttttttcgacaggcgcccaaaaaatatgtggaacccatcacggacgggatgcagctgcgctaagaaccgccctacatttttgtgcaacgcgaagatggctgtattcgcggactttgggcgttcggcgaaaacaaatgcgaaccagtttttgacactccgacgaatgtgagcatggagctgaaaaagaaaagtgccggagccaccgccagcagccccaaaaac

SEQ ID NO: 91511 - DNA, 466 bp, Heterodera glycines
  SCN-specific regions: Sequence locations=1-404,427-466
tgtcgttgatcactccaaactcacaaaagcgacagttttgcacttggaagcgtcgactgtccacgtaaatgcattcgtagaaatgctttggttccaaatgcgacacgcaaatctccaattttaagtgtgtttgcctgtgccgtgttcccaaaatgccaaactcactgttccggtctgctttcggttttcttgctgatcggtgctaatccgattgatccccccgtgcagctttgagttctgcgactttccttcccttgcacaaatcaaatcgcaattcggccccataaaataatccaaacactgcacggaatattccaacttcagccttaagcaatcggaagctttaccctgacaactctctcaatgctttttcttacgtgctttgtgtgtcgtatcggcccacaaattcattttccaatgggaaagtcggctccattgagctggacgggacattgtcgccgagggg

SEQ ID NO: 91512 - DNA, 235 bp, Heterodera glycines
  SCN-specific regions: Sequence locations=1-235
atttgaagtgatccatcaattcctttccgatggctttgaattgaatcaaatccatgacgccgaacctaacatttcggatttccacccgattgccgacagtttgcaactttccaaccagccaaaaatgtgcctgccggaaagtgaaatagagcacacattcactggtgacctcatcgaactgatcggcacttctctctgctcaattagtctcgagcattggactgaagtcatacgc

SEQ ID NO: 91513 - DNA, 493 bp, Heterodera glycines
  SCN-specific regions: Sequence locations=1-214,236-459,482-493
attgactttgatatgtataaaaagcaaaaaaataattaaaaaatgaatttacatgtaggggacccgaacctagtgttttaaaaacgatgacaagcgcactaccgatataccaatggacaattcgcaaagaagcaaataattatttaatttgtttattcattaaaaaagtttggcacgtcataattcggcactcagactcatttcgcagaaaataaaaacatttttcttaagaacccatgggtgctctatccacccaccaaatttcatttggaaatcccacggacacctggggaccttcctttgtcaggaaaactactcctgaggtgcggaaatggcaaaaaaatgttttttgtaccggttgaaaattcgaaaaattgaacaaaatggggcacttctaaccttttaaaatggtcaaaaccggacaaatttgatatcattcgacagctattgatgagtaacgtttaaaaatcaaagaataaagtcaaaccgacac

SEQ ID NO: 91514 - DNA, 471 bp, Heterodera glycines
  SCN-specific regions: Sequence locations=1-471
gagagaactagtctctgggggtagcattcattttgaggtgctttgagtcataacggccgcttttcaaaaaactcattggggtcgtccgctttcggctaaatagtgcacctcggcaaaaggggcggcgtttgagcgacgattctctgggggtagcattcattttgaggtgctttgtttgagtcatacggccgcttttcaaaaaactcattggggtcgtccgctttcggctaaatagtgcacctcggaaaaaggggcggcgtttgagcgacgattctctgggggtagcattcattttgaggtgctttgagtcataacggccgcttttcaaaaaactcattggggtcgtccgctttcggctaaatagtgcacctcagcaaaaagggcggcgtttgagcgacgattctctgagggtagcattcattttgaggtgctttgagtcataacggccgcttttcaaaaaactcattgggg

SEQ ID NO: 91515 - DNA, 560 bp, Heterodera glycines
  SCN-specific regions: Sequence locations=1-351,373-373,396-560
gggcgagcagttcaccgtttcccagcaaaccaagacggatgctcagctgagtctgatggaaaccgcggtggacatcaaagtcgaaaatttcgacatttctgctgatggccgtcaactgtttaacaaagcctcgctcactatcgcaatcggaaggcgttatgggctggtcggacccaatggaatgggcaagacgacgctgctcaaacacatcgctgcccgcaaattggcaattccgccaaacattgacattttatattgtgaacaggagatcgaagctgacaaaacatcggccattgagacggtccttcgctcggacaaagtgcggacggaacttttggagcgcgaaaaggcattgataattcaattggaagcgggagacatttccgcggggggagaaactgcaagaagtgaccagcgaactgaagaacatcggcgctgaggcggcggagccgagggcacggcgaattttggccggacttggctttaacaaacaaatgcaggaaaaggcgggggaagacttttccggggggtggcgaatgcgcgtctctttggccagggcc

SEQ ID NO: 91516 - DNA, 636 bp, Heterodera glycines
  SCN-specific regions: Sequence locations=1-363,385-636
cccaattcaacacgaattacgcccattgtgacacgtaccccgaacaactttggatccccaggggggccacaacgcaaatactcattgcgtcatgcagatttcgaagccgcgctcgactgcccgtgctgacttatttctatgggaataacggagcagcgttgggcagatcgtcacagacattggccggtttcagtgcgcgatgtttggaggacgaaagtttgatggaggtgatcatggcgacgaatccgttcagcacacacctctatttgatcgacacccgaccgagggtaaacgcaatggtcaacaaagtgcagggcaaaggctttgaagacacgcgcaattacacgaacattcagttccattttttcgacattgagaacattcatgtgatgcgagcaagtctcaacaaactgctggaagcatgccaacggactcaaacaatgacccaatatttgaaaattgttgatgcttgcgggtggctgaggcatttgaaaacactgatcgactgcagtgtgtttatcgcagagtcaattttgcgcggaatctcttgtgatattcactgctcggatggatgggaccgcacttcacaaacagtttcattggcacaattggtcatcgaccctttctacagaacag

SEQ ID NO: 91517 - DNA, 434 bp, Heterodera glycines
  SCN-specific regions: Sequence locations=1-29,51-64,100-434
catggaccacgaatcgactaactgaagttcaagctgttcagcagcagcacccatcgacgactgttcatcatcagcatcatcatcgtcgtcgtcgtcgtccattttgccgctgggcatttcgcgcatcattaacggcaagtggttgttgtccggttcgcctgctgggagcgattcgcgcgccgggcaaggctcgccggatgagtcccagcgctgacttactgtagtagcaatgttttcattgttgttgtttttgttgttggcgatatgtgccagtgactgatggtgttcaacagcagtagaagatggttctgtgttacataaaatgttgggtatggtataataattatcgtaccttcttggaaaagattactgcgaatttttttaaaattgaaatttagcaacgaaatcacgcaacctcatttacaaatataaaa

SEQ ID NO: 91518 - DNA, 256 bp, Heterodera glycines
  SCN-specific regions: Sequence locations=1-256
aacatgtcagagttagttccatgcaagtgtcgcaatccatttttgagtgctcaccatgtcgcctcaatgccttgagtgtgcactcttggatcaacaaacacaatgtcctctagcgcttgcttgcgcaaacaaagtgaacttttttatttattcatcttattgaggaatgaaaatctcctaagttgaataaaattgtaaaatgtactttattcacaaatttttgatcggactcataaactctgattgtacttacaaa

SEQ ID NO: 91519 - DNA, 599 bp, Heterodera glycines
  SCN-specific regions: Sequence locations=1-238,260-599
gtcccatctgtcgtcggtcagcccaattcttccgtctccgcctctttggcctctttggtccacccgcccccccgttttcgctgctccttccacggcgaattctctccacacgccaaactctgccgctgtccgtttcccattttccacatgcattggcccgatgatgagtcattttgagatgatcggaacagataatcaaatgtttccgcaaaatgtgcgacttaatccgggcttggcgctctgctcttccgcccctttcggagggcacatcggcacatcgcttccctccgccgtcactgtctctcccgccgcagtcgcatcggtcggtggcggtgagctccaacagtttgcaattccgcgcatatcgcaacagtcgcaagctcagcccgtgcaggggttgcaatttgcattgggacagtcggcgatatttggcggagaatcggcgagagacggcggaggacagcaaacgcagcatttgttcgacctcagtaacagcataatatgcacaaatggcagttccatggccaacgcaagtgttatttcaatggcggcagcaatttccaaaggttctcttctctcgcagtgccaatctcagcaga

SEQ ID NO: 91520 - DNA, 643 bp, Heterodera glycines
  SCN-specific regions: Sequence locations=1-2,25-48,80-153,186-228,250- 537,566-606,628-643
caagagtgaaaataatttttaaatttgaaaaaaacagaatgtcaagggttaaaataatttttaaatttgaaaaaaaaatgcaaagggttgaaataatttttaaatttgaaaaaacagaatgccataatttaattttgaaaaaaacagaacgccaagattttaaatattttttaaacgagaaaatggggaaaacaaatgcaagaaattggccagaaataaatagggaaatttggcacaaaaatgtgcaaaaatttggcaagaaataaatagggaaatttggcacaaaaatgtgcaaaaattggcaaaagaaagggttaaaaattgtggcaaaagaatgccaaaaattggcaagaaataaatagggaaatttggcacaaaaatgtgcaaaattagcaaaataaagggttaaaaatttgggcataacaatgccaaaaattgacaagaaataaattgggaaataagggggcaaaacaatgccaaaaaattgcggcaaaatggcacaaaaaacggtgccatagtaataataatgccaatctggcacataaataataaatggcaaaaagtaatgggtaaatgggtaaacaaatgccaaagaaggaaaaaattaatgcataaataaatgataatggattattgattggct

SEQ ID NO: 91521 - DNA, 612 bp, Heterodera glycines
  SCN-specific regions: Sequence locations=1-2,24-50,72-92,114-456,479 -612
gttaaaatgaaaataagtgaagaaaccataagaaaacgactccaatcaattaatcaaacacaagaagcagttcaaacatgctcaaaatgggttttacataatcgtgaaatgattgacagaattgccacctgttggatggatatctacaaaaaggctcctgagaaattacgcatcgcactcatttatttgttgaatgatgttgtgcaaaaagcagcaagcaaaaaggataataatgtaactttggctttgcatccacactggataaacgcaactgcgatgtccaatgtaaatgtgaagaaggcgatctcgcggtgcgtggaagttttggaacaaaggaatgtttaccctgctcatatcatagaagaaatgaaagcggcattggttagtagaatagccactgagaaggacgattctcaaagtggggagatcgacttttcgcaaatggctcgtagcatcgacagtttcttcaaaaatgaagttctcaccgaaaaagctcgtgaaatactggccagaagttcttttaactttaaagaatcagtccaatctcgagtgaaagatagagaggaaggagtgaaagcacttgcggacatggatacatcccgacaaaaaatg

SEQ ID NO: 91522 - DNA, 633 bp, Heterodera glycines
  SCN-specific regions: Sequence locations=1-114,136-593,615-633
gtttgagataggtaaaccagctgttcattgtacgtttattgcctattatctagctccgcagcgacaatgtctaccataattcgaaaaaatgaacaaagagctaacgacaaaaatcctgggaagaaattagaatatgaagcgagtgtgtttatcctcagcgaagtatttggagagatctttgaccagcagaagggagtgcatctttttatgaatggtgtgctgtcaattgtggaaaagtccactggagttttcattgagtggaagccttgcgggacaacgcctctgaccgcattgcctgaccacgacgacaccgaatgggtgattgagggcgaagaggcgggcgaggaagagaacggcacgagaggaaagcaacaaaaaaacgcggacagtaatttaagacaaagcctttcgctcgacctcaactccattcgctcattcatccacggaaacttgaagaaagctcctatttggcttcgtttcatttgcaaagatgggactgagtcggacacttactatttccgaggcggtggttatgaatcgcttgtgaattgtttgcaaagatacgtttttcttactcgttcggccaagtcagacaatctcattttgatttcggacagtcgcaccgatgccttg

SEQ ID NO: 91523 - DNA, 642 bp, Heterodera glycines
  SCN-specific regions: Sequence locations=1-249,280-642
accaacagaaggcgagagtcgatggatcagcattggcctcgctctgtcaacgcccacctcaacaatcacgccagtcaccagcaacttcaacactcggtcggctcgccgtacatggtcgcctccatcccctccacgccctcctgctccgcattggtcggcccccattgtgccgttgtcgaacctttgacgccgtcggccatttcatccgcattcagtcacaacaatttggccacaaccgctgcacatcaccagcagcaacacaacaacagcaaccattatgcaagttgcaacagcaccaatgcaatgtcctcctccaatttgatggtggccgcttcgccctacacgcgttccgcttcctccgttatccattcgcatggcgcacggttcggctcggatcagccgcaaacccaacaactgcagcaacactgcatttaccacgctgacggcagcatgtacaacaactccaccttggttgagccgggcggtgtgcacggcctgcatccgttgtccacggcgacttcctcctcaacactggtggtgaacattaacaacaataatggcactgggaatgctgccgtgggagcgaacgcagccacaacgccgggcagtactccgaacacacagcggaagcagcaccgacgg

SEQ ID NO: 91524 - DNA, 593 bp, Heterodera glycines
  SCN-specific regions: Sequence locations=22-593
gctaaaccaacagagcttgaggagatttcgtctgatttgtccactgttcctacacaaatacatgtctccattcccgaaaatcttatgaattttgacggcactgaactaatcgaccttcccattgacaaatgcgtcattgtttaccattgtggaatttcttatggcattgaacctgaattgtggaaagcaaaaacaatggaaaaaattgatggggaccaaatcaaacaaactcaagaaatggacactaaacaattggaggattatgtcactgtttaccatcatggatggtacggtcgttttgaggatgaacaacaacaacaactaattgacgaagaggaggagcaaaaaagacaatttgacaaaagtgaaactgaccgaattgcattatcagtggagcagaaaaaagaacaattggctgccgttgaccacaaaaaaaaatcacatgaattgtctgataattctgttgaaccgatggaagacaaaatcgaagacggaattaaaacaattgatacatttgagaagaaaccagcagagaaagaagaacagactttgatcattgatcagcaaaaacggactgatgggagagtgacctt

SEQ ID NO: 91525 - DNA, 541 bp, Heterodera glycines
  SCN-specific regions: Sequence locations=1-541
tcagagaggaattgaagaagaataaggagatgaaaaagttctttgaaagtgtgccggacaagggaccaatcaatccgagggatgcttatgccgggggaagaacgatgccattttgtttgtacgcaaaggctaccgaagaaattgagatatcaatgtttgatatcattagtttgtatccctttgttaattatggtaaaaatctgcttaatttttgttaaagtttcctttcgcttaagatactccataccccgttggagtcccgaaaattgtagtgagcaggaattttaatgtgaattggacagtgcccgacgatattccttatgatggactgctgaaagtgaaggtcgtccccccgaaaaatcttttgtaccccctcctccccgtgcacatcgatgatatgctcctcttccccaattgttgggcttgtgcaaaaagggccaagaatgagtttgtgatgacaaaagatgtaaagaaatgtaaccaccgtccagcgcagagagcatttttgggaacgttcacttcgattgaactacggaaggct

SEQ ID NO: 91526 - DNA, 458 bp, Heterodera glycines
  SCN-specific regions: Sequence locations=1-458
gtcacactaaactcaaataacgaacactaatgtttatcaaaaacatgacacacataattgtgtcacactaaactcaaataacgaacactaatgtttatcaaaaacatgacacacataattgtgtcacactaaactcaaataacaaacactaatgtttatcaaaaacatgacacacataattgtgtcacactaaactcaaataacaaacactaatgtttatcaaaaacatgacacacataattgtgtcacttttaactcaaataacaaacactaatgttttatcaaagacatgacacacataattgtgtcacactaaactcaaataacgaacactaatgtttatcaaaaacatgacacacataattgtgtcacactaaactcaaataacaaacactaatgtttatcaaaaacatgacacacataattgtgtcacactaaactcaaataacaaacactaa

SEQ ID NO: 91527 - DNA, 635 bp, Heterodera glycines
  SCN-specific regions: Sequence locations=1-45,80-174,201-635
tgcgcgccacacagacgaacttgtaactcctggtacttcgcccattcccccaccgccacctcctccagctcctcggccttttcattcgcctccacttcctccacaaggcaaccgcaacttctcaccgccatgtcttcttccaccctctccgtcgggtactgtcaactttttgcacacgccgccgcctcctccgccccctcggcctgcaattcatcagcctcatacttctccaatgcctccacggatggcgccgccggacacaatgatgcgttttaatacgcctcgtcttgctccgatgtctcttcgtctggaaccgtggcaaatgttcccatctgctactccacggcaacggatgatggcgcctacggttccctctcatccacaaatccaaccaatgttaccagcaacaactggtggcaccatgtcacatttcagcaacaaggaattgttggaagataacagggttggttgctcgtcagcaggcggcggacgcggcggtggtgcgggtagtaaacgtaaagccggtgaattctttgaggaattaactacttctccaatgcctccacggatggcgccgccggacacaatgatgcgttttaatacgcctcgtcctgctccgatgtctcttcgtatgg

SEQ ID NO: 91528 - DNA, 626 bp, Heterodera glycines
  SCN-specific regions: Sequence locations=38-56,78-273,309-412,434 -503,526-626
ttttaaaatatactttatcataaaatataaatttaaagcttcataactttctcataagcaatttattaaatacaatttgggccatttaatagctcttacttagtttctcaattaacgcacaaattaaaaaaaatttcattacccctgaaaaattaaagtgataatattcataaatatctattactaaacgactcagcacggataaaaatcaacttttttctcaatcatccgttgggttacaaaacgaacacggctacattttcccttcaaaactaaaataaaaatgaataaataattaaaaattaaatccgaaaaaagaaattaaaaatgttatcttttttataatttcatttctcctcactgtttctgagaattttcaaatcggccaacgtcgcttctggccattggcacgcaatggcaacaatttgcacgaatttggcatgcatttcgatcacctattattgtacatttaaattttttagactttttatggggtttttaactaatgacaaaataaatatttgtgaattaaaaagatccaagccaaggagcatggaatttttatctctcaaatatttttgcccaatttccatcagtaaaaaagagcctacgtaatttggcgtgtc

SEQ ID NO: 91529 - DNA, 652 bp, Heterodera glycines
  SCN-specific regions: Sequence locations=1-297,320-507,529-652
aatacttcatcttcaacttctgctactgactcttcaccagacggagggaactatatcaaagaggaaatgctccagagagaggtcaaattattccagattatctcaaaaattctgactttatataagtcgactatgggcattactggataatcttggctccacccaaaaaaaaaaaattatcttcgtgttatgaaaagatcaacattatcttcaggttttttgtgagtgtcttggtggcgaacgtgtttcggtccgtgcttcgcttatgtttcagagccaaacctttgccaatatgtggaaggtttgtcatttgtcgcacatacagttaaacttttatgtggattttttctagtctttgaacgtggacaccaatgagttgcctgacgattttgtcttcccgatgacgagtgttgcagttccggtctttaaaaagattatcaattggatggagagtcacgtcggtgagtttaattaatgacaaaagtttgtataatgatgaattggaattgcaggacagcaagtgcctgagtttgaagaggtaatatttggcataagaggagtatctactgaccaaaaattttaggacccaaatactcgcgaacgcaaatggttcgtccagactgacttcgaaaaggaatttttcaaggttcgt

SEQ ID NO: 91530 - DNA, 617 bp, Heterodera glycines
  SCN-specific regions: Sequence locations=1-170,262-287,309-314,339-617
aaaactttcaaaatcctaccttgcaccgccgacatgcacagcgcctctcccggcagacaaatcaccggcgggaagtagccgccatgcactgttcgcacatgacgatcacaattcctttcgctgtttgtgccaaagagacagccaggcacgcttaatttgctaaaaagctgttttttaatatttttcataacatataatatttctttatacatttatttaatatatttttttttatttgataaaaaaattaattttaaaaaagtaccaattaaagcatactgtaatcatgaaaataaaaatgaattaatttttcaacataattttatttcattttttcatatgtatagtattaaatttgatgaccgaaagaaaacattgtcactgaaaaaatgcgttggtaaatcaatttttttaaaattttaacctaaattgacacaggaacacatttaaaataatccaattagtgattgttaaattttaatggattttcaaaattctatagttttcttttaaattgaatgtgacaaattcaaaagaagaattttccactgacgcattatccggtgcctttaaatttttcttacgggcaacgaaacagggaaccgcgctcgtccgcg

SEQ ID NO: 91531 - DNA, 557 bp, Heterodera glycines
  SCN-specific regions: Sequence locations=1-401,423-557
gtatataaagtagtaattttccgttatttgtaaccgtaaaaatgaacacttctacagcattcacagataaagacttgcaattaaaactgccttttggtatgataatttcgggtccctcatcatcgggaaaaagcacctttctcttaaaacttattgcggaatccaaagacttaattgatccatcaccggttgagattctctactgctttggtgaaatgagttctactgtcccggtgttgcaaaaggcaggcatatccgtgtatgctggagtcccaccagaagaatttattcgtagccaatcaaagccgcttctgctcatccttgacgatctgttgacgtctatagatgagaagtatctgtcagaattgttcaccaaaaagtctcatcatcagaactttgccgttatatttgtgactcaaaatttgttcgaacgaaaaataaaggttgctcgccaaaatgcccaatatgttgttcttatgcgttcaccgaattcaacccttgcagtacggaaccttggtgtgcaactgtttccccgacagttggactactttttggac

SEQ ID NO: 91532 - DNA, 610 bp, Heterodera glycines
  SCN-specific regions: Sequence locations=1-56,78-142,167-271,302 -308,338-397,420-610
ataaattaaatttgcatttatttagctttccaaaataagcatttattttatcattcatttatcaatgctcaataatatttttttgtgcatttattgcctttttcgcgcacttatcggagatttggcagaaaaaagcggcgaaaaatataataaaagtacaaatttatggccaatttctttgacgaaattcgcaaagtttgccttcttttttgactgctttacaaatgttactacgcataaaagtgcacattttttaaatacgccggggcggcaaaagtataaaaactaaaaataagcaaaatttgtggattttattttcaatttaaattattattttcgttaagcttttaatatgcggcatttcgctgcttcttccacagttttcggccttttctttgcttcgtttgctgtcgccacggaattcctcaacaataaggacaaaattttggatcttcccgggttggactttaagccaaactttgagcattattcgggtaattatggaaatgattaaacaaattatattaattgggtttttaggctatttgaaggtttctgaggagcatcagctcttttattggctggtcacctcgcagcgaaatgcgtcgga

SEQ ID NO: 91533 - DNA, 346 bp, Heterodera glycines
  SCN-specific regions: Sequence locations=1-246,268-346
tgacgaccaagcggaaatagtgcagaagatgggcaaggacgccatagactcatgccttatcctgccacagcccgacttacggcatttggaagacggacaaagtctgcgcactttgaccattgagtcgcgagacgaccccaaagtccaggagatttgccaattgatgttgtattggctgaacaatgagttggcagaggaacggattgtggtgcgcaatttgcaggaggacatttatgacggacaagtgatccaaaaactgactgacaagttggcacaagtcaagattgaagttccggaagtctcccaaagcgaagaaggccaaaagcaaaaatggcgcataattgtg

SEQ ID NO: 91534 - DNA, 422 bp, Heterodera glycines
  SCN-specific regions: Sequence locations=1-422
aacactgaaatactctaagcaaatggccaaatattcaacagaaatgcccaaatattcgacgcaaatagcaaaatattctacgggaatggccaattcgtggaaatgtcgttttccccggcattctctctctctctgctgctctccctcactttggaagtcttttgttcccggacgacgtccattcggcacttcgccagcagctgctccgcgtcttttccgaatatgtcacaataataaaatatcagatcgcgcgtcacaatcgcttgtttggtcgccgtgttgtacaattccaacgaaatttcttcctcggccttaataaatctcgcggactttgcaataatacagaaaaatggacattggacacattgaacagagttgggccaaacactttcgaaatattttccaacgaggccaaattgcgg

SEQ ID NO: 91535 - DNA, 148 bp, Heterodera glycines; identical to SEQ ID NO: 68167
  SCN-specific regions: Sequence locations=1-26,48-148

SEQ ID NO: 91536 - DNA, 635 bp, Heterodera glycines
  SCN-specific regions: Sequence locations=1-635
gtgcctatgctttcgagtttttcgaatttttagaaatcaattaaaattggtgcacttctgagcacacacccttcggagaatatcagtgaacaaaattttaagaaattcagaaatcgtaagtaattcaccagaatcaaaattttgaggcttaaaaaaaattcgaaaccggaattccgatgataaaaaaaagtcggaaaccaaaattctgacatgtccaacaaaatcggagattgcgctattctcatgccttataatttccgcggcgcaaaaaattttcagaaacccccctaaaaatgccagattcgtattcccagcagccataaaatatccatggccatcctcctccacctgttgatgaagtaatggcacaatggttggtccatgtcctggtatcgctcgttccaggacaggaacaccggggcattttcgtcggacaacagaaagcgcaggaagccgtccccggacattttgccctgcgcaatgtacgactcgtccgactcgtacttggcgatcagctgctgcacccgctcctggtcaaagtgggggaacaggatttcgttcagccgcgggtcgcgctgctcttcgttgagaaactggagcagccgctcgcgcgtcagatactccttttggcccga

SEQ ID NO: 91537 - DNA, 427 bp, Heterodera glycines
  SCN-specific regions: Sequence locations=1-55,77-427
attgggacctccaaggccaagcctcccaaactgattcggctgctgatcgatcgagtcggccccgtctctttgtttctccattttttggcattcgcatacgccgtttttgttatttctcattttggtacggagaaagcgaaaattcaagaaaacgcgctgctggctggacttgttgaggaaaattggaaggatacttcgaaattggaccattttctgagggatttgcgcaggaatgttggtgacaaaaatagtgaacttcgcgattacatcgttaatgctctggtcgaaatgggcgttgaagtggccaaacactcgttcagactgactccatcatcctttttgaataactcttccgtggataaagtgaatgtctatggaattgtccgttcctttcgtgccaacccggccgagtccattcttctcgctg

SEQ ID NO: 91538 - DNA, 436 bp, Heterodera glycines
  SCN-specific regions: Sequence locations=1-436
attcccttcggcccattgacattttcggttcgacttcttcgattttggaattgtccaattttcaaatggccaatgagagcgctccgtacgaatttattctgtcggtttcctttgaagatggtcattcgtataattcaacactaaaattatttgtacatgcatatccacaaattccagtgattgatgcgcaaaacttgacggttaatttacgtgctgattcggtgatgctcaaagctcatatttcgaatggttctgcggatgtgtttttgaattttacttggatgcaaacggatggtccgtcccgcgttgacttggcaaatcggcactcgctcagttcggcgtccatcgtcggcccattcaatgcctccggcatttactccttccgcgttaaggctgttaccattgcagaggatgttgtcgaagcgtccctttttgt

SEQ ID NO: 91539 - DNA, 641 bp, Heterodera glycines
  SCN-specific regions: Sequence locations=1-505,528-641
cattcgtcaacgaaacggaaaaacagaaaatcgcaaggggccgcgacacggaaatcgcaaaggcacagacgcacgtgccgtacagggaaattctctgctccggcgccgtttgggcagttttcttcggtggcattggcaatttcactgccatcaacctgctctaccagtttacgcccacttatttgtacaaggtacaaggctttgaagtggtcaagaccgggtttatggccgcccttccgccgcttggttctggcggtgatgaaagaatgtgccgggctgatcaatgatagaatccccgcgcggataatgagcgaaactgtcaaaaccaaactgttcaattccatcgccttcatgagtatgtccgctgtcattgtggccgtctctttcgtgccttccggctatggcaatctcgcgctgtttctgctcactttctcggcattcactctcggctttaacattggcggattttacaaaagcggctcgatgattgccgggccctattcgccttttgtaatgggccaaatttccaccgcaatgaccgtcacaatgctgactgtgccggtgattgtcaatccgttgaccataaataacacccgcgaagaatgggcattggcattttatgtgaacgccgccattatcgt

SEQ ID NO: 91540 - DNA, 590 bp, Heterodera glycines
  SCN-specific regions: Sequence locations=1-420,442-568
aagtttgagttctaacgaaagggcaactactgcaactccaattaaatcgttcagttccttttgactcggatgccgccgccccacgcggattcccccccccccccccatttttctgtgccgcttccgccgatcacttcgcttttgacccgtcttctccgaatgtcgcctttcggctttttctcttcgccctttttccctcttcgatccctcaaaatcggtccaattttttttgttgttgtttgttttttttcgcatcgttccaccacctgaaaggggacattcgtcgcctcattagccaatgccagggctaagaaaaatcgccatttcagtgaacgatgcggcgaacaacagtcaaagcttagtaaatacacaaacatcgaccagcaaagcaacggcagcatttgcttccgcctgcctccgtgaactcttccaatcccgaatgaaacgaatggcacacattttgggcagcatagaagcgctgctggtgtgcagaaacaaagcaacggagagacaattgttgtgcaagagggtgaggagcaaaggaaagtgatcggaaatgaaaatggcgaagggaaaaaagcaaaggaatg

SEQ ID NO: 91541 - DNA, 635 bp, Heterodera glycines
  SCN-specific regions: Sequence locations=1-75,98-133,155-635
cttttttgttctctgaaacggaagacggtgacttcgcttcattcaaattgcttttgttaaggaaacctttgttcgttgacatattgcaaaattttctggagcgattgttaaggaattggcctttggatgaaagttattgtttgttaattgaaatttggcaaacgttgatttaccacaaattgctcaaccgatgttctgacgaaaaatacaaattgtttgtccaaatgtcttcgcaatatttcgtggatcttattgagacacaaattcaacgaatgctcaccacagacccaaagaatttggtggagtcgccggtgctgagttatgccaaggaaaacattttccgctgtgagcccattttgggctttttttgagagacggaatttgccgaccattgattacctccgggcattgtgtcaaaaactcgaagattatcggaatggcattcagcgaaaattggaagcgactaatcgaagccgttaccgttccgttttggcttggttgctccaactgctcttctccttcgcttacaccgctccagtcaacatgcatttgctaagtgcacacattgccgacttacgcgagctcatcgtccaactttcacgtcgtccggattggatgcgcgattctgacctgca

SEQ ID NO: 91542 - DNA, 445 bp, Heterodera glycines
  SCN-specific regions: Sequence locations=1-11,33-445
cattcatctgctcccttcgccgactactgcccagcgcccaaaactgctccccaactaccgtactacctacggaggtgctgatttggcctcagcactcaattttgagttgccgccaagtgaagtggcgactcacaccctgtatttggcactgatggacacgccgactgagcatgacgcctgacttttggccgacgcgatgaagggattgggcaccaactaatacatgcttattgagattttggtgacccgcagcgatgcccaactgcgtgccgtcaacgcggcctaccagaagttgtactgtcatgggttggacaacgacctgtcggccgacaccaacggcagctattggactctgctgctcgacttggtcgaagcgaaccgtgatgagtcgtaccgtactgatctggacaaggcgaagacggatgccaataaactcttccaagcc

SEQ ID NO: 91543 - DNA, 593 bp, Heterodera glycines
  SCN-specific regions: Sequence locations=1-593
ggaaagtgcatctttcagcgaatagcacaaataattatgcactgctcttctatttggctttacaagacaaagcttcacattttgttttacaagaccagcagtaccgcaaatcgtcaaacaactttggctatggctttctcgacggatattctcatattcttggtcaattcgctatgaatatccaaggcgttttttcctccgaagctgtttcaaaaattgcttacaaaatgacaccgattttggatgtactattcgtcgatgaattgcttaaagtttcaattggacagactgaagggaagctcggactgcagttaacgcaaaacccagagatacctgacgaggaagcaaatttcgcagcgattcaatttgatttttcaaagaatatccatattgaattagaaatgcttgctgaaggcgatgctaaaattgcgaatttcgatcatatttttactcgaaaattggaaacgtttagcaacaaatttgatgaaatattcccgattgatcaccaggaaggctctgattcatttaatcgcttgggaaaaattgcattgtccaatttactcggaggaattggagtttggcacggatattcc

SEQ ID NO: 91544 - DNA, 561 bp, Heterodera glycines
  SCN-specific regions: Sequence locations=1-561
gtttctcgatgaccggcacatttccttctgagcccacttttgctgctgcctcctcaaatgccgttgttgacgatggtggcgagtcgcatcaaacggaacgaccgaccgaaactgaagacacttcggccgccttccttccccataacatttcgttacgttctgttatcgaacggtttggggaggaaaatgtgttgaaagaatggacggaggaagactgtgccggacttcttgtccaattgctcaaaaatttttgcgactacgaagtagcaaaacgaattgtgcgctgtttccgagaaacatcggttgacgagattaacgactgtttcaacctttgcaaagaattgaataaacgtgccgcgaatgagcgagttcgaatgggaaattgcgtgagttgtgcgccgctgccccaagagagtctgccgacttttccgaattggtcatcggtgttggcacaggcgaaaaaatcacagggaatccctgacgactcttccgctgtcgttgccaaaatgctctcagaaatttccgccaaatataatgatgccaatttcgcgcccgattccc

SEQ ID NO: 91545 - DNA, 497 bp, Heterodera glycines
  SCN-specific regions: Sequence locations=1-340,362-365,388-469,492-497
cgctcatcgttccgtcaggggaggacactgaaaaagccgcggagcaggggcagcactcgggtgcttggaatttggatggggaaattctgcttcagccatcggaccgaccattgcatttcagactccatccgggactgatccgatactttggacttgctgaggaggtcgagctggataagcggggcagttgctgctgttgctgatcacttcccaattctcattgtcgtgccgatgttcaagtgattttatggccattcgtccgttttccccctttttcttctcttttgtcactttgcattgtttttacctttcaattttcacaatgcatttacatatttaccttttctcatttgtgtaaaacattgtctctttttcatctttcatcgtatttttccctttttctatcgtccaaagtgcgcttattcctttgccattgtccctcactttttgcccctttagtttctttccctcattctttggttgctgggcttaaacac

SEQ ID NO: 91546 - DNA, 558 bp, Heterodera glycines
  SCN-specific regions: Sequence locations=1-15,38-308,339-558
ctttgtgctgtctgcgctgcttttgctgctgctcaacctgggcgtccgacgtgagggtgaactgtccgcctattccgtgttcaaccccaactgtgaacggttgccgggccaattgactggcgaacactttgagcgggacatgctttttgccaggaggcagtaatcgatcgaacaccgacgggttctaaccccctccccccccccctaagttaagccattttttgggtgggcctgtgatttttgtactgttgtatcaaatattatatatttagaaatgacaaagaagtgaagcaaagaataccaaaagcaaaatttaatttctttttaaatttatatttcgtttgtttttttagtcgattcataggagatgttctcgttttattgtaaaggtattttttgtacagaattttctgaaaatttccaaaaataaaaaccttaaataagtacaaaaaatagacatctaacatcgaagaagctccaacccaagtggaaagtgcttttttcctgtttatctcgattattaaaaatgctcaaaatttgcagttctttaaaaaagcg

SEQ ID NO: 91547 - DNA, 553 bp, Heterodera glycines
  SCN-specific regions: Sequence locations=1-45,85-103,125-194,219-553
cttcttcggcgtgtgcctgtccaccgtggccacggttatcgctgtgctttccgtgccgttcgcctaccagcacttccaacagatcggcgcccaaatgcagaacgaagtggacttctgcaaaatgcgccccggacccgagggacagaacggccaacccggtattttcggcaccacccgcgtctcctggccgccccgggccccagggacctcctggacccgatggacagcccggcaaccccggagagtctggccaacccggccagcccggcaaactcacccagggcccgcccgtcgtcggaccgcctggcccatcaggaccccctggccagcccggacagcccggcgagaacggacagcccggccagcctggaaaccccggcccgcaaggataccctggcgacggcggaagccccggccaacccggcaaccccggaggcagcggcgagcccggacagcccggagcacagggatccagcggccaatgctaccactgcccaccgccccgcaccgcccccggctactgagtgtgatcagtcgaccatcgacaattgga

SEQ ID NO: 91548 - DNA, 190 bp, Heterodera glycines
  SCN-specific regions: Sequence locations=1-18,40-190
gtgctctctggtgactatcggcggcccagtcctgcctctggactctctgtactcgtggatgagcctgatgagctggaaaatgagccactccgttgaggccttccgcatcaacccctcctcggactggactgcattggtggacgtgcaactggtcgtcaccccgcggtcgaatccacgggaaaactccttc

SEQ ID NO: 91549 - DNA, 580 bp, Heterodera glycines
  SCN-specific regions: Sequence locations=1-335,357-481,503-507,531-580
gaagacggagggcaaagcgacaaagaaaggacggctgcagaagaggcggacgacaccttatgacatttgggaggacgaaggcgaacaaatcactgccaccactaaatgcaaacgcgtgaaatacgtgccgaatttgctcccggctgtggtgccacctcccgagggaatgtcttacaatccgccgattgacagttatttgagaatggccgtgataattgcgaacgaagaaaggcaaattgaaaagaaacggcggcggacagagcgaaggattggcattggcactgacgaagtggcgactttgccggctttgcgggaagaagtgacatattccgtcagaggaggaggaggagtgactgtgagaatggaagaggaaaaagtgaaggacgaaatggcggggggagaggatgaaaaagtcagtcccaatgagttgcgacttcaaaagcgaaaaaccgcaaaagaaaagaaacggcgaaagttgcgaatggaggaagagagaaagaaaacggcggaaaaggaagtggagggaaagatgagaagacaattggacagtttgaagtctctcaaggcgcaagtgcttaag

SEQ ID NO: 91550 - DNA, 590 bp, Heterodera glycines
  SCN-specific regions: Sequence locations=1-590
gcggactgagcacgaactacgccatcaaagatatggtcgacaaattccgtgagactgtccaatttgtggacgatggcgcgccttcattcttgcgattgggagcctcaaaaatggcgaagaaagagcagcaaagacattgccacgcctgtgccaagaaagtgccggacagcgaactgttcatttgcaaagactgcaataagccaaccaaaaagcagttcatctgtgccctctgtgttgttcgttcgcatatttcaacacactgtggtgacattggactgtttggccagtgagcgcgaccgcgagttggccgcactgcgcattgaagagattctgaatcatgctcaacggatggttgacgaatcgcgaggcatgcaaaacgacattgccaagcagtttgagacgatgcgcgagaatctgttggccaaactgagctttttctacgccttgcaaaacgagtgcctgaacggtgaacaaattttgctgaaagagcacattgaagagaaagtgtactctgccattcacaagtgcgaacagcttaatgagcattttttgcgactgcgcgagctcaaatcggagtttgaacagcattt

SEQ ID NO: 91551 - DNA, 348 bp, Heterodera glycines
  misc_feature (322)..(322): n is a, c, g, or t
  SCN-specific regions: Sequence locations=1-320
ccatttgcttttgggggacactgacgactgtttcctacggcatttgtgccgcacttttcctctggcaattcttcactcggtttcgccacaatgtgcttttgtccgaacatacttccgctggtttctcatcggagggatgcgtccggttgggcttttccttttggcttttgataagcgcagttttggcacaattcgcctcttgcgttttgctattttgggcattaaaggggagatttaagcaaacgaatgaagaacaaaaatcgaaagagcaagacaccgttttcctttattaacgaaaaatataaaacagaaaaccgagtanaaaaaaaaaaaaaaaaaaaaaaaaaa

SEQ ID NO: 91552 - DNA, 560 bp, Heterodera glycines
  SCN-specific regions: Sequence locations=1-560
cggcctctgttctggaaaggcgctctctcctggaaatgtacgccgactttttcgcccatccagacgaattggtcagcgcggcttacgaaaccacacctgagaaaagattccttgccgtcctgaagtactatctgaactccttcttcccggctcgcaaaagtggcgtcgccaagaagccgtacaatctttattttgggcgagacatttcgctgccgctggacgctgccggacgtgcctttgaacacggagcaaactacccgcggaccgttcccgggctctgccagcaatcagttgacattcatcgcggagcaagtcggccatcacccgcccatctctgccttctacgctgaacatccggcctctggcgtctgctgcacttcgtacatttacaccgagtcgtacgtcgccggcttttcttcccttggcgtccgtaacatcgggagagcgactgtggtactaggaaatcacaatgagacttacaccgccactttccctgacgccgtcgcacgaaactgtcacgccactccgtggttcgaactcaccggcaaagtgaaagttcg

SEQ ID NO: 91553 - DNA, 516 bp, Heterodera glycines
  SCN-specific regions: Sequence locations=1-396,418-516
catcgaagtgacgaccaaatggaggtgtggccaactttccatttgctgacggattacgtgccggagtacggtaaagtgcgggtggagggcggagtacggtacaagctggtgttcgacaactccggtggcactttcttcagtcgagaagtgaaatacgggcttagagtgaagaaggttgaggagagtgaggaggaggagagagagcacggagcaaaagaagcagagaaaacgaacggagtgacttcatggggagaagagagacaaagcgtggccagagacaccgaggaagagaaagagaacacgatcagagatggagagggaaaagcgaaaaattaatgggaagacaagcagagacgacagcagcagattctttcccttccctaccgtaacccatcaacacacatacagtaactatttatacgcaaaattttatacagaaattaagccacttttacatgttgtgatatttgaatatcagtccgtgattggccgaataaagcttctctccgttttcaa

SEQ ID NO: 91554 - DNA, 172 bp, Heterodera glycines
  SCN-specific regions: Sequence locations=1-172
agttgtctcacgcccaattcctggcccgaagggaccgcccggagcgcctggccagaacggaaaccccggaaagcaaagtcagccaggacagccaggaggccaaggaccgccccggaccttctggcgcgcccgggctagcccggccagcctggaaaactctggccagcctgga

SEQ ID NO: 91555 - DNA, 536 bp, Heterodera glycines
  SCN-specific regions: Sequence locations=1-536
ttatggcaaagttcgagatggaatacaaaaaaggccttgacccagtgaccgctccgacagcttgcgtcaaaatgcttccgacgtacatccgcgcgattgctgttggcgaagaaaagggcgaattcctggcactggacctcggcggaaccaattttcgtgtccgacatcgaagggtttatgcacagcaccgacgggaacccattcgccaaagtcggcgagatgctgcgtgccattggcatttcgaactcatcggccgccgactgtgcaaatgtcgcctacgtcagctcgttgattggcacgcgcgccgcccatctctgtgcctgtgggcttgccgccatcctcaaccgcatgcagaggccccgcgtgacgatcggcgtcgacggctccgtgttccgcttccacccgaccttcaaattcaacctggaccagaagatcaaggcgctgttggccgtcaaatgcgaattcttcatggtgctcagcgaggacggaagtggacgaggcgcagcagtcgcagcagcggtcgcattgcggatgaa

SEQ ID NO: 91556 - DNA, 554 bp, Heterodera glycines
  SCN-specific regions: Sequence locations=1-554
agaaattcattcactcagtccatcacaattccgtcttctccgactgttccattctcaaaagcgtcgtaccataacgtcacacacatcataaccctcatgaccactccagcaaacgcggcgagggcccggattgccaaggcgaagctgcgcgatgccaagcggaggagggcggcagttggacgcgcaggatacacaagaaaagcgcagcgggcgagcgatgtgccatttgtatgaccaacgtgagcttcttcacgcggacgacgctcggctgcacccatccgttccatcgccgctgcttgtatcgctggatccgctaccacaccaattgccccgtgtgccgctacaacttcgcccgcaccattccgcgcggtgagcgtaaccaaccgctgtaagatgccatgtgttgtgatcgccgtacgatgtcatttgtgtgatcatatttgtatcccattgttcggttatgcgtatgtatttgtacaatggaatgtatgttcttatatgtactctgtatgtacagtatgtataatactcgtcagtaaaatactctccttgtt

SEQ ID NO: 91557 - DNA, 560 bp, Heterodera glycines
  SCN-specific regions: Sequence locations=1-560
attttctaacgcaataattctgcaattattcttccctttgtgacatctttcggaactcggccaaaattgtgctaattgcgaaaaatgaacagacgttggatttgcaacgacgtttggatggacattttcccatcctttgaccgtgcccaactcggcctcaaattggcacttctttcgccacgtttcaatgcgttggtggacaaacatttcgatggcaaaagcgaattgacaatttggagatcaatctttattagcaaggacaaaggaccagaaccgaagctgtctgtacgaatcgatgacaaatttgtgccatttccattcccagacgaccgtccgctgcccagcaaaatccgttttaaagaccttcggattgattacatcgatcactccgtcatcgcttttcttcgttcaaatcaccaaattttcgacaaaagaggcatcaatttatatttgtggattccatcaccacacaacacggatggccaaccaatttgggacatttttggtcgtgaaatttggccaattttttcggcaaacattcgctgtttgggctttaccgg

SEQ ID NO: 91558 - DNA, 584 bp, Heterodera glycines
  SCN-specific regions: Sequence locations=1-48,70-584
aagaaattgcataaatccagaacaaattcaaattcttccggttcatcgtctcctaatgtttctgtgaatggttcatcacgagaagcttgttcagcaatgcaatttatgtcgagcttaaatcaaaatggacaacaaaatttgagtgtgtctccccaatctccaattatgaatattgctgagctgagggtgcgtttgagggaggacagtgttctcgattttctgcacattatttgggctccacggaaatttcgaatgtcgaaggcaccgaagactgccggagggcaatgcaatcggccaaaaatcgcgtacgccaaatggctgatgtcccatgggttgtgctggaaatatctgttactggcataaacattcgagaaaatgataacaaattgttctatcgacatccaatcgcaaatattcaggtggtgtgccaggatgaagttgacctgaactgttttgcctacatttaccaagagggagatcgccatttttgttatgtcttctgtgtactcactgcgataattgccaaggaaatcattgtgacacttggcgaaactttcaatttggcctaacaaatcgcaattcag

SEQ ID NO: 91559 - DNA, 634 bp, Heterodera glycines
  SCN-specific regions: Sequence locations=1-28,50-82,119-243,266-634
gagggagagaatttccgttccatttaataatttaataaacccaaaatgtcttcatcaactgctgaactgaatccggaagatggtggtcatccgccacagaacaccgccgtggccatcgagcagtcgcaacaggccatccatccgccggcacaaagcggaagcggcaaaattgccgcgtgggcatcgccgaacgcggacgacacggagccgtacggaatttgcgcaaagattctgatcgttctgttttacatcatcacaatcatcacttttccgatctccgtgttcatgtgtattaaaattgtccaacaatatgaacgagcggtgggtaatatccaaaacccattagggaaccgggggagagcaattatcagtcattagtgttgggctcgtgaatatctctggctacctttatgttacagttttatttattccgtttttctgaattttacccctttcccctaataagtgcgttggagactgtcggtctcgagcctgaactcgagaaaagtctcggtcctttgggatctcgatctcgtatcgagtctcgggaaatttcggtctcgaacagcacaactttcatttcccatatactcactccccctcacccaccgcaaaattcgattttccaggaatt

SEQ ID NO: 91560 - DNA, 649 bp, Heterodera glycines
  SCN-specific regions: Sequence locations=1-23,45-649
gcaattttaaacggcctggatttaattaattttcatttttaaggtgatcgccaatccgaaaacacttggccaatgcgccggtaaaattcaaaaatatttaaaatccgaatttgcatcaattacaccgtcagtttccttcgtttgttcagacacgcatttgggcgaaatttgggtgtccagcgggcacaatgccagcgggttcttttcactgttcagtgaagaggcgcatttgcaaacgaatcatttcaacgccaaactgaagacgggtgacaccaacacggcattcgcacgcaccggctatttgggcttcttacggcaaacgcaagcgatcacagcggacggaggtgggcgaagggagagaacgacggggaggggagcaaaaggaatggcaaatgacatgagacatttaaggcgaaacaatatttgaaaattcgcatttttggatcgaaaaatgaaaaataccgtcgattccaagtgtgtttttagcatgctctttcgatttttttctaaatccaatgcttcccttttttcacattatcagaattacacgacgcaatctttgtggtcggtgctttggaggaagcgctgatgctgcgcggaatgcgcttccatccggtggacattgaactcagtgtttctcgggcacacc

SEQ ID NO: 91561 - DNA, 559 bp, Heterodera glycines
  SCN-specific regions: Sequence locations=1-355,379-559
gcgagttggactcgttggcgagcagatcgcccgcgggcgcgacttcgacctatcagccgcatccaatcggcggaatggggggcacgaggaactacgaatatgaaagtgctgccggtgtcgtcggcacttccgctgcgtctggtgcagcggtgacgcaccaatggccggacgatctgatcgaaattgtgcacgagccaatgggccatacattggacagaatgcgacgcttcagcacttccctctccaacgtggaggggcgcgagggggcagcagccgaatcggaaaaagtggaggagaaataccgacgcacgtacagagaggaatattcgggcaatggagctgaacgacgatgactgaacagaaaaagaaggaaagaaaacggagagagaacacagcacgagcagttgaagcagtacggcacccaaacccatccaatcgctgggtctcttttttcctcaccgatcgatctattttcttcgttactgcctttcatttgcttcacttttctattctgatcaggtcgttccctcctcctggatcattcccacccccccccctt

SEQ ID NO: 91562 - DNA, 341 bp, Heterodera glycines
  SCN-specific regions: Sequence locations=1-171,194-230,252-341
atcctttaaggcggacgatggcgcaaaactcatcgaccaaagcgaaaatcgttgtcaccgattcgacggtttcggtgaaaaaattggccgaattcggcgacgtttgccaattttcgggcaatggtcaaatgccgagggaaatgcttttgagagaattggccgacgcggaggcacttttttgtttgttgagggacaaaatcgacgacgaattgttggcacgagcaccaaaattttttgttttgagcacaatgagtgtcggatatgagcacattgatttttaagcatgcacaaaacgggggattcgcattggatacacgccaggtgttttgacggatgcgaca

SEQ ID NO: 91563 - DNA, 343 bp, Heterodera glycines
  SCN-specific regions: Sequence locations=1-6,42-204,229-343
aaaaacataaaatattaaaaactgaaaaaataattaaattagattcgaataaaaatatcatctgctactgttagtccctttcaacgccaattgttcccgagtcaattcgttggacagaacaaagggcacaacggcgttatcaaaggtcaaaatccaaatggcaaaaatgaaattggcgggagatgaagccgaggcaaaagcctaaaatttggaaaaaattggtttaagaaagaatagtaaattacaaataaatgacacttttcggtttagacggctctgatgggacccaatgaaaaaacaagttgggagcaagggcgtaggcagggggggggggctgaggggg

SEQ ID NO: 91564 - DNA, 531 bp, Heterodera glycines
  SCN-specific regions: Sequence locations=1-220,242-402,426-469,493 -498,520-531
ctgcttgcccggttccgccttctctctgcccaattggttccgtttggtgttggctttccccgaagaaacgacgagggaagcgtgcgagcggatagccgccttctgcacacggcacatgcgcccgtgcaggaaacaattggcactatgggggagtcaactggacgaggaggacggccgagggtcggaaggggcggaacggaccgcagctgaagagagtacgagtggtgaggaggaggaagacggccatattctaagcgagcgatcagccgaatgatcaatcgatcggccgatcaaagcgtgccgaaatgcggcacgggcacacattcccatccaaccgaaaagcaaatctcaaacagtcgctaccgtcgcgtcatttatcctttttgattgtttatttttttctcttattaatttatataatttctaaacaaattactttgcttttatgcattctttcctatttttatccatttgattttgattctctttataacccaatgttatttttgtgcaaataaatcctctcatttt

SEQ ID NO: 91565 - DNA, 513 bp, Heterodera glycines
  SCN-specific regions: Sequence locations=1-289,319-513
actactactgttcaccaaattttgttgatcattttttgcgcaatcaacaacataaaacaatgatgatgatgagctctgctgctatgctttttgtgatgatcactttggcattgatcagctttggctgttcaatcggagctgtcaaatcggagggcgacgacgagtcgggcgcagtgcgccacagccatgaattgatcagtcgtattaaacgctacggctattggtacaacagctacggatatggcggaggctgcgcatgtgcccccgtgccggtgacgtcatcatgctacagctgtggcagcggcggcggcggctatggctattcttcgtaccaacctgtgccaccaccaccgcctcccatgcagccatcgtattcctcttgcgcaacatgtggcggtgggtacggcgggtacggtggcggcttgtcaggctacagtagcagctggaacaacggtgggagcgcgtccagctcatggaataactacggcagctcctcttccatgtcagttggca

SEQ ID NO: 91566 - DNA, 173 bp, Heterodera glycines
  SCN-specific regions: Sequence locations=1-46,69-69,93-173
agcggtggtggaggtgaagcggctgcaccagcaccggaagccgcaccggcggcagaagcggcggcgcccgcaccagcggagcaacccgcggccgaacaacccgctccggcgcctgctgctgagccagctaagcaacaggcatccggttaccgacgaaagcgcaaccagaacag

SEQ ID NO: 91567 - DNA, 607 bp, Heterodera glycines
  SCN-specific regions: Sequence locations=1-83,105-582,604-607
aattcccagcttcgttcccgttttatccgccaacaatgactttcctcaccgacattcttcatccgaacattgacacgagtggcaaagtctgcatcagcattcttcatccgcctggcattgatccactgggctatgagcaggcggccgagcgttggaatcgcaaccgaaccgtggagtccattttggtgtccattcaactgctgttggtggagccaaacttcaacagtccggccaatgtggatgctgccgttttgttccgcagcgatccggcacgatacagggaggaagtgcgtcgacgtgtggagatggagatagcgaggacggcaccaatactaccgggagcgcaaccgccgccggaagagcaggggacgcaaccgccggaagaacaggggacgacgcaagcggcagaagaacagagggcgcaaccgccggaagaacaggggacgcaaccgccggaacagcaagggacgacgcaaccgctggaacagcaagtgacgacgcaagcggtggaagaacaggggacgcaacagccagcgacaccgccgcctgaagggccgcagcaacaaacggacgaatggtacatgtgatgtgatgtgatgccctctga

SEQ ID NO: 91568 - DNA, 631 bp, Heterodera glycines
  SCN-specific regions: Sequence locations=1-631
caaaaatgctttcttcttccgcctgctgtactctgttggccgccctcatttcggcggcgtttttcgccatggcaaacgcacaaacggtgaagcagtgcctgtgctccgaaattcagccctgttccgaaaagtacatgaacacatggaagacatgtatgcagcagtgtaagggccatttttccagcgtgggcggcgacgtggaaaaattgggccactgtttggacagcaaccaggcactgctccagtctatcatcagatgcacccaatcgcatggggacgagtcgtaagtttgacgagtcgggcaaattaatgcaatgccatgggggctactgtagtcaaaattacggtcggcaattccattctaattagattattttatgccaatgacccgatttaattggaactctttgattaaccaattaacggggttggggaaatcattaaatgccattgggactactgtgatcaaaaatacgatttgaaattccgttccaactggtcattttatgccagtttggtgtcccgatttaattgggactctttacaattagtgggaggtcccgctctttttgggattgatcagtatttgagtagtgtggaaggggaaataatttggaaattaattgaaatg

SEQ ID NO: 91569 - DNA, 214 bp, Heterodera glycines
  SCN-specific regions: Sequence locations=1-214
gcaagagacggatgagcaccgtcagatgcgccgtgtcactttcgaagcggacgttgtttcgacgggagctgtgaatgcttccgtcgctactttgacaatgctttacaattacggccagaccttttttatttgtctgatggctgagacggattactgcaaagcccgtgctcgtgacatgtggctggagatgacctccctccgaattggcaaggga

SEQ ID NO: 91570 - DNA, 591 bp, Heterodera glycines
  SCN-specific regions: Sequence locations=1-24,46-591
gtccaattaagttaacaacagatttttgctttttgacacacaaatcaattggaaaaagggaaaagcgtgctaattgaaccaccaaaatgaatcgacgttggatttgtggtgatgtgtggatggacattctgccatcttttgaccgtcctgaacttggtctcaaaatggcattgctttccgaccgtttcgatgttttggtggacacgcatttcgatggaaaaaacgaattgacaatttggagaacaatcaatattagcaaggacaaaggaccaaaagcaaaactattgggctattggatggattttccgatgccggaccgtccgttgcccaacaaaatccgctttaaagaccttcggattgagtacattgaccattccgtgatcaaatttctccgtgccaacaagcaaatttgggacagaaatggcatcaaattggaattgtctattgcaaatgtccagtacattttggatgtttttgttcgtgaaatttggccaatctttgcgacgaacattcgctatttgagctgccgatcagttggacaatttgcgtcgttgtattcaccgacaattctcaccgatctcaatcaattga

SEQ ID NO: 91571 - DNA, 568 bp, Heterodera glycines
  SCN-specific regions: Sequence locations=1-126,159-392,435-568
gccatcgctgatttgcgggaaggaggaggaagagacggagcaaatggccgagtcgaagtccgaattgggcgacgaattgtggacgggcatggaagggcctccggtgaaggaaatgaaactcgagacgaaggcggaggaggaagaggacgagttcgacgaacagtttctaaacgaatccaaaacaattccaatggacacagaaacactcactgccgcggattctctccgctcgcatttcggctcactgaccaaaggcaatcagtgccttttttattgcacttttgtaaatatttccgtctcttaggaattccaaaccgaatgcatcgttcgtctcttctcagtgcctgggaaccgccgacttcgtccgcatctattctcaaaaatcccgaacaacagcagccttcccttttgtcggacattacagaagtgttcagtgcacaacaaaatgtactcggtccatcgacttcaattgggaaaattacggaaatgactcacaatgttccgtcccaattcaacgcccaagttaccgttaaagagctcatctcccaatcatttggagagacaaaag

SEQ ID NO: 91572 - DNA, 640 bp, Heterodera glycines
  SCN-specific regions: Sequence locations=1-640
gaaattttaatattcatttaataatgtcaagtcacccaaagccattttgggcttctagtgcagaagcaagacaaaagcggaaggaatggcgccaggagcgggctcaaaaaggcggttcaacaccaaaaagtcctcgacaaaccacagaagctccatcaacaaccggagagggaacatcgaccgagacaatgccatcgacttcgaatgctgagccccgtaagtgcaaaaatcacaagcgcctacttctcttctcaaccgaaatccgatcgattggaacaccgttttcgatggatattgccgccctccttggcgaaattcgggagctccacgtttttggacgtgcggacctattgacaacagaacaaatcacagatttctcaaacaaatgtctcggcattcatggctatttcaagaaactttgggagacctatccaactgcatttgacacaaacaatgccgcaggattcatccccaaattgcattggtcgctcgcccatggtccagactttgccaagcgctggggatggttcgcatggatcagtgaacagggcatcgaacatttacaccacgttttgaacaagcagtctgagcgcttcttccggtacaagggcgacgaactgctgctgaagatcggagaaca

SEQ ID NO: 91573 - DNA, 631 bp, Heterodera glycines
  SCN-specific regions: Sequence locations=1-180,213-506,529-631
cccatttcgaagtgcacccgctgcaacatttttaaacggcctcgacaaacaagcaaattcttcaccaacacaccgatgaagagcgtcgtcagcccaactccgttccgccggcccctttcgctccgctgtgtgtgctcagtgctggtgctgctcatctgtgcgttcgatgtgtcactggcagcaaaagacaaggagaagaatggcaaagaagaaccaggaggcccatttaatacgctcagcatcattttgttgattccgctggtcatcgtcaccggcgcgttcgtctacctgttgtttatgaagccacagagcgaaggaaccggcgaggacgacggagaaggcgaaggagacgcggacgtggaaaagggaccaaccgaagagacgaaaacggagcctcgaattgaatctccagcaactcttttgggcgtgacagtgccgttggagcaagacgaagaagagcagaaaaaggacgacgagggtggcgaccaaaccgcggagaagaaagaagaggacgcggcggcagcggacgaacaaccgaaagaaggcgccgcggaggcagcggaagcggagaaaagtgcgacaaaggaggagacgaccgaggacacggaggagaccacggaaggatcgacca

SEQ ID NO: 91574 - DNA, 481 bp, Heterodera glycines
  SCN-specific regions: Sequence locations=1-481
actaatcagatttgacctatctgaacaacataacgacatccgggacggagctcttaaattaactaaacaagtggttgctcctcaagccgtggactatcaacaaacaatggcttccccctgtgacattatcaaacaagcgcatcacttgggactgatgaatccgacccttcccgcagaataaggtgggcctggttgatccaatttcgagaccgctctgatcgccgaggcattatcttaaggctgttcggccatccaattggccgttacggactcatcggttgcgtgaggtccgcttccttagcccggcatccaaactgaaaagcgtcagtacgccagcatgttggcaacttaaccactgattgccacggattgtgtgacccacccgcgggcatgctcgcacatgagcggaatgaaaacaaacggcgaactgacaagagataaatggatgctcaacggtagcaaggcctgtattaccggtggc

SEQ ID NO: 91575 - DNA, 646 bp, Heterodera glycines
  SCN-specific regions: Sequence locations=1-5,30-369,394-646
cgggcattaaatttttaataaaaaaaaatgggtattcatggccgagagtctcgacttcaactaaacaatccaaaacaaattttggaaaatttcagggcgtccaaacggcactgctccaattggccccaccattctccggcattatcactggcatcgccttcttcgtggtctccattttcagcattggcaacaaggttttgaccaagtggattgtgcagaatggcaccaaggatgagtgggcagtggtcttttatgtgtcagcagttgttgctgcactgccggttgtcgtcttctcaatgtggggaagtgatcagccccaactgtgggctcgctcatcatcaatgaaacggacacaaaacagcatcgcatcaacaatcacaacagcaacaacaatctcagtgaagcggaaagaatgcccagacacagcaaaaatatgatgctcaattagtgcgagtgtaattaattaatgattgctaagcccaaatttgaaatttcacacacactgccaattaacgggacaaaacgcttgtacaatacctatgtacaagtagtggaaatcgcatttaaatgtcaggcatttgaattatttaattatttgtattttcatatctttttaatgtattttttgcacattttgtttttctca

SEQ ID NO: 91576 - DNA, 229 bp, Heterodera glycines
  SCN-specific regions: Sequence locations=1-157,179-229
ggcgttccacttgttgctgctcggcctagatcccgatggacacacatgctcattgtgtcctggacagccactgcttaaggaagagtccgtttggatcgcgcccattgacgactcaacataaccaccgcctcgacgcgtcacagatacaatactcctgttaaacgccgactccaatttaaccttgaacagccacggacgctcaaaagctgcttgttttccaggaattctt

SEQ ID NO: 91577 - DNA, 478 bp, Heterodera glycines
  misc_feature (383)..(383): n is a, c, g, or t
  SCN-specific regions: Sequence locations=1-478
ccggcgcggcgccaccggtgcctggggatgatgatgaagtggaagaggaatgagcccgcatttgagcggccgctcgaagaatggcgggagcgccgcaaccaacacgcgcaaaacaatattcacccgcctccggcgccaccgcaggaggaggaggaggagcactgggcccagggtatttggccgctgctgttggtgtcgccactcttttgctcttcactatgcctgatgagcccgcttatgagcggccgctcgaggagtggagagagaggcacaaccaaaacatcgagaacaatattcacccgcctccggcgccaccgcaggaggaggaggaggagcactgggcccaggcatggcctgaggaggaggaggaggcggcgcccgangcggcgttgaaccgaggggatttctacctaatcggaggtgtccatgacccgatcagtcttcgttttgaggctgcgatttgcgcgagatgatgcgg

SEQ ID NO: 91578 - DNA, 140 bp, Heterodera glycines
  SCN-specific regions: Sequence locations=1-140
caaaaaatgcaatcatatcattacatttatcatatcggctaatacaaattccctttgcctaactatgcctcttgcttggacttctgtggacactcacaacgcacttttgtgcgccgcagttccttccattggcgccttcg

SEQ ID NO: 91579 - DNA, 628 bp, Heterodera glycines
  SCN-specific regions: Sequence locations=1-242,265-474,498-628
tgattcccagcagaaggggcggctgacgctgaaaattgaaaagttttccgatttttctcgcggcggagaatccggcactgaacgatacagcgatgccgtgaacatccgaggcttttcattcaaaattttggccaacacttacacaatgtctgctgacaagagcaagaaatgtttgggctttttcatcgaatgcaataaaaatgaaccgaattggtgctgtacatgttcagcaacgctgcaaattgttgtgcaaaagaaacagaaatgttcaccaccatacatcaaacagttcaaggacaacaatttcagcgccgaaaaggacgactggggtttcaaagaattcatttctatcgagcgattgctgaacccggccaatgggtggtacaatgaaaaggatgactcagtgattttggtggctgaagtgtttccgtattcgcctgcgtatccgcccagctggtctcagaagcggcaatggactgactgactgattgattgatccatttgtgcaattgttgcgattgatttaaatatttttatcgccaacaattttgacacttcttaaaatttccaatttgcatttttcacttgactgcgaatgtacatataattcaacgaatttattttgctg

SEQ ID NO: 91580 - DNA, 620 bp, Heterodera glycines
  SCN-specific regions: Sequence locations=1-21,43-51,73-147,169-620
gagatatggacccaacaagacaaaaaattaaccgccctaaagaagcttcaaggtctaatttgggaggaaggctatcgcaacgggtcgcttcagtctcatgttttccccgacgttcccaaggcatttcaaacactttccgaattgggcattcccattttcattttctcttcgggttctgtccatgctcaacggcttctcttttcacacacacaatttggagacattagtaaatttatctccggctatttcgacaccgaaaccgggccaaagctcgaaagtgattcgtaccgaaacattgcaaagcaaatcaattgtccggtggggaatgtgctcttcctgaccgatgtcgaaaaagaagccgtgtcagcagatgaagcgggtcttcaagtgcgattattcgtgcgcgaaggaaacgcccccctaagcgaggacgccgcaaaaaagttcaagactttggaaagtttccaaaatctattgagaattgattgagcaatcaccatctaaaatacacgctccgaaggcaaatgatgagttacaaaaattattcaccaaataaattattgggactaggtcgttttggcgccgaagttttggcgcgccagcccgagtttttggatcct

SEQ ID NO: 91581 - DNA, 648 bp, Heterodera glycines
  SCN-specific regions: Sequence locations=1-131,154-648
taagattttattttccatttgtgatgcgttatctgttgagaattaggaattataattttctcacaaagatcggcaaaagcagtgttgtccaatcgcaagaatcccctccatcgcttcttacggattcaaagccctttaaaaaagtgctcaattctgccgtccaatattacgaggaatgtattggcctggtagaagtccacaaagcccgcgacgaagtcaaccgatgcgaaaacaatttgtttttggcacaacaggcgagaagagaaaaacagggcgaaataaagtcattgcaaaaccgattgaaagacattcacagcgaattggacagaactcagcgaggcgaagacaggtatctccatctgctcacagaagaacacgcggcaatcaaaagtgagagggaattgctttcgtcctttgaacaattggaagccaatgaacgcgatgcatttaatttgctctccaataaagttcgcattagccacgaacgcgaaagggaacgagatgaacgtacgaagtactggtcgttgaccggctctttgctcggcgctttcctcggcattttcggcacgacaattgccaacgaactgaggatgaaacacattcgggaaatgattcctagtggccagcaaatccaacctttgctgaagg

SEQ ID NO: 91582 - DNA, 420 bp, Heterodera glycines
  misc_feature (414)..(415): n is a, c, g, or t
  SCN-specific regions: Sequence locations=1-327,354-420
gccattttatggactttgagtttggcggaggatccggcggaggcgactcgattgttcacaaaatttgtcccggcgtcgagcgaaaagtgttcgaaggctgatttcaatcgcaaagccatgcctactggtagaaagccccacacccaacagaaaggggccaaaattaaaggaaaacggcgctgtctttctgtctatcgctcatcccacttaataatttctcacaggtgcaacttcaccggcctcttcaacttctcaatgaactgcttcaaaaacccgagtgaatactcattacagagggatttgcagtgggtcagagtggactaacgaatgaagatgatgatgacgatgatgatcattgtgtctcaaagacattgtactaatgtaatttgtctatacaataaacgagaatattcnnaaaaa

SEQ ID NO: 91583 - DNA, 458 bp, Heterodera glycines
  SCN-specific regions: Sequence locations=1-458
atttctccgttttgcttgaaagttgagactttcctcagggcgaacgaaatcacttatgaagttattggcagttggaaccttcgaaatgctccgcaaaagcgctttccattcattgaattgaatggtgaacgaatttcggattcgcaaattattttgtggagattgtcggactatttcaaaattgaagatgggttgtttctacgaacaaagggcaaaagcacgtgcaattgaaagactaatcgaagggtcactttattattctctcattcgttttttatcctatgaaaatgcgactaaaatggtaaattcggaaattagcggtctccgattgccggcctttttgtctcgattcttggcaagacggttgactgaagcgacgcgaaaacgattgcttgctgaaagcaccctcctccacccgcgtgatattactttggagtcactctcacttgatttgcatg

SEQ ID NO: 91584 - DNA, 644 bp, Heterodera glycines
  SCN-specific regions: Sequence locations=1-418,441-644
tccaattaagttaatttggtaaaataaacatcttattaatatatttgttttgtataaaacattatggacatttctcgacttcgaaggatttgtgccatttacgcttccgatgggattaacggatatccattcagtttggcggtgattaagaaggcattggagtcaaaattaaatgtgtgctcattattgttccttcatctccggagggatctgcccgatactctcaaaaataacccaaaattcgtcgcgttggaatgttttggtttcgattcattagaggcaattcgcaaaagattggcaaaggaagacatttcgcgcgaatctttggtgttcatcgactcgcttcccgttctgatcgagcagttctcgctgccctccacctcgtggttcctcacccaaattgccgaactgtccgcctgcgttttggcattggttcacagctcagaatccgaagatgaccaaaacagcgaagattggcgacgaattgaatcaattgcatcgactgttttcgagcttagggcgagggataaacacacattgtgccgaacgaagaccaaaaaaaggaatggcaccgcagaagagaaacttgaacaattctccatcgaagaagactattccatcactttttctccatttgattattc

SEQ ID NO: 91585 - DNA, 547 bp, Heterodera glycines
  SCN-specific regions: Sequence locations=1-547
tgaacgaagcgcaaaattattggactgccgtcggtcacaaaaattttgtaattatggacagaaagccatttaaaaaaatggcgaatgggccaattgaaacaccaaaacagcagaaaaaaacgcagcagagaaaggctaataagtcggcatcggcacttccgtctaaatttgatgcgcgaaaacaatggccggaatgtgcggatttcattgggatggtaaatcatataggttataatgggaacggaggatgcgcttcggcttgggccatttccgctgcggcggtgctcaccgaccgaatttgcattgaacgactcaaaaagggcattcgctcgtacaccaatcacgcgtcgtccttcgcttccgcgcaagacattttggattcgcatttggacaataaatgttcctgttcgaccgaaatttcgactgcaattgtatggaaatggttcgccgagacgggcgtcgtcacaggcacaaattactcaatgggcttgggctgcaagccgtacatttatcccccacaaaagaattgcctgtgaaagccactggt

SEQ ID NO: 91586 - DNA, 370 bp, Heterodera glycines
  SCN-specific regions: Sequence locations=1-370
ggcaccgaacttggtctccgaccagccaaactgtacccctgatgcacctggtgacggaacaacttctgccactgcggtacaacctgccatcgcaaaagaaggcttcaagaacatctccacatgtgctaatccgtcgtacgtgcccaacgcaatgatgaactgaccgcactaattgtgctgggaactgcaggcaatgagcaagacagggacaactcccaaagaaatcactcacgtggacactattgcagcgacactagacgagaacaaccgaaaactgatctcggatgcgatgaacaaggacagaaacaagggtgtcatcaccgcgaaagacgtgaagaccctgttagaccagttgcagatgattgaaggt

SEQ ID NO: 91587 - DNA, 629 bp, Heterodera glycines
  SCN-specific regions: Sequence locations=1-9,31-264,286-629
gtccaattaagatttaaaatggctttaaaacctaacctgaagcctaagcctaggcctagcctaacccatgatactaattgcgtttgaaaattctcgtagatgtgaattgtctatgatccgaattgtcccatcagctgtaaaattctcctagggattatttcaccaattggtgcaacacttttgattatacgatgtcactgaaaattggattcatcggagcggggaaaatggcacaagcattggcgcgaggtttcatcaattcgggacgctatccggcagagcaattgatggcgagttgtccaaagacggaagttgcaacgattgagcaattcaaaaaaatgggcgtcaaaatgacggatgacaacacacaaattacccgtgagaatgaagtcatcattttgtcggtcaaaccgatgcaaatcggcaaagtgacgcccgaaattgcgccccatgtcaaacagagtcatttgctcatttcacttgccttagggattaggctcctctccatcgaacaatttttgccatcaaattcgcgagttgtccgcgcgatgccgaatactcccgccgttgtctgcgccggagtcagcgcttataccatgggctcggcgtgcagagatggcaactccaat

SEQ ID NO: 91588 - DNA, 637 bp, Heterodera glycines
  SCN-specific regions: Sequence locations=1-637
ctccgcattggccaacactttggccaaattggtgttgcgctacgctgagctcaacaagggtgtcccctcaactgttaataaattggcgagtggtgcgctgctgctcatcgcttcaatcattcatcttggcaagtcgggcttgtgcaaacagccgatcactgaggacgacttggaccgtttgtcgaccactgttcgactgattgttgaccaatggccgaaagcggtggatgtgtttttgagagagtgccgtgcttcgttggaaagcatgctcaaggccaagggggacgtggaccggcacgaacgcgacacaaaagcgccgaagaagaaaattgtgcagcccgacaagacaattatgttcacgcagctgtccacacgcgtgtcagaaaacgtgacggacacaaatttgtttgatctttcgctttcccaagcgcttggtactgcacccaaaacgaccaaatacacctttgccagctccaaactgggaaaagtgattcagttagccggcttttcggatcccgtctatgccgaggcgtacgtcaacgtcaaccaatatgacattgtattggacgtactcgtggtcaaccagactagcgacaccttgcaaaatttgtcattggaactctcaaccgttggcgac

SEQ ID NO: 91589 - DNA, 319 bp, Heterodera glycines
  SCN-specific regions: Sequence locations=1-94,116-319
cggactccccggtccgcccggaccccccggattctacgcgacgaacggacaacccggacagtcggcaccaccctcgtctcctggccgccccggaccccagggacctcctggacccgatggacagcccggcaaccccggagagtctgggcaaaccggtcagcccggcaaactcacccaaagaccgaccgtcgtcggaccgactggttcttcaagaacctctggtgagccaaggacttttttttataacggataggacggtcagtctggaaaccccggactgtgacgataccctggagaacctcgtaaccacggacaaccg

SEQ ID NO: 91590 - DNA, 653 bp, Heterodera glycines
  SCN-specific regions: Sequence locations=1-217,239-578,600-653
attttggagatcactcaagaaattgagcgaatgagaggccaaagggaccaaaaactggccaaaataaacgaattggagcgtaacaacaaagagttggcagttcaatgtgaacgcttcagccacgagaacctccagcaccaatcggaggtgcaacgtcagctggctcgagcgcatgaaatttcagaaattcgcgctgagattgtccaattgaacgaccaaattcagcagggagagaatgaaatacaaacgattgctattcgctcacagaatcaggagaaattggtggaagagaagcggccaagttgggaagagtcgtgcaaaaacattcaattggctcgcaatctcttcacggaactgttggtccgttacaacaaaggtagaagcgatgctggtgccctttatgaattgccgcccgacgcaaaagcatcaccctttggacacggcacttcgaatgcacaaccgaaacgaacattcggcacttcatttgatgacgacttcaaacccaacctttcaactgcagttgatgtgaatgtccaacaaaaacctgtagacaaaacatcagcagttggtgacatcgaagtgaaaaataatgaaattgttcaaaatggcaaccaattgagcaaagagagcgtttcaactgtaccatatgaaca

SEQ ID NO: 91591 - DNA, 489 bp, Heterodera glycines
  SCN-specific regions: Sequence locations=1-489
tttcctttagcctaaatgttttccaatttatcttttttttaatgacggaagcaacaaaaatttacaacagactcagtgcttttcaaaagtttcgcatcaatttgaactgccatttgcgtcgcgtccggtcgaattggttgtatcagctttcgacggcgctggtcttcgttaccgccttaaaccatgccagcatttacctcacttacgggcccgaccacccgcgatgcatgcaacaatggaaggaacggaaacagcgcggattgttaacggacgaattgctttggaaggagcggctgctgtacgcccgcaggcgtgagtttctcactgctgttgatggttacggcacagttgacaattggaaacacccgagggcgacgatgggagcgtcgactttgtccagcaaactgttttaggaagaaaagcaaacaatccaaccttcgtttaatgcaattattaaatcggattaactccaataaactttttgtttgt

SEQ ID NO: 91592 - DNA, 292 bp, Heterodera glycines
  misc_feature (2)..(2): n is a, c, g, or t
  SCN-specific regions: Sequence locations=1-66,90-159,186-292
gnaagagaatcacattggtctcgggattggctttgtgcgctctcagatggctatcatcgccacgggcgtcactctgccgtctctgtactgggagatgagcgaaatgaacagcaaagtgcgggatggagttgaggacttcggcgtcggcgccgactcggactggactgacttgatggacgtgcaagtggacgtgacgccgccgtcaaagccccgtgataaccccggcaactcgatcttttttttcgggcggcgactggacaggagctgccagtgggctgggccccggcaggcg

SEQ ID NO: 91593 - DNA, 379 bp, Heterodera glycines
  SCN-specific regions: Sequence locations=1-243,271-379
tctcgtggtgatccatcaactatacactcaaataaaccaaatgaacaaccttgagatggactgtgttcaagttttccgcgtaaacccgattccacgcgcactgatctgatggaagtgcacattggcgttgctccacatacccactcgccagacaatcccttcaactccattttcctacaccaaaagcaccagggattgccatcaccaatgcgtttgccaactgaatgcagcaatatggcctcatggtcctcctggaccccctgggccccccggaacacacgactatgccgacggcgtcgtgataccggaacatgccgcactatccgacaaacaaatatctccttgcactcccccccggtacacgtgtccaaaatgtgcc

SEQ ID NO: 91594 - DNA, 622 bp, Heterodera glycines
  SCN-specific regions: Sequence locations=1-225,279-622
gttcaataatgtgttcttcggccgatgagcaaatttcgcgccacgccatgttggccgacctcgaattgctgtgcaggaaccggtgcggcttctacggcacgccccagtgcgacgggttgtgctcacgctgttggcgcgactttcagctggagagcaagcggcaaaatgactaccaaaacaacatcaaagtgttgcgacagcaccagcagcacgcgacgggcccaagcggtgcgggcggcggaagtgcggtggcgccgtcgtcggcggcggcggtgacgcgcaaaggctccgacgcgcgcttcaactcgctgaagacgctgctgaagaagtcgccgtgcgtgttctccgccagcacttacgaccaatcgccgctcatcattttggggccgaggccaccgagtccggacactgtgaccgcccaggagcatctacaccaatttttagaggccaattttgcccacgtttatgccaaagagttggacaagcagtgccaagtgttcattgacaacttgttcaagagtgaatttttgccaagcgatgagctctctctgctcgtccaggcattttaccaatcgatccaagaaagtgccgtcaaatttgctgcgcaaatgccaccgcccgc

SEQ ID NO: 91595 - DNA, 622 bp, Heterodera glycines
  SCN-specific regions: Sequence locations=1-114,136-622
ctttccgtccactttgttggccaccaacgaaccgttcactcagccgcgccacatttgcgctacggatttccttaactatgagggccaaaagttcagcaaatctcgtggcattggcgtgttcggcgacgccgtggcttccattggcattcctccggacgttctgcgcttttatttgctttatattcgccccgaagggcaggatgcaacattcagttgggacgacttaacacagaaggtcaattccgaactgttggccaatattggcaattttattcaccgttccctcacttttctatccaaaaatttcgccggtgttcagccgtcggtcgtgccaacatcggctgagtattcgctgttcgctgctgtcgacgaggaaatggagcagtacacaaaggccatggaggaagtgcgcctgcgagaggcgctgaagcacattttggccatttcgcggaagggcaaccaatacatccaggcgggggagccgtgggcattggtcaaaggcacggccgaggaacggaaacgagccgagacaatcattggcgtctctgccaacctcagtgcgctgttgtccgtgctgctctatccgttcatgccctccattagcgcacagattcaacaccag

SEQ ID NO: 91596 - DNA, 641 bp, Heterodera glycines
  SCN-specific regions: Sequence locations=1-323,345-641
gtttgaggatcaaaaaaatcgaatggaacaagaggcattttacacggtgggggagttcgacagaagcaaaattgaccttaacaagccggcgatgactgtcgaagaatacatgcaacaggttgtcgttggccgtgagcttttgcccgacgtcgccgtcgcttctcccgaagtgctcaaacggttcagcgccactcccttaagaaagtctctcacaaatcttccgggcatttgcgatgactcacgaaccttcacctccaggttcgggccgaacaaggagtggtgtgtagcgaagagcaacgaattctctcagagcagatccgagtttgagtgcgtcaaagtgcctgatgatgaccccctcaaagacgtccaattgccccccatgaatgattggatgcgttggtgccaagtgtgtttcgagagccgattggagggattcgcaattgcgcctgagaatgagaaacgcttcgcccaccacaaaggcactccgccgacggtgtcactgatcacgagcctcaaagaccaccaagtgaacgagctgatcatccaccaaataaagtatatgctcaacaaaggccaaactcgcgcgactttgcagtggctttacgcattgcttttggtggtcaaaaagcctttgctgcccg

SEQ ID NO: 91597 - DNA, 163 bp, Heterodera glycines
  misc_feature (35)..(35): n is a, c, g, or t
  misc_feature (45)..(45): n is a, c, g, or t
  SCN-specific regions: Sequence locations=1-61,111-163
cgtcactctgccatctctgaattcggagatgagcnaaatgaacancgaagtgcgcgacggagttgaggccttccgcgtcaacaccgactcggcctggactgacttgatgggcctgtcagtgggcctggcgccgccgtcgaagcccccggataaaccattcaat

SEQ ID NO: 91598 - DNA, 466 bp, Heterodera glycines
  SCN-specific regions: Sequence locations=1-22,99-100,159-466
tgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccggacagcctggagcgaacggagttgtctcacgcccaattcctggcccgaagggaccgcccggagcgcctggccagaacggaaaccccggaagccaaggt

SEQ ID NO: 91599 - DNA, 280 bp, Heterodera glycines
  SCN-specific regions: Sequence locations=1-38,65-280
tgtctcgatgtgctctctgtcgactatcatcgcctacgtcgtcactctgccatctctgtactcgcagatcagcgacatgaacaggaaaaagcgcaaccgatttgaggccttccgtgcctacaccgactcaggctgcactgacttgacggacctgatggtggtcatgacgcccccgtctcagccccaagatcacccctacaactccctcttcccagccatcctttaactgcccggactgtgccagtgcgctggcctccgactcccgagctgtccccctggt

SEQ ID NO: 91600 - DNA, 593 bp, Heterodera glycines
  SCN-specific regions: Sequence locations=1-75,105-482,504-593
gtgccgttcaattgcgagcgaaggcgaacgatcccttagagaaggcgacgctgttaacggtatgtgtgcaggcttttatttgcaaaaatgaaaaacatgcatatatttgctccgaatggcgaattttgaaattcggtagtgccggtgggtcaatggcaaaaaaacaaaaattcggaaaattagatttagaagtttaatagaataagtgaacatttactgttcatgaaatggtgtatcatgggtaaaacaggttgatttttattcccattatgaaaacccagggagtaacagagcaagagattttttgttatactggcctgcgtccatcgatgatgacaaatggtcatgctaatcatgaaagggccttttcggaatggcccattaaccatgttggaaatgaaccgctctgagatggatagacggaataaccaacaggaagggtgtggcgacttttgggctgagggagataaagcaaccctcccaaaaaatttaaagaaaaattaccaattgcacaaaagatttaaggggggcgcaatccaacgccactgactggtcatgtatttaattaaatagcaattcagtcattttaaggc

SEQ ID NO: 91601 - DNA, 178 bp, Heterodera glycines
  SCN-specific regions: Sequence locations=1-178
tgctcgtttcgacactttgccaccgcatcagcgacgaaaaggggaccgaaggttgagccgtcgcgactgcccaatgggctctctgtggcgtcggtggaactgcagggcccaatttcccaattgatgtttgctttccgttccggtgcgcgctttgagcaacacgacgaagccgggctga

SEQ ID NO: 91602 - DNA, 645 bp, Heterodera glycines
  SCN-specific regions: Sequence locations=1-230,252-645
ggccaactccttcgggagtccgtccagcccggacaacgaacgccatctcgtcaacaccacgggcgccccatgccgaatttacaatgccatgccatgccaaacatttcgccacatttgccattcagaaaaatgagttgaagccgcgggcaaacaatcggcgctgaattgacaaagatgccgcttctctgttgctgctgatcgcattgctgtgctgtaccgtgcccgcaccggtggccgcaatccgtggcgcatttttccgttccgggcattcgtcggccgctttgtcttgtctaccgatgccagtaagccgttgtgccgctgtcgtcggcaacgaaaaggtcgccggtgtggtgccaccatttctgatcactgccgagcaaatgatcaacaacaaagaacaaccgccgggtggtggttgatcttcgccagttggcacagtgaaacgtgaactaacaatgctggcggatgcggcgaagcaaatgctggaggaaataaccgacaaaagtgaagaagccgctctcgaggaaatggaagaaaatacaggaaattctggcacaaagcccactgcacacattcgcttttccatcccggcactgtttgggacaccgtcacgcattttgtgacgccagtaagcgtgccgccggg

SEQ ID NO: 91603 - DNA, 334 bp, Heterodera glycines
  misc_feature (179)..(179): n is a, c, g, or t
  SCN-specific regions: Sequence locations=1-58,92-235,257-334
atgatgcaaatgaactgcaaactgcgttatggaggtgaggccttccgcgtcatcacctactcggcctggactgacttgatggacgtgcaagtggtctcgactccgccggcgaagtcccgtgataaccccttcaactccatcttccgtgccaaacgtcaactgcccggacactgctcagnactctggtctccaacaggcaagctgtccccctggtccgcccggcccgtccggaccgcctggacagcctggacagcctggaggcgcaggacagcccggacagcctggacagcctggccaacccgctcctccttggccgccccaaaacatcccctgc

SEQ ID NO: 91604 - DNA, 569 bp, Heterodera glycines
  SCN-specific regions: Sequence locations=1-325,347-569
tcttatttctcaccgacgataaggtatgagtacgcggacgaatcgaacatttcacagccgtcgtcgatgtacgcggacccgcccctcttcaaggaggaaatgtcggacgaatcgcacttttttctccactcaaacaacagcaatcagtcactgccatttccagcctctacgtttgtgcaggcacacgacgatgagaatttgcagccacccgttgctgcgttcagtccttttgccattgccgacacttcgcaagaattacattactcgcaaccggcgccgtcgtcagtcgattatttcttttggcaatcggacgaagcgtcgtcatcttctgtttgtgcagaagaaagacgacagatgtatgaacaatacggcggacaaaagcaaatgagacggaccgaaaatgacaaaaacacggaacaatgccaacggaacgcccagcggaacatcggcgaaagaatgccaacgatggacgacaacaacgaccaacagccgtcgattctgcgaagaatgcctttgcaatcgatggaaaacgcatcgctactgaagttgtccgaattttcctcttccga

SEQ ID NO: 91605 - DNA, 643 bp, Heterodera glycines
  SCN-specific regions: Sequence locations=1-643
atcacttacagcggttccttcgcaacgacagtgcattatgtgaacacgccgttggctaacagtctgaatgaactgttagaaacaacagtctccgaaaaaggcatttcttccgcaatgagtttacaagaaaagaattcgccattatatgcttcttgcgaaaaattcatagaagccgacgcgacaagtttgagaagtttgagcatttgcagtgagctcaacgcgcgaataattcaacggggcggaagaacgcgcgtcagtggacgctctaacaaagataaaatgataagacggccatctccgccttcacttccaccgccactaccacctcgcaaacaatcttcacagccatgcttttcaaaatacattcctccggtgttcgatggagattacgttgacattgatgccataatggagattaatcaaagcgaatacattaacaaatcaatgctcattagttcgaatgccggtcgagagatgccaaaatatcaatcacacaatgcaacagattatattcaagtctatccgaatgcaacttcagaattaagaaagacggacgattcactcagagcaccgatgagacgctcgagttccttgtacgacttctttgtatctcaacaacctccagttcattctcttgcgaaaa

SEQ ID NO: 91606 - DNA, 592 bp, Heterodera glycines
  SCN-specific regions: Sequence locations=1-19,42-592
gtcaaacttcgctgtcatgcccatcaaagtctcgtcctgaacatcttttctgtctcactccggagcatctttgcgatggcgtcacgcattgtgcaaacggagaagacgaagattctaagacctattgccgtgcgaaatgtgacgacaaaaaagaattctcgtgtcgcgtgtcggaaatttgtcttccgaaggaagtgttctgtgacggaataaaacattgtccttttggagacgacgaactgaactgcacggaatgtcgaggcgaagcaaagcgatgcggtgaccattgtctgccaaaacggaagttatgcgacggagaagtggactgtcaagtggacggagggagtgacgaaaaggactgcgattgtccttcttgttccggaatgaacagcgcgttgtgtgacggcgagcagaagttttgcgtggacaggcgacgattgtgtgacggacgagcggactgtccgggaggggaggacgaaaacgattgccatggcatttgtccatcattgcccaaaggagcgagcagaacggaggacaagaatacggatggaatgggtcaatgctccgatggagtcactcgcttatgggctgt

SEQ ID NO: 91607 - DNA, 579 bp, Heterodera glycines
  SCN-specific regions: Sequence locations=1-386,427-579
cggatttcctggcatggatggtgaaaagggcgatgccggatatccggggccagccggacccgctctcagagatggctttgttgtggtcacacattcgcagacgacgcaagtgccgaactgtccacaaggcactgaaaagctgtgggacggcttttcattgctgtacattgaaggcaacgaaagagcacactaccaggacctcggcgatgccggctcatgtcttccccgcttctccacaatgccattcctgttctgtgattttaatgatgtttgcaattatgcttcacgcaatgacaaatcgtattggttatccaccggcgaagcacttccaatgatgccagtgaacgagcgcgaaattcagccatacatttcacggtgctcaggttgtgaaacgcctgcaaatgtgatcgctgtccattcccagtccatccaaattccaaattgtccaaacggttggagttctctgtggatcggctactcatttgccatgcacactggtgccggcgctgaaggcggtggacagtcattaagttcttcgggctcctgtcttgaggattttcgaacaacaccattcattga

SEQ ID NO: 91608 - DNA, 543 bp, Heterodera glycines
  SCN-specific regions: Sequence locations=1-170,192-435,487-543
attttcttcgggcgaattaccactggcgcccaagacgatttgcggaagatcacacagatcgcttactctcaggtggtcaaattcggaatgagcgagaaagtcggtccggtatccttcgacactccggagcctggcgaaatggcattcgataagccctattcggaggctaccgctcagctgattgaccaggaggtgcgcgacatggtcagcgcggcactgcggcgaacgcgcgaacttttgatgtcgaaggtggaacagatcgaacgggtcgctcttcgactgttggagaaggaaatcttggcaagggaggacatgatcgaattgttgggtccgaggccttttgccgagaagcacacttatgaggagttcgtggcaggcacaggatcaatggatgaggacacgacgctgccgaaaggacttgactcgtggaaccgcgaacgagagaaagaagagaaaaaggacggagagaaagagcaaaagaaagaagcagcctaagccatgttgttatttgtcattttgtttatttaattagagatgaacccg

SEQ ID NO: 91609 - DNA, 591 bp, Heterodera glycines
  SCN-specific regions: Sequence locations=1-23,46-591
ctgtgctcacatttctccgttcaaacaagccaatttgggacagaatgggcaccaaatttgagttggaagtgtattcatacgaaacggatcaaatatgggatgtttttgtccgtgaaatttggcccatttttgcgacaaacattcggcatttgagctttgccggtgccgatgctttggacaatttgcgtcgccgcatttcaccgacacttctcactgatcttgttcaattgtattcaatcacttcctatggactgtgccccgatggaatttctgacgatgggccaaatgcaactgccggccaagcgttgtccaaatggttgcacacgccgagcaaaaatggaaaagcgaatgaattgtattgctgtgcttatttttgtgaaataacatggatcaacactttcaaggagacatttctccgtgccaccacttctgtcgcttacaatgttcggcttgaacttctagtggctaacgaaatgaatactgttgaacaatttgagttggtgaacgaaatgacccaagaaaagttgacactgacgaaggacgaagagatttgtctgttgaaacggtgtccaattgttggggagacggcgg

SEQ ID NO: 91610 - DNA, 581 bp, Heterodera glycines
  SCN-specific regions: Sequence locations=1-497,538-581
cattaaaacactttatccgtgttaactgattgcttttatgaatgggggcaaaaatttgtgttattggatttaattaattaatgaacatcggcaattaatcaggcaaaaatcaaaatcatccgtcgcttcttctccatctgcacatcgttcttgacccccacaaagcattcaccctccgctcattcattcttcttataaaagcgcttcgttttcactccgttatattccatttgcatcaccaaaaagccgtccgagtcgatgttgtatttgtagatgtccggcttctcctccgagtccacctttttgtgcgtttcgatcagctcgtcggttgttgggttgtagtcgaaggtgatcttaggcactgagtcgtccaaatactcggcttggaactcctcgcccaatttgaagctgggccactccacattctttttggtggtttcaattttgcatgcatatgtgccgctctcattcttcgaaaatgttttggtgatgccggcaagcttgaccctcgtgccgaattcggcacgaggcgggcaactcgaccatcggacggccggaatcaaacgaaatccccctgctct

SEQ ID NO: 91611 - DNA, 635 bp, Heterodera glycines
  SCN-specific regions: Sequence locations=1-635
cgaaattgccacccgctggacgcctttgcattccgataacgatttcgccttctgacattggccaagacaaaatgctcctcgacaatggcactttgatctttttttccgcccaactgttgtccgcattgctctcgcttgtcccgcttggccttggcataatggcaatgctttgctctgtgtacttatataaattcaccgtctattttcatgccctcccttctgtcatggcctggtgtgcttctgcttggttctcagccaaattgctgctcgattggacggacttttggatttgcgtcaacttccaagcggatcacacaaatgtgccgttggtcagtttggtgctcagcattgtgttggcgtgttcgttcgtcttcgagattttcttcaagaattcgctgctcaaaaagcagttggccacggaatgtgccatcgtgtgaacaatacgcagagacgaaacgaatcgggaacgatgctgatgccaacaaaacacaatcaatgcgatgaaacggcgatgtgatggatgatatatatgtatatgataaatcggataacctatttctccgtcatacactgttgtattcattatactagtatatatatatcatatatatatgcatagttgtataaactcactc

SEQ ID NO: 91612 - DNA, 651 bp, Heterodera glycines
  SCN-specific regions: Sequence locations=1-214,244-591,623-651
cggagggaaaagagaagcatcggcaaaaggacgacgaaaaatttgggcaaaaagaggcgaaaggatgaagcagtaacagcaccgccggtcactggcgttgtgctgccgtcctccaccaccgcagcggctgatgtgccaccgccgccgtgcccttcggaaaccgcaaatggccaaggcccgtcaacgacgacggcaaatgccaaatcaaccaccaccacagccagcaacagcaacgagcatcaggagaaggaggaggccactgcgatgttgctgaagatgcaacttggcacgccggtgccgatgagtcacaacgtttgcgctgacaagcccgactacgcggtggagaagcccgcgctggagaagtggtccattggtattcaagcgttccaacaccaaccgcccgcctcctccaccggcttcttcaaacggatgcacaaaattgtgaaaagtgtgcgcaaaaatggccccgcaggcgttgaggacggcgcagacaatgaaaacaacaacaaaaaggacaacgaagaaaatggaaaaaaggcgaaagaacaccaaaagagatgataattgggagaggacagaattatgagttatcaatcaaagcaaaacaaagaaaaactgtttttagttcaatttttttggtgatttgtgtga

SEQ ID NO: 91613 - DNA, 559 bp, Heterodera glycines
  SCN-specific regions: Sequence locations=1-7,35-154,176-537
tctggtggctatcatcgccacagtcgtcactctggcctctctgtacttcgagatgagaccaatgaacagccaagtgcgcgaccgagtttaaggctttcccggcaaaaccgaatcgggctggaatgactttatggacacgcaaatgggcctgacacccccgccccaaaccccctgataaacccctttaatccatctttcgtggcaaaaagcaaatggccggacactgtcagaggggtgggctcccacagaccaaaatgttcccccggttcggcccggtccctcctggaagcctggacaaaccccgacaaacttgtaaggggcaggacaaccccgaacagctggacaagactgggcaaacccgcttcctccttgttccggccccaaaaaaattaacctgcccaccattggccctggtgggccaaaccccgcgcgccccccccaggaaatagggaccccccccgcacacaaaaggaagacccctgtgacaacccgggtaaacaccccccttcaaggggggagggaacctggaaacaaactggggagcggccccggacccccc

SEQ ID NO: 91614 - DNA, 576 bp, Heterodera glycines
  SCN-specific regions: Sequence locations=1-576
cttttccctttttcttccttttcttcttcttcgtcccatcaatttcatccttccaatttgcgcgttgtttccaaaaattggaacgccattcaattgacaactctcagcctctgacagaaatctttcgctcggcccccactgattgtctcgaacaatgcatttcacacacaggcaatggcgatgagcaggaaaatcccggttactgtcgctctgttgtgtacgaccatctccaacacagctgtcgactgtacggtcacgacggaagcaaagtgccggcactgatacacccagccaacggattcgacctgtacagacgcacttcgagcatgcaggaatgtgttggtcccactcagcgacttttggcacttaatgcaaaaaaaggcgcagtgttcgctgcgcccagccaacaagtgcaaagtgtgaagggaaagacggccattcccgtgacgacgccgatggcggaagacgaaacactgagcgacgaggaattggccactttgctggaccaattggagagaaaggatgagaaaggcacggaaattgtgcgacaaaggcacgagggggagggaaaagtgg

SEQ ID NO: 91615 - DNA, 609 bp, Heterodera glycines
  misc_feature (594)..(594): n is a, c, g, or t
  SCN-specific regions: Sequence locations=1-33,55-291,313-609
ctcaggagcaaattcagcacatggaattttcgctggtcaccggcggcaaaggaatggagagggaattggccagccatcggttggacgacaatgtcgccacggaactgaaacttgtgctggccgccggcctctacccacagttcggcgtcgtggacccgaccaacaatttccgagagggtcacgaccaattcgcgcacacgccctccaagccgttcgtggtgctgcacccgaacagtgcgcttggtctacggcccgaagtgctgcgatcggacgatttggactcggagggccattccgtgcagcaccaactcatctactttggccttctgttggagacgacgaagccgtacttgtgcaattcgtgccgcatccccgcctcctttttgttggtcatcgccagaaatatcacttgcgtctctccgtctgtgctctgttgcgacggttttgtcgagtttcactttgtgaaggcgcgccattgcgacgattcgctggcattcgcctgtcgcgtgcgttcgctgtttctgcagtcgcttgagcataaattgcgcagcgacgactacggcgactgtcgcgagttggagcggctgatcatcnaattcgcacgcctcc

SEQ ID NO: 91616 - DNA, 556 bp, Heterodera glycines
  SCN-specific regions: Sequence locations=1-556
gaccggcagaagcgacagacatttccacaaaacagcagcggatgccacgaatgcaagtcgccgccaccccttctacggaaaagccgaaaacacggaagcggaaacatgagctctctgatgaaaccgatgctgaattagaaaaatcaaatgcaaaacgtttgagaacatcatctaaacctattacagcattcacttcgttgtacatttctttggacaaatcaaaagaactgcttggggaatccgaagctagggtaaacttgaggccattgccacaattcgaatccattggactgagaacgcgtgtggccaaatacgcggaagcaagcgaaaaatgtttattgaccaagtccggacccgaagaatttaaagaacacacaattccgattcggcgaatggaaggcatagaaaatggcattccgattatagcgaagggtcgggaaaatggcattgatgcaaaacaggtcataaagcccgtggctggaccggcagaagcgacagacatttccacaaaacagcagcggatgccacgaatgcaagtcgccgccacccctcctac

SEQ ID NO: 91617 - DNA, 448 bp, Heterodera glycines
  SCN-specific regions: Sequence locations=1-147,173-339,380-404,426-448
gattgtactcgggattgcctaggtgcgctctctgatggctatcatccccacagactttactctgccatctctgtactccgagatgattcaaagaacatcaaattgcgccgactgagttgaggccttgcgcgtgaacacccactccggctggactgacttgatggacgtgcaattggtcgtgacatcgccgtccaattcccctgataacgccttcaactccatcttccgtgtcaaacaacaactgccccgacactgccattgcactggcctccaagagccaagatgtgaccctgggccacccggaccgtacgaaaagcctgtacagaccggacagcctgaaggggaaggacaccccggacatgctggacaacctgaacaatccgctcactcatgccagcaccagaagatcccctgcccacgctgccctgctggctcgcactgtcgcccc

SEQ ID NO: 91618 - DNA, 322 bp, Heterodera glycines
  SCN-specific regions: Sequence locations=1-81,111-151,173-322
gctagatactcgcattgtccttgtgagcgccccgatgtgcactctgttggctatcatcgccacggcttttactctgccatatctgtactcggagatgagccaaatgaacaacaaagtgcccgacggagttgaggccatccacgttcccagcgactccttctggaatgaccaaatggacgtgcacgcggcgttgacgccgccggcgaacccccgcgacaaccccttcctctccatattccgagtgcgccgacaactgcccggacatgttgtacgaccaggacagtccggacaggctggacaaggtgggcaagccgctcctgct

SEQ ID NO: 91619 - DNA, 626 bp, Heterodera glycines
  SCN-specific regions: Sequence locations=1-551,573-603
gttggacaatatttgatgaatccattcggagaggacgacgacgattttgagctcaattatgtgcttgatcggaacacatacatcgcgcatatgatagcctccgagttggccgatcagattccgtcaaagatctccgatgagatggaggtcacgctcccgcacacgcgggcatccttcaaaattcaggacatcatccccaaagggcatttgtccgactttcaaattgcgcccaaggacatgcagctgatccgtgccaatgagctggccaatgccatgatggagttggagcagaagcgcaaaaagctgagcgccattttcagggcggccggcagaaagcaaaccccaaacagcttaacaatagttcccggcgcggctgacagcagcagcattgaagagaaccgacgtttgacatcgacaattgaggaggaagcggtgccaccgccgacgacaccgacaaaaaaggaacatcccggcccatgagtgataattaaactttgaaaattgaaaatgaatggatcaatcaaatcccgctcattttaaatcatataataatttgcattttgtgtatctctctcttaacatttgcttgccattttgtgtcggataaagaaaagggaaaagaaaaa

SEQ ID NO: 91620 - DNA, 256 bp, Heterodera glycines
  SCN-specific regions: Sequence locations=1-256
cattgctctctagattgcctcaaagagttctctgatgaatagcctccacacaaacaaatgtcgggcaactctgtacgcctacacgagccaaaggaacacctcaacgcggcaactgttcgaagccttccgcggaaacatcaagtcatactgaactgagttgatgtacaaattggggaccaagacccccacgacaaatgcccgagataaccccttaggctccatcttccgcgtcaaacttcaactgaccggacactgc

SEQ ID NO: 91621 - DNA, 605 bp, Heterodera glycines
  misc_feature (480)..(480): n is a, c, g, or t
  SCN-specific regions: Sequence locations=1-605
aattcagtgaccgtttttccgatgatcagttctcattgttcgatgcgatccatcaacctcgtccgctggtcaaaaacaacgtacgagaaatcattgacatggcaaacaatcgacggcttactgttgtggaggcggaggatgcgaacattttgcgtatgcgggtgggaagattcatcgaattgaacggacgcaccgaaatgtctctgcatgatgcgtaccaactcaaattggttcaaaagccgcagactttggccgaggtcattgatagtggctcgctggacaacaatggtcgtttcatcgatggtgttaaacctcgcactctgctcgaggcgatttgttcgggaatgctcgacccggatgtggcgcacatcaaagcgggaccaggcgatgagctgatttccatcggagaggcgctgaagcgaggccgattgacgccgaaaggagaaattgtgttgactctgggtgaagttggcatacacngaggagagaaaattaatttgttcatggcgcacgaacggggccttttgaccagccgtgttcaacacaccatcttcgatgtaaaaggagtgagaaatgctgcggatgggtcaattatgagcttcaag

SEQ ID NO: 91622 - DNA, 502 bp, Heterodera glycines
  SCN-specific regions: Sequence locations=1-502
gagaggcgaggctaaagaccctcaaggagaacctacggcaggaacggtttcaagggagaagctactggaaatccttcttatgaacaaattggcttctactggcaaactgccgccaaaatctgctaggaattttctccacaaaaagcttcaacaaagaaaatttttcgattccggtgactacaacatgaacaacaacaagcctattccacctccgataggacataatttgactgctgccacaactcccaaactggccgttccggttgaaactgaacccgataaaaaaatggaacaatcagctccgattattggatcgcaattgctcccaatgatgcgtcccttggccggctcaatttcgggttgttcgatggatgacggcgaatctgacgatgagggcggaaaacttcagattcctcgacctgacacattgccgcagcgcgaatcgaccattttacatccggcagcacatagctaattgagtcctcaaccggacattcaccac

SEQ ID NO: 91623 - DNA, 269 bp, Heterodera glycines
  SCN-specific regions: Sequence locations=1-45,79-103,138-167,189 -210,256-269
cttcttcggcgtttgcctgtccaccgtggccacggttatcgctgtgctttccgtgccgttcgcctaccagcacttccagcagatcggcgcccaaatgcagaacgaagtggacttctgcaaaatgcgctccggcaacatgtggcgtgaggtaaagccgaaaaggcggattggaaaagccggaaagtttcaaaaaaatttcaacaaattttcaggtcacccgcacccaggcctactccaaggtgtcgcacgacagccgtcacaagcgtcag

SEQ ID NO: 91624 - DNA, 637 bp, Heterodera glycines
  SCN-specific regions: Sequence locations=1-637
gttcgacgccgtcgttttggaggacgtcgccgcgttgaaaagtgcggaggattggcgttcctttcttccgttggcaccccttttgcgggtgttcagtgacccccaccattcgattgcactccctccgtccgccgatagcgaagagacgccttttcagtgttccgttgtgcagcaaattgcgcccaacagagaagagtcgaccgttttcatccttgaccaacaataccgtagcaatatgaacgcccaaatttggtcgggtcgcgccttttacgcgccgctttacaaagagctcgacttagcaaggccagtggcacacgctcagcaggaattgcgactgaaccatttgatggatcgacttgtgctggacgaacggacggtgaacaccgacacactgacgctggtggacaccggcgcattggaaggccactggacggagacaatgttcaaaccttacaaaatggccgcttgggctggcgattcttccgccccttcgctggtcaattggggcgaggcacttctggcggccatgcacatcgattctctgctcagttacggcatttggcccttccaaatcgcatgtttcacgcacagttcggcacacggcgaagccatccgaaggattttattctctctgaac

SEQ ID NO: 91625 - DNA, 616 bp, Heterodera glycines
  SCN-specific regions: Sequence locations=1-616
gaaacactttttgcggcgcgctaatcctgctaaagccggtcaaaatgtctgggcaaggctcgggctttaacaatttaacaagaccctgtccgcttggctcaaagaagcccgtttaaccggacgacctgaacccggtagtttcaaaatttagctggcgcgggctcgggtggcccatgaaagtctgtcgagcgccagacccggcccaattatattgtataatcgtaatataatttaatttttcatgaccttttccagcaactattgcctcccctcttttggatgttggccaagttttgcggaccaaaagcaccgaatctttgccctttttgctttgcttggcaaatttggcggtctgtgtccaatggttgttgtacggagttttggtcgacgatttctacatgaaagttcccaacggaatcgggacgttcatctcgaccatgcagttgtctctgttcatcgtttaccccagaacttacaaacaactcacagttggcaatgtttaagtgtgtccgaacgttgccaaagccatggaatgtttcgccgtgtttgaattgactaacaaacaataagcaaaacccagcagctgtgtgtccgttgtcagtgcattcattacctc

SEQ ID NO: 91626 - DNA, 217 bp, Heterodera glycines
  SCN-specific regions: Sequence locations=1-217
gggcaacagaaacctaataacagctcatactactcgccgaagggtataatgccaatacgcagaggagtacagaaaaagattgatcggacttcgaccagcaaattgcagggcagcgccgcaaatttgcagcttttgcgcagaacctcgggactgggcaatggacaagcgcaagaaacgcgattgaggagtgtctcttccgtcgccgcgtcacaccgca

SEQ ID NO: 91627 - DNA, 627 bp, Heterodera glycines
  SCN-specific regions: Sequence locations=1-437,459-627
gtttgagagcccatcgcaaaggctgtcgaatatgcgccaacggaaggaatttgtgacggagcagcaacaaaaagcatttccgtcgcctgcggtggccgttcaaatcaaagtccgcgcggacaatcggacggacatccaaatcaaagaggcattttgtgagcagaaaaccaatgaaatggcaatgccaaaagtggaacattatgccgaacattcgtccgccgatgttttttccaccgacggaaagcaaacatttggccaaaatgagtcggaaaagcgacagaatgggaagtacgttttgtccggcctttcccccgaaatttccccgccgccgtaccaaaaaatgaatatgtcacactcttcacgaacaaattcacccgaagaacaaaaaggaaatttccacgagattttcgcgctgagtgcgcaagaggcgcgccaacggatgaaggggaggaaaagggacccgcggaaggagggcaaaatgacattggaagagaagcaccggcttatactgaacttataagcagtttattcaacaatccgtccgaacttcttcccgttgctgtccaagtcaaacattctcactagtccactctctctccctccctctctctcttttagtccactctc

SEQ ID NO: 91628 - DNA, 583 bp, Heterodera glycines
  SCN-specific regions: Sequence locations=1-172,194-395,417-583
ttgaagattaatgaacgttacgacaacggatggattttgttgttcagcacccgcccctcccccgatggaataaatacatcataataaatcaccgccgtctgtcagttgcgatcaatggccaccattaccacttcattacctaataaaacagcgttcatcgccagcacaggtcaaaaaatgaaatttattagtttgcttttgcctattgacaattgaaaatgagggagaaaaaagggtgacgggaaaataacaaaataataacaccaaaggaacgtgtttttcacaaaatttacatgtgacaaatggtgaacaatgtacaattaatgaataaatgagtagggaatgaagatcgaatgcgggttggtctgtgctgataagcccttttgtactttcggtctgaattttattggtaaagataaaaagaccgattccgcgtttttttcacgagaaaatcgattcgatctcttaaatacatcgtttattgttattggtgagtgaacacaaggtcgtagcaaaaagtcattttaggggtagggggcaagaaaatccctaaaattttaacggattgtttaaactccacatg

SEQ ID NO: 91629 - DNA, 645 bp, Heterodera glycines
  SCN-specific regions: Sequence locations=1-36,123-499,522-645
caagtttgaggcttcctccggtgccgatgccgtccgctcttccgctttctcttccgttttgcttggccctgcttttcctcctcctcctctctccgtccccatgcttttcctcgtctcctcctgacgattcgccaattgtcagcaccaaatttggcaaaatccgtggccaacttttgcacgtcgtcgaccccgtcgatggccaacccgtggcactcaccgcctttttgggtgtgcccttcgcgcgaccgccgctgggcaaattgcgatttgagaagcctttgaaaccggaaaaatggagcggagttttcaatgcttctgaaatggcacccgcgtgttggcccattgcgcgtgccgaaatttatgcagagcctgatcagctcagtgaggattgtctctatatgaacatttttggaccggaaaaattgccgtccgatgatgccaatttggcccccgttctcgtctatatccacgggggcggtttccaggccggcacaagtcgccaattcaaacccgaagcgattgccaaatttgtacgccgtggccttctgtttgtcaccatacaataccgactcgcaatgttgggctttgccacgacgggcgacgcttcctttgccgggaattacggcctttgggaccaggcgatgg

SEQ ID NO: 91630 - DNA, 606 bp, Heterodera glycines
  SCN-specific regions: Sequence locations=1-2,24-45,122-123,182 -437,459-467,490-562,591-606
gagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttcccgtgcaaacgtcaactgcccggacactgccagtgcgctgggctcaacaggcaagctgtccccctggtccgccccgccccgtccggacggcctggacagcccggacagcctggaggcgcaggaaagccggacagcctggaaaggctgggcaacccggtcttccttggccggcccaaaaaatcccctggccaccctgccctgttgggccgcccgggcgcccccggaggaaaggggaccgcccggaacaaaagagaacccctggaacactggggacccccccctaagggggaaggacttggaaaccctggggggcccgggacccaagagaaaccctggaaacccgggaaaccccccagaaaccttgggcaaccc

SEQ ID NO: 91631 - DNA, 493 bp, Heterodera glycines
  SCN-specific regions: Sequence locations=40-227,249-493
ggagggggaagaggaggaagaagaggacacttggtggacaatgccaatgccggagttggccaaattgaagggcttcccattcgatgccgatcagttggacaaagttgaaaagctgaccgaggtgatggacgtgtggttggacagcgggttggcctggcaaacgttgacaagcaatgccgatgattttgatggcgaaagtggtgccaaattggtcgccgatttggtggtggagggggctgatcagtttcgcggctggttccaaacttccatgctcacttcaatggcattacaagacagcgtgccgtttagacgcattttggtccatgccatggcggtggacgaccgggggaagaaaatgcccaagtccaagggaaatgttgtggaccccaaaacgatcacaggttgtgaagaatcggctccctccgatgcgggtgccctcggggtggacccacttcgtctttggcgcgcttggctcgcctccgaatcctcgggt

SEQ ID NO: 91632 - DNA, 624 bp, Heterodera glycines
  SCN-specific regions: Sequence locations=1-75,114-624
atgaatttcgctgtccgtttgcctttgtctcccttgaaatcgtttcttttgccccgcctttggccccccttttgctgctgctccgtctcttcttcttccgtttgttctgttcctctgttcgcctatccttcgctcgtttcttttccgtctcccgtcgccgcatttttgtgccaacgcgcgggcgtcgccggacaatcgttgcccctccgcctctttgacgtccgttctcgtcaaaaacagcacttttaccaccaccaccatggcactttctcggcccgcttctccgcctttttgcgccgtttgtttccctttggccgtggcggtgccgtcgttctgatggcgttcaacatcaaacagttgttcagcttcaaccgaaccgacgtgctggacgacgacccgctgaaggacaaagtgaagcgggcgatgctgcaccgaaagtacggcgaatgggcggcggctgttcaggtgctcaacgaggcgttgaacgaggcggtctagttgggcaatgaaattttcgtgtcacggatgtattacgaattggccaccaccttttgggagtcgggacaattggagaacgcagagcatttactgaaactgctgcacggaagatacctcactttgcaa

SEQ ID NO: 91633 - DNA, 648 bp, Heterodera glycines
  SCN-specific regions: Sequence locations=1-180,202-648
taaagaggccatcgaaggggaccaaaagacgcacactttttgtggtaccattgagtacatggcacccgaaattctgatgagaactgggcatggcaaagcggtcgattggtggagtttgggggcgttgacttttgacatgctcaccgggggaccgcctttttcggcagagaatcgcaaaaggacaattgacaaaatcctcaagggacgccttacacttccgccctatttaagtttcgaagcgaaagacttgataaaacggttgctgaagcgacacgtggacactcgccttggggccgggccgggggacgccgaagagataaagaaacacgcctttttcacccaccacgtcgagaattggacaaatgtttatcggcgagaatcgaagccccgtacaagccgaacatcaccagtgaggaggacgcctctctgttcgactccaaattcaccaaaatgactcccgtcgattctccgaccgccgaattgccaccaatgtccgtcaatcccttcgaaggattcacttatatagcgccttccgtcctcgaacaagtcagccaacccacgttggtccgtccgagacaacagcgcaaaatacatggccccgccatctttcacagtttccacccccaccaatcgacgaccgacaacgga

SEQ ID NO: 91634 - DNA, 608 bp, Heterodera glycines
  SCN-specific regions: Sequence locations=1-474,517-608
cgttgttgggtgcccggagtgcccggggcggtgctcacttggcgaccctcgcacggtggcccactgccctcgggcgcgaatcagagcggcggttacttggacttccccagcgtgtcccagcaccacccgggtcagtacgtttgcgcggcttacgacccgagccgcgacccgatcggaagtcgacctgtcgactcggacaatgtgcggctgaagctacggccgaagaagcctttccaagtgctagtggagccgccctaccaaattgtggacgaggaacagcccctgccacgtccttaccgctgttgggtgccggggtatccgcaggcggtgctcaaatggcgaccggcactcgacgaaatgcttcccagcggggtggaggagcagcacaacggtgcactgctcaacatcccacgggcagagcttcggcatgccggcgattatatttgcacagcctatgacccgcacgacgagtcaccggaagagaacacagcacaaagaggaagaggaggagggcaaaaagaagcagcggaagcggaagaggacggaacacgcacagcacaagcggaagaagagcatcgcggaagtgcgcaaggaaaacttgcggagga

SEQ ID NO: 91635 - DNA, 553 bp, Heterodera glycines
  SCN-specific regions: Sequence locations=1-553
gaggggcgccattaaactctcgaaagggcacgaaatccgaggccatcaatttgtggccacttttttccggcagcccactttctgctctttgtgcagcgaatttatgtggggactgaataagcagggatatcggtgccgactctgcactttggcggttcacaaaaaatgtcacgaaaaaacgctaagtcagtgcccgggatcagccaaaaacagcaaagaaaccatctacctcaaagaacggttcaaaatcgatgtgccgcacagattcaaacaggacaatttcaaaagtctgaccttctgcgaccattgcggctcacttttatacggactgttcaagcagggaatgaaatgctaagtgtgcggagtgaattgtcacaatcgctgcgaaaggcatatgcccaacctttgcggcgttaaccaaaaacagctgtccgacgcacttttggagatcaaacgaagcactccgccgggctctgtcggcggagggacggcacaacagcagcaaatgttcaacggaatgggcaacaagttcaaagccctcttccggccacaa

SEQ ID NO: 91636 - DNA, 633 bp, Heterodera glycines
  SCN-specific regions: Sequence locations=1-419,441-541,565-633
gtttgagccatggattgttcctcaaaaattaaactccctaatgagctcaaagccgagttggccaatgcttttcgtttcgatttccgttggtccgttctccgcgtttcttcctccgtttttgatcactttctcgccaaaagacagcataaaattcttcaaaatgttgatttgaaatttcgacagtcatgtgaacagcatgtggaattggacaatgttgggcaaaagttggccaattttcgaaacgaaatctctctgccaatgtccaatgtgccaatacatgaagctgtgatcgcggcacgcattctgatcagcttacatacgcgcaatttcaatgagttgtacgccttcttggaaagccacaaattcccacgacaaattcatccgaagcagcagaaaatttggtgggacattcattttttggaggccgaacaaacgctggggaaaagccaacttagcctattggaaaagtacaaagtgcgtgaggagcatccgttgccgccgacaatttgggacggacaacggaaaaatggcttattaaacgaaaatacgctgacactgctaaatgagcaatacgcggagagtcgttacttctatgccggaaggtgggaaatagcggaagcgacgggcctttcg

SEQ ID NO: 91637 - DNA, 326 bp, Heterodera glycines
  SCN-specific regions: Sequence locations=1-12,66-326
gacgaaaacgtacagcagccacagcaacaacaaaacatggaggaggaggaagagggacagaaaagtgacgacggaaaagcggaggaggggcagcagacgaaacgccaaattggcatggacgacgacgaagtggtggcggtgctgggccacgagcttggccattggaagttgggccataccatgctgttgttgacttgcactgaggtcaacttgttgctgatgctggtcatcttctcgctgttccatcaacaggagagtcttttcaccgcttttggcttcccacccgcgcaacaacagcccattctgatcggactgttgatcatcgg

SEQ ID NO: 91638 - DNA, 399 bp, Heterodera glycines
  SCN-specific regions: Sequence locations=1-399
ggcttttaccatgaagccttggtcaagactcggagaatttgtctcttaaagaaaatttttttcgaaataatggtttttctgggtcatagaattcgattctgatattgaatttttgttcgagtccgggtcaggggttcgaaatgggccgaaatgatatcagcatcaaattctacggcccacataaaacagttttatttcgaaactttttttgaaaattttctttttcaaaaaaggggggtacatttttttctattaccgagcctgggaatcatacaaaaatggagcaataaagcagttcgcacacaataaaaaacaatgtaataaataaagcttaaggcttagcctagcacccaaataataagcatgaaagcttttggcaaattgaaggactatccgcaa

SEQ ID NO: 91639 - DNA, 492 bp, Heterodera glycines
  SCN-specific regions: Sequence locations=1-492
ttctgcgttcatttggtccgcctctggtggagacaatggcctaaatcaattgcaatttaaatttgaatattaaagcaaaagctgttgctatcacaaactcacccaatgcaatccgtgcaattattgagcgtaatgatgactttgttcaaattgtccgtcttttcatccttccactgaagcgtccccccaatttgttatcgcttcaacagccaaatttggcaccgcttcaacgtccaattgccataagcatattcgtcttttttctccaatgtcagcttttcgttggtccgttcgttcaccaattcaaaagactcaattggcgatgattcaaaaaattcaaatttaattcgaattatgtagctggccgaagaagtggtggcacggagaaaggcctaaacaatggaaaaagaaaagcaaagggcaatcaacccaaacacattttacgaaaatgtggacacacctctttgaagctgttcaacaatttagtgattc

SEQ ID NO: 91640 - DNA, 322 bp, Heterodera glycines
  SCN-specific regions: Sequence locations=1-17,40-187,209-246,297-322
cgaacaatttgctcaaggtatggtcaaaaataagcgactatatatgatgtacaatgattattttgcattccctcaggttactgtactactactgtcgtgcacttacgaacacggcgtgtgctgtcgttgttatgatgattctcacaggtaccatatacatgctgtatatttctgtatccacatgctgtacatacagtatccatccgcttatttccaagcataggtattcaaaaaatggttttaagctaatattaaaaaaactaaaaataaaaacaattaatattgaaattaatatactcttttgcataaatcatatacatcg

SEQ ID NO: 91641 - DNA, 512 bp, Heterodera glycines
  SCN-specific regions: Sequence locations=1-512
cgcgatcacttgcaattgcgtgcccttttgtaaaattttcaatgccgttttcccacgtccctctgcgccgaatgttcagaaaaaatgaatgtcagtgacgaagaaatccatttctctcggactgttcgtcatcttaatcagcggctgttcttcggtttgttatcgcaattttcgggaaacattgccattgtttgggacggtaaagcgatgaccacacaatttgacatgatagttactcctattttgttacaagagcacaatgtgaccaaaaattacaaattggaactcgtggcacaacccgacacacaacacgttgtctatttgatttatgcgacccgtcaatctgtgttattgcttatgcgaaattggcttcaccaattgcccgacgatgacttacgcctccatcacgttgtgttcatccccgacgcttcattaactctcagacaacagttgcgtgaagatcaacgcgtttgggatcgtctccaatcggtcgactctttgcctttgcattg

SEQ ID NO: 91642 - DNA, 375 bp, Heterodera glycines
  SCN-specific regions: Sequence locations=1-15,39-171,203-375
ctctaaaacactttgtaaatttatatttatataaaaatcgaccttattgcaaacagttcgtgacgttttggtgaaacagtgtatacgcgcaccaacatgcgcgcccctgcaccaacagtcagcggtcgttttcgtttaatccagtctcgtttcttttggtcccaacttgaatacacattttaaaagaaaaacaaaatagacatactaaacatagtaaggcatttgattatatttctagtcaacagcgactggggcacgttcacacaatgataagaaagaacttaagcgtgtgtttgccgccagacgttgccgcccttgcttctcatgaccttcttcaacaacaatagtttgtcccagttcatcatgaatagaaag

SEQ ID NO: 91643 - DNA, 231 bp, Heterodera glycines
  SCN-specific regions: Sequence locations=1-231
atccgtcaaatcattggttgttgtcgttgtttgttccccgatacgagtcctctctggtttgcaccggcatgtggtctttgcactttgggcacgttttttggagtccttactgaaatggacaacaaattgttcaccattaattgaccctttctcggcacaacgccctactaattgatttggacggcctcctcttgtggaaaaagtctttgagtttgtccgcatttgtcacat

SEQ ID NO: 91644 - DNA, 501 bp, Heterodera glycines
  SCN-specific regions: Sequence locations=1-501
aagctagtcaaggactgcttcaagcgaactttgggtcgaaggattctttccttcgaccaactcaacacattcgcggccgaagtggaggccaccctcaattacagaccgattaccgcggtctcagacgcagtggatggaccagttccactgcgtcccatctttctcttacaaccagagattcatatcaattaagaaacaacaacggacccaattgattcagaggaaatgttttcctccacacacgaacgtttaacttcccgaatacaagcactccgggaagccaacgacattttctgggccaaatggcactctgagtatttaacattactcagagaaagagcccagtaggaccacaaaggcccacgacaccaaaacttcggtgaaccgaagaaagggatggtggtcctaatctctcaggacctcgttcctcgcaatcaatggccaatgggacgaatcgttgaaacacacggacggcctggagccatccgaagtgttaaagtt

SEQ ID NO: 91645 - DNA, 473 bp, Heterodera glycines
  SCN-specific regions: Sequence locations=1-191,213-473
gccattccgagtcccagtgcaatttgagtgtgggcaaacatatgaccgcccgggaatgccccgtctgttacattcgacagcaccccaccaatttccacaagctccaaacctgctcgcatttgacatgcaaagcctgtctcgtcaaggggcctttttgtcagcaatttaagaggggcaaaaattgtgtgaggtgtttaaatattggaaaaatcaaaaatatttattgattcattttctcaaagcattttttatgacatcacgaaaatcgagctatttaatatccatctttttcttaatcattgtttcgttttcagtatttgaacctcgaaatcatggagagtcggactaacatttcttgtccaaattgttccgctcttctccacgccagtgacatttatgcactgcttgaccaccagcctgagctgttggaccgctatgaaaagttctcattgcgccgtgcgctcagcactgac

SEQ ID NO: 91646 - DNA, 565 bp, Heterodera glycines
  SCN-specific regions: Sequence locations=1-565
tttgtggtgccattttatgatgccatgaaattggcgaaaaaaaaatttgtggtttcaagaattgagacattatcgagagagccgagggaggagagaatggcgactcaaaaaccgcgaaaagacaggtgaaggccaaaaattagtttagagaattggtcgggaatggggactcaaaaatattgaaatgacataaaaagccaaaatcatagacggattgtcgaagttagggactgaaaattcaaatattttggatttggaataccgaaaaatttgagaaaattaagagcaagggtggggagaatttcggataatttgagaaaattcagagccatttgaattgaaaactaaatcatgaaatttagaaaccttagattcaattgctcgggattcaaagaaactaaatcataatgaaatatacagaaaataggactaggatttaaatgtgcctaagtttgggaacgtgaaaacctatagtgaaaggctttcgagatcgttaatcccggatttccagaatgaagatccagaattcaaaatttgggcccttgctcaagactgaaaaaagcca

SEQ ID NO: 91647 - DNA, 535 bp, Heterodera glycines
  SCN-specific regions: Sequence locations=1-535
aaggtgttcgatgccctgttcactgatccatgcgaaccacccccagcgctttgcaaagtctggaccatgggcgagaagccaatgcaatttgggggtgaatccagcggcattgtttgtgtcaaatgcagttggataggtctcccaattcttaaaaggggaatgtgagaaaaatgcaaaaaaattttttgccttgaaatagccatgaatgccgagatatttgtttgagaaatctgtgatttgttctgttgtcaataggtccgcacgtccaaaaacgtggagctcccgaatttcgtcaaggagggcggcaatatccatcgaaaacggtgttccaatcgatcggatttcggttgaggcgagaagtaggcgcttcatgtggtcgcctaaaattgattcgaaaaaaagaaagaggggaatgtcaggaccagtatactcttgcgtcttggcatgccgaattgctcccgactttgccataattgcttctaattggcgtttttctgcgggtgacccatttttttgaaaaaagtcaatgcatttc

SEQ ID NO: 91648 - DNA, 617 bp, Heterodera glycines
  SCN-specific regions: Sequence locations=1-303,334-335,358-529,554-617
tgctgttggtccagcagcatttctttctgctggatcaaaattgactctcggggttatgtctatgtcctttctcgaaaactaatccaatgattttttctatctggataaagtgggattagaattttaaaaggtaaaacaaaatatttagcaacaaagccaacgacgacgcctcccaaccatttgaccaccaacaacaattcggcgtcctcttgctcatctgcagcttggcgtctatcaatttctattgttattctgtccattgctttttatttttttccattatgtttcgtaattataccaatgaaattttaaaattttatcttttaaattaatgctaataaaattgaatggaaagagacatttattccatccagggattttgctgacgtcctcaaaaatttcggcaatcgggattccaagcctaaaaatgtcggaatcttaaatcggcattctggcattttttttttattcttcgatttggcgcagtttatgaaaaaggttttgatttgatgttcctgctgatttcgacgttggatttgattcaaaataaaaaagtttttaacacgaatgttttcaaagaaatagtacataaaattgccattagagaaacaaaggaa

SEQ ID NO: 91649 - DNA, 618 bp, Heterodera glycines
  SCN-specific regions: Sequence locations=1-71,93-337,359-401,424-618
cacttcacttcacttccttgcgccaacgtcaattttcttcattctttgtcaaagtcttcatcagagcatatcccttccctttttcctcctccattcactccaaaatgaccaatttcttattgctcaattttaattttgtgattgccttttttgctacattgacccaatcccaagaattcccacccgttcaacctgtcccggcaccgcccgaaacccaaaatcaaaatttggaggaaaactccgatattacaacgggtgaactgacataaatgagacaaaaggataaatgaatgtttccgttaaaggcatgccgccttcagtcacagaaacaacggttgcgccttttgatgggccgtcgcaaatgaaaggattaggcggaggagagcaaattatgaccacaacgccccaggggaacagctcagaaccaaaaccgagcagcccaacaaatggaaacgaagaaaaggacacaaaaagtgaatacggtcgaattggtgctgtaattttggtactgtaatcaaaatgttcagcagttgctgctggggttgcgctttccacaacagttgcaacgatcgaatcgccgggaaattcatttggcacgacggaaacgccactgggcac

SEQ ID NO: 91650 - DNA, 633 bp, Heterodera glycines
  SCN-specific regions: Sequence locations=1-633
gcgcgagcgaagttcaccgactatttcacttcggttgcggagacggtcaaccaatacttggacaatgtgaacgactttttgcaccgagtgaaccaaatgactttttctcagcggatcgaagtgctcagtacgcttgagcgtgcgttggtcgtcgaatacccaaaaaatgcggaagaatgtgtgagttgggcccgtgaactgttcgacacgctttaccacaatgacattgcccaaatgctgcacaatttcccttccagcatgcttactgcccaaggcgacaaattttggagtggaaccaaacgctgtccgcacactttgaacttcgacgttaacaaccctgaacacttcgagttcgtcttctccgcttccattttgcgtgcccaatcttacagtttggctccgatcactgaccgcaaaaaagtggcacaattggccatggcgtactgctccaagccgttcagaccacaagagggagtgcgcatcgctgtgaccgacgcggaggcgactgccaatgatggcaacacagcaaatggcgatgcagacgaaactgaacttcggctgaacgatctgaacgtgaaattggccaggctgaagttggagaacattcgccgcatgacgcccattgactttgag

SEQ ID NO: 91651 - DNA, 350 bp, Heterodera glycines
  SCN-specific regions: Sequence locations=1-15,37-217,239-350
atgagtcgaaatcgtctcccaccagaacttttactcgaaattgtcctctgcgttcgcaggggacacaacacgcctaacatttgtttctcttctcgcattttacgaactttcatggagcctcgagttgcgctgtggcggagagtttggatttctatgttacgcaaactatctgacgcttatttaaaggcacttttgacgtctatttggaactatgtgcccctggatgaaaattgccaaatgttttttggaacacttaacggagtttttcgtcaattggaagacagagaaattgctgccaattgtttgatcagtggtcccggcggcatcaaagggcaaattccgctcgcaca

SEQ ID NO: 91652 - DNA, 552 bp, Heterodera glycines
  SCN-specific regions: Sequence locations=1-552
gttggacgcccatcagaaagaggaggagaagcgcattccgctgatcattcccacggtttccgagtaccgttacgcggagccggacaccgacgagaacatcattttcgaggattacacccacaacagcggcatccccgtggttcgtgccggcacagtgctgaagctggtcgaacggctgacgtatccgcagtacaccgattttttaatttgtcaaaacgttcatgaccactttccgctcgttctgttcaccggccgaattgttggcacttttaattgaacgctttgtcattccgacgccgcacattttcatggcattggacccgcagcatttgctgtcatccgtgatggcgaactcatcctgcaatgattcggcatccctctcaaatggttctctccaacattcgcaactccattcgttcgcccacaatttgtcgcagtcccaacttgagcaggcattccacaaattcaggcaggaataccaaaagcccattcagctgaaagtgttgagcatcatcaaccactgggtgagcaaccacttctacgacttcgagt

SEQ ID NO: 91653 - DNA, 611 bp, Heterodera glycines
  SCN-specific regions: Sequence locations=1-397,420-521,543-611
aggacattctctttgggtcaattgaaaatgtcgtcaagccgcaggcgatgaaggagaaggaggacgcctgggaaacagttcgtactgaaatgattgagcagggctttgtcaatttcgagcgaaagtcgtggcgcgatgtacgaaatcacgactggcaatacttaagacgttctgcggttgcaaaatacgaacacaatcagaaggcgggcgttgaaatgatccaatacaacgaggtagacaaactcgtcttcgaaataatgggcaacgaagtgtcctccttcgacaacacaaacaacgattctgttttcttgcacaattttccaaatgatgaaggacaacaaaatgaagtggccgacccgccgttctttccaacgtttgccactaatgcattgcgaactccgaaattagaagaactgcagcaaatgaactccaacttaagccattccatttctgttggttcgtctcgtgacccaccggcacagacaaagggattttcggttgaaacaatcaaattttttggaatttgcagaacaaaaagattctcctccctgtggcgaaattcagtccgaccttttgcacagtcctcatttcgtcatcctctctaatcaacg

SEQ ID NO: 91654 - DNA, 576 bp, Heterodera glycines
  SCN-specific regions: Sequence locations=1-69,91-576
ggaagacgtgccaacaatgtttggctgagaaaaagaagagaaagcggcaaatgcaattggaaaggaatgaaattgactttctttgtttaccctgcaatttcaaagtctctccgccgttcgcatcgcgaaaaacatcgaatatttccaaccaatcgttgcactcgtccatggaattctcctcgaaaagcgcaaattgcttaattgaagggaaaggcggcggtaattggggacgaatttggccaaactttgaaaaagagaagaatttgggcattggatgggccaacgatgtgataagtgcactcggcatcaagcggatactgaaacgggagcagaaggaatggaaggcaaaacggatgacgaacgttggaaggatagcggggactgttgaaagagccgaccgagtcgcggaagcgaaaggcgcaccgattggaaccgccgacggactcaccggcgatgccaaaatctgacaaaaggggcgcaaagggcggcatgacgacgagttcggcacttcctctgacccgttttgaattcgacgcgcgcccgaaaaccgtacggcggcgcaaaattggaggccga

SEQ ID NO: 91655 - DNA, 624 bp, Heterodera glycines
  SCN-specific regions: Sequence locations=1-289,311-338,361-624
gtaaaatgtgtgaaccaattgggaataataatgatgtttccgcatcacaacatttccctggtgccagtggttccggcggtttgacgtcagttagccccctcgaacctttggatccgacaaagtttcgtaacataatggtcgagaagcatgaggtcccttcagcattcggcaatttttgtgacaatagcgaaatgacttccgatttggctcctctgggccagcagcagcagtcgtccactgggccttttctgcatccgtgtttccctccagcagctgtgtccgctttacatcagtcaaatccacaacccttcaaagtccaacagtcgccatcgattggccaacagcagcagcaacaactgtactttgttcagcaaaatgcccaaggcaacttcggtccaatgcattcgttttcatccacctccccgctgtttggtgtgagacagatgagttactttggccccggtggtgtttccgttcaaccaaactggaaccagcagcgtcaagcccaatatattaataaccctcaacttggtcagcaaaacaacataatgtcacctcctaagcaacaacaacaatttgtcgttgcaaattgtaagccttcgcagccgtgccaaatcagctctt

SEQ ID NO: 91656 - DNA, 190 bp, Heterodera glycines
  SCN-specific regions: Sequence locations=1-190
atttaatacaccgtttcactttttctttgcttgtttgatttttttcagccgtttttcctgaccattccaaaattggaaattggcccgctaatttttctcgaattttttatggtctcatataacaaaaacgaatgtcttatatataatttagaccgttcgaatacaaacatggctatctttgctacttaaa

SEQ ID NO: 91657 - DNA, 543 bp, Heterodera glycines
  SCN-specific regions: Sequence locations=1-81,112-200,233-331,353-543
acacatggccgccgggcaaggcaacaggtcggcacttcactttggcattttgggggcgagcgccggagggcgacggcatcgttttaataattttatttgaatttaaaaaatgttattcgcttaagtgaggtggtcctttggttcggttacattcgcgggggccacgtcaaaccgccggtggatttaattgacaggcgccgaaaaataaaaaaataataataatgattttattgtttttctcaggacaccctttcattacgcgtgtctcggtggacaagcgaacacagttgaagcgatggtataacacattggagatgaccaattcattggtcaaatactttcttcatttattaatggccggcactttttctgatcacttattttgcactaatttccaatttttgctcatttcatttgtctctttttgagtgatttgtgaagcatttggttctgatcatttctttgtcattttctgatcagttatttttaattcatcgatcatttcaaacatttgattaatgattgtccaatattccccctgat

SEQ ID NO: 91658 - DNA, 569 bp, Heterodera glycines
  SCN-specific regions: Sequence locations=1-192,214-320,342-569
ttaaaaaagggacagcgaaaggaatgggcggaggaaacggccgctggacaagcgaacggacgaacggcaccaccattcgcaacactgcagcggggcaacagaacacagaggaaacaattttgtgtctatccgaggggagtcgccgtacaatttgggggttgtgaggaggagcaattggacaatcgaaacattggggaagagaacacagaacaaaagcaaaggcaaagtgaaagcgaagggaggggatttttgaaagagacgaaacgaagcgaacggagcagccaaaagccgagagatccgcgtttcattacgccgctttgttcttcctcttctgagcccgtaaagcgccgttctctgctggtggagccaatggcaccgctcgaagatcaccacgagttgccggtggtcgttttgcaagaggagcgactgaactcgcaaccgccggtcagcaaggagtacctgcaagaactgttcgttcaattggacgtcagcttcaacgaattgcacaaccgccggcccccctcttcggcatgttcctccggcgccgccccttccgcccaatccgccgg

SEQ ID NO: 91659 - DNA, 550 bp, Heterodera glycines
  SCN-specific regions: Sequence locations=33-209,232-550
ggacgcgatcaagaagaagatgcaggcgatgaggatctagaatgacaaggggatcaaccgggcggacgccgcggaggaaaagtgccatcaaacgcaggaacggttggaacgtgttgaggacgaattgcgggactcgcagaacaacatgatggcgacggagaactacttggacaccgcgcaggaggacctgaccgctgccaactatttgttggaggagaaggagaacaacgtgctcgacgctgaagtccaaatggtgtccctgaaccctcgcttgggtctgttggcacaggagatggacaagcttgaggagtgccttaaacttgccaccgactaaatggaagaatcgacggaccattgcgacaagtcttaacgcgtgtcataaatgatggaaaaccgctctctgctagacgatgagcgtgccaatgccatccaagatcagctgaaggaggccctgtcgctggaggaataactggactgaaaataccaccacgtcgctcgtaaattggcaatggttgagtccgatttggaacgtgccgaggaactcaccgag

SEQ ID NO: 91660 - DNA, 289 bp, Heterodera glycines
  SCN-specific regions: Sequence locations=1-289
cgctccatttgccattcggccgaccacacgtaccaacgatggacccaacctttggctgatggtgcttgtcacacatgggattgtgcctatctgaatcgacggaaggcgcaatgttgggcgatgcaaactcaaacatccgactccatttttgtgaaccctggaatctttgtggcaagaaagacatacagcctacgcgatacaacatgatgctgaagaggaacggcacaactttctaaatctgaatggccgattactgacggactcgttggtcatgccggagatgaaaggc

SEQ ID NO: 91661 - DNA, 572 bp, Heterodera glycines
  SCN-specific regions: Sequence locations=1-11,52-216,240-572
aatacaaacagaaattaaaaacagaaattaaaaattttccaagaaaattaaggttttttagggtccggtggtgccgataaaagccgccgaaaaagttttgatgatttagtgcaattaattacccaaaattgtacaaaaactgctatttttgaaaaaagattaaaaaaaaatttccgactttaccaaaaatttcggaaatcggaattccgtcccatctgatatatactgtatatgaatgagctaccgtcgcacattggcaatctcaaggggggggggggtgcacattgggggatagacctttcagattcctacgtttgtactattaattatttcaaactatttatcaaaattttagaaaagttgcgaaatgttcgtaacaagttttgtatacaaatcaatggctttcgtgtttatgtcactcggattcacattttcgccatcttcggcattccgatcagagagtttgatgagcagtccttggcacagacttttatagagctgttggacacgttcggagcgacaatagaaggtgatcacgacggagatgaacactgcaacttcctcccagtgga

SEQ ID NO: 91662 - DNA, 499 bp, Heterodera glycines
  SCN-specific regions: Sequence locations=1-18,43-470
ggtgcaaaaagatatgactttaaaattaatttttttttaaatccgaaaaatcacgcgaccgttctgaatccagcctaaatccccaaaaaccccacatactccggcgtgctgcccttcatggacttgatgagttcgatgagtgggtttttgtccgtcgatttgttcaacagctcgcccccgtggtcgaacagcgttttcatgtacaatgggctgaccgccagcagcgcgaccattgacggcgtttcgcccgcattgttcagcgaattgatcaacgccctgcccgcctcctgttcaagcagtgtctccaacatttgggtggacacccgggcagcatagtgaagctgaaaatgggaaaaatatgggaaatttgtttgaaaaaagcaataaaatattgaggatgtgctgccattcccaccgatgttaccaaatttaaaaagtaaatcgcaaaaattcgattttacaaaaaaacgaaaaaattttctatataaaaatattaaat

SEQ ID NO: 91663 - DNA, 533 bp, Heterodera glycines
  SCN-specific regions: Sequence locations=1-239,261-533
gcgagcattacgtaaaatgggaagaaagaacctaaaaacttcaaagtcacttcgacccttggaaaatgtcaatgattcggttggaaaaataggggaagacttggaggacgaagaactcgaagaagcggacgacaacgaatcgcttgaagacgaaattggagcggaatcgggagaagaaccttttgaattagaatttgttgggtataaatcggcaacaaagtcggctaaatgtttgcttttggaagcattggaggacaacacaattgcaacttcgcgctttgttctcttcaagttttcggatggcattgaccattctgttcaggttgctaacaaagctcttcaatggattgtcagtcccgtcgactgggaaacttttttcaacgatttcttcaataagcgtgttttggtggtaaatcgtaagaccaaggattacttcgagggtttctttgggactgtcgatttgttcgaaatgctgcaaaaatttgacttggacgttggcacggatgtgaacttttctctgtatgaaaattatg

SEQ ID NO: 91664 - DNA, 602 bp, Heterodera glycines
  SCN-specific regions: Sequence locations=1-159,198-581
attaatttgaatcaccactcaccgcaaaactaatgaaattgtgaaatctacggcttatatttttattaaaaatgcgatcaccacttctccaattaaattctcagtgcctttcttttgagaaataattcgaaatattcccgaacttttacaagattctgcaaaaataaaaaaaaattcaataaaattaacttaaatttcatatcagtttttccaatatcagtttattcggacattttttattgcaactatgcttttcaaggtcgctgaccatgacaagattttttgtatcgccgaagccaaattcgaacaataagtcttaaattcgaaaatctgttttttacccattaaatgatcgttataaaaagttaaaaggaatgacttgtttcgggtttcaatttttgtctaaaatttatctacatgatcgcttattatagcattggcgattttcaatttatttctatgcattttagacagttttagacccaaaagttgaaatttggaaaatttcaactttaaactatgttcgaattcaggtctatctcatatcgaaattgtgatcgcgaccctgaaaatccaagactaacaaagtgttttcaacacaa

SEQ ID NO: 91665 - DNA, 615 bp, Heterodera glycines
  SCN-specific regions: Sequence locations=1-79,133-134,156-249,302 -328,369-415,463-615
gagagagaggcagtcacagcacaatacccctccggggacgaccaaaagcgttgagaacgcaatgaatagagaaaataatgagtgagatggagagaagagagagagagaaagggagaggagagagcgacagagcaaaaggaaaaggcagacaacacgacaaaggagaggagaaaaacggccatttgctgttgttacactgccgggggacgagccaaaccaagttcaaagtgccggtgcgcagcggtttgttttcgttcaatgctaatcagctaattgctcactaattaccccaaataacaaactgtcccctgatgccgacattcgccaacaaatgccttccgctcgaacttctgtacgaaattgtgcctttcatccctgccgaaaatgccgcccctaatgcgctctcgtcctgttcgctgctgcacaaacttttgctgccacgtgtcatcaaatggaaagagaaagcgatggacgaaagaataatcgagctatttgaccaatttaaagaagagatggagcagaaattaatgaacaaattggacgaaattaaagaagaaataagccttgaatttaaccaaaaattcgacgctttggagcaaaaattcgacgctttgg

SEQ ID NO: 91666 - DNA, 525 bp, Heterodera glycines
  SCN-specific regions: Sequence locations=1-176,199-452,474-525
ctggagggccaattcgaatttgatgcgtggcacagaaatgtaaatgcgctgctccaacttgggcctgacccggccgggcctcacccgctcgtgttcaacctttgtaaagttaatcgagtgagttccgatcagtgtccgacgtctgggcataccgccggaggaggcgctgccctcaaaaaaggttgccaaattgccgcaattgtcccaatcttttgccaaggaattgaagccgttaagtgacgccgattcggtggcatttgcaccgtacggccaattggttgccgactttgtgcaccacgtggaacagtccacggaggtgcaatggccgggcgtgccggagggcgaaatgagcgatggcattgccggaccgctggtgcaagagtttgtcgtccgatgggttccggccggcattgaggacggcgacggcgagcccaatcagttggtgctcgaatttgagggcatcagcggctcatttgcgggccaaaaagggcgcccgggcgccgcctactcatccgaactcggcat

SEQ ID NO: 91667 - DNA, 611 bp, Heterodera glycines
  SCN-specific regions: Sequence locations=1-611
ggaatgtttgcgattgtccaacggcgtgcgctgtgttttccacaacaaatcgtgcaccaaaactctgcccaattcgtccttcaggcagtcctttctctcaattgccaagggcgaaacggcgatggtctcttaccaagaacactgtacagggactgccatgggagacaaagatgccgtcgaattgcgcacctgcactttgttgaccgactgcaacaattgtctgcttcaaaagggctgcggttggtgcgagagcagtcagagttgcctcggttcctacgccaattgtgctgatggtttgcttggcgatcgttcgctctgtccgttcggtggtgccaaacagcgtcgtacggatgtcgttgagcagcgtccgtgcagtttggccaccaattgcttctcatgcaatcgtcttccgcactgcacttggtttgccatcgacacgaaacacatttgcgtgtcattggcggacgaggccattcttatcgaggagcacaatcggatgcaaaccgaacggctgtcccttgcgccgatggcggacgatgcgccatctacgaacgttcagcaacaatcgaatccttcctcgactctttcaccacaatcgattatttcaaatg

SEQ ID NO: 91668 - DNA, 648 bp, Heterodera glycines
  SCN-specific regions: Sequence locations=1-527,558-648
tcaaccaccctggtgcaaggaatgccatttcaaagatcattttcgtcaaaacgctcttcgcttcaccggaccccccgcggatgaaagtgtcggaagcgctcaatgcaaattcaatcaagctcagttgggacccgccattggaaccatttggtgacatcactcattacatgatatcatggaatttggtgttggaatacgacacggccaaggcgaccgatgtttgtgacaagagggcctttctctccaacatcccagcggcaaaagttgtgcatccgttcgcttcccaagacacgtgttccaaggagggctgttgcaagtgcacaggcgaaagtcgaagcggcgaagccaatgcccgcggcaaagccatcgacgcgaacaaattgcacgacgagcggaaggaaaagagcaatttcgaagaccaactccaaaatgttgtcttcgtgcaaaagacaataaactcggccgttgcccgtggcggcattcgttttcggcgtgccgttgcgttcgacgccgcaccgcccaatgagacgcgtgaacaaccacaacaacaacagcaggacgaaatagacgaagatgatgcaaaggcaattccgctgctctccgtcgaagtcgcatcatcgcttcaaaccgtgttgccctcctattaca

SEQ ID NO: 91669 - DNA, 418 bp, Heterodera glycines
  SCN-specific regions: Sequence locations=1-127,149-383,405-418
tgaaaatatctttcatattgacattgacgatgtgtacattggtgccattggcactcgaatggttgcagatgacgtggactatttgtccattttgcatggcaaactgcacgaacacattgccaactttcatttcacgcttggcttttctggcaatttttttcgtcgtggtgacgcggcacaaattcaaggagacaacatccttgacatcaatgcgaacaaattccactggttcccgcacatgtggcgtcacaaccatccgccagaattgtctgcggattatctgcttgcattgatgacacgaaatcgtgtgtttgatgagaatggtggcatttgtgccaatctgagctatgccggttcaccacaacattctggggtttatccgatatatcaggctctgtaacatgcctggggcaaaatt

SEQ ID NO: 91670 - DNA, 232 bp, Heterodera glycines
  SCN-specific regions: Sequence locations=1-7,46-201,228-232
ccaatcccaaccataacaaatgtgccactaacaacttgctgctctcgtggcgaacaatggatcctgaatgggcaaggcctgtttcgcggtccatgacgcgctccgcgcggtgttacccatcattgtgggccgaccccgtgatctgggcgtcatggtctctatgggacataacgactcatacgcgcgatactatgcttaactcaagcgaggtattctgactctgaagtcaccc

SEQ ID NO: 91671 - DNA, 541 bp, Heterodera glycines
  SCN-specific regions: Sequence locations=1-168,208-541
ttcccttttccaccttcatggcaaccatttcgcattggtgggccaaacggaatttgcaaatggccgtctttttgctctttttcagcaaaaagtcggcgcagcgattcaaaacggagtccagctgaaaacggtgggccaacagaaggacactctccacacagccatctgaatttttaaattatgtatgaattataatttaataattttcattttctaccatccaactccaaattcattggtgccatcgtgtggatcagtcgctcgaaattcggcacggccttcgcattcccttccaactgaattcgcggggttttctctgcggtctttccaaaaaacaatttgcggaagaaaacggaatgggcagccaaaatctgaaattaattcaaagggaaacatcggaaattgcccatttaatttattgacataattaacgattaaattgtcattaattagctcacgtatttgttcacgcaaatcgtctttccgatgaccaccaaagtgtgcccactttgaacagagctaaaagagagaaatggataac

SEQ ID NO: 91672 - DNA, 568 bp, Heterodera glycines
  misc_feature (246)..(246): n is a, c, g, or t
  SCN-specific regions: Sequence locations=1-2,24-57,81-92,116-314,336 -423,445-568
ggcaaattttatatgaataaattggactgatttcggggaaatgaaccgatttaattcaattaaaaatgccaaaacaaaaatgggggagggcatcatggccttaaatggaatttttccatttttttgtcgcttggtttgtgcccaccatttttctttgaaatttcagcgcggattaacggagtcgcaaagcgtgccgccatttcaaatgcggcggacacaccgtcggcgccgaggcgttcaatgtgngtcctacatcaccggatcagtctgaagccgtcgccagccgaaggtattttttggcttggccatgtcacaattttttaaaatttacaaaatttcctcaaattttagcggaaaaaatggggatttttttatatagtaaatctaccatcccaaaacgtcataaaacggggattttttgtcaaattttttttataaataattcatcaaatgttcaaattggtccgttaaaatcaggcccacattatatgtcaaccaatttttcagttttttgccactttttactgaaatattttgaatttgttgctcttaatttgttgctcttttt

SEQ ID NO: 91673 - DNA, 295 bp, Heterodera glycines
  SCN-specific regions: Sequence locations=1-295
agccaccaagtcgggcgaaattgcggccgctgcagggcttaaatcgacctcaatcgcggatgagcacatcgatcgcatcacttccagcaatgtgatccaaccaccgaaagacgcggcttatttgtcccgtgacatcgccccccgagttggcgtacccgtccatgtcactgcacggactgtcaacaggctttgcagctcggactacaacgcgattgcaccgggaggccaacagatcctcgcaggagactcaaaggttgtgctggctggtggaacagagacgatcagtgaagcgcca

SEQ ID NO: 91674 - DNA, 619 bp, Heterodera glycines
  SCN-specific regions: Sequence locations=1-619
gccaacggaagggcgaaaggttggaccatttgcgaagataatactcaaaagtcaaactcagctgtgccgaggacgaattgtgcacgggcggctcattttgtggcgaaaactccatttgtatggcgccccgggggaaagcgttcaaatagaaaacggaaaagcgaagaaatgcatgttgcaattggaggaaaaggcgcgggacagcagccaaccggtcaaggcggagccgggccagctttgcgtggagggcggcatggaatgttccggaggggccaagtgccagaatggcatttgcagttgccctgagggtacgtctgcttttggcacgaccattggccattcatctgtcgtcccgttgccttttctatcctccctttttttctttaggccacactctcttccgcaatgagtgccttccgcctcgggcattgccaataagcattgagaaaattcacactcattctgccctttttgcgccccaatcagcagtgatggacagtccatcttcagtcggcacaaatttcgaccccaatttacaggatccaatcccatccaaaaccgtttcgcccggagcaatgtgtcggttggtatttagtctgccgatgtttcacgtttattt

SEQ ID NO: 91675 - DNA, 168 bp, Heterodera glycines
  SCN-specific regions: Sequence locations=1-132,154-168
aggaaaaaaaattaaatctgagggaacgattaacaatgttcaatttcttattgcatttttgttgataacaattttccgaaaaatcctaaaataagcaccaaaatcgggagggattctcgaatcgggattccgtccaaatccccgatcccgatcaacccccaatgaatt

SEQ ID NO: 91676 - DNA, 623 bp, Heterodera glycines
  SCN-specific regions: Sequence locations=1-623
aaaataattgctttgattattaacatgaaatatccggaaaatttaattgagtattggttatccaattttcacattaatatttaattgtccaactttgaattttttgcaatttaatccactgaactttttagcagttttaattttttttttttcatctcaaaataagcataatgaaatacctaacaccaaacatatttttgattgttttttaataatgcattcctctaaatttgatcaatcacaattttttgttttgcttttcgttatttaattttattataaacacttttatagggaaaccaacggaaattctctcacttccatattttatgcttaaatgcgatttggacccatttcgttccgaggccaattccatgtctcgaattcttagttcatgaaccgtgagcatgtctcttaaccgattttctgatcggtctaaattttggtcaaatctcggctatgccaattttgacattccaaaatttggcgatggcgatcaggccctaccttcttcaaataattatttggccacagatttgtacaatggcgcaaaaaaaagttttaacgggatttttcccggtcccggtcaaaatacttaagtactatcagttgtacgtgttttt

SEQ ID NO: 91677 - DNA, 626 bp, Heterodera glycines
  SCN-specific regions: Sequence locations=1-390,412-626
cttttgactacggtaaccgtactctgagagggcggttggccaacgatagtgggcacagtaacgcggcggaaatggtcggccttttcctgcaacaattggcccatcatgacaacgaaaactgtgtgaacagtgcaaggagtccacggcaaaagaaggaacatgggcaacaacagcagcaggttaagaagatgaataaatggtcattggctaattatcttttgcatttcaaggaccattctctagcactgtcctttgtcgagagtttgttgaatgcctccaacaaagtgccattgtcggaccatttgccgtcaacaaaaggctgccaattgaattggcaatccaccggcattcgagagcttcgctcagaatggatagtcgatgcagcgcttaaactgaacccgcaaattccgcgccatttaaggtccccgggttaataaatgccatggcattggcactttctccgctttaaaaaagcaaaatttataatttagtaaatcattggcacttaatgccatctcacgcatcgatctgtcctccaatcagttgtgctctgtgccccatattctattcacccatttgtcctcgctccgttcattggacctctccaaaaattgcattctgcgctt

SEQ ID NO: 91678 - DNA, 641 bp, Heterodera glycines
  SCN-specific regions: Sequence locations=1-198,221-641
tgtcttcatttgctaaattggatgctaaaaaagtgcttattgttgtgacgggagcaagccgtgggattggacgggaattggcccttcaaatggccaagttttttgcgacgaatgaatgttttttcgttcttttggctcgcggaaaagaagcgcttgaggcggttggggatcaaattcgcaaggagttcggtgtcatttacaacttatacaaaggcctagactaagcctttgctttaggcttaagattgcttgggctcaaccgcctattatattttcaatatagtttttctgcagaaacccctcggctgttgttgaactcgtttttgcggacttggcaacacaaccctttgcgttgggcagcattaacagccgaataaaggcgtggagagaaaccgttccgtttgacctctgtttgctcttccacaacgccgggactgtcggtgaaatggccaaaaaatcatccgaactaagcgacgaggcgcaatggcacgagtttttgcaggccaatttggtgtcagcgattttattgaacaacggagtttatgcggccttaaacaatgcagagtcggtccgtttgttcatcgtcaacatcacttcgctgctgtccgtaaaggcatttccctcgtttacccaatattctg

SEQ ID NO: 91679 - DNA, 570 bp, Heterodera glycines
  SCN-specific regions: Sequence locations=1-321,343-570
gtttgagtgagtctagaatatcttaatttgctcaaaatgtcttgaaaatggttggttgtccaccaatcgttgtccgtaacgccaacactcctccgacggcaccgttttggtgccattggatcaacaacaaacgcagaggcatttagtccaacttctccgtcttccgccatggcaccgtcttcctcctctgctgccgccatgacaccactcggcgtcattttggtgtccaaggacgagtcggccgatttttgtgctgttcatgtacccatttgagcgccgtgtgtcgccgcactccgcccacattaacagcagggaaaagtgccatgagcacaaggactcagtggtgtcaatgattggtaaagacgtgccaaagttgggcggcggcggtacgccggacgacgtgccgtgccaaccagctgcaattgacagcggtgatcagcaacaacaacgtctctgcgacggcattgcgttggacggcatttcgactggttttcccgtcaaaatgttggcccctttgctcgtcgccaaaggctccaacggaaatgggacgccttttgatatcaaagtgga

SEQ ID NO: 91680 - DNA, 625 bp, Heterodera glycines
  SCN-specific regions: Sequence locations=1-36,58-80,104-153,176-625
cgcctttttcgtcccttacattgtcctttttctgctcattgccttgcctatttgtttcattgaactgtcccttggccaattcatcagtttgtgtcccctctccgcttggaaaatgtcgccgctgtttaaaggcatcggtgtctccatggtgttcatttcgtgcatcatctccatttactacaacatgatcacttcgtgggccttctattacatgatcaatttgctcaaatttccgctgccgtgggcaacttgtgggaacagttggaacaccgagaattgctccgtttggaataagggcgctgttgagacgtgtcgactgctcagcggcgtcattttggcgaacggaagctgtgccaattttggcgagaatttggcgaccgaatttggcaaaggcaacgacagcgcagtcacctcgttcaccgacggtccgaaggcgggcggagtgatgccgagcgtggaatatttccagtcaaccaagttctgatgctctcttccggcatcgtcgacttccaaaccgtcaattggcaattggcaatctgtctgctcatttcttggcttttcgtctttctgtgctctttcaaagggatcaaaacgagtggcaaagttgtctatttcatcgtcatct

SEQ ID NO: 91681 - DNA, 626 bp, Heterodera glycines
  SCN-specific regions: Sequence locations=1-5,27-626
gaagtacgaagaggaggaggagttgcacaaacgctttccgttgatgtcgggcgaaggccattacgacccgagcagaactgacgcgcaccacaattgcatttccagaccttgctatgggtggacagtgccggagaacagacgcgtctttttggagggggacgttcgagtggacattttccagaaatcgcagttaaaactgttcaatgtgaagcaagagaagaaaaagattggccacatttggttcaacacaatgttcacatgcccgggtttttgcggagatgcttatacgcacggggatgaggagtactcctacccggaggcgatgattgtgcggcgctgttacaaaagaaaccctcgccagccgaaaaacacggaaaagcggcagggacagcacgacgactcgaacagcgagaaggaggacacgggcagaggcagggaaaggtccgtcccagccgcgaatcgacttggcggactgcgtctaaacggaactgctgaaaccgcaattgttcccgaaaagaagcgttccgcacgttcgccgtgccgacaactcattgaaatggaatcgaggaattggcaatcgcaagatggtgaagaacacccacacaaaacgcaccagtcagggtgtc

SEQ ID NO: 91682 - DNA, 585 bp, Heterodera glycines
  SCN-specific regions: Sequence locations=1-116,138-312,334-345,367-585
cccattcctctgatggttagtgattagaatcactttcccccaattgtttgttaagctgatgatgactcggtctgtgctgacatcgaccgatgggcgtgctcttcgcttgaggaggaggaaaactgtgccaatggcgcatttcggcaaagcagcgaatcgaccggcagaatcaaagagttggagcagcaacagcagagactgagcgaatcggtgatgcaactgagcactcactttgcacaagtccaatttcgaattcagcaaattgcaaaggcaccggacgaacagcgaaatgaaatgatcaaacagctgcaggaattcgcttcacggagttgcatcgatgtggggacacttcgaccagcgaaagggtcggaaggagcagcggaagagggacagcagcagcagcgggagacggactacagaacggctcagatgcgccaactgattgccgacctgcgccaacagctcaccgagttggagcagttcgcctggcaaaacggacaacttgggcccggcgaattgccattgagggaattgcgaagccgacaaatgttgttgctggacaaactgcgggagaaaattcgactg

SEQ ID NO: 91683 - DNA, 625 bp, Heterodera glycines
  SCN-specific regions: Sequence locations=1-123,145-372,395-416,440 -460,482-536,569-625
tacaattgtaaacggattgtaaaccggaaggcgaaaacacataaaaataggcttttttcgacctttgccggggtataactttgttcgaatttgtcgtagagctacgaaatttttttctcacccttcctctcgacgagctctacaaattgttcgcttaccgcaaaagcgtagctctgagggttcccgagaaataaggtgaaaacacacattttacaacccatttttggccagttgtaaaaagccgggtttttttcgttcgaacgcgattttctcgaaaatgtctgcttgtcgctaatttttccacaaggatagaacgatagaaaaaaccgagctctttcgaatggtaccggtcccgtggcgatccgttgcgtagttctttgcttctttttcgtttagtggttagctccccacatactttataagcaaaaaataatattttgccggaaatataaatttatgatgaagaaaaaataaaagattgaatcgtgtgaaacctccttattgattttaggaggaaaagctggaaatttttatgcatttaaatattttgaataaaaaatatttataagaagttttttcttccgcggtttttgaataaatttaaaaataaagggattttggagct

SEQ ID NO: 91684 - DNA, 337 bp, Heterodera glycines
  SCN-specific regions: Sequence locations=1-337
acttattccagagctttttaaagtgcttggagagaaagttgaaatggaacgtcaaaagcatgggtcacaagatcgtgttccgggcggaacaattcctttcctttgggtttagtccctttatgtgcttggcggccttctccacgaccggtatttgactccggctgaattggaccctcttagcaagcgattattggccactgagaaacgaccgccctgagaagtgcaagttgtgattctcgctgaaaggccaaatgttaaggaataattgttgacaaatgaagtcgaagtgcaaatgattagccaattggattcgaaatacgcttagcttcccccctca

SEQ ID NO: 91685 - DNA, 651 bp, Heterodera glycines
  SCN-specific regions: Sequence locations=1-328,370-393,417-651
atttcatcgcccttttatcaaaaccctgctttcgctttcatacgtttccttcttgcagtaaaaggttctcctacacactttcagtttttcattcattgccaagccgtttttctcgacttcgattgtttaggggcgaatcccataaaaattatgcaactgcagaaaacaaaagaccttcgagacatttaaaagatctcactctgcgagagcttcgcgaaattgcgacccttgcatacccacacagaaatacttattttagcgggcctttgctgtctttgtgtcagttcggtgattttcctctcagtccctcgaattctcggcaaactcatggatgaaatgaacaaagaaaaggaaaagaaatctgactttatttcgaagcttgtccgacttctcaaagaaaatccttttgctttgctcgtcatgttaattgtcggtgctggggctatcggcttgagagcgtatttaatgcacacggcgggccaattagttgtaaacgatttgcgaaccaaagtgttcaattcggtccttcgccaggacatggcgttcttcgaccgcaacaaagtgggcgaaattgtgagtcgcctttctaccgatgcttttgtcgtcggttactcggtgtccaccaatctcagcgaaggcatccgtgccatt

SEQ ID NO: 91686 - DNA, 635 bp, Heterodera glycines
  SCN-specific regions: Sequence locations=1-22,45-116,140-635
gcaggagcagaaacaacatctacaccaccaccaggaggaggaggggtcgaacgcgttcaaatcgttgtttttgttggcggtggacaaagatcatcagcaggacaaggagtttttattgaacgacgacgacgacaacaaccagcaccaccgagtggaggaacagttgccgttgttgttcattgttggcagcaccgttggcaccgcgttgcaccgactgttgttgttttttgcccgcacgacgcccatgggttggcccgactggctgcagccgcacattgatgccttcgtgctctgggtgaatgggttgctcgagtattggcatctcggctacttggaatacctcgtctggcttctcctcccaattttcattgtgttcgttttgcccattgtttttctgttcttcagctacggttgtgtgattttcttgcgcatttacaagcatcggaatcgtatccgagaagcgtatgcctccagcgtttgggacggtgcccgggcgagcattgccagcttttgggaaggcgtcggttacctttggcatggctacgaaattgatgggttggagaacattccggacgaagggcccggcatgatcattgcctaccacggacccacgcccatcgatctctattatgtga

SEQ ID NO: 91687 - DNA, 630 bp, Heterodera glycines
  SCN-specific regions: Sequence locations=1-279,301-630
ggagcactgacatattacggcaaatttatcaaagaaatgcgtgagctacgaagcccgctggatgaactgctgaaaaaggacataaaatgggaatggagtcgacaacaacaggaggaatttgaaaaagcaaaggaattatgctttccgacctcctgttgacccattacaacccaaaattgccgataattgttgcagccgacgcatcaaaggacggaatcggcgcaacaataagccacattttggccgacaaatcagaacgtgtcgttgaacacgcgtcgtgcacattcacagcggcacaaaagaattatagccaaattgaaaaggaggctcttggtttggtgtttgcagttcagaaatttcaccgaatgctgtatggtcgaaaattcacactgctcacattctggctatttttggatcaaagaaaggaattccaatttactctgccagtcgcctgcaaagatgggcactcatcctttcaaattatgaatttgacattcgctatgtgagcacaaccgcatttggaaatgtcgacgttttgtccagactcatcgccaattacccacggccaaatgaggacattctaatcgccaacatttgcaacaaaaccgaatgttttgtcaatttggtttt

SEQ ID NO: 91688 - DNA, 619 bp, Heterodera glycines
  misc_feature (601)..(601): n is a, c, g, or t
  SCN-specific regions: Sequence locations=1-27,50-55,78-177,199-619
attctcaccatttcctctcgtccttcgcttcctttcctttcgctctttcgtcgcttttcctccgccctttcgtccgttgtcttacgccttttctctgctcattgaatgcggggattagcctccattgatcagctgatcacctcacaacagcaaaaggccaaaggacaaagggaccgacgggggaaaaggccaaacggaggccgaaaaagcgatggttttgttcaacggaacggccaaaattcgggtggtcgaagcgcgcgaccttcagcccacagaatggtcgaaaagattcaaccagtcggacgacccggacagccaattggtggatgcgtatgtgaatgtcgactgcgatgagtaccacgttggcaaaacggtgacgaggcccaagaccaaaagtccggtgtggaacgaggactatcagaccgaggtgcgcaatgggaaggaactcggcttcaccgttttccacgactgcgctttgccgccggacgatttcgtgtcgaactgtcgcatcactttcgatcacctcaaactgatgggtgtcaacgacatttgggccgacttagagccccatggccaactccatctccaaatcgaactgcanggcaaaacggccgaagga

SEQ ID NO: 91689 - DNA, 590 bp, Heterodera glycines
  SCN-specific regions: Sequence locations=1-569
cttattttgacttgacttctctgttaaatttctattgaaatggataatgaaaacttttcttcctcaaactccaaacagcaaagcaggaacggtggtggacgcgtcggttcacccttcagaaatggttattcgaacagtggtagcaatggaaaacacggcggaagcaacgattccagaaaaagacggacagttattcgacgcgtcaacgaaaccgcgagctcttcccacgcttgggattcgtcgcacgtgtggctttctggggaggagaagtcccgacttgaagccgttcagcgggaatggcgcctgagtcggccaaaggccaaacaacagttgtggtccaagcagcaaatgggcggcagcggaggtcgcgtcggctctctgatggaactaacgacggacagcgcggagcgcaaaagtttggacgctctgaccgagtcagtcgcctcctcttcctccgtgcacccatcgccaaattccgtgttcacccgaaacagaaaagtcacgtcgcccccggcattggcgggcgattccgtgctgaaaaagtcgtcgccgcctgccgcgtcgtccattttcaattctgctgacaaaga

SEQ ID NO: 91690 - DNA, 587 bp, Heterodera glycines
  misc_feature (247)..(247): n is a, c, g, or t
  SCN-specific regions: Sequence locations=1-62,149-197,220-436,458 -526,549-587
gaagattttaatttttgcaatatgagtaccaatacgcacaatatatttgcatatatcatttgattatttttattattaatttttttaatagaaattttacttaatatttatataaatatattttttgttcttgaattaattaaaattagtcttttgccgcggtaacgaagaaatgataaaatgctctccaaaataaatttttaacaacacttcaaaaataaatgcattatggtatcttcatatatantttttatttcctatcaaaaaaagggtctgtatcagggatgggccaaattgaaaaataaaaagcgaaatgcgaaaagcgaaatttgcgaaactgaaaaatgcgaaatgaaaaaaaaaagcgaaatgcgaaaagccaaaatatgcgaaaatgcggaaagcgaaatgcgaaaagcgaaattttttctacaactttttaatagttaaaatcataaagcaaaaatcattttttaaaattttattccaaatttaaaaatcaataaaacgcttttttgaggcgcgctttttccaaaaaactttttgggaagagggggcagacggcgccggcaggcgccgccgggaaa

SEQ ID NO: 91691 - DNA, 643 bp, Heterodera glycines
  SCN-specific regions: Sequence locations=1-58,80-99,145-207,229 -329,362-429,488-567,594-643
ggggatttaatgttgtttaaacgctaattgatttggaagattaatgtgatttatggcattttttaaaccaatttttcattcggttcgatgacatcactcaaaattttaaaaaaaatgaaaagaaattttttcttaaatattattctgtagcctctaagtgttctcaattaacgattgaaagattgtttattttgattgctaaagtcaaaagttatggtcaattattttttgattttgaagattaaatccgccgccgatgaattaatttatttgagggattaattaggtaattaaatgccaaattttggtcagccaaagaaaataggcacaattaaaatttttataaaaacattttaaaatagaattgatcagccatttttaaatatgtgcattattaacatgcaaataaaatttggtggattttagagcatattttttgaaaaaatatttataaattaattttgcaaaaaaaatatattaaaataatgaaaaactcagaattttttcaagaattttaaaaacaataagcgttgaaatattttcaggttaagaaagggttaattcaaaattaggtaattaatttttaaaaatttgatcatccacaactcattttaattgatcaaaagctcgtcaaattttgcgg

SEQ ID NO: 91692 - DNA, 644 bp, Heterodera glycines
  SCN-specific regions: Sequence locations=1-6,36-331,353-644
gtttgaggaaataattttttcaaaaaatgtcttccaatccagcgctaataaaagaaggctttgtggagaaatacaaaagcggctttttgagcagcaaatggaaatcggtgttcgcccgcctctattcggactccacattggcactgtacagcgaccgggccgattcacgtccatcggaaaccattttcctcaagaatgtgatcccctatgtttgcattggctttatgacagaccgaatgccggtctgttgtccatcacttccgccgggcactgcggtgcaacgtttgattggcattggcatggacccgagagcagagaaagtccattggattttgttcccatctgagcagattttagaggagtggcttaatggcattatgtcgacgctgccgccaccgccaaatccgccgccgcaacagcctacagtaccacagcaaaacatcggatttgttccaccaccaaaatatcctgaccaaccgccaccctatggtggtcagccgatacaaccgcaacagcagtcaccgtattacccgcctccagcggcgggtgggtacggtgcacagccacagtacccgcagcaacagtacccgggcccacagactgtagtcattgacagggcaacaaccccgagcggaggctacgga

SEQ ID NO: 91693 - DNA, 551 bp, Heterodera glycines
  SCN-specific regions: Sequence locations=1-80,102-243,266-424,446-551
atttgctaagccttttttttcttcgtttcggcttcatttgtttccgtatgctttttgttttgtttttttgccatcactttttgcttaaaatatttttcaccatggcatttcccattgctttttccatttttggcattttttcagtgcttttcggtaataaaaatgatgggcccaaactgcgcgtgaagcgcagtagcagcgtcgccagcagcgcaagtgccgccggtgccatcgctggcggtgccaatgccaattcgaatgccaacaatgcgtttgcatcattttatgccgatgatgacaataccgttttgtgttgtgtgtgccctgcgccgatgacattaggcgatttgaagaaaagttcgtcgaaaaaaaataatgaaaaattattttgaaagctttgcggcttttcactatttaaaattttcaaaaatccatttttaaatggcttaaaatagaaaatttgactccaaaaagtgcctgttttgcttttttgctttcttttttcgtttttcgatttttagagcctggtcttcccgagaggccaaaaaatg

SEQ ID NO: 91694 - DNA, 626 bp, Heterodera glycines
  SCN-specific regions: Sequence locations=1-340,362-444,469-626
ccatcgtgtcgtcttctcccgtcgtttctgaggtcattttgccactaacccctgaaaaccaaatttacgaattaaatttccattatcaaaagacctgacacaaagaacagaaaatcgccgagcaatttgaccgatgcttgccgaatccgccagttctcgtggatcagcgcggattggagctgtgggatcagcaactttcgagcgtgcgtggaagaggcggtgatcaaacgtttgcccgcaattaacgccgactcgcggacgtattccgtttcatcagccaaagcctggcaaataacagaaagacagttaaatattgtgctgcaatgaatgaatcaccttcagaatggaaggaatgattttggaaaggaatgggatgaaactgaaaaagtattgaaaagttaatttaggagaagttgaaattggactgaccgatctccgaaagccatgggcaaataaatgtacaattggatgtacccatcgcgaatgtgtggctgagtcgtgggtgactcggtaatgcgaataacgccgggcaaattgtcagacagaaattggtcgccaagtgccgaaatgacttcggaaagtccttgcgccgccccttgccggtcccacgaagaggagggcgaaac

SEQ ID NO: 91695 - DNA, 626 bp, Heterodera glycines
  SCN-specific regions: Sequence locations=1-10,33-151,173-385,407-626
tcgaggagacaattcaaaacaaatggcaaaaggcaaaagtctttgaaaaagaggcccctgaagaagacaaatcatcaactccgaaatacgtggtcacttttccgtttccttatatgaacggccgcctccatctcggacacacattttcgttgacaaaatgtgaattttctgttggttaccatcgcctgcgcggccgtcgctgtctgtttccattcgctttcctttgcaccggaatgccaatcaaagcatgtgctgacaaactgttgagggaaattgaacaatttggcaatccgccagtgtttggctaccaaagcagcgaagaaatgtcaaaaaacgggacagaattagcgaaacaggaggaggaagtggaccaaatcatcaaggacaagagcaagggcaaaaagagcaaggctttggcgaaaactgtggctgccaaattccaatggcaaattatgcaatcgttgggcctcaatgacgcagaaattgccgagttttccaaatccgagcattggctgacctatttcccgcccaagtgtatggcggacctgcgcaaaatgggccttgcggtggactggcgacgtgccttcatcaccacagagggaaatgcctatttcgactcattcgtg

SEQ ID NO: 91696 - DNA, 583 bp, Heterodera glycines
  misc_feature (200)..(201): n is a, c, g, or t
  misc_feature (207)..(207): n is a, c, g, or t
  SCN-specific regions: Sequence locations=1-4,28-156,189-583
tgcgattttgtcactttttcttttcttaattcacattttaaggtataaacggcaaaaagaaaaaactccgttggtcggattgatggaaagcgctttgccactgctccaagaacgactttcaactttgttacccaaccaaagccaaccgtcctgcatcctccaaaaacaaattttaaaaattttttactgcctaaaccatnncatganaaaccttcaaatcctatcaatggaccagttcagcaaatggctccatttgtttttggccattttggagagggaagtgcctaacgaatgcaacactttgccagaagatgaacgggccgagacgttgtggtggaagtgcaagaaatgggcgataaaaataatacaaaggatttttgaaaggtatggcaacaaaggcaatgtggacttatcctactccgatttcgcaactcaatattccaaggacttggtccttccggtgatcacctcgttgatggtgcatgttttgaacaatttcatcaacgggcattttgtgtccgacgaagtgtcttatttcacactcagccatttgtcggatgcgatgaatcaggcgcaagtttgg

SEQ ID NO: 91697 - DNA, 591 bp, Heterodera glycines
  SCN-specific regions: Sequence locations=1-55,226-228,251-380,402-591
ctccgctgtgctctgttctcccagcgcttcgtccacggtggatgcatcggcggtgtccttcttcttgcccttcttgtccttcttcccgtgcttgtccttcttgcccgctttgttgtcgtcgctcttccccgcctccttcgatcggtgtttgtccttgcgcttctcctcctttttgtccgccgctggtgctgctgctgcgccttcgcccttcttgtccttcttcttgtgcttgtcgcccttgctgccagccttcttctcctccttgtcgccggcggtcgtcgcttcttcgcctccttccggcttgggcttctcctcgtcgtcgctcttcggttggtcgagcatcgggccgaggtacgccttccaacagtactgaaaaggacaaaaatgttatgaaatgcaaattgaaaaaataaagaaagcgcagcattacaattcctgctccgaaggcagcagcagcgatgaataggtaagtggccattgcgttgcgttgcgcactgaagcggttcgttggttggagtgtggtgaagaagaagaagaaatgtgaagcggagggaaagacgaccccttttatacggatccaattctgctgga

SEQ ID NO: 91698 - DNA, 549 bp, Heterodera glycines
  SCN-specific regions: Sequence locations=1-13,40-50,72-474,496-549
gttttaaattttgaaaaacaaatatttatttctcagatattcatttagagaaaatttatttatttaataaagcgaaaatgaatgattggataaaatggcagaaggatggacggacgaaccgacaaaaaacgatggaattgaaatgattcattcatttgctggcgatcactaaaaaagagttggactgaaaagccaaaagcaccacaaatattatgtgaaagcaaaaaaaaaacaattagtattcaaatatattttgatgaaatcgcctaaaaatgtaaaaaaataaataaaatcatacggaaaaagagaataatggaatttggataaaatatttaattgaaaatagaataggcattggaatttctgttcaagatttaatcataatccacaggatggcattcttgtgcgaggaatggcaagaaaaagcgcttgtcttcacaaatgtgcaattgtcgcttacaagatgccaaatccaattaatttacaaagaaataatgtttgaggctgcatttgcacttttttatttgcctatttttcttttttctctta

SEQ ID NO: 91699 - DNA, 530 bp, Heterodera glycines
  SCN-specific regions: Sequence locations=1-143,165-169,191-382,404 -414,462-530
gcacaaaaagttttacacacgcaaaaaaaaaaataacaccaatttcacggcataaacaacacgatcatcgtcgcggctggcagatcaaaaatcgtgctgtccaccagtccgtctgctgcgagccgccccgccccccaccccctccgggggcaatttggggaaaagaatttgggtgtgtgtgtgactgtgacccatttacggcacagcctttaaaggtgcccggaggaggaagaggcgattagccgcatcttttcagaagcacagcgccttaaaaggcgttgtatggcgcggctgtcaccaaggcggggagagagaaagtaaagtaaagttggaaagtgatctgacagctgagttgatgaggcaagaaagttggtgtggttggcatgtgaaaatttatttaattgtcaaatggagttttaaaagatttaatttaatttgaacaaatattaattaattttaatggaaaatcgaatactgtattgaggaggatgatttacttacttttgagaaaccatccactgatctcaacc

SEQ ID NO: 91700 - DNA, 639 bp, Heterodera glycines
  SCN-specific regions: Sequence locations=1-53,78-81,103-205,227 -268,299-639
gaaagcagcagcacattagtgggtaatgatgacgataatcgtgtcattagctcattttataattattattattaattgcttttttgtcatatcattagctccttcttattattattttaatccatttgaatgtttcgaaatgcaatttttcacttttttaatcttttttattccgttcgaagagcaaaaagaggtgaggtaattaaaaacattgtaaaaatatttaacaataatagtaatttgagctcgacctggtcctggttccagcaggcctgggctttcctggacttgggtttcctgagtttttgtcccggaaatccaagtccaattcaaatataaaaaaatttaggtccaggtttggcatgaaaaccaggatttcttgtgtaatattttagaacttgttatttcgagttaccgatttgattgctttaacaaaaaaactgaaaaagtctaggcccgacctggatccaggccatgacaagcctggatttttctgaatttttgtcgaggaaatccaggccaaagtccaacctggaatccaggtccagaggtccagcttttttttcaaataatcgagatctgataaaaacgattattataaacaattttatgtgtgttagagatgtcgcgaattttgac

SEQ ID NO: 91701 - DNA, 592 bp, Heterodera glycines
  SCN-specific regions: Sequence locations=1-592
gtgaccgccgcttccaccgttccgttgagcattcagaatgaaattttgtggatcaaacaggacgctctccaagttcgcaacgccgtcattctcttggagcaggagaaggacagtcttcgcaaagcaattcgcaaactcaagttggagaatggccgcctgaagacaaaggtgaaaactttgaacgaaaaggtggcaaagattagtaacgaggaaatggacgatgaagagggaaaattggcgcctgaatcttaattggactatgacgaactaaaccgaggggatttctacctaatcggaggcgtccatgacccgatcagtcttcgttttgaagctgcgatccgtgaccaaaatgccgtcgaacataaaagtgccgaacgctactactggtacaaaatggcggaattctttggcgacgaggaagccatgaagagcattctgcacgcgcagaatgtccaacaggccgaagaggccatgaaaaacatcaaaggcttcgacgttgccgaatgggacaaagtcaaacttaaacattgggaggacggacagcgactgaagcttgagcaagtccgttggatcgaaaatttgctggtgctga

SEQ ID NO: 91702 - DNA, 606 bp, Heterodera glycines
  SCN-specific regions: Sequence locations=1-197,219-225,247-606
cgaaattgtcaaaactcgtgaaaatgaagctggatgagtctgaggcctttcgtacgttgttcactcccgaacttacccgactctcccaactgtttgaggggcatggattcgagattcgaatcgccggcggcgctgtcagagaccttttgatgggcacgcgaccgtccgacgtggattttgcgacggacgccacgccaactcaaatgaaggagatgtttgagcgagaacagatcagaatgttcaacaagcgtggcgaggagcacggcacggtgacatgtcggataaacgaccgcgagaacttcgaggtgacaaccctccgcgtggacgtggtgtgcgacggacggagggcgaaggtcaacttcaccaccgattgggagttggacgccttccgcagggacttgaccatcaactcgctcttccttggcctcgacgggctcatctacgattacaccggtggcatcgaagacgtcaaacagcggcgcatcatttttgtcggtgaccccatccaaaggcttcaggaggattatttgcgtattttgcgatactttcgcttcttcggccgtttctcccaattggacgcgccccatgaacagaaaaatttggaag

SEQ ID NO: 91703 - DNA, 391 bp, Heterodera glycines
  SCN-specific regions: Sequence locations=1-41,63-391
tgatttgtaaaatttccaattttctctatgtccccttcggctttgttcgtttgttttggcactcggcagaaaggaggacgcaaaatgccgtgcacaaattgtatggcggaatacacacgacgcagaaaagaaatcggttgtgccgtttgtcgtttcggcttttgcgagcgatgcgttagccaaaagtgcgcagtgccatcagtgtccccgaccaaaccggtgccggtgtgcaacaattgctacacattgttgacagacccaaaacggcagtgtccgcaggcgagtcgcctcggggctgaaaagtcgcgcgatttgccaccgattggcgtgcccttcgagcaaaacgcatggggcactgatcggttgccgcccccgtcgctgcgctcgttgt

SEQ ID NO: 91704 - DNA, 379 bp, Heterodera glycines
  SCN-specific regions: Sequence locations=1-115,137-357
cacgacagtaccagtattacagtccccatgattcgggagagcattcacaattgagtgtgatgcttcgaaaaaggctattggagcagttctccttcaggaaaatggtcctgttgcttacatttcaagagcattaaatcggcacgaaacaaattacccttcaattgaaagggaggcgttggcattagtttatgcagttaaggaattctcgccatatatcgttgggtctggggttacaaaagtaataacggattgtagtgccttaacaggcatgatgaaagcgaaggagctaaaagggagacttgagaaatatcaagtaactctccaaagtttcgaattagaaattatttatcggcctggaaaaaaaaaaaaaaaaaaaaaa

SEQ ID NO: 91705 - DNA, 648 bp, Heterodera glycines
  SCN-specific regions: Sequence locations=1-269,291-499,522-648
attttcgatgacaaccatcggcgaatgattaacacttcaatgcttctcgcgattgatctccacaacggtcgcctcgtccgaaagtcgtttccgctgaacagtcgcattccgacgccgcgcgacaaaacgacgtcatgggtcgcggacgacaagttcttcatttttggtggctatggcatgagttggcatcggcttgaccatgcccaccaccaatatttcttccgaccccacgactttctcgacgactacatgggcagttgttggaataaccaattgctgttctatgaccttttgcttgagttgtggctggaggcgccccacggcggcacaaaaccgtcggcgcgcgcagcggcggcctccgcctactcagccacacttaacaaagtgtttttgttcggtggacgtcatgaccaaacgcgactgaacgaccttttcgtgttcgacttggaccaaatgttgtggacacaaatcgagtcgtccctcccctccgaagtgtccctttcgcccgggggtttgccccctcttcgccccgagggtcgttcctggtgcacttttacacttgtggaagcgcagaaaaagattctttgtttcggtggactcgacaccgccggaaggcctttgagcgacctttgggagttggacatcgcg

SEQ ID NO: 91706 - DNA, 638 bp, Heterodera glycines
  SCN-specific regions: Sequence locations=1-398,420-638
atgaatcgcggaaattcgacattgattggtgtgccactgtgcgaccaagtttctacgattttgagccacgttttgacgagatggctcgacaatgtttcgtcccatttgctattggcattttgcacttcttgaaggaaaagtttggctgacaacaatgctggtgacatcaatccaagcgggtcgtacactttggcaatgtgtgatagaattgtgcgcttggtgattgttccctcgaaaattggcaatttgaatgcgatacgattgtgtttcggcttccaagcgattccaagaacttttgtctcttccaattctttggccaagtcttcggctggcaattgtttgagcccttcaatgtcggtgccgtaaaattctcggattatcatgccggctgctttgaagattgatttggcttcattgaccactgatttgagttgttcgtcggctttcatttcgattagaatattatcgacgtaaagattctcgtcaatgcgttttgccaagtcgttgtcgaaaagtgaaaggtgttcacggatcgtggcattaagcagaaaaggcgaaacggtcaatccgaagcttacacgactataacgaaagaccaaaatgtcttctcgttttagaggggttaattcggcctcttt

SEQ ID NO: 91707 - DNA, 646 bp, Heterodera glycines
  SCN-specific regions: Sequence locations=1-252,274-473,496-646
agttccttaactgtttgcaggtcgcgtaatcggattacttttggatgggttggaacggcgcggtttggcgaagcgccagtggcaattgccaattttcggtagccaatagtgaaaccgttacgcgttttaacagtctgaaatatgggtacgttaaaaacaaaattttttagtggtatgagaggccaaaaccttttgatcgtgttgccacgaaatcacggcatcctgaactaattgaattctgcttgtcctgccaaaaagtaaatttgggtcaatgccctccacgtcgaaggccattgtgacctgtccaaccttaaagattgactgcatcaggcttgaacagacatctcaacctgtctttgattggccacacgcttaacgaatccttcggcgcctgagataaaaacgatgcgatggtttgatgtgccagcaacttcgtccctttccaataaatcgcacagctcttgaacaacgcaaacacccgcaacaccgccacccaccaccacgtaatcaacatgtagaacccgagcatccataataaagtgtacaagtaattcttcgatattttcggaacctggaaatagggttagacaaatcgggtccgggtaaagatatttacacgattctgtattgactgggtccaaaagca

SEQ ID NO: 91708 - DNA, 357 bp, Heterodera glycines
  SCN-specific regions: Sequence locations=1-88,110-357
agaaaccgctgatcagagccgagaacggtggaatggaaatcacccgccaaccgctggaccaacgtcggcatcatttcggaaagccaatgggccatggattgggcatttcgccaccaatttggcggataatcacttcaaaattgattttaacattggcgcaaaattgtcgagaatttcggaaagatgccaatgactcattccattttctgtcccccacacactcactacggttgcaagtcgtgccggtgccggtagagacgaatggtcgggtaactgtgcacgtattcaccgtcgcaaatgtccgggaacgcttcgcagtcgacggagccaaaagacacccaaaaaaaaaaaaaaaaa

SEQ ID NO: 91709 - DNA, 604 bp, Heterodera glycines
  SCN-specific regions: Sequence locations=1-135,157-372,399-604
gtcagccaatagctttacaaccactgaatttaggtgccaattttgaaaattgaactcgcatttccataccacgggatcaacgtggacataaattgcaattgcgtggccggcattttcaactcacatttaatttaccattattcaaggtgagattgtgtggtttccgtttgagttaattgtttcttacttttcaggctcgatgaacgttttgtccaaatgaatataattctgaaagaatgggggaaagttaggcaagtcatcgacccaaggtgggattttctttcttggagcgattgagcaatttcttccaatttagattcgggaaaatcaacagttacacgatgactctgatggtaatgcactttctccaatgcggtgtttttcccccgattctgccgaatttatacgccctttttcccaaattgtttgacggcagcggaaacgtggaagatttgcgttatgacgtcaacattaagcctaatttgcctagtctgtcttattttttggggtcttggcagttcgtacaataggcagttcgtacaatggagtttcgtacaaaagccagtttcaatttggcgtttcgtacaataatcaaattttaaaa

SEQ ID NO: 91710 - DNA, 337 bp, Heterodera glycines
  SCN-specific regions: Sequence locations=1-205,228-337
ctcattttctcgtattttaccttcttaagacagtgctttctatttgacaccaaaattaattgatttgactcaaatagtgcaatagaagcgttattttgtgcaagtcacaattttagtgttgcagaatttgcattatgctgccagtttggactgatgattacgattatgaaactgaagatacagagagaagccgtcgtttgtgtaaattgcgtgcagagggaacaacgcatggatgggctcaattgttttttttggcggaagagactgaagaggacggcgaaggaatggccgcggcacagccaatgggcgcttcgaccgttctttgtgcgagaggacc

SEQ ID NO: 91711 - DNA, 490 bp, Heterodera glycines
  SCN-specific regions: Sequence locations=1-171,194-454
gtgattggtaattagtaatgtacccctctcattattatcaaattaattgtttaccaaaacaaacatattgtactagtatatacacacacccattgtctgccaacctgggcgggcgtccgcgcgagcgcatgcccggataaatgtacttgacaatcacacgcgcgcgcccggtgccacggccgccgcgcatgccgcgcgggggccgattggtggaggacagcccgggcacattggtacgcttcggcatcaccttgatctgacggcccaggaacagcgagtcgttcaacgaggtggacgtgttcaccgcgtccacgtccgcgaattggatgtacgcgaaactggaggaaatgtggcaaacatatgaaaatgtgttagcaaaaggactataattagtaatgtacccctctcattattataatcagtcccgcccgcccccttccgcttttcttccccgaaaatttaaaaaaaatttcagaaatttttaaaaaaa

SEQ ID NO: 91712 - DNA, 638 bp, Heterodera glycines
  SCN-specific regions: Sequence locations=1-82,117-322,344-410,432-638
gtttgagttggcctttttctgcccattttcttaatggcttttcgcccgtgaaatgaccgccacttcgacgacgatcgtcagcgagctcgaggaggaggaggagaaggagcagaaaatccgtgcgattgtcgttttgccggccccggaaataattgacgcgcggcagggaactgccgcgagggatgcgaacgaagcgatggaggaaatggccaaagcgatgcgggaaaagacgagggactgtgcgaagctgatctctgcccactcggctgtcattttcactgcaaattttttgcaaagtcgcgtcgtcatcaatgacattggcggacaattggccaaactttacgatgcgttggaagtgaaaaaggcggaagagtttgagcaaaggatgaacgaattggcaagtgccggggatgagaggagagggagaaaaattgccgaacttcgggaagcatttcgcgagtgggagactcttttggcacggcttgacgtcgagttggagcgggtggccgggccaaacatccagacggaactcggcgaaacgggcagggaaattcaattggtgtcctccaacaaaatgttcaaaggcggctccctcctctcctacgttcagtcctcctcctaccctctgatgttcctcg

SEQ ID NO: 91713 - DNA, 628 bp, Heterodera glycines
  SCN-specific regions: Sequence locations=1-83,238-242,265-283,307 -343,365-374,404-487,519-628
aaaacatagaaaaacctatgtttttcggatttattttatgccattttcttctaattaaaaatttttcgcctcttttcttcatgtttattaaatgttaaatttgttgaaataaaaaataattaaatgatgtaaaaaaatatttttattaatgtaaaatttataaatgaaatataaaaattttaaaatcagaatgtaattttatttcttaaattattttatgcataaattatttaaaatcatcgcattaatagaataaaattttataaaaccaatgtgccacagcaataaaattttaaaattatttttgtgcataaattattttaaacccgtcccttaatgcaataaaaacttttaaaaaaccaaagcgcttcatctataaaatttcaatataaaatttttatttgcgcttttattggtttatttattttcttttttattcatactccaaaaaatcaaatgctatatatagagtggttctcatttctatgcttacaaaattatttattttaaagttctaaggcactcaatggagatgccttccttaaagttcaacatgattgcctgggccatcttgctcattccggtaataaacctccaatcagtgctgatcaaacaaattttttttttt

SEQ ID NO: 91714 - DNA, 624 bp, Heterodera glycines
  SCN-specific regions: Sequence locations=1-624
cacagttggtgaaaatatttctgatttgcggaccaatgaaacagcaaatattggcatttttttatgactgcgtaattggaagagtgagactttaacaataaattgaaaattgtctggatttggattatttcaaggtttgtacaattaaagttgaaggcgaacagtcaaccacaacaatcagcgtaaagtcaacggaaccaacggacgatgaaattttgtttgacattcatgagaagtgcggccgagtccgagcggttggtttcgcgccggacatgcaaattgtcagcattcaacaggaggacagtgtcattgaatttgtgctgctgcaggagggcaaagttgtgggcacttttcggcacaattgcaccgcaaaaggcgccgatgtgctcggcgtccattggctgtccaactcccaagtcgcttttgtcaccgacttgggctgcgagttcttttgtgtgtacgcgtacaaacgcacgctgaaaatgacccaacggctccctcaaatttgtttgtttgtgccagcggtgtacagaacaacctttttagtttcgtaacttttcagcaaaatgttccgcacactttgggcacggctgaggttgattttggctactcttcaacaaagcc

SEQ ID NO: 91715 - DNA, 480 bp, Heterodera glycines
  SCN-specific regions: Sequence locations=1-19,41-334,357-480
agttctgttcaattgcatttccctttttctttgccctctctttcctttcccttcactcactgttcccgttcacggcactctccgccagaatgttgctgttgccgttgtcaaattccattagcattggctcgtccccgtcggggttattcggcttcactttcggtgccgttgtcgttgccttcgtccgtttaattgacggggacggcgaattggctttgttcgtgctgttcgtgatcagaatgaatgttcggctcacttctgctggtgttgttccttgagttgttggcctttctttgtcaattttcccttttggtgtttccctctgttcctccgttgttgccatttctgtcgatggccgtgccgttctcttcgcctcgggggtcgtcggccgttgcctttgaggcggagatggcggcacggcactcgacgacgccggctcgtgctgttccagctcttcttcggcttgctgttgcctctgct

SEQ ID NO: 91716 - DNA, 632 bp, Heterodera glycines
  SCN-specific regions: Sequence locations=1-139,161-176,202-278,302 -515,539-632
cgatcgcaacctcttgtggcattttgaagcccggggaggatttcttagcgcttgaggggaaggaattcaacgaccggatccgggacgagcacggcgaagtttgtcaggagaagttggaccaaatctggccgaaactgcgtgttttggcaagggcacagccgacggacaaatacattctggtcaaaggcatcatcgacagcaaactgagcgctaaccgcgaagttgtagcagtgaccggggacggcacgaatgacgggcccgctttgaagaaggcggacgtgggatttgccatgggaatcgccgggacagacgtcgccaaagaggcgtccgacataattctcacggacgacaatttcacttcgattgtcaaagcagtgatgtggggtcggaatgtgtacgactccatcgccaagtttctccaattccaactcactgtcaatgttgtggccgttgtcgtcgcgttcgttggggcgtgtgccattcaggacacccctctgaaggccgtccaaatgctgtgggtcaacctcatcatggacactctggcttctttggctcttgccactgaattgccaaacgaggacttactaaagcgaaagccctacgggaggacaagtccgttgatttcgcgcaca

SEQ ID NO: 91717 - DNA, 624 bp, Heterodera glycines
  SCN-specific regions: Sequence locations=1-624
gagaaatgaatcctttttggagacactgtctaattccaaaaaggcgaaaattgttattagagacgcatccgatgaacaactattatgcctggtagaaatttgtctcaacattctaaagggccgagttccattgcgtccacgtcatttaaagaagctgaaagctcacgcacagatgcttcgtcgtctcgcccgcacacgttgttctcgctctgccaaaaacgttttgctacagcacggagacggcctcccagccattgtagggctcattgcatcgattgcccttccgcttattgcgaacgtcattgaaaattatacatagtgcttgataaagtttaaaaaaagtaaaatgcaacatacaaagcgctatttgttggtccccgaagagatttatcagagtttggcaacactgtcaccgtctgacggttcaccaattgggctggtccgtgccagaattaaacaaataaaaaatgatgatgccataaatgaggcggaaagagcagtcaaatatgagcaggaaattaagcgtctcaacaagctcaaaaaggacgaggatgaacgtcccgtcggtgttaaattagaaaatttgagtgatgtggttgacgccatgccaaaaccattcaacat

SEQ ID NO: 91718 - DNA, 619 bp, Heterodera glycines
  SCN-specific regions: Sequence locations=1-619
atgagttcaagcaaccgtcagcaaatttactaccaaagccgtcaccatccgcagccccaccgtgtccccggcttgtcattgccaattgcttcgtcctctcaccacgacattggctccatcagtcctcgacatgaccatcggcagatggtcatcgtgtccgggagtgactcgtgcacggattgcgtggccgattaccattcgtcgtgcgactgtcccgcctgcgaatcgaaaaatcttgcttcggtcggacatgacgctgggctggacgaccaccagctgtactcgtactcactggaaccgacacagttggaggacgacgacgaggggattgtgcacgaattcacaacggactctggcgaacgccatgtggtgatcatgacgaagaatgatgagcatttccaggagggcatcaccattcaagaaagagttcgtcgtcagaaattgtctgaagccgcccgtagccgatacgctcagctcagcgatgaggagaaacgagcggtcaccgaacggagaatcatcatgcgacaacgacggaagcagaaagaacgcgagatggaggagttggaggcgatactccgcgcaagcaatgacatcaccgacgatttgattcccctggatg

SEQ ID NO: 91719 - DNA, 653 bp, Heterodera glycines
  SCN-specific regions: Sequence locations=1-37,59-116,217-653
gcaagggatgttcagaagcgcaacactcagtccgaacggaaggggagagttggaaaagacagcacacgacggccgttgcccgcgttatttattcgcacgaccaccgctaaatggggaggaaacgacgaagaataaaaagaaaagggtagaagaaaagccaaaagggaaggagaaacaatcgaagaaagaggcgaaaacggacgaaaagggaaaaaacaaaggcaacgacgaattggacgtattcgcctcattgggcacactgcaaaagtcactggtgaccagagacttgatgagccgattctgtggacaacagcgttcgtcattggccgaagaagcgattgtcagtcattcgacaaaagcggacaaatctatggacaatggctaccccctccgcggcacaaattcctttttgccacaatcgccgtccgttgggccgcggtcgactgcaacgccattaacaaattcgtcgggcagcagcgaaagcgacagctcatcgttgggccggtttcgaagaggactgtccattggcccggcattttccggtatttctgattccgttgaagacccctcgctggccgagaaaattacacggaattacgaaagtatcttcctaaagacattggagcaggtgaacatcactcgccgttgctctg

SEQ ID NO: 91720 - DNA, 614 bp, Heterodera glycines
  SCN-specific regions: Sequence locations=1-526,548-614
atggaattggatttggagttccgtccattcaacaattacccgacaatgtcttggagttgattttcacctatgtgtcgccttacgaggattacaattccataaaattggtgtcccggcgatggtattatcttgcgaccgcaacgttgaggcgaatgaatcattttttcaacaaatgcataaacttttcatggcactttgtcgagggcgatcacctcctctcatagcggtgttcccacgcggcgtgtttccatccccgtcattgtgtcgtgtatatttttggtggctgtacgaatacgtacactgcgttcaacgacctgtggcttttcgacttgagtcgtcgtgaatgggaacgcgtgatggtcgcccgtcctccgctgccctccccaaaggcactcgcttcgatggtccgtttcggggacaacctcctcctattcggcggcttttccaagtcttcgatgaaccccattcatcagacaaacacattttacaacgaattgcatttgttcaacacagcatcgacgtgttgggaggagattatttccgagaacactgcgccccatttgggcggccattctgcttccattttgtcttattttatgctcgggttcggcggc

SEQ ID NO: 91721 - DNA, 589 bp, Heterodera glycines
  SCN-specific regions: Sequence locations=1-469,491-589
gaatgagtccttcccgaggagttggagcagtacgcggacgctgtggcgccaaaatctttttttgtttcattttttgcccaattttcttcaaattttttgccgcttcaacagcggtggaggaaatagcacaatgttttgagcagcaatacgccaacagaatggtcaaattcggcgcacttcacgtcgtccgccgggttggcattatttcaccattgggtgccttctatttggcacatttcattgatgaagcagatacaacaaaggagctccgccgttacccatcactccgacaacggcatttggcacggcaggaaaacggcgaaattttggtgatttactcggggcattccgcgcactctttggaatgggcccgtgtcgatttgttggcttccgcgcttcggcttgagcccattttggacggggacgactttcagccgcacgtgtcgcccgtactgctggttactgcgtgccctgcgcccgctgtgtctgcgcccgtctcattgcccgccccgtactcgttgaaaacgcgcagcagcacaacaagcggcgaggagcagcagcgtatggtcaacaacaacaatataacgcc

SEQ ID NO: 91722 - DNA, 627 bp, Heterodera glycines
  SCN-specific regions: Sequence locations=1-92,114-404,434-588,610-627
gtcgacacataatggaaaaggtacagacaacagagaattaattttcccctcattagctaattgccattacgtcaaatcaaaagataatttgtataaatttaaggatgattttgccaacaaccaagaatatatcacggtgatggtgtacaaaaatgatgggaagcgcgtctatttgccatgtgcgttcggctgctttaatttacattacccgatattctaatccgttttcagttgaccccaagccaattttggagggcactcgcatcaacaggtgcctctgcctgatcattctgtcccttttttaatttgtccatttcaattagtccccattatctttgtcaactgattgtccgtgagcctggcattcaacgctttacgcttgtcattgcgcaagtacaaatatcatatattaatttattttaatattaatttagtttaccatatccatctctcccaatattttcttttacagtatgaaaagatgaagaccatttactacagtttgcgggtgtattcgagcgcagattttcgttgcggtaatatgccaatgccgtacaaattccaccgcaaagtggggtaaggaaacaaatttcattgaaaaaattgaaagtaaattttaaggaagcg

SEQ ID NO: 91723 - DNA, 410 bp, Heterodera glycines
  SCN-specific regions: Sequence locations=1-410
cgcctttaccttccacccctgcgcgtcttcctggctggaccggtgcgcaaagtacgggatgttgtccgagaaccactggtaaatctcgctgagcttcagccgtccgtcaatggcacagccgagcgcgcgcgcgatcaagtccgagtaggactcctcgccccagggattcggctttttgtgtgaatgctgctgcgctgcttgaccaccaataccaacagcaccatcatctgtgacaccggtgggcgccgttccgccgtcagcggtacgtcgacggactcgcttcggcttcggcctgattagtgccatagaggatgtgccgagttgagcggtggagaatgacgatgacgcggtgacaccgcaaggaccaccggaggaggacagcaacaacgactgttgtactgcttgagaat

SEQ ID NO: 91724 - DNA, 411 bp, Heterodera glycines
  SCN-specific regions: Sequence locations=1-40,100-189,250-411
ggggggaaacgtagtgcacccggacaaaatatcgccgcagaaatttaaaaaaaaattttcaaactttaaaattttaaagaaaaaaattctttaaaaattcagcgctttttttgttgttgttgaaattttatgataaattactgttttttaacgaaaaatctttcaaaattttcaatgatttttttcttgaaattttcatattaaaaattttcaaagattttcttctttaaaatttttttttttaaatttctgcggcgatattttgagacgcaccccaatccatgacaaggggtgcgccagtcagaccctcatacgtcggacgtttggcgcagggggggggtgcgccaggaccaatttttcttaggtcggcccccaattttccccggcgacgaccttttttccaaaaaactt

SEQ ID NO: 91725 - DNA, 530 bp, Heterodera glycines
  SCN-specific regions: Sequence locations=1-355,381-530
atttcccgccgacatctgatcaagcgccacccagtctgatcagcggcttatggcacaacgacgctgaagccagcccggacaattcgccattgttcgatcaacacccatggcatcccaccgatggtgccatcccagccgatcattcatcaccgccaggccacccatggcattctgccgatgccatgccgggtcatgcacacacaacggcggttgatcaaccaacatgggatcagcaggttaaagctatgtctgatcagcgcccaccattgggacctgatcctcaatatttggtgactaccgccacatcaatcaacaagcatccgccggcggcaccacaacaaaagccatcgccaatttcggcaccacattcggccacattgccaaggacacagtcgacgccttccgctgctgccagccggccatggactccgtcgacagtcatccatacgactataaatacgacctatcaaggcagtcacgggcatcatcaccagcaattgccaacgccacccgccacaccgtcgccgcgg

SEQ ID NO: 91726 - DNA, 473 bp, Heterodera glycines
  SCN-specific regions: Sequence locations=1-3,27-63,94-161,185-304,355- 473
gtgacaccaaaaggcccaacggcgggtgtcttacttttatgcaaatttcataataccttcatcatttaattaaaatataatttaaattaattaccgattcatagctaaggatggcattaaaattgaatttgggcactcaaactttgacacgccttctgtcattatgtgactgaagctgactacatccgtcaattggtcaaaatgcaacaattgcagtcgaattcgtctgtcaacaaagtcacaaaattgtttcaaatgaatggaattggcgacaatgcaacacacagcgaagaagtggtcgtacttaattaattagtgagttaattaattaattactaagaattaattaattaaaaagtttctttattatttaattcattcccaaattaccttctctgtaaagttagcagtcggaaataattggccccaattttcggagggatttgaattttgaatctttcggactttaatta

SEQ ID NO: 91727 - DNA, 628 bp, Heterodera glycines
  SCN-specific regions: Sequence locations=1-170,193-628
ttcgccgggtggtcctaaaccgtaaaaatcaatatttgccttgaaacaccatcacctggcggtgagtcttcgccacgctcgcccggaggcccctcttcgccggcttcgccgtggggtccaatttcgccctttggtcccggctcgcccttagcgtaaccgatgccctgctcgcccggcggtcctcgcggcccggcctcgccgatctcgccttgcagtccgatttcgccctcggggccctcctcgcccggctgtccttcgcgtccgggtgatccaggggcacctaagcaataaatgttttgacattcattcgcctaaatgccagtgccaaccctttgctcctttctctccgcggaatccgcgtttgcctttgtatccagggggcccgggagggccggcagggctaaatgaattacacatttagcaattcggaattcaattccacgcataccaaggtgcgcattgtccgcctccgcccagttggccaccgtattcgccttcgccctccgcctgtgacaccaattcctccgggaaggccgggtttgcccgtcctgccaggctctcccgggtatcccggcgaccccttcggtccgggcgggcatcattgactggcagccacaaccggcgaaga

SEQ ID NO: 91728 - DNA, 654 bp, Heterodera glycines
  SCN-specific regions: Sequence locations=1-93,115-160,182-221,243-654
cttcaacgccttcgtttgctgatgggacaacggctcattccaatgggaaggattcattagcagaagggcaaggacacgcaaagaagcccaagcttactcaaaaagtaataatttcaaaagagaaggctttgccgctgaaacaagcgattccaaatacgacgagaactttgaagaagcttttcaacgagtgcaaaacggacaaagaacagtcgcaaccaattctgaagaggaaaatacctaagtcgaaggtggagcccaacggagtcacagtgaaagcggaagaaagtacagaactttgcttacaaagcgtcgtccatcctcaccattcgccggaagtgccaagtaccagcgggtcaatgtgttatgacagtcggacaacgatacctataagtgcttgggagggcaaccaaatggaacggatggatggggataacgataaaaaggacaacgtcaatagaatcgagaatttgttgcccatggtccggggagaattccgagagcatttggagggattggacgaggcaattcggcaacaaaattacccgaaagctggggaggaagtgcaggcattggccgactctttgttcgatgcggatgaatttgacaacgaacaggcggagtgcatttctctctgtttactacacatattcctgg

SEQ ID NO: 91729 - DNA, 159 bp, Heterodera glycines
  SCN-specific regions: Sequence locations=1-159
atccctcccaaccttttctggcgattgtaccaattatacgagtttttggaacacatttaaggcaggtgttcatgacctgaacattcccaattccctcaaatttacctatctaaagcaatgtctctctggtcctccccttactttaattaattctctccc

SEQ ID NO: 91730 - DNA, 552 bp, Heterodera glycines
  SCN-specific regions: Sequence locations=1-88,117-312,336-364,402-552
ttataaaccatataaaaatgatgaacgaaaagaaaaaaaattagtcatgagaattgtgaattttttttgtccacaataaaaaaggccctaattaaataattaaagtaattaaatttgaaagcgtaaaattatttttgctcctcatcagttggtcagaggatggaacaatcattggccccaaattaaagaaaagtacgatgatgtcagaaaagggctcaacacaaaacgagtggagaaaattggcgaacaagttcggcagaacgtagcgacggacttcagccacgaaagccgatggaaactgaagcaaatagtggaggaggacaaggaggagcagaactatctgcagcagaaccagcagcacgagaagctgaaggaggagtatgagaagcaggacgaggacgctgactcagacggtagaattgacacggaaattcgaaatggcattttcaaaggggcaaattgccaagttgaactgtgagcataacttacagccggtggtaatgggggccaattaaggcataatttggtgataattggcgagtatttactttc

SEQ ID NO: 91731 - DNA, 653 bp, Heterodera glycines
  SCN-specific regions: Sequence locations=1-46,172-653
ggctgagcgggcaaagaaacggggcaaagccaaaggggataaatctgaggagagaaataagcaaaggaaatgggagaggaaaagctgaccaaaaagataaaacaaatgataaaaggaaaagcaaagaaaaatgggacgataaaacggaagaaaaggcaaaagaaaggacaaatggtcaaattgggagaagataagagacggaagtgataagggacgatgattcatcagcagaaagaaccaaaaaacaaaacaaaagcctacacaaaactgttggtgaagtgaagcggtgaatttgggcaaagctttcaaagggacgagaaaattttgaaggatttgccgcggcgaaaagagacgccgactccgttgggaagtgagcagcggaatttcgggaggaagaagccatccgacaagcaatcgcagggggaaaaagccaatcagagggaccatctgctcaatggaccaaaaaagagaacgccaatggcgccgaaaataatccccggaaggcatatactcaattttgatctaaacactcgaataattaggtaacaattaacaaattaatcaaccaaacaactcacgccgcctctttcgcacattctctgcgcatgtttgtaaaagaacggtttgtgccattgtccaaatttgttcaacaa

SEQ ID NO: 91732 - DNA, 303 bp, Heterodera glycines
  misc_feature (158)..(159): n is a, c, g, or t
  SCN-specific regions: Sequence locations=1-72,94-207,232-303
gtacacaatgaccattttttgatgtttcaatggtttttgactaaatttagcttatttggatcaatttaggaacaaaagtaatcgaaaattttgagttttcgacatttttgttcgaattcgggtccgggattcgaatttgatcaaaatgaatgggttanngattcgtgatcagtgaccctaaaaaccccataaaacgtgttttcacgacaattttccaaaaaggggggaccatcggcagtattacctaaaattttcttggtatcatttaaagagcccattaaagttctctaataacatacaaaa

SEQ ID NO: 91733 - DNA, 606 bp, Heterodera glycines
  SCN-specific regions: Sequence locations=1-326,348-507,587-606
caacaacagcagcagaatatgatgcaatttgcacgaaaacattcgagcagttcattggccgagcaacggatggccatggacagagaccatctcgatttggcattccatcatggctccaccgtgtcgctgtacgccggcaccggcgtccgcaatcagccgatgcttccgctgagtaacagtgccaatcgcatggtgccattgacaacaccggcgtcgcgtgcaaaacagcgcaagcagcacattatgaacgcctattttggcggttttggctcggcactgaacaaattggcggctgcgaataattggacaattaacggcgtgaaaatgatgggcagcaacgaggaagtgtcttcatcggtcgagatccaccaaaatcatcctgcttccggcatcaatttctgtccaaatccgtcgcagccattgcgccaaacacggggcacgttctcacagcgaaagctgcagaatcaccagcaatggactgcccgatcggtggtcggcatttacacggacgaagaggacgaggaggaggaggacgacgacaatgttgatgaggatgcggatgatgatgacgacattgcggatgatgtggacgtgtcaaccgaggaa

SEQ ID NO: 91734 - DNA, 588 bp, Heterodera glycines
  SCN-specific regions: Sequence locations=1-20,42-75,97-588
agaaaacttatttttatggcaaaaaattaatttatttttttcgaaaaggggtggacaaattatgctattaccaaagactgaataatgtccaaacaaaatttatcatgaatgtattttgtcaaaaaagaacgggaggagaaggcaatgacaaaacgacttgaaaagcatggcgcaatgggacaatacaaaaaagcatttgccattcattcgaaatcatcaatctgcgcaattgtgccgcatcccctcaattgatttgggccagcaaaatggcacggcgctcagtgttttggaacagtgcgcgtaccaaacgcttcacctgcgccggcttcagccaaagtgccaatggaccggtgccttcgcaccaacgcggtcgacagtcgtggtcagcagattggccgaaatctccgcgtcgctggaggcgatgtcctccttggccaggattatgttcgccattgcggacaacaaatacgaaaccaactcgccgacacaatgcgtcagcacgaaatcggacagcacctgggaaaatgcggcaaaattgatgcgtttattggcattttattaagaaattcactcttttcccacacctct

SEQ ID NO: 91735 - DNA, 461 bp, Heterodera glycines
  SCN-specific regions: Sequence locations=1-461
agaaaaaatggaagttttatccgacgaagaagaaggaatggcattgtccgatttgaaagagacagcaaagaaaaacaacgaagaagccaaacgccgagaatttgaccggcgactgccaatcattcactcatatttgggcgatgtcaaccaaggggaattgtctggtcaagaaattaaacaaaggcaatttgaggaacctgggaatacaatcaaaatttcggtttttgttataaacgaagtttgtctgtttccgggccagaaaatgccaatccaattccaccaaaggtcaggcatccaatttgtgcacaatgcacaccgtcagcaaaatatccttgcccttttcactgcggaagaccctaatttcgaatttcacaatgatgaggaattttcgtccgtgccatgccaccaaactggcacattgtttcagatgcaaaatatcttggaaaatggtgagaatgatg

SEQ ID NO: 91736 - DNA, 229 bp, Heterodera glycines
  SCN-specific regions: Sequence locations=1-42,221-229
gtacggcgaccccaacagcatgcggccctccaacgacggcagcgccgccgccgcagccgccatgagtgtgctgcgcacctccaacaccctctacaacgcccctgactccgtgccctccacccccggcgcccccaacacggctactgccgctgccgcggctgcagctactgccgcagctgcagctactgccgcggctgcagctactgccgcggctgcagcccaaccttca

SEQ ID NO: 91737 - DNA, 466 bp, Heterodera glycines
  SCN-specific regions: Sequence locations=1-241,263-466
tttgagcttccaatccaaataactgaatcttttccaattgtttctttatgctttggcgccgttccggtaattcgtcgtctgtcggtcgaagcggcggcgaatcctttggacaacgcgacacaatgggccaattgtcctccgccgaattgccaaccgtggccaatgccgtggatgtacagtcggaagaaccgtcgacagattcaaagacggggcccgaaattggaaacgaagcggggcggctggagaagctggtgatcagaccgagtcagcccatcgacatttgccgagcgccctctcagaatgagccgaggaatttccatctccaacacttgcaaaagccaatggcacaacgactgttgcagcgaagtgcctccgaaatgacaacagcagtgccaaagtgtgcttcgaccgatcgttgggcatccgcaggcacacaaaaggggcaccaccagccgagagtgattca

SEQ ID NO: 91738 - DNA, 505 bp, Heterodera glycines
  SCN-specific regions: Sequence locations=1-505
acgcggcgtcggcggcggaagcggcgccggacgcgcagagcggcgaagcgcacgccgcgggcattgcctacaaaattcggctggcggtgccgcacgtgctcattttttccaccacaattttatacaatttgttcggcgctttggcttttcaatcgttggagcgcccatttgagcttgcccacctgcaaaagcattctttggccatttctcaagcgcagaatgccctcctccaactcggtctctcctccgcttccaatgattcttccttcgctgctgatgacagcgcctttaacgttacacttatggtcacaattgacgaactcattcgtgtttcgatgaatgcgtttgaggaaggcattcgtgccgatgaaattctgctggccggcgcttcccatggcaattggcagaatttggcacttccgtctgtcgatgggtcgccgccacttggccattggtcttctgatcaccaccagcacaagtccaaatggaacttccattcttcgtt

SEQ ID NO: 91739 - DNA, 517 bp, Heterodera glycines
  SCN-specific regions: Sequence locations=1-517
aaaaaagggaatgaaaaaacaacaaattctgatgacaattcacaaaccatgcactcatcacatctccgcgacggactgaaattgaattttcactttaaatttggcttttttggcactgccaacccgaaatatctttgttcaaatagccacggatttcgcccagaatgaactcaatgtcactgttgcgcggcttcggagaaaacgaaacgtcgcacggcgagtccgtcgtgccggccaccgtcattctctgccatggactaaaaatgtacgacagtttatgaggacattccaacacaaaaacgcacagaaagaaaatcactcgtccgtcggtggtggacgggtccaaaaggcccgtgttggcgggactgtaatagccgggcaacacaatgtgcacgccggcggacggacgacagattggctccgtgtccgggtcggccatcatacggatggagtcggtgaatggaccggtggcattcacaatgcatttggcacggatgggaaacaattcgccagtcaa

SEQ ID NO: 91740 - DNA, 358 bp, Heterodera glycines
  SCN-specific regions: Sequence locations=1-358
tttgatccttggccagaactgggcggacggcattcattgctatgacgggagcgccctgcaaaatgtgtggtgggaaaaggttggagaatacgcggccactttcccgagcagcaccgagtgcaaggagaacagtttctcggacacgagcggcggtgcgaaaaatggcaaggacaaagtgttccaaatgaacggcggcggcactttaacgatcaaagattttgaggcggaacgcattgtcaatttggcgcgcgcgtgctgcaactgcaaaacgcaatgccaaaaactaaagtttgtgctggagaacattaaagcgactgagctgaaaacgctgttgagtggcctcaacaaaaattatggc

SEQ ID NO: 91741 - DNA, 572 bp, Heterodera glycines
  SCN-specific regions: Sequence locations=1-120,219-260,308-398,420-572
gtgaccaaaatggaaacataaaaatgccatgcaaaacggcacttcaaatattgcaggggacggggggggggaaacagaatttggcaccaaatttatgcagggaaagaaggcatgccaaagttataaattgtaaaattaaaaaagaaatatttatataattatatttttaaacttaaattaattagaattttgtcattttttaaaaaagatatattataccgttttcaattctttaagtaaccacggcgaaattaatcaggaaataaaaagaattttgaaattaattaaaaaataaatttaattatttgggaatttgttttatgttttcaaaattagccaatttccattcattggtttggcgttatggtggcattccttttggcctgcgcttttggcggaaaacaaaacaaagcatgatggggatgaatgaatgtccatgtgccgagactgaaatgagaaatcagaaaccgtgaacaaatttttgtgaaggtgttgttggctaggggccatctttttttggcgagggcaaactgagaaaattcagtgaatttttaatcgaattttccacaatg

SEQ ID NO: 91742 - DNA, 649 bp, Heterodera glycines
  SCN-specific regions: Sequence locations=1-649
caaaagatcaagccccattggatgttcactttggacgatttgatacgaaacgccgttcagcaagcgataaaatttcttagaccacaagagccgacgagtcgcgacgaaggcttcgccaattccaagcaatgttcgtcggtccatcagttgctgcccgtcccccaacaatcttcgcttttggcgccggcttcgtctttcgatctgttgggcaaggcgtacactgaccaaatcaaaagtctctgggacgacttggtcagtgtcgagcgcaaattgctcagtgtgttggaggtggcatttgtggagcggcaggaacgcatccgctcactgtgcacttcggcctccgatttgacgcctgggaatccgaacggcgtgcagcagcagcaattgtgggcaacgttggcatcacaacagacaatgggacaagggcaaatgccgaacaacggcagcaaccaccagcagcagggagcagggggaggcactcacttcgcttctcctctcctttccgtcgatgacagtggcattgacatggagagactgagtgatgatgatgaacccttacgtgaatggcttttgcgcatcgggtgtgacgattattcgattgagctcttggagagagagcggtacacaaaaagggacattttggagtttg

SEQ ID NO: 91743 - DNA, 661 bp, Heterodera glycines
  SCN-specific regions: Sequence locations=1-598,621-661
ttcttctgctcctgttgataaagaggagccttgggtcaggcgctttccaccatacaggtgttcgatagaggttgaagagctcaatgaattctatgttcttcatcaacaagtcgtgcccaatcgtgttgtgccatgctgcgtggattgtgtcgaaattacggaaattgctgcaattgcggttgagaaaataaacagcgatcggatcagtgaaggaatgaagcctttgaatcttgtcaggatcatccttgcaaccacacaatacgtttcgggcagaagcttttgtcttcaaatactttttaaacagacaaaggatagcaacaacgagaggactaattctccatcttgccctatatatttcttccaaatttatcgcaatattaaaggggtcatcgacattaaatatgaagaaattgcactctttgccgatgtaccgggcggacgatggcaattattgagtggcaattttatgcccaaaattaggtttcaatgctcgcctgattgggatgaattggcggcggaaaaatggattcagacagcactcgaggcaggcttccgaatgtttgatcttacattttttagccataatcaagggcagattagcaaagcaattaagaaatatttgccttggtttggtctcaatcgtaccgatgtgtttatcacc

SEQ ID NO: 91744 - DNA, 648 bp, Heterodera glycines
  SCN-specific regions: Sequence locations=1-111,133-246,268-648
gtcagattttttatttttggaaatttgtcgagtaatatctatcaatcatcaccatcacctattcttgcctttttatttgcccaaatattgcataattagtggagcaattgtaaaattattttattaccaaactccaacaacactcagcaaaagtcattcaaatccgatgggacaacgtccgtcaatgcagcagagcgaagtcgcgcggcgtcctcgtgccggttctgaacttggcagcagcgcacaaaccacgggcagcagcagtgcaacggcacacattcacaaccatcggagagcgaatggaacgcgcagcagacagccgcagaatgacacgagctcgccttcttccgcttcgtccgcgtccccggcgtccgcgcattcttcgcgttcattcaccgaagaggccgcagaaggggtcactggtggaggtgccgcagaattggcccgcttcttcaatcagttgggctttgtgccggtccaaagcagcagcaaccggcatcgaacatccgcagaaattctgattggcggcacgtcgacgagtccgtcaggttcaggtgggctagcccaaccgcagcagcagaacggcgatgcggcttcgtctgcaccgtccacgtccgtgcgccatgcctcctcgtcatcatcaaatct

SEQ ID NO: 91745 - DNA, 628 bp, Heterodera glycines
  SCN-specific regions: Sequence locations=1-397,419-628
cattcgccaactgcaaaacgtagtgcaaaacgttgaagaaacggtgaacgaagcgcaagaggaacagctgcaggaagaggcgccgccgccactgctcgcggaagccgaagcagcacagccgacggaggaggacgcggtggaccacgtgctgttgctgaagaaggactcggagcagttcaacaacgccgacatgggcctggcaaacactgtgcacaaaatcgtgaaaggcggcatccaacgtgtggagggaaaccgcgtctatttgaaggtggccaaggaacagctgacggaggaggagctgtacaagctgatcggctacctggacaagaagattgcgcagccgaacaacctgtactttgacgagttcctctacgaaaatggccagttgtccttccgcatttctcgcctcggcgtgttgcaaccgaacaaagacaaaaaggacggcaacgcggacgccgcattggaaaatgcgagcggagtggcgcaggcggtgtacaaacgacggaaggacatccaaacgttggccggcatccgcgtggatgagacgggcatcggaagcggagtgtacgtcgtcccggtggagcgttctcagcgcgattggctgttcgtgccaataatggctgtttcc

SEQ ID NO: 91746 - DNA, 585 bp, Heterodera glycines
  SCN-specific regions: Sequence locations=1-2,24-531,553-585
agtttttttttttttttttttttgttgcacttgaggcaagtggcgtccttgaatgtgcagtcggagcgccaatggtcggatttgccacatgatccgcatggatgcgtcggttgaccacgcgttggctttccgcttgaatttgcaccttgtgcgaatggcgtttgtggcaattggtgggttaaccagcgaaagggcgctctccttgacaagctgaattgcccgaagttcctcctcaattttcttgagcgaaatgtcggtgccgttcttctgcgagtcatccaacattttcaatgccttttgtcgcaaatcatgatgttcatcattgagcgcgatgaccaaaataatgcacttgagctgctcctttgtcagactcaggtcggcattttcacatgatgcgttgatctgcgcaattagtgatgagatgtcttgcccttgttgctgtcgaattttaaaacattcgaagcgacggacgaacagcgaacgtgtctcggcaaaaagctgtttgagctgtgaagtgatgtcattccaattcacttggtccggttgggttgggctgatcgtgtccctgatatttgctgtactcct

SEQ ID NO: 91747 - DNA, 238 bp, Heterodera glycines
  SCN-specific regions: Sequence locations=1-238
cacccctgtggtttcgtgcgccgtcgcttctttgggctgtgatgcagtcatcatgaacagcgcttctcacaatccgaaggacgacggcggcttccatgcttaatgggccaaagaagctcccattctgagtccacaccatgcggaaatttgtcgaattgtctcggaggagccaaaacccgaacaaggctattgtgacatcggccaactcggcacaagtgtctttctccactcagacgac

SEQ ID NO: 91748 - DNA, 658 bp, Heterodera glycines
  SCN-specific regions: Sequence locations=1-281,304-322,355-555,590-658
atcttttttaaagttaagttatgattgcaaggatctccatgaatttaatttattactcattttgaaatggttataggacatttgcggttcggacatttgcggtccggacatttgcggcctgctggaaatcggacatttgcggcccgacaaatgcggtcggacttttgcggtccggacatttgcggcccgtttcttaagggccattttcggacatttgcggccggacatttgcggcccaagggaaaatcggacatttgcggccatcaaaacgccaaattgtcattcctttttcaaattaattataccaaatatttttatttaacacatttcaccaattattttgttcaatgacttataataattttttcaactaatttttcgaaatatttttaactttttttcacaatttgattatttaatttaaaagagcttgctgaaggctccaaccagcttaaaatgcttgcttaaggtagcaagcatgcaacatcacaattaaaataagtctgcctatttatagtcgtagctcggcttctgatcacttccatacttagttcgtttctttttaaaattaatttttgttctttagaaaatctgccattatttatttggattcttgcttaaaactctcctcgttgcaaaaataggtttccattcctta

SEQ ID NO: 91749 - DNA, 604 bp, Heterodera glycines
  SCN-specific regions: Sequence locations=1-138,160-244,278-530,552-604
acaccattgcccaagaaagtgcaattttaagatatcatttgataaaaggatgtgggctttgactaacaaataagttaaaaagttaatggtctatgaaaaattgagattgtcactgattggacgcctaaagtgaattacaaaaaaaattaaattaataatccgccgaatggataaaaaaaaaaagattttattgtttagtttactggcatacgatgaacttttaggaacataagcataaacattgaaaaataatttttttaattatctaaaaataaaaggatatgggcaaaaaatctattaatcgcttaaataaaatcccattcggcccccaaaaaatcaaactcctccacgagcttctttcggaattagttcttgcccttcgttatgattttgggtaactaaaaacccgaatttgtgcagcctttgattttttttctcatcaaaaagaaacaaaactttcgtaaagtaagagtattattaatcgagttgctaaatgtatattgtttccagacttttgaacaagcggtggaagagcagcaaagggctttagccagttctgccactggtttatccaatgccacaaaataccttttggagtttggcc

SEQ ID NO: 91750 - DNA, 343 bp, Heterodera glycines
  SCN-specific regions: Sequence locations=1-217,239-322
gcggtcgcgtggtttcctttgtgcaacgccgccgtcggaccgcctcattcaaaagtcgcgtgtcgcgtccgcccaattggcgccattcgatgcgattgggccgaacagcgacccaagtggaagatgaagcgagcgaagagatgttgctgagcatcacgcactcccagcagatgcagcagcgggcgacggccgcgccgggcgcccaacgccacacgccggcgccgcccgaggcgccgcggtcgcccgtttttatgctgagcattgcccgcaaaggtcgcctgcttctcccattcttcgcttttttcttagtggtttggtgacctttttttatttttattttttt

SEQ ID NO: 91751 - DNA, 632 bp, Heterodera glycines
  SCN-specific regions: Sequence locations=1-168,190-247,334-347,369 -563,597-632
gttgataagagccaactgaggccggacgatcgggaccatttcagcgccgctgatcggtcattttaatctactttataatatatattttggatggtccatgtatagtaaattgtaataaaaatgatatcttataggcaggcatacgataactggcagacaatcgtggtgaaaataaataaattaaaaaatgaaatggagtaatcagatcgaaacgacaattgcacaaattcggcccaattggcacaacaataaaaataaaaataaaaattaaaatgtaaaatagtaaatagtaaattaaaattaaaaaaattaaaattgaaattgaaaatgaaatgaaagacgaacattattcaattgaattgaattgatgatgatgtgttggcgcgatcgtggtaaaaaaaacaacaaacaaacaacagagaaaaatacaaaaaaaggaatgaatgggcagtgagtgatctgaactgatcggaatcaaatagcacagaaaagggagggaaagttgtagtgtaaaaagtctgacacagaaagaaaggcttggcagcacagataagctgataactcgaaacaaacaaaaagaaaaatggatgtttatttgtgattcaaactgatcagaacatgggacctgatct

SEQ ID NO: 91752 - DNA, 656 bp, Heterodera glycines
  SCN-specific regions: Sequence locations=1-226,249-656
tatcgtttttcatgtttagttagaactctgctaaagtagcaaatggggtggatttcctcctttttgttcttctgtagaagacatccggcgattgctttggtgctggcgtcagtttcaactacgaatggatgtccaaatcttggcggagctaacactggcgctgtcatcaatctttcttttaactcttccagggcttgctcgtgtaattgtccccattccgtcgtactttcattttttgttagttcataaatgggttgcagtatttcagcgaatccgtaaataaattttcgaaagtatgataagacaccaatcagcgatcgtaattcagttatattttttggttttttgattttttgtatcggctccaaatccttggggtcaattcgcacacctttttccgaaattaaatgtcccaaatatcgtatttctccaagtgcaaatcggcacttctctggctttaatcgaaagccaacctcagccatcgttttcagaaatgtttcgatgtcttttaagtgttcgtcctctgtcatcgaaccgataatacaatcatccaaatacacaaagaaggtagctgagcacaattggcgtacttcttccatggctcgttggaaggttgttggtgcgcccgcccatccgaatgggcatcggagccactc

SEQ ID NO: 91753 - DNA, 634 bp, Heterodera glycines
  SCN-specific regions: Sequence locations=1-360,429-447,495-512
gtcgattggaataaatggaaaaaaaagcaaagtcaaaacacaaaaccttaaagcaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggggggtgaacaatccaacgcttggcgaattctgcttcgcaatgataggaagagccgacatcg

SEQ ID NO: 91754 - DNA, 232 bp, Heterodera glycines
  SCN-specific regions: Sequence locations=1-68,90-232
ctctcatacattcttgatcaacttgatcaattgatcaaacgacgtaataccatttcccgaaccggctgaaattttttttttttttttttgctataaaagtgggccgaaccgacgaaaaaaatcattccataaaacggatcgccaaaaacaaaaaccaacaaatccctcaaaaaacaaaaatgtctcctttccgcttcctgatgatgttgctgggtgcgctggtcgctgccat

SEQ ID NO: 91755 - DNA, 632 bp, Heterodera glycines
  SCN-specific regions: Sequence locations=1-223,245-549,580-632
tatagtcgtgccggaccactcatattctttccgcgccattccgatggaattcgtttataacgcacttcattccaatcacgttctgggtcgtcctccggaagaaaatgttcagcactgtttaaatcagctggttgtgcattttccgcccctgcaagcagagttgaatcagagaagtcggcaggcaaacgcacataatttgtgtaacgcacttctaaaaataaagcaaagatgagaaacaacaaaacaaactgcgctataaattacctgagagctctgtaaggtcggtatatggctttggaaaatgttttcggcatcgggttcgcccctgctcatcgacctctgtgcacgcagaattgcaatcatgcagcatcattgtagtaacataatgccatagccggcgctgctgatttgcttctattgacatgtcctccattggtggaagcggaggaattcttgcaaacacatattggtcaacactttcaggtgttaaaaccctctcccgttcttccaggataagaagcatatggatgtgtggcatgcctaaatttcaaatgctataaatattttctaaaaaattcaccacgcttttggtgttcaacgctatagcaccatcctggcacttttcccagcac

SEQ ID NO: 91756 - DNA, 639 bp, Heterodera glycines
  SCN-specific regions: Sequence locations=1-379,402-639
ccaacgtcggttgaccacacgcatacgggacgagcaagtgatgtttttcgtcactgcaacatacagaagcaattgtttcgccgacgactccttcctgtacaaatgcaggctcggcatgctgaagttgacccgtgcccagctgaacgacggggtgccggatcaagaacaacccccggttggggagcagcaatcgacacaaaattcggacatatcggtagacgaattgcctcagcgattgaaaatttggattgtgccatccggagcgggcgatgtcagtgccgttggatacttcctggtcaagcgcattgacgcacggatatgggtttccaatgagccagaatccgattcggatagcagcagtgtgaacggagatgccacaaacaacggcaacaacaacaaagtgccattgtcgcattctttcgcggcatggttttacgaaatggtcaccgccttccacgaagccaatcgcctgtctgatgagcgacgaacatccatccagcaatttgttgacgaactgcaacagggctttcgcaccgagaccggcgttgactcgttgcaaattgaactgttcggctccgttctgtccggattcggctccaacgactgtgacattgacctttgcctgatcaacaccggcat

SEQ ID NO: 91757 - DNA, 236 bp, Heterodera glycines
  SCN-specific regions: Sequence locations=1-193,215-236
ataatgtaacattattttccaccacctctgttttccccaataaaacagatgactcattgccatctcttctgatcaatgacatcgaaatgatggcacatttcaacaaaagcggtgccatcggaaacacttcgattagcttcaatttcaccacaaattcatcaacaaatttattgtcccatccaaatgcaactgatcatcaccaaatgaaactgaaccccgttctcgttgatgaacat

SEQ ID NO: 91758 - DNA, 534 bp, Heterodera glycines
  SCN-specific regions: Sequence locations=1-316,339-534
caccaataccaccacctgatgcttgtgcccccacaacaacaacaaatggacgctacttcatatacccaacaacagtatctgtaacaaccgaaccctactgcatttccgatggggtcatattacggcgttgtggaccatcaacaatttatgagccagccatgctcaattccttcagaaaatgtgcaaaatgacccgtcggcgcaacaacaggtgggcgtccaccagttaaagaagactcaatccatgctttttaccgctccttctgatatgactcatcaacaacagttcggctgtggcaacccatcaagcgtcacttttccttctccttctgcgtctttcgtccatccgtcgccctcccaagatttttctgtggttcgaactcaccataaacaccaacaaccgatggttcgtcttccgccttctcaacaaactccgcatgctcatctcatgcatcaaatatcctcccaatctcttcaatttttcgggcacgatccgcttttagctgccactctcaatcctgatatctgtttggcc

SEQ ID NO: 91759 - DNA, 529 bp, Heterodera glycines
  SCN-specific regions: Sequence locations=1-31,53-170,192-257,279 -281,330-354,376-487,509-529
aaaatgaaaaaaagggttccgtggattttgcaaaaaatattcttaaatgagaatgaatcttttttttcaatttgatcattttggacactgactgatcagttgcctcaatttgagcgaaacttagtctcgaatgggtgggcccaattgtgcggacggtcaatgggtttcgaataaattttcaatttttaattaccttttgactcatagccggcgattgttgctgaagtgaaggggaataattatatagacaattgaaacaaaaagcagcagcacagcatttcaattttttaattgaaaaaatcaaaaatataatatttaaaaaatttattcgttgattaacggaaagaattaagagaagggaatgaatcaaaaaattggccgactctatcgaaaatgcacaatttttacacaaaacagcggaaaaggttacacaaaaagttggagaaatattttgggggatgtgattatgccctgtggggttttgagcgaaattcatttgggagagggaaaatggaggggggggggcacg

SEQ ID NO: 91760 - DNA, 451 bp, Heterodera glycines
  SCN-specific regions: Sequence locations=1-277,299-379,441-451
cgaggactaatgaaagtgcgaatccgattaggctgaccgtttaatggcaaaaagtcatcgcagtaattggccaaattcaattgtccgttcacatggcgacatcccatcaccgccgatggcattggcgcggcgattttccgcctctgtgcctcggctgtcggccgaatgaatgcgtcgcttcggtcgtccattgccttcgcttctcccccccccccaattttttttttgccttttccgtcagtttctgtcaatgtcccgcatcctttcgcttctccttttgttgcctttgtctatggcaatgatttgttacaattcacaggcggtcaatccgagcagagaaagcatttgtgagccggaagaggtccaagagaaaagcgatgggaagggaagggaagagggggagggggaaagggaagggaagggaagggaagggaagggaaagaataggggg

SEQ ID NO: 91761 - DNA, 571 bp, Heterodera glycines
  SCN-specific regions: Sequence locations=1-571
tttcattgtgagagccaagcgctgcactttctgcgcctttggcggatcactgaaaaatcacacacccaccgatttgggagaaattgcggccgctgctgcacataaatcggcctcaatcgcggctgagcacatcgatcacgttattttcggcaatgtcatccaatcatccaaagacgcggcttatttggcccgtcacatcgggctccgaggtggagttcccgaccatgaccctgccgttactgataacaggctttgcggctcgggcttcaaggcgattgcgcagggaggccaaccaatcctcgcgggtgactcaaaggttgttttggcgggtggaactgactcgatgagtcaggcgcccttcgcagagcgcggcgctcgcttcggcacacagctcggtgccaagattgagttcgaagacgtgctttggctaggacttaccgacgcacacgcgaacatgccgatgggaatcactgcagagaatttgggtgcgaaatacaatgggacacaacaggacgccgacgctaatgccattcggtcgcaaaaccgctggagactcgcaaacaatgccggc

SEQ ID NO: 91762 - DNA, 631 bp, Heterodera glycines
  SCN-specific regions: Sequence locations=1-631
ggcgtttaatttgcaaaaagacactgtgataattagcaggtaaaacattaattggctttttccttcctcaaatgataatccttttcttttctcctttcgtcttgcacaaattttgcgttttccgttggaattcgaaaggcactcattggagaagggagatcatcccgaaatccgagagggaattgcccacgcgcgacaatggttcgatcgtcgattagaacaaattcgaattgtggagacggaggaaaagggcatcatttgcagggagtacgaggaaggggttgcccaactcgagcaggaacatgtcaaggtgggctaacaagggaacatatcgaactgtatgtgtccaaatcactttaaaaccacgtctatcatgtagagcatagtctattttattttgtacttgggcagaagctgaaagagttggaggaatcgttcttcaaagagttggatgaacagaatcggtctctcgacagtgaagtcaatgcgttggacattgccattccgccgcttggcaatggcgaggaatccctggcgaattgtgccacgcaattgggacagtgccaacaccacccgaacccactcagtgccaatcacggcataacaaccgcaattagcggcaaaaaattcc

SEQ ID NO: 91763 - DNA, 575 bp, Heterodera glycines
  SCN-specific regions: Sequence locations=1-575
gaaagattgttttgattgccaatgacattaccttccaaatgggctctttctcaatgcgcgagcatcggttataccaaaaagcaagtgaatacagtcggaagcatcaaatgccacgcatttatgtcgcagcaaattcgggcgctcgaattggttttgcatcggacgttaaaaatcgcttgaaaattgtgtggaacgacgaagaaaggcccgaggacggcttcaaatacctttcgatggattgtggggaggaggaaagcgacattctctcccaagttgagtcgaccttcacggatggacgccatcgcattgacgcagtgattgggaaagagaacgacatcggagttgagaatttggtcggttcgggatttatcgccggggagacaagcgctgcctaccgcgaagtgcccacttattgcttggtgtccggtcgtgctgttggcattggggcgtatgtcgcacgtctgtctcaacgcatttggccaggtggaaattcacatatcaatctgactggcgcgggtgccctcatttcatgcttgggcgggaagggtacacttctaacaatccctttgggggga

SEQ ID NO: 91764 - DNA, 636 bp, Heterodera glycines
  SCN-specific regions: Sequence locations=74-86,109-224,264-302,328 -338,467-636
aaataataaaataataataattaattaattaaacatttttataataatttaactaataaatattatttaattataaccctcgttcctttttcctttaaaatcaaaaattgggaaaattccgttaattgatttgtttattaggccttattgcagcactcttccccttcttcattgatttgtttattttgttcatcttaaggggtcctgtaattaatttggtttagttaaaataattatgcaaaaaaataaataaataaaaaattgggctcataaattaaatttagataaaaaaaaacattcaaagccaaagagttagaaaaaataaatttgcatcaaagtataaaatttcattgaaattttaattgtttgaaatttaaaaaaatatttgttattattttaaataataattaactaattaattaattagaacattttttaaaatttataaataaatattatttaattatacggtcccccatttctttttcgctttaagtcaaaaattgggaaattccgttaattgatttgtttatttgaccccccttcccttcccgccacccgaactcgccatttcccgtatccctcgctgcaacccttcctcgccactctcgctgccgagcaatttctcgccatttt

SEQ ID NO: 91765 - DNA, 623 bp, Heterodera glycines
  SCN-specific regions: Sequence locations=1-581,605-623
gcgatcagaaaaatactcaaaatgttaacgtcgaatgtaattgtccaattttgaattcaggcattggtcgttgaggagaaaaatcgtccaaagttttcgctgaccgaaccggaattgagccctgaacagcttcgtcaactttttccggaattgtccgaccactggagaagagcattagccaaatcgcccgtggtgaagcgagccgccgccattcaggagcaggagcagaagcgggtcagcaagcacaggacgagcagatattggctggatgaacagttgagtccctctgagcacatttggctgccctcctccgcttcatccgcttcttcgtccgccgtggacaccgaatgttatttgggcgagaaggactgccagaagatgggggagaagcgccgctgcagcggctgtcacattgtggcacacacggcatgcttcccactgctggccaagatgaatttgagctgcaaaatgacttttcgcgactgcgcacaaagtgccaatgccaaaagtccgtcgtcaatggccgccagaaaacaaaggcacagcaaaagcgaacagaacaatggcaacgaattggtgagcaacaacagcacaaccacaaccacaataacaacatgtagcaa

SEQ ID NO: 91766 - DNA, 333 bp, Heterodera glycines
  SCN-specific regions: Sequence locations=1-333
ggatcgctggggtcgtgggttcgagtcccaccgggcgagttaccttttatgttctacaaaagtggccgcgccaaaatggccgcgccaaagtgacccagaccccaatttgacggcaattgaatatttagtggcacaaaattttagccaaaattcatcaatgatgcctgcttatggcacggaagggcaaaatgccaaagtgccattttttttaaatggaaaagcacacaaatggtgttgatgaaacctaatttggcaatgaaagcgatcaaaagaaaagaggggtgggacgaccgaaaaggcatcccagtgaatgaaaagtgtgcgggaggaaaa

SEQ ID NO: 91767 - DNA, 526 bp, Heterodera glycines
  SCN-specific regions: Sequence locations=1-6,28-526
accgtaccatccctccttaatttattcgttctcagttcgtacaaccgcagcggatgcgatggcctcgctgttgctaatgtctcgcagcgtcatcggcgactttacgcatgtgagcgacgccaaccaaccagggcgagagagagacaacggcagcaacaacggcaaactgctgacccatttggccaaacagagaccgaaaccggcacggctcaatcgcagtcgcattcagccgaccatggcaacggtgacaagcccgacggtggatgatgagcagcagcactgtgtggacgacacccctccgacatcctcctcaactggtgaaattttgccggatttagccagtaaaaccaaataaatacgagaaagtatgctggtcaatggtgatttttcatggggtactccttggacattcagctaatgaccattttgtatccgctgagtacgtttctgacccaacggttgcagcatcgtcaccggcaacggcacactgtgccaatccgaagtcggtaatttatggccgcttgtg

SEQ ID NO: 91768 - DNA, 625 bp, Heterodera glycines
  SCN-specific regions: Sequence locations=1-625
agttgactggcgcctggcggaacgaactggcgagggggacagcagacggcgacgggcgagcggccgatttggcggtgacggcgttgacgagcgcatgacgggacagaccggcgctggcgagggtgaaagctgacggcggcggtgggggacaaaggacaaaggcggggcaggccgagttggacggcgaatcggagagcggttggccggcagaacaagttggggacgagggcggttgggcacggcgggagtagggcggcgagagtgtcgtctttcggcttgcgccaaatcgtcttttgctcgtttaagcgccgcttttttctcaggcaaactcataattggtggggagaatttaggaatgttggaaggaattttggaatagatttcggagaaatgtgaagagtagtggccggagaacggcttaaatagtctccgattggaaaatcgaccgaagaacaagtgaatcataacagtgtttgaacggattatgcgaaaaggtcgaaggtggcggaatgatcggatgtaacgagtcactgagaatgagcaaccgccgaaaggtgaattgtcctccaatggcagaataatttgcaaattccaatttctttgaaaatgaacgagtgtataaaag

SEQ ID NO: 91769 - DNA, 652 bp, Heterodera glycines
  SCN-specific regions: Sequence locations=1-296,318-652
gtcaaattctcgacttttttgtcttggacgtcagcgtaacattccctttctgatggaaacagccaaatttgacccgcatgtcaattggcttccgccttgttatgcttcaacttctgagttttacgctgtaaatccattggatcaaacagatttggaggaggagagcggcaaagaaattgggacgagccaaaacactccttctggggaaaaaaaggcggaatcaactgggtggggcgcattggacgacgaacgacagcactacaaatgcgaaaatggcattgaaaccatcactttcccacagcaaaccaaacaaaaaattgatctcgacttgccaccactgccctacaatatgctcacccagcaatggataagcgacaaatccatcgccgatgcggtggaggcactcattggtgcacatttgattcaactcggccaagacgctgctctcaagtttatgaattggttgggaattcgcgttttgacgcaaaggccttgccttcgcagttcgcttgatgatcactctttaaaatcattatttttgctttacaataaattcgactttgccacagtcgaaaatacaattggatacaaatttgcgaacaaagcctatttggtccaggcattcacccacgcttcctacttcaacaatcgt

SEQ ID NO: 91770 - DNA, 632 bp, Heterodera glycines
  SCN-specific regions: Sequence locations=1-190,223-632
caaataaatgaccaacctggcaagcttgtccttttcatcgagttttcgaccaaatgcatccatgtattctctaaagcgttttgcccacctgtcaaatgtgaccacacagtcatccttgtagccttcaagtgccatgggatacgcatcagtgatcatgttgacactttggaaggatagtgcattgcgttgctgatcattatcctcatcatcgctgctggagctttcttggctttgattgagtgtctgtcttgcctgatgtaccaattgttgtacaggagggggaaccggcagatgaggaacgggtggttgagtgatagccatagcttgttgaatgttcttgttggctaaagtgagattttcgagggtttttaccttaccagcaactttcgaaatctcatcagtgaaggtctgaaagcctgcgttgacttcattggcgagggtgccaagatggttttgcacattgttggccttacgattgacttgacggatggtgcggctgactccctcttcgagtcgtatgagttcaccaaaaactttctcaacgtcctcaaaacggactgtgctattttgctgtttgccttgaaacagtgtcttatttacgactttaagaattgactcatcatcagaaaagt

SEQ ID NO: 91771 - DNA, 494 bp, Heterodera glycines
  SCN-specific regions: Sequence locations=36-58,126-168,190-302,325-494
taaaaaaaagaaaaaataaataaaaaacaaaaattgtttgtaaatttgaaatcagcggtaaatataataataaattaaaaaatgttttaaaaataatgaaacatataaaatatttttttttttttggttttttgcgacataaaaaaattaaaaatgttaagcgatgtatttatgtacaagaaaaatgatggtcaccttgtaattttgaatttcagttttaaaaaatagaaaaaagctaaagtcatattaaagagccaaataagaatggcacttttgctggctgaattttagaggaattaggcaaaaaataaatataatttaaaaccaaagatcatattttaaagaattaagaatattttgaagaaaaaataatgcaatttttaaaattttttcccgaatatcggtgaagcgaaaataaaattgttaggtgccggcaccggcggcacgggcgatgggcaacggcacatattaatgggcgagagagaatgagcttc

SEQ ID NO: 91772 - DNA, 313 bp, Heterodera glycines
  SCN-specific regions: Sequence locations=1-45,81-142,178-213,235-313
tgatggttggtggtttgtgaactaattttttgatcaattaaactgaaaaaaaaatatatatatatatatagataatttaacttagtttattgcctgggcctaaattgatggagcaattccttgcttagcttatgagtaattcaaatatttttaaaaaattattcaaaaatttttataccgaccaggtggtggtgccctcctgagccttgccactttcaatttcttcaacaacagtaggggtgtggtagaagctgttcagatatgattttatgccgtaaaatttgccaccagctcctttaaaaaaaaaaaaaaa

SEQ ID NO: 91773 - DNA, 641 bp, Heterodera glycines
  SCN-specific regions: Sequence locations=1-35,122-149,183-416,439 -499,522-641
atttaatattattttgcatttttttatacatttccattttttattttataattttccaatgttacaaaatttgaaaatataaattttacttttactaaacataaaattatttttattttttcggccggagaaaagataagtattcaaggtaattaaaaaataataaatatatttttttaaatgttaaatggccaatttaggaaaacttcatattcaaaaatatcttttggatttggcatcagatgtctatttaaatttgaataaacattcatatgaaaaatttcaaacacaagctcttcaagctttctgtagtgaaaattttttgaatgaaaatgaaatacaaaatttgataaatcagaatttttataaaaatggcaaaaaatgatagacattttttgtatgcagatgagtcaaggaaaaaacatagaaaattttgaaggaacgattcagaaattgggcattgaataaagggcaatccaattataattaatcaaaacctaatgttttcaaaaacaataaaattataccaaaattggatgaatccgaaattactttaccgaagaaaatgtcaattgaaaacaaaaataaacttttacaacatttttatttgggagtcaacgaattttttaaagcatttagcg

SEQ ID NO: 91774 - DNA, 615 bp, Heterodera glycines
  SCN-specific regions: Sequence locations=1-547,569-615
atcagttcaaatgcagcccatttcggccacagaatttgcttctttgaatatgcagcaacaaaccaacggaaactcaaatgcacagcaaatgcacgagggacagaatcagcagacaatgggaggcgcaaagaaaattggcgcgtccaattcccatcaaatctcacatcggcttgtcacttctgtgcccaacagcgcttttggccaatccaacggaatcgcatccaatgccttgggggcgtcggcgtcggcttcttcgtttctgttgcgcaactccaaagcgaactgtttcctttgtgaccttccgcgaatgccgtgggcaattgttcttgattatgcggaacccgtgtgcagaggctgtgtgaactatgaaggagcagagaagatcgaagcggtgatcgaaagcgcacgtcggatgaagcaggtccatgcgactctctccgccggcatttgtccgtccgtcatttccaattccgtgccaatgggccctttggaccttctgaacggcacttcttcacaattgaggtcgcatctgttttccgctcagcctgcacaacaaatctctgtgaacggaaatggcattggcttggccaatgccgcggcgtccgctcatcaccc

SEQ ID NO: 91775 - DNA, 595 bp, Heterodera glycines
  SCN-specific regions: Sequence locations=1-118,140-193,215-444,466-595
ccgaggaggacgacgctgaccaggaaatccggaggggacattcccggataagggccattgccatgttaagcgatccattttctatattcgtcaacattttcacccctctttatttaaactttccatttctcttcattttttctcatttacataatgttttcttcaactccaccatttgcccttttcttttcaatttttctgccattcacatctgcctccgaatttttgtctctttgttcacactttctcagatcacatttttccatttggccattctttcatctcatttttccctttgtttggcattttttctccccgccgatttttgtacccttcggcgtcgctcttttgcatcttaatctttgcccccccccagggggaaaatgttttggtacttaagtattgtttatcgtctaattctacacacacattcacctcttgctctttactggtttttcactcctcaccatctttttctttttgctgaatcattcccaatttttgaccccctcaataatccttatcgcctttccctgcctccaattttcaccatataatccatcaacatctcgcatataatatccaccaatttttg

SEQ ID NO: 91776 - DNA, 617 bp, Heterodera glycines
  SCN-specific regions: Sequence locations=1-8,40-77,99-521,553-617
gtttgagcattatttatcaatttttatttaaaaaataatcggcaataaaacagtggcccgacagtttggcacaaaatttattctttcattcattccttcgtttgtgccattattctctttgctctcaaaacgtgattccctagcgatgcccatcgacgctgctgctttgtgcttttccgttgcgcggcattaatccttcccttttgacagttggcacaaatcgaatcgtgcaatgtccgccccttttcccggtggccattcttccagcaatgtccaatcgcctgtgacgactccgtccagaggtcaacaaacgctgtctttggcggctgctttggttcaacagcagcaacaatcgggcacgaacacaccgaacgtaccgcaggggatggagcagcaactgcaacagaccgacctccgttcgctgcagttgcagcaacaattcaccgcccttatgcagtcacaaccccaacaaccgcccgctgcccacgcgcacgcggcacaccaaacagcgcagcaaaatgtccaccaacaccaccagcagcagcaggcatcgcagttgtcttccgcttttctgccccatcagcagcatttgctggaagggaccgcgcaaagttcca

SEQ ID NO: 91777 - DNA, 319 bp, Heterodera glycines
  SCN-specific regions: Sequence locations=1-130,152-319
atatttttttataaatttcagtaaaactcgcaattgcactgtcctttttcagttgaatagaaaaagacatatgggagaaggaacagacagacagcagaaggacaacaaacagaaaatgagcaattagtgataaaagggaaatgataaaatataaaaaaatatgggaaatgataaaatgggaatttgacggaggacagagaaagaaaggcgttattttgcagcagcaaaaggaaaagtgaggacaaaaacgaattcgcaattggaagagtcaaaacatttgggaggagcaaaaagagacaaacattcaataaaaaaaaaa

SEQ ID NO: 91778 - DNA, 595 bp, Heterodera glycines
  SCN-specific regions: Sequence locations=1-133,242-595
aaacgacagatctgatcagaaaacaattggcagagatcgaacgagagattgccaggaggatgcagaacaaaaatgtgaagaaggtcgagcggggagacgccgcaattcactttttagggtttttgaatgaatgtctttctttctctcgtcacatcccttgtctctctccatcactctctttctcttgctttccctcttttatttctccgttctatttcctctgtcctttttgttttcttccgcacgggtttcggttcggttcgcctcgctaaatggccctttcagatggacgagcaggagatgaaccagctgttgttgaaccacgcgttcggcttccaacagcaaatgcaaaacgggcggcgacagggcgaagatgtacggggagttggtcaacaaacggaggtcagagcgaatgagtcggtgtcgtgtcgtccatcgtccacctgttcctctgtgtccttcttttttggatgctttcactgtttggccgcttttctctaacctagagtgcgctgggaccgggaattttgggcaaaaccgggaccgggacttgccgggaccaaagaagccgggaccgggacttgccgggacctaa

SEQ ID NO: 91779 - DNA, 256 bp, Heterodera glycines
  SCN-specific regions: Sequence locations=1-198,220-256
gccacaggggccatcattctccgtaaatagcaaaatcgatgctttttgttcgcttgtcattgtcgccccccccattaagtgtccattcattatccggcatggaattcgggccatattcgcattttcgccacttaccgggcccattccaacgagcgcatcaacgcccttttgggcgttcgcattgggctgacccacgtgaacatcactctgggcagtgagttcgaaatggggataaacaacatgccaaaatttaaaa

SEQ ID NO: 91780 - DNA, 651 bp, Heterodera glycines
  SCN-specific regions: Sequence locations=1-220,242-651
taaatatttaaatgcctaatatgattttcagttgggacacggccaaagaccgtgccaatttgtacatggttatggaatttctgcccggcggcgaactgttcgcctattttcgagcattgcgcaagttctccagcactgtggtcaaattttactcagcagagatcattttggcacttgagtatcttcattccaaacaaattgtaacatcgtggcaaaacggaaatatttaatcgacaaataattcaaattttaggcttatcgcgacctaaaaccggaaaatctgatggttagcatccacggacacatcaaactaacggattttggctttgcaaaagtcatccagaacaagtcagtcattgagtttgtgttgcattttttcagcttttttttgtcccttctcaatttgccaattaatccatggccatcatcccccggcacattctttcaaatgatctttaggccaattgagaatcgcataatccaaaaatgctttcccattggctaataacagctgttccctatagcactttctgatcacaaagatcgaccgaatcattgtgaaaaaatcgtgaaatttgtcagaaaagctcacaactgaattagcccatccgccgaagtttcgatgggaaatgggcaaattcatttgtcagt

SEQ ID NO: 91781 - DNA, 633 bp, Heterodera glycines
  SCN-specific regions: Sequence locations=1-339,361-432,454-456,478-633
cgaactgacaaatggaaaaggtcatcctcgccgacatcgaaaaggcattcctgcaattgggcgtcagagaacaggaccgcgacgccacgcgattcctttggcttgctaacccaaaggaagcaaatctcgaacagctgaaacaagaagacttccgcgtcttccgattctgccgagtcagtttcggattaaccgtgtcgccatttctgctcaatgccacgatccgggagcacctggcacttcacgacacggatgttgcacaacgcatcagtgacaatctttacgtggacaacatcatggtggaagtcaaaccaagtgaaagcatcaatcaactagtcacggaagcaaaaatcatttttgaatccgccggaatgcggatccgcgaatttttcggaagtcaaatcgacgaactcaaagagcttgactcatccgaattggccaaagacctcgaaaacacaagggtgttaggcattgaatggaagccacgacatgaccagctgatcttcaaaatgccgctcttcacaagtccaaccacaaagcgaaacattctgtcacacatcgcaaaagtgtatgacccacttgggcttatttctccagcactgttgcccgccaagcattttttgcaaatcgtccaaa

SEQ ID NO: 91782 - DNA, 572 bp, Heterodera glycines
  SCN-specific regions: Sequence locations=1-132,154-572
cagctgagtaccaagagaaaagccaccaaatgcgtgaacacaacaattgcaacggaaatgtgcaggaaaaaaagagcgtcacttttgtgtcgagtcggccgagttcgtcgctgagtgtagccagcacaaatacaaacagcaacgacagcaagcagccgtttaaacgatgtccactgaaaatcgaccgatatcgtaagcatctcagtgagattttgcattcgctggagaaagtcgcaattttcattggggaaacggcgtgcggaaagagcacccaaatccctcagctgtgccttcaggctccgtggtcatccgaaggcacaattgtagtcactcagccgaggcgagtggcggccaaaatgttgggcacgagggtggcccaggaattaggcactgcggtcggcgaattggtcggctacaaattccgctttgaagatcagaccagcgaacggactcgactcgtttacatgaccgagggcattctcttgcgcgaattgctgcacaattgtcggctcaacgcctactccgccgtcattgtggacgaagtgcacgagcgttccctcaacccgatgtgc

SEQ ID NO: 91783 - DNA, 526 bp, Heterodera glycines
  SCN-specific regions: Sequence locations=1-425,447-526
gcttttggctaatggtgaaaaatgaatcctcaaaataattgtccgacagctgcggtcattgcacaacagtcgcccccaaatgctgagcccgattcgctgttcgcccagcaaagcgtcgcgggcgaagacattccgtggtggcaaaggaattttctgctgcaacagcccactttggtgaacgcttggaatgccgtctttcccaccgttgtcgtcaacattttcggcattgtcattttcctccgtatgggttggatcgtcgtgcgtttgcctttgattcggtgccattggttctgccgttctcccatttgtccagggcactgccggtctcttccaggcatttgttgttctcgccctgtgcacccttttctcctcagtgactgtcctttccgccattggaatttgtgagcgatgtcagattcgcagtggtggcatttactttttggtttcccatgtgctcggaaaacgaatcggtggggccgttgggctcatttacacctttggtcaagcatgcgcaactgcactggtc

SEQ ID NO: 91784 - DNA, 495 bp, Heterodera glycines
  SCN-specific regions: Sequence locations=1-167,244-320,369-449,471-495
gggagaagaccccaattccccaaaattgaacaacaactgttcgaattggtgcagcaccaattgacggcgggggaatgcgcgtcgaacaaatggatacgaaaaatggtaaagaaattgacaacagtgggtacagagaatgccaatggaaaacggatgaaagaggacaaagaaaaagagagggaaaaagagcgaatgggcgaggaacagagaggggaggacagagaagcagagggagggaaagagcggtgccaattctcggaacggtggctgaacaatttcaaaaggcggtatggtattcaaacaacgatggagggtactgtaaatgcggaaggagacgaagagacggaagacgacgaggcggagagagaacggcggggcggagacacaattttagtggaaggcactctgtcgctggtgattgcggggggtgtcgcctgtctgctcacttctctgatcactggctgagtttgtgcctttcgctgctggggcaatttg

SEQ ID NO: 91785 - DNA, 610 bp, Heterodera glycines
  SCN-specific regions: Sequence locations=1-235,257-610
ccattatcgctggacggaagagctggaggatcgtctataatgactcgcagcgttgttggagctttgggaaacgaaatagggacaacacccaacagaaagaacaatttcaacaagccaccggctcaaccgacaaagcaaacgccgaattccatcaaaaaacagcgaaaaatggccaaccaaggaatgattcaaaccaacgaaggaatgttgactgctggccaaaatatcacaaaagaagtgcagcaggagaagcagaattctccgactctaactgccaccaataaaaccaacgagggaatgttgactgcggaacaaaatatcataaatgaagtgcaacaggagaagcagaattctccgactctaactgccaccaacacatccttttacactgcccatgagagttcctccattggcgaagtttcgatgtatgagcacgttccattgacggaaaatgagcccataataacgcctccgaagtcgaccacaccgcccgtgctcatcgtcatcccgaatcaggaagaaaaggaggaacgccgtcgacacatcaaagaacttctcgcccgcactcgccaagaggctaatggcccgccaaatgcgcagaataacggaa

SEQ ID NO: 91786 - DNA, 474 bp, Heterodera glycines
  SCN-specific regions: Sequence locations=1-266,289-474
caaataaaatttaaatctctttctaaagggtcttgaaccaatggttgtgccatcgaactgtccagaagatttgccccgaacaatgcaagtggacccatttgttaagcaaacggcacgccaaaaggcgaccgatgttgcacagcgaatgattgatgaaaaagtaaataaaaaaaattaatgaaaaaatgggaatccgcgcgttagcctcatggccggtatcgaaattttttgaaattttgcacagatacgaaacaactggcaacagccggatttacccctgactctattgcactttaggcctccaatcaatgggaccatcttcagtttcttaggcctgagaaatccgaaattcaaaaattttcgagtaaattcaagaatgtagaaattacccaagtaaggacaatttatggcctaggaaactgagaagggtcactgattgaacgcctaaagtgtaatggagccgtaaattcctaa

SEQ ID NO: 91787 - DNA, 619 bp, Heterodera glycines
  SCN-specific regions: Sequence locations=1-619
cggcgggccacatttcccaacgctgcctgctcttcgggactttatctacatgtaccggatggacgcggacaaaacgctgagccaaaattacttgatggatatgaacttgactcggaagatggttaggagagccggagacttaacgaatgcgtttgatgtggaggtcggaccgggtccaggtggaattacccgagcaattcttgagcagccgtgcaaacgattggacgtggtcgaaattgacaaacaatttttgatgcctttgcagcatttgagcaatcattccatggagcggatgaatgtccatcgggaggacgtgctcaaatttgactttgaacaagtgtggacggatgcgggggcggccaaatgttcatgggttgaggagcatccgaattttcacatcattgggaatttgccctttcacatttcaacgacgatggtcataaagatgatgagacaaatgtctattctccgtggaccgttcgagtttggccgggttccgctcacctttaccttccagtacgaacttgccaagtgtgtagtccgctaaacgtgcaccgactttcactctcccatctgagtgacatgccacaatttgaccgagccgctcattctcattcat

SEQ ID NO: 91788 - DNA, 207 bp, Heterodera glycines
  SCN-specific regions: Sequence locations=1-207
ctcgcatcaaatttcatgaacaaatcccttaattcctcagggaaatcctgttctggaatttctgggacaaaaactttaccatagtggcaacaatccttaaaagaattgccacgaccatgaattttctcctctgcaaagtgcagagcatcacaaaattcacatctctcattcatttgactaagtctatgttcattagcattctcatga

SEQ ID NO: 91789 - DNA, 652 bp, Heterodera glycines
  SCN-specific regions: Sequence locations=1-594,616-652
cctcaacagcgtggcccaaggctttctgacacgcgaaaagagtgctgcaacgagtaatgtaccgttgagaatgccaactgatgataccaattcgtaccaagaaaaattggatgaatacttttctaaattaagtgagaaaaatttgagcattcttgatgaattgggcatgacaaaattgaccgccgaaatcaaaaatttgagcgaagaggaacgtgcgatccttgaagccacaaaggaaatgggaacggaagcatggattcaggcgtaccgtgagatacgtcttgtctgccaattcaactacgacgtcaataggaatcgttttgtcctgaacaccgacccacggtacgttaaaaggtcaaagtctcgcctcagctcgcttacattctcggtttcaacaacacggagtttattcaatctgaaaacgaggcaagattcatgccggacatgagcggtggagtgtcatccttccacgtttacacgccggatcttattgaaccaatgatgattggtgacgtcacggcccccgtgttgcgcatagtgaccatacgcggaaacccggaccaagtagttgaagaacaattttttgccatacagtatcataaacttttattaaaggagttttctgaaattctgattgagatacgtaccaata

SEQ ID NO: 91790 - DNA, 241 bp, Heterodera glycines
  SCN-specific regions: Sequence locations=1-241
ggacaacagagcgtccgaggccttttcggccattctgcaaataaaagatttggcggacagtgacgccggagcctatcgctgtgccattgtgaatctttttttttatggcaatgccaacttcaatttgaaacttactggtttcggatcgccaccattcgttgagaaaccgcaaatttcctcacatgaccacggccggctgatgatcatggagggtgaggatacacccgtttggaaaccgacg

SEQ ID NO: 91791 - DNA, 152 bp, Heterodera glycines
  SCN-specific regions: Sequence locations=1-152
gtgtgttttcggcctttgattttttcgtttatgcaaaacaggtggatgaagggcttaaaaaagcaaagcaacaagtttcgtcagttgccaatgctcagtccagtgacgaacaacgacgaaaactgctcacagaaatcgcggcgtttttcaaa

SEQ ID NO: 91792 - DNA, 652 bp, Heterodera glycines; identical to SEQ ID NO: 60259
  SCN-specific regions: Sequence locations=1-34,75-304,329-344,444 -540,564-652

SEQ ID NO: 91793 - DNA, 665 bp, Heterodera glycines
  SCN-specific regions: Sequence locations=1-267,289-665
cttccgcttcttcgatttccgtgcccgattttgtgagggttgaagaaattcccgaggaatgtgccataaaacgcgtcccctcggctctatgttcatttgtcgacccattctgtgaccctaagaaacccgtcaaaacaacattttcggacatttccactgctgcatttaatatccgtgacggaatccttcggacgcccacaattaagtcagacgctctgtcgtcaatgtttggcgtcgatttgttcttcaaacaggagtatttgcaagtgaccggcagcttcaaagagcgaggggcgcgctttgcccttctgcgacttacggaagagcaacggcgaatcggagtgatcgctgcgtcggctggcaatcacgcactttccctggcttaccatggcagcaaattgggcatcccggtgactgtggtgatgccgaagttcgctcctctaatgaagatttcctgctgtgaatcttacaaggccaaagtcattctccatgggcttaacattcaggagtcaaagatattcgcttatgagttggccaaagagaaaaacctcaaatacgtcaacggattcgacaaccccgacgtaattgcaggccaaggaacaattggactggaaatactggaccaagtgggcgatgtggacgcaattgttgtccccgtggggggg

SEQ ID NO: 91794 - DNA, 575 bp, Heterodera glycines
  SCN-specific regions: Sequence locations=1-575
atggaagggaaaagcagaagcgggcggaggagagactgtgagggattatgggagaagcaatcgctgctcgacccccccccccccttcgtcttgtacataaactgtccgtcgttgcccacgtctatctgctgcgcaaataataaaatgcttactccccccttcccccggcgcatttgcccattcgattccatcgataaaatattgagaaattctaattaaaaataaaaaaaagagagagagaaagtaattaatcagtagacggcggaaggaaagggatgtgagagaatgaataataatgattgagcaatgaatgccaaagggcactttcactgatttggcgatgcctttgaaaactcacgcaaatgctccccctccgtctcttccgcccggccctttcggcggtgtcctcgtccaatttcttctcgcccattggccgcgcgtttcgtcgccaccgccccaacaatttgcggggaattattatggaggtgaagcaacagaacgaagagaacgatgagaagcgggggaatttgggaaggaaaagcgaagaattgggggaaaaccatcggaaaataaaa

SEQ ID NO: 91795 - DNA, 663 bp, Heterodera glycines
  SCN-specific regions: Sequence locations=1-186,255-407,429-663
cacactttttccaattattacctttatgttttataaatttagtcatattcaaacctagtggttcctccccgaccctatctatctgagaaaaagtcggggatgggggaggatattcttcgaaaaaatgccggcgatggctggggaaatttaaaaaaaacgtcggggagcaataccactgttggcgtctaaatttctttaaaaattgaaaaaattattaaaaaaaaactttatttaaagaaaaaaaatcttataaagtcatttgaatacaccatttagagaggcaaaacaactttttgcttatgaaaaaaattttttcatcggagatcaacctttaacttgttatttaattattaacaatgtgcattttgccaacaacgtataaatgaacgctaattttaaaatttcggtaattttttaaaatttcttttggcgggaaatatcatttgggagagagacaacgcagaaatgagagggtgctgcaattcagtattggtcatacaaagcattttgaaatccttcttccatttcgaataccaaatttgtgctggtttctttaaatatctgataattgcacatttatgaagtcttgctacaacttttattttatatggcaatccaagctttattaaatgttgaaatgaaaaaaaatgcaattaaaaagta

SEQ ID NO: 91796 - DNA, 662 bp, Heterodera glycines
  SCN-specific regions: Sequence locations=1-427,454-662
atttcatcctcaaatgttttttacttattgttcaccttctcatttacattttacacaaaaaaattcaccatattcattgcctgtcacattgattcaacattaccacttcttttgcatcacatttaaactgttgaagcgggtgtcaacaaaaccggccaagtcagaatgggctacattctttttattccatcaaattcatgcaccgaattgatttgctggccacacacactgttgttcaagttcgagcttggcattaaggcggatgatgaccggcgccagtgctgcaaagtgcagagacggagttggccaagaccgcccatttcatcatgcgcctggaggcgcgcgcggatgacatttggcaacgcttttgcgccacatccatttgctcacaatcagcggcaacaagtacgacaacataaaaggcgtccaccaaaaacaacaccaacaatggcaccattggtgggccgaccagcagcagtgtggcttcatcatcaattgttgtccaacgggcggacaaccaaatgacgcttactgacctgtccgagcgctccgattcgctggaatgggcacaacgaaatcgcaaaaagcgcatcggttcacaggcctcaaccgaactttcccctggtgggaccggcagtggtggcggcacttcagcaacaggc

SEQ ID NO: 91797 - DNA, 620 bp, Heterodera glycines
  SCN-specific regions: Sequence locations=1-41,63-116,144-620
gtttcttcatgttgatcacacttccactcgcttggcccatcggaaagcttttggattgtattttgggcgaagatttggttggcatggatcacgaaaagttgttggaaatgctgcgaatggcacaccaacacagcgaacaccacgaagaactcgcggaagatttgaaaattgctgttggagcgatggaaattgcggagaaaattgtgcgcgaagtgatgacaccaattgaggatgtgttcatgctttctgactaggccgtgttggactcggattgtgtggcggacgtagttcggcgaggctacagtcgtatccccgtgttcacgaacaacgaccgtaaccaaatcaccggtttgcttttcatcaaagatttggcccttttaaagcccaacgaacgactgaccgtttccaccatttgcgacttttatgcacgcactttgcgtttcgtcaccgacgacacaccgttgcaaacgatgctcgaggagttcaaggagggtgaatatcacttgggcattgttttgtcggagaatcacaatcgcgtggtgggcatcatcccattggaggacattgtggaggaaattctgcagtcgaaaattgtcgaccaaagtgaagttgtgtacgac

SEQ ID NO: 91798 - DNA, 178 bp, Heterodera glycines
  SCN-specific regions: Sequence locations=1-178
gccctccaaagaccctctaaaggccaccgatttggtcactgcggccgctgtgctgctcgctctactcgcaaacctcaaccaaatggccattctctcctccatgccctttctgctcgcttatgccttcgtaaattattcttacggttcgttggcaatgagcgacgatttggactcattg

SEQ ID NO: 91799 - DNA, 653 bp, Heterodera glycines
  SCN-specific regions: Sequence locations=1-130,152-157,179-403,425-653
gaagaacaccggaaataccgcttttccgattctgaatgtgcattgttgcgcgttaaattggttggagtattttgcataacgttctcatcattgtctactcggtactggtaaaacaagggaatttggcatcttgggctggcatcatttcaatggcctatttgttttcaagaaaacggctgaccattaaataagttgaattccaacgcacttcgacatccttaatcatagattttgcattgttatttatttgaattttattactttttgtaaagtttttagtggaagatcattttcaatttgcaatgctttgaaatcgtcagcaattatgcgcgattttcttatgcgacggattgcttttttcattcgttcctttacatcgaaaatcccaccaaggagctttaagccatctccaacagccttaaaatagccaaatatacacaaaattaaatgtattttatttaccaattgaattttgtgggcaaaacattgcatggaattataaccgagcaaattggtcgccaatttcatcgcaccttcgtcatcacgtagaatcaagtgtaattttttatcagtaatttgataagcgttcaaagtcttaaaaacacagacatacattttaagctttacccaaaaattaacttttgaaaacatgt

SEQ ID NO: 91800 - DNA, 566 bp, Heterodera glycines
  SCN-specific regions: Sequence locations=1-566
tcgggcttctttcgttggcggatcgtattgatgtgctcaattcacttactaccgaagatcgcaagttgatggtccgtcttcacagtcttgaaattcttggcgtttcgaaagttttcgatggaatcagaaccgcatacttggcactcaaacacaggaagaatcgcaaccatcgtcagcgtattgtcgtattcttgggcagtccattagacccgttgcttgaagaaaaggaaacgtttataaaattcgctaaaaagctaaaaaaggaaaaagtgagtgtcgatcttgtcttgtttggggaggccaccgccgagaataacaaaatcattgccgattttgtcgaccttcttaacggggctgaagagggaaattcgcatttgttggtcgtgatggctggagacaccaaactgtatgatgtttcgctccgttcccccatttttgcggcctcgggggctgcattaggcgcacgcggcgaatttggcatcaacgaagaggaccacccggaattggccatgccattgcccattcccttggaagaggagcgtcctccgcccccactgtcagcaggg

SEQ ID NO: 91801 - DNA, 536 bp, Heterodera glycines
  SCN-specific regions: Sequence locations=1-367,390-467,489-536
gaagcgggagaaattgggagcggagaagggacttcgaactattctcaagaaaatacggacaaaccgaagcgaaagagaaggaccatagaggaaattgagcaggaaaagttgaacaaagaagtgaaccgaatttgccgtcagattcaatcggcgaaaaactccaagtgcgaacaattccttttctgtcatttttcgtcgaagattctcgacttggacggttttctttttttgcagttaaaaaccctgaaatattaacgaatttggctgattaagacaaattgagcgatgagctgagaaaacgctttgaggagcgtggaattgaacaacaaattgtttatgacaaatcgcccaaaaatccgatgcaaattttttggcgcaaaaagaaattggaagcgtaccttgacggtgagcaattgcacaaaacggagagaatggaattgcaaaatgtgttctgttgcgctttgagcggtgagacattttctgtgctggtcaaaagtcggggaaattcgatgatggattatttggacgagcaaatg

SEQ ID NO: 91802 - DNA, 446 bp, Heterodera glycines
  SCN-specific regions: Sequence locations=1-215,237-446
agctgatgcacgagcactgtcccaacccagaagggtttgtgctggccaatgactccgattacaaacggtgctatttgttggttcggcaaacattgaagcgaatgccaaccgcaaatgtggcggtggtaagtcacgacgcctcccatttgttggtccttttggacgccaatggccgaccgatgcttttccatcgggttctatgcgatttgatttgcagcggtgacggcactctgcgcaaaaaccccgaactttggcggagttgggacccactgacaagtgtaaatttgcacaaacttcaattaccaattgcgcggcgttgcttggaactattggacaacgacggtttgatgggctattcgacttgttcattgaaccccctacaagatgaagctgttattggttcacttttacgtcaatcccaacggaacagtggaacttggggggac

SEQ ID NO: 91803 - DNA, 438 bp, Heterodera glycines
  SCN-specific regions: Sequence locations=1-438
aaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaaatggtctaagtaaaaatcgtaattacgctcaaaaagcttctcaaacaattttagcgcttccaattccttctacatttttttttatacatcccattatgagcgctaaaattatcagagtgccgaaaatcgcatgtgatctaagcctaaaaaaaatggtctaagtaaaaatcgtaattacgctcaaaaagcttctcaaacaatttcagcgcttccaattccttctacaatcgcctttatacatccccttatgagcgctaaaattatcagagtgcccaaaaccgc

SEQ ID NO: 91804 - DNA, 579 bp, Heterodera glycines
  SCN-specific regions: Sequence locations=1-161,204-245,268-356,378-579
ctccgacccaattgtctgtctctacttcgtttgtgcgcaaaactgacaattcccgagactcgggatggccgaggagtttcgaccaccattaatggggttggcattccgtcccaccccctgaagaaataaaaaactaaacatttttaaggaaaatgaagcataaatttctttaaaatatgcataaaattttccccagtggcgcctctcggcagcgcctctgacgacaaaattgccttaaattcttcaaaatttgaccccaaaatgaatgaatgtgtgggcaatgttttccccccccccctaaatgccaataacatcttcctgaatttcagctccagaacattgaggcaaaggtaagcaagcggaagtgagtggctgccccgagggcgtccaatcggtttttatgggtccaatcaatgggccgggccatcactcagtttcttaggccataacttttttcttacttgatcaatgcccacatttaccaagccaagaatctatgccttggctaaataagaaaaaaatgatggcttaagaaactgaggaaatgggccataaagtgcaatggagccaattttgatc

SEQ ID NO: 91805 - DNA, 561 bp, Heterodera glycines
  misc_feature (485)..(485): n is a, c, g, or t
  SCN-specific regions: Sequence locations=1-43,65-127,149-338,360 -363,394-433,457-477,530-561
ttaaacagccaacaaagataaattaattattttgttttatttctgtgataatctttataaaaattcattcccttttgaaagttgcaaagaaattctgtgggacttattgtggcacctctctattagactcttgtctaatagctcctgtaatctggttttgcaactttcaaaaaagtaacaaattacgaattagcaattttatattcgaaaattttgcagttgataattgttgctataaccacgatgtgtgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatatttttggagaatgttttaaagaaggataaaaataattattttattttaccgtcaatagatatgcatatgtattttanatttttattgttatgtaaacttctaatatatatatatttatatacataatcatatgagttggcggttttaagaaac

SEQ ID NO: 91806 - DNA, 413 bp, Heterodera glycines
  SCN-specific regions: Sequence locations=1-392
cgaaatggtgagaccggctgcagcgagcacaaaggcccccaccaatcccgcgaatacatgtgaatggtttgtggaagtagtcgagacttccttggaaagctcgtgaaatttcgtcgtcattccgctaaactttccatcaaagtcgctacggaccctcttttcaagggtgagcaagtcctaaacggagtttgttcgattgagttaaacatttaaaacaactttccaatcgacgacaccaacagtcgaatagtggcgaaaagagtcgcttcttaaataatatttgggtgaattgcaaacactttcgtcatttggaccaaccgagagagattggcctgcagagttgcgcccgattgacccgtcacccacagaaggcgaacacccacttcaaagggaaaaaaaaaaaaaaaaaaaaa

SEQ ID NO: 91807 - DNA, 564 bp, Heterodera glycines
  misc_feature (334)..(334): n is a, c, g, or t
  SCN-specific regions: Sequence locations=1-18,60-64,88-250,274-564
gagagaactagtctcgtgttttttttttattttaattttattttttaatttaattttcaatcaattcaaatatttttattaaaaattcccgaccatcgtcggccacgagggtgccggcgttgacgagtcggtgggccccggcgtgcaaagtgtccgtgcctgtgaccacgtcattccgctgccgttgtgccaatgccgcgagtgcgacgtttgcgcagacccaacgtcgaatctttgccgaaaatttctttatttgtgagggaattgatatggcgtgtcttttattattggaaatggttgacaaaaacgaccaaaaaatcacagactttttttntggggggtggcaccacccgtttttcgtgccgtggacagcccatttaccatttcgtcggttgcagcacgttcagtgagtacacagtgacgccggaaattgcggttgccaagattgatccgtcgttgcccctggacagaatggcactgctcggctgcggtgtcaccaccggttacggtagtccgatcaaagggtgtcccatccgcgccggcagtacggtgggcgtgtgggga

SEQ ID NO: 91808 - DNA, 671 bp, Heterodera glycines
  SCN-specific regions: Sequence locations=1-327,350-459,481-623,647-671
cttactgactgctttgtgattaaagatttgaaaattttgaaaatgcagcagcatccgatgcatcatcacccccattatcagcaaccgcaatttgcctatccacctccgccgctgtctgcgcccaacgcaggcaccggagcacatatgcagcagcagccgactccgccaccacaggcggcacaacttcacgccatggcggcgtccgctacgcccaccggactgttcatttacgctaccaatttcggcacctttcagcaggcggcggcggcgatggggccggtgggcgaaccgccgcatcagcagcccaatgaactgatcggcccaatgcccggacagcatcagcaacatccgatgcatcatcatcctcactatcagcaaccgtcgttcgcttatccgccgccaccgctctcggcgcccactgtcagcaccggaggagcgcacatgcagcagcaacagacaccgccgccgcagacggcaccgccgacgcaccaccaacacgtcatgcccaccgcactgttcggctacaatcccaacatcggaccattccatccgccaccggcgatgggaccaacagtcgagcagccgcatcagcagccgaatgaactgattggccaaatgcctgtgcgacatcagcaacagcagcatccgatgcatcaccacccccactatca

SEQ ID NO: 91809 - DNA, 422 bp, Heterodera glycines
  SCN-specific regions: Sequence locations=1-422
gtttagaagaaacggaacaccatcagcagcaagaacagattcgccaagctttgcaagacgaaactattcctgcccatattcgctcgctgattcgagcaatttctgatcaattgtccgataaggtgacagaaattcaagcacttcgacgtgtttttggagacaaaaagtacgcacttttgctcagccgcggagcagctttgatggaggaggaagctggttggcatccggacatgctttatctgttttgcattggccttatcgtcttcattattctcttcgcaatccgtcaatggattaaaggtgcacagtttcgcgagaaagtcagagctcgtggggcggtggccattgtgacgggcgcgaacagcggaattgggaaacacctggagcgcgagctcaacctgcgttatgtgaaagtgtacatg

SEQ ID NO: 91810 - DNA, 556 bp, Heterodera glycines
  SCN-specific regions: Sequence locations=1-556
gtttgaggtccaaaaatatccgaatattcctccgtttgtttattcgctatgctccgttaccttcgttctcgtattggcagttcgtatcaagtgaagagcgaccattttgacgatttcgtcgacttcagcaaactgacgacccatggcttccctcagaaagcttcttcgatgtccgtggacgagaaattgggatatatcgcaattgggacgaaagacggcagacttttgatattttgttcaaacggtgcccaacatttgtccgccaattttggcagcaaattgccgatctgtgcgctttactttgtcgcagcattttgtacggtgtcaaatcacttctgatcagctcactgtcacccatttgaacaatgaaaggcatttgaagcggatcacttgctgtgagatggttggcctcgccgatgggcagtccgcccttctgattggcacaataatcggcaacatttatgcacttttggtgcgcaacatggaacttactgaacatgttgtttttctcgacaccgctctcaaagacattttcgagttcgattctcagcaaaag

SEQ ID NO: 91811 - DNA, 489 bp, Heterodera glycines
  SCN-specific regions: Sequence locations=1-6,152-175,201-342,364-489
taatgcttaattaaatatttattatcctttttaaaaatcaaatttgaaataaaatcaatttaaaagttattttataaattgttttattaaaaataagttaaatgaattattaccaaaaaaaaaaaaaattaaaaggaaaaaaatataaaatccctctaattaaatccgggaagggtttaaaataatttattttatttaaacgggcgcgaagcgcccgtctgagctcaacaaaatttaaaaacgagctcttagcgcccgtccgagctcaacaaagcttaaaacggaaagcacgcctgtcaacaaaatttaaaaacaggcgccaagcgcccgtccaagcccaacaaagaaattttttaagaacaataacccgtttccaaaagtttttttaagtcagaatattaaaaaagacaatcgctgcaataaattttctttataaagatttagtcccaaaaatccgcggatcacagtcgcgcattgcggattcaaatt

SEQ ID NO: 91812 - DNA, 545 bp, Heterodera glycines
  SCN-specific regions: Sequence locations=1-545
cgaatttggaggccgaacagcaacagaagccaaaggaggaggcgggcgaagagggcactgaaaatgagaaaggcccaccaaccgaccgaattgcggggacagacccatgggcactgagaatcggtccaccgccgaggagggaggactgttgcacggacgaatatgagcttttatgtgtagaaaatttggacgaacttttgagcagtgagaagcaaaagccgaccaacgaggacgacgacgagtcggccccgccgtggcgcttcgggccggcccaaatgtggtacgaccgttttggggtgccggcgaacccgtcgaatttcgactacggactgaagaggcggggcacggcgctgtcgaaacgttcaacggacgacggcactatgccattgccaagcgaagatgaccgcaactttttgccagcgcatttcttacattgggaggacgacataatcattgaccctgaacaggcgcgggaaaagctggtgaaggaactctcttcggccaaactgccgcgttgcggatggattccgacgccgtacacgcgc

SEQ ID NO: 91813 - DNA, 248 bp, Heterodera glycines
  SCN-specific regions: Sequence locations=1-248
taacccattttgaaaaaacatttgtattccattaggtgcggatgtgccaaatctccagtaattttgacggattcccgccctcccctttaacgtacgaccgaaaaattgaaaagtttacactcttgcgctgaaacggcgtgcgcccgccacttcgctggcacgggatttgaagtggtcaagcaaaaggtcggcatctttgcgcagcatttggcccgactcactgaagttctggaaaaaaaaaaaaaaaa

SEQ ID NO: 91814 - DNA, 205 bp, Heterodera glycines
  SCN-specific regions: Sequence locations=1-205
gatcgaaagcagcttttccgattggaatgctttctaattcaaacatgtgaaagcatacacagaccaagaaggggcgaacgaacgaatgctaactcaattgagcgccaaacagttcattgacaagcacaacggagcgtaaaaagaggggatagtgtccttccatagccgggagagattcatattgtctacctgcccttttccgaat

SEQ ID NO: 91815 - DNA, 595 bp, Heterodera glycines
  SCN-specific regions: Sequence locations=1-595
attttatgctaattctggctcttttctaagaacccgtgcggataatatcaaagcaaggaagtcttctgctcgcctttgcagcctctgtacggcactggggccaacactttatgtgtcgttaattttatgctaattctggctcttttctaagaacccgtgcggaaatataaaagcaaggaagtcttctgctcgcctttgcagcctctgtacggcactggggccaacactttatgtgtcgttaattttattctaattctggctcttttctaagaacccgtgcggaaatataaaagcaaggaaatcttctgctcgcctttgcagcctctgtacggcactggggccaacactttatgtgtcgttaattttatgctaattctggctcttttctaagaacccgtgcggaaatataaaagcaaggaagtcttctgcacgcctttgcagcctctgtacggcactggggccaacactttatgtgtcgttaattttatgctaattctagctcttttctaagaacccgtgcggaaatatacgtgcaaggaagtcttctgctcgcctttgcagcctctgtacggcacttgggccaacactttatgtg

SEQ ID NO: 91816 - DNA, 543 bp, Heterodera glycines
  SCN-specific regions: Sequence locations=1-120,142-338,361-543
ggtcgtacacggaggagccgcacgccacaaggcgaagtcaaattttggaaaggcatccggaagtgaaggaattctttggcattgaccaaagcttcaaatatgtcgttgtttcgatggtccttttccaattgctcatggccttctttctcagggactcgcattggcttttggtttgcctccaagcgtatttcgtcggtggcactttgtctcattcgctgactttggctgtccacgagtgctcccacaatttgggctttggccattccaaaatgcttcagaatcgtctcctcggcttcgttgccaatttgcccatggccattcccatgtcgatttccttcaggaaataccatttggtgaacaccatcgcaatttgggcgaagatgtcgtggacactgatgttcccaccgaatttgaggcccgttttttcaccggcaaagtcggcaaattcgcttggcttttcctccaacccgttttctacgcaattcgtccctttgccatttacagaaagtctgtcactgacatggaaattgtcaatgctttgct

SEQ ID NO: 91817 - DNA, 625 bp, Heterodera glycines
  SCN-specific regions: Sequence locations=1-131,153-163,243-267,289 -460,606-625
aattaaaccaatttataaaattcatattgataaaaatttaagacctaattaattgaaataaaagaagcctccgaaatgatgcgagttttcgatcatgagcatttataatatggcatacattaatgacgaaattgaaaaactcacataaattgaaattcatcactatatttattaaatgtaaataatgaaaatataatctatgtcttttaaaaatcaaaaataaattataaatttaaaattaagatactttagtgcataacaatctataaaattaattttaaagaaactagcgcaggcgcgctcgcttcgctcgcgcacttcgcgctagctaaaggttaaaaaaatatttgtcatccttatccaacttgcctcacgctctatttttttctctcatctctttgtcgactcttctctttctctcgtctcttcttaattttctctttttccatctaacctcttttctttctctctatccgctttctctcatctctttccactctctctctcctctctctctcctcactcctctccccttttatcttttctctctctctctctgtttcatttcattctatctctttcctctctctctctctctctctctcctcttttctcttctcgttcc

SEQ ID NO: 91818 - DNA, 563 bp, Heterodera glycines
  SCN-specific regions: Sequence locations=1-314,336-563
ttgaaagtctaaaaaagtgaaaattgctttggcctgctgtttttctctgatggtcagcaataaaatggagggcaaaaaaatgttgaatatcgctgcctcttggcccgccattgttggtgatgttgtagtcaatgagcaggcactggaaagtgcgcaaatacttccacaattattgcacgaggccagcgtagaggcacaacaacaacagttgatgaacagacagcagccgatctgttagtacaattggccaatggcggagcgcaatgaaagcaatgagaacgaagaaaatgaggacaacgagggggcagacgaagaacagctgcaaaacatgttggagaactaccaaaaacacgtgatcaggcagaagcaacgccagagcagcagaagaggacagcaaggcacagccggcagaagcgcgagtcatctgcagaagagaatgaacgcctcgcaacaatctccgatgagtcattcccagccgtgtctgctttcgtccagcgttggccaatcgcatcacaaaaatgacgcgattgctggtggaattaacggcttggttggcgtccaga

SEQ ID NO: 91819 - DNA, 634 bp, Heterodera glycines
  SCN-specific regions: Sequence locations=1-426,463-634
ggcgttcttttctccgaagctgaagcttttgcactgctcaatgatggcgaacttgaagctcgatttgaaaaggccatagggtctctcaacattctcgaatgcacattatgcgattcagccaaaatgaaggcattgcaacgaagagttcagcagaaaaatgggccatgtgaggagcagcagacgagtcgagtgccgagcagggcaccgaccctttcccaaacgaccgcggaccaacagatgttaagcacatcccacacgacgacaacggcgacaagtgctagcagtagtttcactgtgcaaagtgcaaatttgactcgcccggagagcacatcatcagcgaaatcatcgacaactcgggatcagcaacaacagcagcacggtcggcttcaaccaaacacaagcactgtcgccagtaatgcgccgagtctgcttcaacaacagcagcagtcacagagggccgcagctgcgacctatcggccgaatgctgccgattttgtgtcaaaagctggctgcattccccaggcaacgacttcagccagctcactctcttcaagcaaccatttacacccacaggcagcatccatccaggctcaattctaccaacaactttctcaactaaaccattcgcagatgc

SEQ ID NO: 91820 - DNA, 647 bp, Heterodera glycines
  SCN-specific regions: Sequence locations=1-581,604-647
ggttgattcaacgctaacgacgaatgattgcagaaattgacatttatgggtcttcgattctatgaaaaatattttgttcttttcggagcgtttattggaggctgctttctgttctctggaattctcgtctattttggctctgatagaattaacatattgcctgaactgcaaaatcggataatcaacccgaaagttcgcaatgtttacgattcacaatcaatcaaacagatggagcacagatttggttttgcatcgaatttaaacgtttcgatgaaagaaaatgaacgtcgacgaaactttacaagaaatatgatgaagtttgcatggagcaattacgtacgctatgcgtggggtgaaaatgaattacggccgatcgccaaaatcggtcattctggctcagtctttggacgtgcaccagtgggggcgactattatcgatgcacttgacacgctgtatattatgggtatgaacaaggaattcgaccagtgatttgtccgttttcgaaacaaatattcgcttcgttggtggtctgctgagtgcttatgctctcactaaagatcagatgtttttgaataaagctcgcgatgttgctgacctgctcatgccgtcatttaatgccagccctttcgggattccgatgtctttaa

SEQ ID NO: 91821 - DNA, 594 bp, Heterodera glycines
  SCN-specific regions: Sequence locations=1-151,174-410,432-594
ggaaatgctgcgcaagaaaatcacctcacgtccgacaattcttcacctggttcgactacgtgctaaacatgggggacaacaattgttgtgtgcaaacacgcatttgtattatgacccgaaatacgaggaagtgaaaatcattcaaacccttctctgtcttcggtacattgacaaaatccgtgcgcaactttcaaatgattcgtcgtgccaaatccaagtgatattcgccggcgatttcaacagcactcccgaaagtcgcccaattgcattgattggtggcgacgaccaaactttggaaatgaaaccagacgaaaaaaactacgaaactaacgctgaatctctgaaagttaaagcgcccttcaaaagccaacttctgtccggttctcccgactacaccaacttcacgtgtccccccggctcctccctgggcttcaacggctgcttggattacatttgggcccaccctccgctgcgcattgagcacatttggccaatgccggaccatcggctggtcaccaaatacgacgcacttccgtctccaattgcgcccagcgaccatttgcccattttgtgcgacgtccaattggacagcga

SEQ ID NO: 91822 - DNA, 677 bp, Heterodera glycines
  SCN-specific regions: Sequence locations=1-353,375-677
gtgtccaaacaatgtatgcatttggactgttggatggcattaaagccaaaatcaactctccgataaatctttgcagcgcagggaaagaatcgagaggcaaaaatgccccgatcaaatccaacaaagttgacggcacgccaaataaggacgccgaaaaacaaatcagtcagctaaagcaggagtacaccaatgtctttaaaaatgaattgggactctgcacaaaggtcaaagcgcatttagaattgaaacccgacgcacagccaatatacagaaaggctcgtccggtcccgtacaacgccaaaaatgcagttgacggagaattggatcgttgggagaaaatgggagtcatcggcaaagttgagcacacagaatgggcagcaccgattttggtcgtcaaaaaggtcgatggtagcgctcgattgtgcatcgactattcaaccggactcaacaatgcgctaaaagaccaccagcacccgttaccattaccggaagacatttttgccaccttaaatggaggccagtacttttcacaaattgatctccgggatgcgtatcttcaagtggagctggacgaagcatcgaaaaagctgtgtgccattgccacccatagaggaaattatagagtcaagagacttccctttggcatcaaaacagcgcctggcattttccagtcgata

SEQ ID NO: 91823 - DNA, 680 bp, Heterodera glycines
  SCN-specific regions: Sequence locations=1-395,418-500,525-680
catagcaattcatttgatcagcttaaaatttcactaaaaacggtggagtgccatgtgtcaattactgagagccattggcaggcgtttgaacagctccgaattggaggaaaccacgcacttcgactacacccttctgtactgccacggtatctgctgaatgccgacaaataacaaataattatgtcaattgggcggattatcaattaattggctaattaaatgcctcttactcaccgccgttgatttgcatttgcatttatgcctacaattagactgctcactcttcatcatttggacttttccgatgccgcgtccgtgccggaagagttgtttttggaatggacacgacaggcggaaacgcaatggcatcacattgggctgagaagagcaaaaatcaaagccaaagctggtgctgatcagccaaatctgcgccaaaatcagtggacattttgctcagccaaattggaatggttggacatctcagaaatgggcagcattggtaattaattaataattaattaattggggaaaaggcagcaacaaaaaacagctgaagtcggcacattacgattggacggatgcgttcagctcaaatggctttatgcggacgcaaatgccctgggggacattcaaatcagcgactcggggcctgcggcgcttctgtctttgtccgcacgcga

SEQ ID NO: 91824 - DNA, 274 bp, Heterodera glycines
  SCN-specific regions: Sequence locations=1-274
taaaaaattatcccgggggtggagtcgagttgctcatagaatcatagaaaattcatttttctaaattgccgaaaaaataattgaaaactgatcaaatcgctgttgtaatttttaggtttgcggtgcctacgaattttcctttgttgtacacaccgacagattctgtcaggcgagccggccagggatgtcctgttacgcgttcagcagctctacgccaaaatgagcagcgcacaacggaaaaaacgaattcttcttagaaaaaaaaaaaaaaaaa

SEQ ID NO: 91825 - DNA, 554 bp, Heterodera glycines
  SCN-specific regions: Sequence locations=1-382,404-554
caattctcatcgacgtatgggcgttcactgaacagcagcggaagggaggcgccacagcattggacagtttttgttcaacaaacacttcgacgccaaaagttggcacattcagatcgttgagcacactcatcctggacattcttaatccggtagcaaagcggcacaaaaatgcgctgatcaattcgttgggcgtcgtttggatgttccgcaacagttacggaggaggtgccaaaatggcggacacatgccgatgctccttcgattactccgcccagcaaattgaagtggccaatttggcgctgaatttgaatgccctgtcgctgacttccatcatttgctcggtcagtgacacgttgaaggagtcgggcaacaaaacgacaaaatcatcatcttcagcatcatcggctaactccagtgaaaagttgggcgtcggcgggttcagttttttatttaaagacgaggattaacccgatgttgacggattttgtgcgccgttgcggcagtcttagtacgagtcggggtaccagaacgagtcggggcagtacgagttgggt

SEQ ID NO: 91826 - DNA, 360 bp, Heterodera glycines
  SCN-specific regions: Sequence locations=1-360
atcgagtggttcaggaaaaagcggaaaagcagcgaaaattgagtgcccaactgaacaaactgctcactttgggcagtcctatcagcgtcaacctgctcagtatttccattttctgctcttacgcctctaaaatcgatgttctccactgttatgccgacctgcacaaatcgattcaacaatttctctcttcttatggccaggaactgatccaaaaagtgaaattcgattgcaattttaacatcgacttcccttccgaatttgccctctccgtttgtcaaccgttgggtctttccacactgtcattcgccgataattcgagctctcacggcatttttctgaattgtgacccaaattcgcgga

SEQ ID NO: 91827 - DNA, 601 bp, Heterodera glycines
  SCN-specific regions: Sequence locations=1-601
acaacttcgtaccaaattgaaaatgctggactttcccgttgcatgaaaggtgcgcaatcactgcggtgcgcggggccacggcaaatcacggccattggttttgacttgggcgcggtcggctgcaatttggccatcatcatttttgtgccgaatttcatgtgcggaaaatgtttgcacactgttgtgtttgggttgagcggctttgacgccaacgggtaccaagtccatctctttcatatgcccaaattccgcggcttcctcaaaagtgcgctgcccgaacggaccaacgaaattgtgtggctgcagcacatgaaattcatcgtcttcgacgacactgttctcataagaatcgctatttgctgatcgagactgtccactgttgaccgacttcttcgtcgacctgttccgcctcgttgacaatccttccggcggatgaacgcgtcggaacagttttttggaaaaaactcagactcttggtccgtctctttcgtatgcccaaattctgcggcctcctcaaaagtgcgctgcgctgaccgaaccaacgaattgtgtgactgcaccacatgaaattcttcgtcttccatgaacactgtcgtcatca

SEQ ID NO: 91828 - DNA, 666 bp, Heterodera glycines
  SCN-specific regions: Sequence locations=1-59,81-666
gtccaatgaaatcatgttcctcatcggcaagtacttgttcgacaggtgacacaagcagtaacacagagacagcagaagaagataaggaaggtggtggcatatgcagcctttactgtctcgccagctgtctcggtgttccgtctgagctcggatttgagtttcttcgacagaaaaatgctttggttctctcggggctaaccactcactccgacgacgctttgccttttcttcgcattagcacttttgacaatgttccgcccaccattctcttctacacaaagggtgcaaaagttaaaaagcctccgcctcactttgcctctcaactcacttggtgcaacaattcccttttggccctcgtcgtccgtcacagtttggctgctagccatttcaaattggtggacgaatcgaagaaatggattggctattgggggaagcatttgaagtcaccgcaatatcggacactgaaaccgttccaaaaggtcaatcattttcccggcgcctttcatttgggccgtaaagatcgcctttggctgcacatttacgagtttatgcagcgtttcgaaggggacctcttctgcattatgcccatcacttatgtcctccctcgcgatgctcgaaagctccgactttatttggccggctatacggatcgccatgtcattctga

SEQ ID NO: 91829 - DNA, 662 bp, Heterodera glycines
  SCN-specific regions: Sequence locations=1-595,617-662
gagcaattgcaccatttggggcttttccttgcacaaaaactgacggcaaatgacgaaaaatcgcgcgaattggccctttattatgcacatttttactggagaattcggggcgacccgttaaagtcgcagcagtgccttcgcctctatttgaagcgacggccgaattgcgttgctgccaaactccaaagtgggctcgtccatctccgaatcggcgactatccatccgcaattgaactcctccaatccgtcaatagcattgtcaccaattgcgtcgattgtctgatggcattgggcgatgcctttgttttggatggaaattataaagcgggcatccaagtctttgacatggcgttcaataccgatccgaaggaggaaatggcacttaagaaagcgtcactgctgagatgcactctcaaactgttcgaagtgatggaaaatcagcacaaaaatctgctcgaaataatcaaagacaaagaggcctatcgggacaaaaccaaacgaatgcagcaattggaggcgcacattgagcagaaccgagcagtgcctgaacaccgacttcaggcgcgactcgcccacaaattcatcgaatttggcactttcccatatttaaaatgccgcgaaggcactcaatggatgaacggaattcacgagagaaaacgatt

SEQ ID NO: 91830 - DNA, 650 bp, Heterodera glycines
  SCN-specific regions: Sequence locations=1-5,32-135,161-197,227 -254,278-350,376-377,410-425,449-573,596-596,638-650
tgcgtgaaattgtgcatatccaagcgggccaatgcggaaatcaaatcggagcgaagttttgggaagtgatttcggacgaacatggcattgagccgagcggaatttacaacggagactcggaccttcagctggagcggatcaatgtgtattacaacgaagcgaccgggggaaaatatgtgccgagggcggtgctggtcgatttggagccgggcacgatggactccgtaagggccgggcctttcggacagctttttcggccggacaacttcatcttcggccaaagtggtgctggtaacaattgggcgaaaggacactacacggaaggcgccgaactggtggacaatgtgttggacgtggtgaggaaagaggcggagaattgtgactgccttcagggcttccaaatgacccattcgcttggcggtggcactggctcgggcatgggaacgctgctgatctccaaaattcgcgaggaatatccggaccgaatcatggccacatattcggtcgtcccatcgccaaaagtgtcggatacggtagtggaaccgtacaacgcgactttgtcagtgcaccaattggtggagaatacggacgagacattctgcatcgacaacgaagcactttatgacatctgtttccgaactctgaaactg

SEQ ID NO: 91831 - DNA, 610 bp, Heterodera glycines
  SCN-specific regions: Sequence locations=1-211,233-398,430-535,558-610
gtgcgtaaccatgtccctcggtatttctaggcgagattgctgggtcttcgcccctgattcgcattcgccattgccaatcttggtaagccattcgcgtaaggctgtttgccccggaagcacgcgcatatttagagtcaagctttaaaagttaaataatcaaatttaacatttaaaagtaccttatttgttggaaatgttcccggaagagctcgtccatttttatgctttcttgcacttgatcttctcgcgtgccatgctccacaacaggtgtcagctgtctccaatcgccgcctagaaccataactttgcctccaaatggtttgtcaactgcacaaacatccctcaatagccgatcgacgtaacgcagcacctttttgctcaacatgcttatttccttagcagtaaaatgtttttatatttcaatatatacatacatcgattatgtttaattgaacgatgcgaagccttttcgcccctgcagattcaaacggcatttttggtgtagtattatcatcaacttcattcggtacagagaactgtctgtgaacagtgccaccaccgatcaaaagaagtgccgcaatgccagtgctagctgcagaagtgacagagc

SEQ ID NO: 91832 - DNA, 627 bp, Heterodera glycines
  SCN-specific regions: Sequence locations=1-106,129-224,246-259,281 -421,453-627
atgatttcctccagcaacagcagtgttggcactggtggctcaaaatgcctgaaaaatttggacattgtaatggaaagtgcggacgaaggccaggcactgctgcaagacaaccccaacaacaccacaaccatcacttccgtttctgctgctgatggcattccggacggtgaagggacatcatcatcatctgctgaacagcaacagccaaatcgaacggacagtgcccaagcgcaacatgcacaaccgtcgacgacaatgctcaaaatgaaactgatcagtgccatcagtgacgacgacgacgaaaacaaattggcgacactcaaagggcgcaaaaaggccaaccaacagcagcagccgtcgcgggttaagcgcagtcggctcagtgtgatcactttcctgaacaacatcacagcgccggcgacgcggacagacggcggcggcggcggcaaaagttggcggcgcagtttgagtgtgagtgcttcgtctgttcaacaacaaaaacagccgcaccattcgcatacgccatcgtcaacatccgcggagcacagccaaatggagtcggacaagcagaaaatggtgccgctgacggacagtgggactgataaggacggcggcggatgctccgcc

SEQ ID NO: 91833 - DNA, 573 bp, Heterodera glycines
  SCN-specific regions: Sequence locations=1-232,254-315,337-573
gaaaacattcccatggcgccatgggactcgcgccggtgggctccgcgacgaactccttgtcaagtgcgttgtccacgtcttcgctgctctccagctcaaccattgcacttcacaacatttccatcggggaatcgagcatcgaattggaggaactttcccgggaagagctcatcagacgatgcaacgaactcaccgaacggtgcaaaatggaaatacgttctaagaacaaggagaagcagctcaaggaagagaccatcaaaaagctggtggttcttggccagcagaaaggcatcatcgacacacgcaacaaatcgaagaaaggggagaaagagaagcgcatttgggaacttgcacagcacgagaaaaacctcgagataaacaaatatgaagaccgatacaaggagatgcaatacgcactcgacagcacaagacacgaattggaagaggagtaccagaacagaatcaaaactgaggaggagctacggcagtacaaggactgtttcggacagcttcccaactcatacttggcctccgccaacccgcataataatgacaggcaacgtaaccaggcgc

SEQ ID NO: 91834 - DNA, 667 bp, Heterodera glycines
  SCN-specific regions: Sequence locations=1-667
caactttggaattgtgccgtcgtgcactgccactttgattggtttgacaaggctttttgcgtagattaggttgcattcatcctttctgattattgttttggccttttggtacacggcaattcccatgccgtatatgctggcgtcgcagaagcagtggaattccactgagtcgatggcttggatgtgcctggaaattcgatcgtgattgcttcgcctctgtcgagccactgtgccatcaatttgagccagtacttgttgatgtttgctggcatttcgtcgtcccattttgggttcaagttttgcacttcttgaagaatgagcttggctggcagtagcacgggtgacatgagtccgagcgggtaatagactttggcaatttgcgacagaattgtccgttttgtgatttttccttcgaagattggcaatttgaatatgagtcgattgtgttttggtttccatcgaatgccgagcactttgttgtcttcgaggtcctttgccaagtcgtctggttgcagcttttttagctcttcgatgttgcttccgtagaattctcggagtttcatgcccgctgcttcgaagattgtcttggcttgcgtcacaaatcttgaagcttttccgttggcttggcgtcgaacatgatgttgtcgacgtacagattctcttcgat

SEQ ID NO: 91835 - DNA, 662 bp, Heterodera glycines
  SCN-specific regions: Sequence locations=1-331,353-392,415-453,475-662
ggaaaggattaattgattgaatcgaattgaacatttttgatgcgcagtgaagggtgaatgaattcatcaatcacttcgttcgccattaatcagactgccaccgatttcgacctttcccttccccttttaccacatcgtcaattttcgtcctttgcctttaaacgtcggtagcaactttgactcacaacaatcagccgttgaattagcatttcctggattttgaatttgttttggagagtattcgtcgaacagaacgcggcggtattcatgttcattaaacaaacaacaaacatctgatcgctccttcgccaaattgcaaaaaaaagcggaaattactgacaaaaattcactgaactgctgctgatcacattccaacaaaacaatggctgacctggaagcagttttggcagatgtatcatatttaatggcgatggaaaagagtcgaagtcaaccggcagcacgggcctcgaagaaaatcgttctgcccgacccgagtgttcgaagcattatgcaaaaatacttggagaaaacgggcgaaattcgcttcgaaaagattttctcccaacggttggggtttttgttgctcaaagactttgcggaaaatgtggccgacacttcgtgtcctcagataaaattttatgaagctatcaaagaatacgaaa

SEQ ID NO: 91836 - DNA, 378 bp, Heterodera glycines
  SCN-specific regions: Sequence locations=1-190,213-378
ggcgtttgggatcaggaattggaaaaggcctgcgcgctttgtggccgattccgaacttatgcctggtccccgttcgaattctggcacacggacgtggaatgccgcaaggtcgtcgaagacccactggcagccttcaccaagtggttaatgaacttcgaaacggaagtcttcggcatggagcccggtgcgaagaagcgcagaaaaaggaagaatgccgaaaacaccgacggctaggctatggattgcgaagaagaagaggatgccgtagatgaggacgccgagaacaactggatgctggggtacgaagaagccggggagaagccggagtcggtgacaacatacgcgtacgcccacgccggtaattttggaattatttaa

SEQ ID NO: 91837 - DNA, 658 bp, Heterodera glycines
  SCN-specific regions: Sequence locations=1-425,448-658
gtggcctttggtttttctgccaatttaaaattgttcactgtgacggccaaaggagaaaagttttgaggcgaaggcggcaaaggggcgaatgctttcagctgctggtcgactttggaattgggcagaagaagggaagcgattggcttaagaaggcattcttttgttggtcagatgtgagtgattgtcctaatggtcgtttgtttgcctttgcctctcctccgactgaattcaattcggacggacaaggacagaatttggcgtcggcgccgtcctcgcccggggggcccttctctccgcgctgccccggctttccctccaatccgtctaatccttgcttgccgacccttccgtccggtccgggcattccgatgacaaagtttcgttttcctctctcgccttgtttacccgtctgaccgggcggtcccttcaccccgggtaatcctgcaaattcagccctttattttatttaggcgtttttttcagggtttatctttgcctggtggtcccgtgccgccgggtgccggcgacccggccgcgccccgctttccctgtttccccgcaattcccgggtgtcccggaagtccttctgggccttgctctcctgaaaataaacaagcattcttaaactttacttacagatcagaccgtccgtcccgtc

SEQ ID NO: 91838 - DNA, 421 bp, Heterodera glycines
  SCN-specific regions: Sequence locations=1-272,294-421
ccctcctcatcggctcttacgtccgttgcatatcaacgaaaaaatattgttcagacctggtcccaataacatgccaccactcttccaggagggactctttctaccgatgcttggacatatgcatcccgagttcatcgaaattatggatgatgtgaaagccggcatccaatacattttccaaactgagaatgcgctgaccttcactgtatcagacactggccatgccgggatggaatgtgccatttagattctgctggaggctggccagaccatttttcaggtgcaaaacggaatgtagcgcttgcggacagcgaatgtagtggagagacttgccattaaagtgcatcgattgggcgtaccagcagaagaagtgattaatatggacgctcttgccgaggctgcggattactaccgtccccac

SEQ ID NO: 91839 - DNA, 678 bp, Heterodera glycines
  SCN-specific regions: Sequence locations=1-88,110-324,346-371,393 -630,652-678
cgcttcttccgctggttttcggtgcgttaaatgatgaattgagtgaccaaaaaagagaaaagtttaaaatgaaaaaaattattgtttgaatgatgaacattttgaaaataaaattgacccttttttcctttccattgctttttcaatgcctgaccctcgaaggaataaattcccgaacaattttcttcgtcatcatccatcacattcgtcattctctgttggcattttgcatatttaattattctcggcacttcccgggaaagaaatgttattaaaatggtaaatgataggtcatgggaatgatgatggccatcctttgggcaaaaagagcattttgacaaaattaaatgcaaatttcgctgggaaagtgtttttcgcatttgcaggcgcctccgccgctgctcagccattctctgcgcaaggtttgctgcgccgtgtgccgcgtccgcaccgcgcagttggcgtacatcactcgcgagcagcactcgcaccacgggcaccatgtgccgggccgcaagttgtgccacgtgttccgcgtcagcacaccgctcaatgcacagcacatacaaacggcacttgcggacgcattccgacagcaaaaacagtgggacgaagccgcgggggaagcggaagaaatggccaactgtcacatggacaacgaggaaaatgatgacggga

SEQ ID NO: 91840 - DNA, 671 bp, Heterodera glycines
  SCN-specific regions: Sequence locations=1-252,280-671
gttttacatcgacgagtgtttggcggacccctccatggtcagacgagtggccaattcgttggcatttgccatggtttggcccatcgacggggaagaggtccttcgtctaatgtccctttattgtataagtgccaccccttccttcaggacacaactttcttcgaacttaaagtgtgcgatcagtgggctttcgtcggcgattacgaaaatgaagagacggcacctttagtcaatgtttacagaaggcacggcactcaaaataataataataattaacgacaattccataattgtcccaattaggcacgaactccccgagcatatccattggcgcgactcgcgactggtcgctccgattgtgctgatcgcacggccagggattgtcctacttacggtgactgagtgattcattgctttcttcgcatggataaaaccgcacatttccttttggtatttagcgcaatattccatcgaccgatgttagcgagaaattggccaaaaaatggaaaatgctcgacggatgggaaaataaacacgaagcaatgcaaggtggggacagaagggtgggaaagggcacatttattggccaaattttatgtaaaaaaagaattttaggaattttcatggcaagaggaccgggtaaaattgccaataataatcagttggaattg

SEQ ID NO: 91841 - DNA, 662 bp, Heterodera glycines
  SCN-specific regions: Sequence locations=1-156,178-204,226-461,494 -535,558-662
atcagcaaatgataaaattgtaaaacattgtactgttgaaggtggcatattttcatcagatcatttagcacagctttttgtgctgagtgttccagaaataagagcaaagcctaaagaaatttgcctaagacggtttactccgtctaatgtatcacatttaaatgctgtaatttctgctagattaagttctctttctctttcacattttagtataaatgaaaaatgccgtgccttcaatagcgccttgttgaatgccttgaacgagtgtattccaataaaaaaattactaaaaaaagatttagctccaaaatatccacaacatttattggcatccattaaagaaaaggcaaaattatatagacagtgtaaaattgatccaacaaaaaaagcactttatgatagcattactttacatataaaaatccaaaccaaaaaaatacataatttaattgaacataaggctatttaaaagggaaaaaattcaatttttaaatacattcaaaaacacaatgtcaatccctttgaaataccaaatttagtttttgaaaataaatgctatcatgaaagtgaagagaaatcggaattatttgccattttatttgcaaattcatttaataactccgaaattgtcctaaacgatttaagtttggacaactcctatg

SEQ ID NO: 91842 - DNA, 661 bp, Heterodera glycines
  SCN-specific regions: Sequence locations=1-248,273-293,315-661
cactcgtataaatcaacattactgaaaagcagtttcattacgcctcccaaatgcaaaaataccaattgtgaaatgtacaaatatcagttcaaaattcacctgatcggaaaatttactatggtgggattcttttcgatgaaccactgattcttgtggaaacgatcataagtaatgattagatattcggggagatgaagcagttcaaacttctttaggaaattgtctttgtacgttttgtactccttaaatcaatggaaatttttggattacttcgaatttgtcctaactagttaaaaatgttaaactatttaattgtttaattaaaaaagagttgctcgccgattgggtaattatcgcaatatttggttttgttataaatcaaatgcccactttctccgtttgtccgttgaatttcatgagcagcgtcgacaacggcacttgcgggataatattctgaagccgttcgtccaaataaagcggcgctggtggtaaatccatcgcaagggaaaggaaaggaatttccttggtttgttctgcaaaaattaacttacccaccactcattcattaaaagtccacctttgtattcctccgtttcggccaatgtccgccgtgactcgtcgctggcgtccacaggcagcacttttcgcatgcattgacgca

SEQ ID NO: 91843 - DNA, 618 bp, Heterodera glycines
  SCN-specific regions: Sequence locations=1-41,73-618
actgaccccggctcaaacaaaacattcccatccttggtacacctccccaaaaccactctccctactttctctggtgactgcacctcttacaaatcattttggaattcattttcgtccgctgtccatgatcagtctatccccgattccctcaaatttgtttatctaaaacaatgcctttccggtcctcctctgaacctcgtgtgtgctttgccggtttccgacgcgtcttacgcttccgcaattgaccttttatctgatcactatgatgacccggaagaaattgcccgagcccttcaaaattccctcaggaaattgccgcgtgtccgtaccggagaaaccttttgctctgaccttcgctcactgatcgaacaattggaagcgatttgtgtgcaaatgggacagcagcagcaaccccacaacacgatcaacatacaaatggaagtcgaacagcggctcccccggtacattttggatgaaatttatttggccagggaatcagcaggacaatggtccactgatcggctgcgagataagctccgttctattctcaagagaaaggaacaaatcgacactcttttgcccaaaaccgaccatgggccccgtcctaagtcatctcca

SEQ ID NO: 91844 - DNA, 627 bp, Heterodera glycines
  SCN-specific regions: Sequence locations=1-627
tgaattttgaactcaattcaacccttaatcctctgtcgaaatctctctctctctcttaatccatttaggtttggctcagtgaattaaatgtgcggcatttgggttattttgggcgccgaatatgtgccgaccaaacatcaaagagaattcctgcaaattggcgggaggggtcccgacttgaccattatcagccgagtgtcttccaaagtttggctgggcttccaccgtttggccattgttcagcccggcgactctccaagcgaacagcccatttgtgcggacggtctttcggtggtgtgcaacggcgaaatttacaaccatcggacgctgaaggacaattcgctgctggacaattcgtccgttcggaatggcggcagtgattgtgccgcaattcttcacgcttttcgctcttcaggcaacgatttacgtcgttgttgtgcttccttggacggagtgttctcttttgctatggcggacaacaagttcctttatttggggaaagatccaaccggcgttcgccaccctcttatatggcttccctggaccaagcttttgctaattgggtcccgaggattaaaagtattgaggacactctgggggaaggggtcacactttttcccccccggg

SEQ ID NO: 91845 - DNA, 639 bp, Heterodera glycines
  SCN-specific regions: Sequence locations=23-125,147-179,206-225,247 -338,379-380,402-500,538-639
aaaagattttgtgccattttttgttgttgtacgccatctgcttcctccgcacttttcctcctttttctactcttcgttcaatccttctcgcactttgaacgcttcaaacaatgcatttgcctgaatttttaaatatttttggtcagtcttatcaaaaacacagaaacgaggaaatgtgtgagagagagagagagagagatagagaaacgagatgcaaaaaacaatagggggaccaacacggaggaaggcctgcctaccgcttttcacagctccgaaataagcattgaaggggggaccaacacgagggaaggcctacccatcaacacccagatattaggaaatgtgagagagaaagagagaaatgagaagcaaaaaacaatagggggaccaacacggaggaaggcctgcctaccgcctttcacagctccgagataagcattgaagggggggaccaacacgagggaaggcctgcccatcaacacccagactttatgaaatgtgagagagaaagagagagagagagagaaatgagaaagaccaatccacctttgccctttgcgctggcgtgacatcgacagaagatgaaaacacaaatggcaattgttgctcgaccacttgcggaccattttgctgctgctg

SEQ ID NO: 91846 - DNA, 667 bp, Heterodera glycines
  SCN-specific regions: Sequence locations=1-371,393-560,644-667
ttcatttagtcgttcattctcattctttattttggattttgagactgtcgctctttttaatttaacaaagccttaatcttattctatcaatttcattttaggagtaggagtgcagtaatagtgctttaaaatggctgaaaaaaagaaaaagagggaaaaaaacagtggacgaaagggcactgacgacggcgttgactccaataaattaacaaaggatgaagattcgctggctcgtttcctccgatttaactgtccaacaaattctactatgtttgaggggaatgaagtgcattacttctccggcagaaaagcgatcgatgtgctggtcgagtcgaagaaatacggcgctacggccaaaacacccaaatttttaaacagcgatgcggccgaagaattcctccaaactctactggcaaagggactctttttcagggccaagaaattggtgccaaaaaagaaggaaaagccctcgtctgatcagcaacaaaaaggagaaaaaagcggaagagatgtgagcaaatcgccgccgaatgcggctaaggctgagaagagacagcgaaaggaagcggaggaagtgagtaagacggaggaggacgaagccagagaggaggaagaggatgaggagggccagcagcaggagaagccggaagccaacaccaaggatgaa

SEQ ID NO: 91847 - DNA, 394 bp, Heterodera glycines
  SCN-specific regions: Sequence locations=1-240,263-394
gaaagggtcggcggacgcataccctggccaacttcagcccgatttgtaccgtcggcgtggctccgtcatttccgtcagctcttcgggtggcggtgcgcaagttgtgggccgtgtgcaactgcagctgagctacgatcactcaacctctgacgtggtgatacggttggcacaactgaatctccatccgtcctccgcttcgcttggccaatgccataaacttcttttgttgtgcacaacgccgtgcagcagcagcaacaacaatggcacaaattgtagcgaagagacgatgggaacggcacgggttggcagacgcgcgcgcgagacgggtgcactcacttttgacacgccaaagcggacagtgcaacaatttgccaaaagagttccgattattagc

SEQ ID NO: 91848 - DNA, 432 bp, Heterodera glycines
  SCN-specific regions: Sequence locations=1-432
gaccaatcagcagcagaagcaattaatcagcttatcattgataaactcacaatcaatccgattttcattgataacaatcactacagccaacttttgagtgataagtatttcaaaatcagcttattgtatcattgtgttgttcattatccctccccctattcagattcgcgtggttttcgccaaaaatcccccggatgctttcaccacttgcaagtccttccccgtgcttacccccaacatggactgccctttccccggatggcttatcgaggcgaggccattttcagttattgctttatcagttacctctttaggtagtcaaaatgttggcagactacctcagccttcaggtcgacccgattataatccaatcggaaattggcaatgtcaattggggacacaatgtgagaggaggggaggtggaggggggaa

SEQ ID NO: 91849 - DNA, 503 bp, Heterodera glycines
  SCN-specific regions: Sequence locations=1-184,206-292,318-347,369 -387,409-426,453-503
tcgtgaatcggagcaattggaccattccatctgttcggacccgcaattggacgagagtttaatggcggcgagtttaatcgcggcacacaaaagggccatgggggaggaagaggaggaaacgcccagggcaaagggaggggggcaatggggggaacaacgccggaggggcggagggacccaaacggcggtgcaaagggcgacgacgacacccgccggcggagaagggtgggaacggcacgaaagacagtcttccacctcatcatccgtcgaattggacgacgaaagggacgaacttccgccaccaccgccgccgatggttcagcaaaagttgcggaacggaatgcagcgggaggagagagaagaagcccatcgccattctcagcctctgcccctcccctcccttcctccgaccacggcacaactcccccatcaccagcagcagcaacagtcccttcctccgcttcgttcccatcttccgcttccctcccgcgtccatccgttac

SEQ ID NO: 91850 - DNA, 633 bp, Heterodera glycines
  SCN-specific regions: Sequence locations=1-75,109-196,223-251,273-633
tacttctccaaataatgcttcgcctcctcaaaagtgtcaaactttttgtgcattgcgctcggatagcccttggtctaaaaaaatattatttctttaaaataaaaaatagtctacatttttcttgacagtttctatgtccttgaatatgccaacaacacgaccacgagcgacagcaaaaaattttgtgaaggaatcgtccacagacactgaaaatgaagtttcggaggtgagaaatatggctctattgcagttttcacatcataaaataatttgatttgttagttttaaattttttttatggtcgtttaaactttactcgaagtcgattcgggctttgaacggttgacgaaaccctctaaaaataatgatacgtaagttagagcagtgttcattatagggatatgaacataaattattttattcgaattcggagtctaaccggcttcttcgcgatttttgaacttcttcatagtcggactcggaaagcctttcgtcgctgcttgggcctctttgtaactgccgaacactccacgctgatgaccccaagcaaccgcataaaaaacggacggagtggaaggcgctttcggttgatgatcagacattttcagtgataaataaatgcgtacttttaat

SEQ ID NO: 91851 - DNA, 541 bp, Heterodera glycines
  SCN-specific regions: Sequence locations=1-197,219-411,433-541
actccctggttttattcaatccgcttcgttcttgctttcgtcctactagagatgaattgtttcgggcggttgaacgtctcagagaatccattcttctcatggacactgaaagagcccgattccgtcgttcgaacggggctttgctacggatgatcgtgcgattgtcaggtggcatcccgccaaattttaatcatgctcattttgctgctgctgcacagccggtcgtcaatgtgactgcggttctcgccaatgccaatcccactgggcagaattaccaacgccttctgaatttgaacgccgatttgacggagaccatcgcccgtttaactgtagaaatttcccaattgggatatatgaatgagcaattgacggaacaacttgaacatctcacggaagtgcctccgaatgcgaattttaatctggatgatgttgtgtttcatccgcccctcgaccaacagcacgaagtgcctccgaacccgaattttaatccggctttgcttgagtttgatgatgttgggcttcagccggccctcgaccagca

SEQ ID NO: 91852 - DNA, 230 bp, Heterodera glycines
  SCN-specific regions: Sequence locations=1-230
gtgatgagtaatcatccccattctttgtcaattggccaaccccaacaaaaaagtcgtcgacagcgatggtgcggcgacggtccttttctgctgcttacactgacaatgagcatcggaggggccctcttctgtttgttcgtcgctatatgggcggttggcattgacgtcgtttttcccctttctctgcttctgtccgcttctctcggctttctggtcgcttcctcgctcgg

SEQ ID NO: 91853 - DNA, 690 bp, Heterodera glycines
  SCN-specific regions: Sequence locations=1-690
gccaattcgcccctccgacaggggcaaatgcccgcaaatgttccgccggctcagagaactgcttgcctggcttcaaacggtactccgacccaatgaccaattctggtggtaattacacgccgccggcgcagacacagccaaattactcatgtcagcaccaatcgccctatttggcacactctcagcgcctttccgcccatccgtcgcccgtcccttccgtccgccccctctcccaaacgccgtcttccgtccattcgatgaacaacgccaccatccaacaacaacagcagcaacaaacgcaattcaaccaaacagcaacacattcttatgagcaacaccagcgatttttggccgaccaaaggctaagaatgctcgacttccaacaacagcagcaattcgtcgcttcccatcagtccgtctccgtttcgacctttcagcagagaaagccccgtgaaatgcattcgattactttccacaaaggctcccatggacttggcatccgcgtgatcggaggcaatcagtcgggcatttttgtctcagctgttcaggagaattcgccggccgataagaacggcattcgagtcggtgatcgaattcatgtggtaaacggcgtcagtatggtcggagtgacgagggaagaagcattcgactttctcctctccaccggcgagcagccaattagcataacgg

SEQ ID NO: 91854 - DNA, 507 bp, Heterodera glycines
  SCN-specific regions: Sequence locations=1-301,325-507
agtcaattttgtttaaaggaaaattatgaataagttctccttcccattttttcggcccctcatacgaacgaagtcagggtgtttgactccccccccccccatatttaaggtatgttcttgacgtcgtcgtcaccgccgggcacgggcatcggcattctgttcccaaaagcacttctctgccactgctgctgcccgtccatgtttgtctggtcgctgtgctaacagtgtttttttgccacctgttagtccgacggcttggcaaaatgcttctgcgcccaaagctgtcgtcgctgttattgctcagcagcggcggtggtggtggcacaaaacatttggcaaaaaagacgacgacggcagcggccgagacgaggacaaataagccgaaattgctgggcatcacaacgccagcagcagaggacgacaattggggcaaagtgacgcaatcggaccccaaagactaccgattaaaggtctcaacaattagtgccgtttatgccagggctgctg

SEQ ID NO: 91855 - DNA, 557 bp, Heterodera glycines
  SCN-specific regions: Sequence locations=1-44,66-477,499-557
tcgtcccgtttctcgcgccttttgttctccggccaccgcactttgctttggctcttcggctgctccctctacgccctctattgggccgtgttcgtcaaacccaccgtttacagcagtgtttacttcggctggttctttttcccattcgtcggctatcgccccgataatcaacacgagttcgctgttcaactgcacactttccacgacattttggtggcgtttctgtgcccgggcatttatctgatctttgccctcgttctttgcgcttcgagttacgattttaacacaatgcaaaaaaagacctttctgcaagtgtttttggtctctctgatcaacactttgaccggcagtctctacgtgtacatgcaacacaacgacttgcgccagcaatggatgctcactctcgccgaatttgcttggttccatgcccacggatttcctccggtcatttatttggcactgaacaaaaccatccgcaaggacagctgctcattgttcatgaaagtgttccagcgggaccatatcagctcggtgggcgttgttgccgtgtccgcccc

SEQ ID NO: 91856 - DNA, 560 bp, Heterodera glycines
  SCN-specific regions: Sequence locations=1-403,427-560
ggcaaaaatctccgttgcccattcaaaatgccaccattcctcccccactccttctttcccccctttccccccacctctccgccaactctccgcccattagccacactgccaatgtgccaaaatccaagaattttaagttacttgacacattcctcccatttacttgcggttgcccgggtgagtgtcgccgtaggccaacaacagaattttggggggttgggtttgtttctccggaagggtttgacctttctgccagtgagttgactttgttccgctccagctgaatgaaaaaaagctgtcacctctcgacgacgaagtaaagtgagaaaggacaaatgccaacaaaatatcagtccattgtcaaggcaaaccgtcgtcaaaatgccaaatttaaattttacatggcatttcatttcattcttttctctccccctctccgtatgtctcttctgcctgcctcccatctccaaccttacccttcaagtacccctcccgagggtccctccttttctcggcatctccagtcagtcatcatcctttgccccttcccttccattttt

SEQ ID NO: 91857 - DNA, 640 bp, Heterodera glycines
  SCN-specific regions: Sequence locations=1-452,474-640
ggatgacccgtcgttcaatgaccacgaaaagtcagtcggttgaacacgtcgcagtcgcacaaaaacatttgtccggcattggccgaaacatcgcaaacggaaggacgaaagagtcgaaaagtgcgaatgcatccgacagacagcgaaaggaagtcgaagacgaactgaacaggacgaagcaaatgctgaaacagaccacaaaaacattggatgtgttcgctgtggtggcatcacattttgacagaaaattggacaatgccaacaccgaatcggctgttctgatggctcaaaagggcgacgaggcggcgcaacaccaaagggccatcgccgagcttcgatgaattacgcgcaaaaatttcttctgaacaagcggaaaacatcgcgaagatccaactacagcatcaaaaaaccgtgaacgaattggaaaaacatgtacagaaactcggcaaaaaactggcggaacaagaagaaaaacaccgaagggaattggccgagtcggcgagtcaatcgacaaatagacttcacaaagaattggagagtcggaattacgaattgcaaatgaagaacgaagaaatgttcaaattgagacaggcaaatcgcgaattgcaattcgaagtggacaaattgcccgaaaaagagg

SEQ ID NO: 91858 - DNA, 586 bp, Heterodera glycines
  SCN-specific regions: Sequence locations=1-29,51-216,239-308,346 -400,422-461,489-521,543-586
cccaatgagtaccgcttctccgtccccggcttcttcagcttctgcttcgtcttcccaccaaaaccgtcgtcctttttccatcagttcactccttaacccctcacaaaatgccacgcaaaaatgtcctccgcttggctctgtcgccgcattttccgatgccctccagcaatgtctgccgatgcttttcgctgtgcggggaatgatcggcgaaggcgcaacgaacgcaatgccaaaagaggaagcttcagcggcaccgttcagaaatgctttccaaccgttgctgatgggaaaagttcggatgtgccaagaaggggccaaagaagaagaggaggaacaagaggagaatgggcacgaagtgccaacatcggaagaatcctctcaatcggaggacgatgggattttggccaaagatggggaacagaaagtggagatgaaagacgaggaagaggagcaagattttggagagagtgagctgaagatggagcaggaacataaacagatgaaggcggagggaaagagagagggcgacgagggagacaaagggaacacaacgccaagagagggtgcgtttgaacaaccataccag

SEQ ID NO: 91859 - DNA, 426 bp, Heterodera glycines
  SCN-specific regions: Sequence locations=1-15,38-62,98-426
tacaaaaataaaagtgattttgggattcgggaccaaaggggggtaaccaggatttttgagtgaaaaaattttttcaccaaaaatctttcaaaaacatgtcattagggctattttatgacgctgatcacgaatacgtgatcagattttacttttaacatcgataagacctcagaatccctgtgtgattggggattctgaggcatcattttgaggggggagggggcaggttcggatccggacggtgtatattaattttctgtgcattttaacgggcgcgaagcgcccgtcttgaggccgcgaagcgtcccaatgtcctcaacaaaattaaaaaacgggcgcgaagcgcccgtcctgaggccgcgaagcggctgaatattctctacaaaattaaaaaacgggcgcgaagcggccgaatgttctcaaaaa

SEQ ID NO: 91860 - DNA, 555 bp, Heterodera glycines
  SCN-specific regions: Sequence locations=1-11,34-210,232-322,346-555
tagtgagcttatttttcctgtgctcttcctcctctcccattgcttcttctgctgcttatgcgcccgctttgcttttaggtcgtcacttgaaagttcgtttttttcatctttttccgctttgttgcttttccctatgattttgctttttgttgttcctcagcatactgctcgaactagttgttgcctgtgctacttctgccgatgacgatgttgctccctttttccaatttcgttgcggtgttcctggcagttttccgcttcttgtactacttgaattaattgtttccgttgttgtactgcttgaacgcgcggattttctagtcccctccttctcctcctcccgcttgactttgcttatttttaatgcaccgtttgttgtcgtcgttgccaaagcatttatagtcaatgaacgtcttgaactcgttggtgttgatgttgctgccagtggtcttcgtattgtttctgcactgttgtccatcaaattgggtttgaaccgtgctctcagtgccatttccttccatttccgtgtcgcttttttctcgtctccgcgtctcc

SEQ ID NO: 91861 - DNA, 696 bp, Heterodera glycines
  SCN-specific regions: Sequence locations=1-303,326-696
tatctctgccctgtcgccgcgtgccagacggtgaaattctcaatgtctggtttttagtggatattggtaagcacccattgttatcaacatgtcttcataaaactgcagggtcgccttacaccgctgtgtcatgtacaacactgtctgctctttacggcaacagatcggaacccgcggaccacttttttctgaatatcttgcagtcgccaacacttcggtgcccgactttcacaaattgacctttgcgctgctcagcggactgcccaacgaagtttctttcggtcttaacattctcaccgtcctttcccaccccggcccttttgtgttgaatttcgccaattgtccccagcttatcgctcttttggtcgccctttgcggcgtttgcgttaacgttgaaggtccgtccaatccgtttttgctcttcgattggtggcgtcgttcttccggctacgacttcgcctccttttgggccaactcgggcgttgaagaggctcaacgtgctgcaactgctaaagattgatgaaaatattcaaatggctgagcacgccgttcaattcctttacatgcgctttctcagcaaatttgaacagagcgaagcgggcaacgacatcagcgaagagcacgaagcggaactgatcaacggacgcaccaatcgtttcaaaacgtttgccctcctctccaagcgaactgtgcaga

SEQ ID NO: 91862 - DNA, 371 bp, Heterodera glycines
  SCN-specific regions: Sequence locations=1-18,102-371
gagagagagagtgatattagggagaggaggagggagagaaagagagtgattagggagaggaggagggagagaaagagagtgattagggagaggaggagggaaaagcggacgtacttcccgcggccgcggcggaggcggcaccgcttccgaccatcgaagagatgcgctgcagcagcgaggcgttcagtgcgccgcccttgcggaggaatgcctgcactttgctgaggtcgtcgacgcctcccgcttttcctttctgcttcgccgttgacgagggcgagacggagcagtccaacctttgcgcagctgctgaacaaaccgaacatgtataattccacgctttttgaatcacatcctcacaaaaagcccacccc

SEQ ID NO: 91863 - DNA, 163 bp, Heterodera glycines
  SCN-specific regions: Sequence locations=1-163
gaatggcaatggcacggccaaattaaatttggcggtgccaaacgttggccgagtggcggcgagtgctttattgccgctttgggagttatttattttggacatgcgcttttgttggcattcacttcggttggcacttggcgatatatcaaaaaaaaaaaaaaaa

SEQ ID NO: 91864 - DNA, 583 bp, Heterodera glycines
  SCN-specific regions: Sequence locations=1-301,323-512,535-583
gtttgagctattcttctgattggatttgtcatcgttgtgaaatggaagtacaatacaacagacgtcatgtgccgaggattaaatggaatttggcaatcaattctcgtgaattttctctcgacaaattgtgcgtcgatgaatgtttttacaaattgcctttcgatgaacttttcgcaaaagatgagccaaattcgaagagatgtttttactgtaaaaggttcgtcgagaagaggatggtttcttgcgacttttgcgacgcttctttctgtttcgactgccccaacccgccttttactgcactgccaaatgaacgttttatgtgctcacttcacatcgaaccattcatcgacgccaatttattggattcgaaacgggtaactgaccgaattgccctttggaaaaggtacaccgaactgccaaagtccgaaacgccttttcggtccgttatttcgtgtttctacacaaaagttagagaggataacacaaagcaacatcttaaattgaagtcaatgacaacaaaaaagcaacaaaagactatcaataaacccttcaaaatcgaaagtctgatcaaaagggcttatgc

SEQ ID NO: 91865 - DNA, 627 bp, Heterodera glycines
  SCN-specific regions: Sequence locations=1-627
tttttgcttttgcctattttgcttctccatctccaacaatcccaagcttgcttttcacgtggcaacagtggcgaaccgtcggatggcaatcccgaggcccaggggctaaaatcggaaaacgatgttcggactgttcagttgaagaaggaaaaacaaacggatgaaacggaagaggagaaagacgaggaaagttcggcagaacaaaaattgccatctgaattggacccggaatttgtgaaaacttatctgcgagaatttggtcatctgaagcacaatgagaatggcctttcccatggcgttaagcatttccaacgctttttgggctaccggcagacgggcaatgtcgacttggcaacccttcaaaaaatgtcgtggaaacgctgtgccaactctgacgagggctacacagcacaagacccatcgcaactttgggaacgttcgacattgttctggaacctgaacgcgtcgcaccccaagcagttcactcatggcgaaacgaaggaattaattgcgcaagcattccgcgcatgggaaattgtgatcaaaatcgactttctggagacgaacaatgcggacaatgcgcagatcattttcacatttgaaagcgacggagcaaaaaggaaaaaa

SEQ ID NO: 91866 - DNA, 642 bp, Heterodera glycines
  SCN-specific regions: Sequence locations=1-187,209-642
aaataacaattttttctcagactctttcaccggtaccgggtccgccatcattgagaccacgcgcacgagggactaccgagaggtccgcaagaggaggaggacggagcaggacaaccgacaagcaacattccatcgacctccaaacaacagaaggacaaagagacgagcggagattccaaaatcgcattgccacccccaaaattggccataatcgttgaggccaccgaatcagcaccccgcggattgatttgcccgacacttcctcccatttgttgcgcaatgacactggactggcgtcagtgtgagcagcatcgaatcggtgaaggtggtgtttacgtgccattccccggcggtgaacaatcgacgtgttcagaccgccaaaatcggccgttctgcgacagtccttcagcacatggttgacgtgcgcaagaagctggagttggaggtcaaaattgaccctgccatttttgtcgtttgctccggcggtgcctttgacccaacaaaaacgacattaatcgccgaagttggtcaattgaaactgaacacttaggacgagccgtccacaaaagcatacgaacatataaccgatcagagattgcgttcattggtggcaaggcatacgacaatttccaactttgcctc

SEQ ID NO: 91867 - DNA, 626 bp, Heterodera glycines
  SCN-specific regions: Sequence locations=1-626
gtcacaatcacaaggtctgcctcgtgaccctgcattgaatcagctgtggctgaagcagcatccgctccaagccgttcgccctcagttcacgcccaatttgtgctgcttggctgagtaaagtgaaatgacccggactgaaccaggaaaaccccttcagctccttaaaaggtcaatgacagtccgagtttgaccagaattggtcgcagaaaaactcccgcttccattggcgaatcttggtgaatgagcacaattggagattcagcaattggtattttggcaaaactcgtcagcatcctaaagattcccggtcccgatcttagcctttcaccatggggtgtgtatgccgcatattcaacgccgttgacaatttctggatgtgaacggtagttcacttccaacgttgttttttccacaccagcagatgagtctgtattgagtaaaactgtgtcaaagccgaagccgactcggagttgttcagggatgtccttcatgttcacggctagctgataacgatcaccagtgatgaacagcttctgaacttcctgaaggggtgagaggaccgagcagacttggacaaaaggcgcttggcccgattcgtcaagcactatcatgtttctgtccgtgat

SEQ ID NO: 91868 - DNA, 649 bp, Heterodera glycines
  SCN-specific regions: Sequence locations=1-321,343-649
cgccgctgtgtcgaaatctgaacaaattcaggtgaagttacaacagtatattccaaggcttttttaagaaaatggttccaaatggtggcctctgccaattccaacaaattccccactaatccgaagatgataataaagctctccaaatttgtccggttccactttgctccgacgaaattgagctgaaagaattcgagtaaaacaaaatcatccgattgaccatggccgttgcagattcgcaggtgttaagcacaacttcatggccctcacaaatgaattcaaaatcgccatcggagtcgtgatttttggcagtttggtacgccagcagaatccttgcctgaaagacccccccctggacatatttattcacctctaaaatccgtccattggcacaattttttcttactcctttcaatctcgcttgaattgcggcatcttcctcccaaaattcaaccaaatcaacaaacttacgtttgttgtcaagaaaatgttcaaaagtggcaacaactgtccttccgttattgtccaaaatgtggagagttgtctcaatggcgaactcttccatttttatccgatttttaaggaaacaagacgacaatgccgctgcgatgcctttttcagctaaatgaatgtcagttgcggcactgaa

SEQ ID NO: 91869 - DNA, 612 bp, Heterodera glycines
  SCN-specific regions: Sequence locations=1-87,110-165,243-282,304 -385,416-457,479-612
ataaattttagttaattaaacaataattatttaggtgagaactgaattgtcccggaatccctaccctaaccttcattcacataatacaatattatatattttaataatacttcttttttaacttttgattcgcttattttgatgaaacacactcactcatttccgtaattttattaattatttttcaacaatttttatttatttttatcatttttaaatttatttttattattcctttttataccttcaattggtcttgtgatggaactggtaaacactcattaaacatcagcactcattcatcatttccgatcaaattgaagaaaaccaaaaattacattttttccccaatttcccgcgtccccccataaaaaaatttgaaggccattcattcgttctttcgttcgttcattcgacgcgcaaaaattcatttaatttgcgcccattttaccgaagaaacatttgtgcccaaaaattgccttctcatctcacaaatcagcaacaaatgaattgaataaataatttttcaaaatccattgaaaaagatgaaaatttgtttattttttattttttggaatttttttaaattgcaaaatgttgcatattttttac

SEQ ID NO: 91870 - DNA, 93 bp, Heterodera glycines
  SCN-specific regions: Sequence locations=1-93
ccaatctttggtcttccaagggtccggtcggttttgacagggctaactattggatttgacttccgtcgatcgcttggctttttcccatttgcc

SEQ ID NO: 91871 - DNA, 506 bp, Heterodera glycines
  SCN-specific regions: Sequence locations=1-178,231-356,378-506
ccaggagctcttcttccaagcccatcgttgacgctgatgccaacctgaagacaacgttcacagatgacttctgcaatgatcaacagcgggacgtgcttctgcaccaatcggttgttaagctggagcgggctgtcctgcgacgtctctgcatcgaagaagcaaagtcgaagcggcaatacgtcgtcttcgccgtcatcgtcaccgttgtcatctgagttgtcgtcgttgtcaacagcaactgatgcgcgttgccgagcagacagatcacaaattggctggatgaagcagggctcttcggcggtgtgaggcccgtcgcaacgtctacagttcccgttgtcggctgtttgttgacgtgggcattgatgtttgccctggtaggcgatgcgcccacaatcacggcacactcggcgccattgacagattggctgacgctgacgctgtcctcgggcatccattggagctggagcatgttcgatcagatggtagtcgtagcaatcatcgttggg

SEQ ID NO: 91872 - DNA, 670 bp, Heterodera glycines
  SCN-specific regions: Sequence locations=1-15,37-264,286-451,473-670
cgatcattcatttgagaactttttactgaatgattatgcatagctttgatgagtgatgctttccccccaatcgctcctctttttgttcctttttttgttggcttttctctttccgtccgcccaatgtttgacactaaaaagacagaaaccgtcgcaattaaacagaagaaacgaagaattaaacgcagaaaaagcattgaatagaacggtggccaaactgagaacagacggagagaacggccgactcattcttttggtgtgccgtggaaaatgcctaaaggaaagggcacagatcccaaattggcttcgcgagttcaacacagcgaacaatcgcagctttttgaaaaggaacaacgacaaaagcatttccgacgagcaaagtgatcagagtgtgagtgatcagcagaaaaacaatgcgtcgctgggaagggacgacgaattgcaaaagcattgggaagggggcgtcgcctttcatttctatgcccaccgactcccaatccccgtgatggacattgagacggcactgcggcagcattcgtcgtggcaaagtgtgcttttttatgtggtcgccggaaaggcatttcccgcagcgccggaggcggtgatcagagaaaagaacaccttcctggactggctgaattcttttgaaaagacgccaattgtacgaatt

SEQ ID NO: 91873 - DNA, 593 bp, Heterodera glycines
  SCN-specific regions: Sequence locations=1-2,40-593
tgtatatatacatatgtatttttgtatcatgttttgtgccgcatttatgatcatctccacacatttgatgtacctattgatgtatttgtatgtgctatgtatattttgttcacatatgtctgaatgaatcgtgtttaaagaatgaaagtgttcttgtgactataaataagacgaattttgagtaaaaatttgagtggaattattttctatatacagtgtgtaaatttagaatagggacgactgttttcgggagtttgacttgtcggaaaaaccgatttcgaggcccccacaatagaaatgtgaaaaattgaattttcataaaaattctaaacacgcaaatggaaattgggcggaatacgaatttggcacaaaattggagagaatggcaacaaacaaatgcaaattgtcaattccgatggaaatccattgccaattccgcaaaatccgttgccaaacaaagtcatcggattagaaggcattacaatcgcgtaatgccaatgtttcgcgactccattgttgtgatgtttttgaataccatcgcttttcgccgtttacgccaattggctctgttactactcaaaatcaacgattgg

SEQ ID NO: 91874 - DNA, 529 bp, Heterodera glycines
  SCN-specific regions: Sequence locations=1-86,108-398,420-529
acgtccaagggcccccttcctccatttccttatcatagagttgagctttgatttccgtgggcaacttttcctttatggctacggtcagaaatggattatcatccaaatcactgcccaagctctcaagttgtcggcaaattctgtcgacatgctcagaaaaaccccttaatgacgttgaatgccccgtgggtttagaaaggtggaaaagctcgcttcggagccggtctgcccgtttgttgtcgtccccaaaacggccctttaggaggtcaaccacaatcggatagttgtgatcagtgagggcaaaaccgtcaacaagagttcgggccccaccccggagccgacctaccaaataagtcaatttctgcgcccccgacaaggactgattgtcatgaatcgtatgacagaaagcggcccaaaaggatggccaattgctttcgtgtccgtcgaagtcgggtagctgaagggccgggaggttaattgtggggcgaatggtgggggctgaatggagaggcccgggggcgagggcctg

SEQ ID NO: 91875 - DNA, 597 bp, Heterodera glycines
  SCN-specific regions: Sequence locations=1-597
actcatggctcataaccaatccgaaagttcgactactgatcaaaaaacgcctcccgaaatagacgaaagggcggctggaactgttgaaaacagtggaaatgcggcgaagaaaggtggtccgccgttggcaaagtgcagcgtttcttcctctcagtcgagcggcggcgatcagacggacgttgccgaccctcctcaaagtgtgccatttttgcaggacatcaaactcattccaactacgacatcatccgcttcttcgtcgccggctttttcccaattaagcgaacaaggcgactaccgaacgccaatggccatgatcgtcaagaccgagatggacacgaacccaaaacaacaaattgtcgaaaataccgtcgcaaaggctattaaattttacgacaatgaaattgatggaatgaacagcaaaaaaagggacgctgaaatggaccgtctgaagcaggcgaaggatgcccaagcccagaacattcttgccctaaacaaacttcccttctcttcttgccccgatcgaacgtccaaagaatcgtttgtgaagaaagagagtgtcgactctttggctgcgaaacgacccgcgttggttctgaa

SEQ ID NO: 91876 - DNA, 603 bp, Heterodera glycines; identical to SEQ ID NO: 67272
  SCN-specific regions: Sequence locations=1-70,92-143,166-259,281 -465,488-603

SEQ ID NO: 91877 - DNA, 593 bp, Heterodera glycines
  SCN-specific regions: Sequence locations=1-59,82-125,219-593
cacaactcaattttcctttttgtgcataattttgtttttttgcgtgccgtggcacaatccttttgacattttcctttcttcaatttccattagaaagagcaacattctcggtggcaatcatttacatatttaaatttacaaatttaaaaaaagaaataataattgaaatttattaaaattttaaaatcaattataatttaaatttattaagattttttcttttccttctcttcttttacttgaacatctgaaaattgcagcacagagcgcgaccaaatggcacaacaaacaacgggcgaagaaatgaacaaaatgaagcaacaaatgaaggaatcgtatgaggagttgaagcgttgggatgaagcggagcgggtgacggacaacataatcccggaagatcgtgggctcatgagagacgaaaaagcttacgagaagataaggatggaagaaggaaatgaaggctgatggaagcgggctgtaaagattttcaaaatgatctgaccagtgatcagagatgtctcctattttctaaaatggttaagtattttcatccttaggatgtaccgtatgactcacaaattggggtatctgat

SEQ ID NO: 91878 - DNA, 675 bp, Heterodera glycines
  SCN-specific regions: Sequence locations=1-294,316-675
aacagacgccttgaggcggaaaacagctctttgaacatcactgtggatgcctatcaggagtcggtgcgcaccaaagacgagctgatcatgaacatggttaccaacgcgaccaatgccctgccatttccttcatcgagtgtgccgtccacttctgctgcgaccggtgccatcgccaccaccactccggccggcacaagcggaactccgccaccgctcgcaacgcttcgcaaatcgctgattgggtcgttcatcggcaagggcacttcgtcgcctaccgcgcaaccgacgcccaccgctccaccggttggggacaaacagtcgccagcaaatgggaacggagccgaagcgactgaagcactgctcgtcgactttggcactccgacggacgtggcggcaaagaatttgttcaccgaaacggcggtgaacgacctgaacgaaatgaaggacctgaactccaacaaattgtccaatctttggaggaccgtgagcgaaagctgatccgacaaaattttaacattgaagctgtttactaccagttgaagagccgctacattatgttgctcaaccatttccaaccgtcaatggaccgccaaaaacggctgcccgtggaaccgtcgatgatccaagaactgatcgacgaggtcaccagacctcactctccgatgcgtacacaca

SEQ ID NO: 91879 - DNA, 402 bp, Heterodera glycines
  SCN-specific regions: Sequence locations=1-86,108-402
tattcagtccatgaagttacctacaaaacaaaaaaaagcggtatcctaaaggcgggaaaagcggtaaattattgctattaagatgcgtataaaaatgaattcaataatttttttttttgaaggtcagacgaatccaggaacaatttgtgaaggctttgcaaatccatttgagccaatgcgaacatgggcccctactttccgagattctcacatggcatgtggttgattaatttttaatattaaggcacggatttttattgagcaaaaacccctaaatgacagggttggtgaaaaaaatggagaaataggggcgaagatggcaaaacagagatgcaaaatttacaaaaattgtttattttttatggaaataaattaaaatcggtacaaacaattttatttatt

SEQ ID NO: 91880 - DNA, 665 bp, Heterodera glycines
  SCN-specific regions: Sequence locations=1-630,652-665
gtaaatcatggacttctcagtactgaccaacatacctgtgcaaggaggtgtatgctgaccaatgaatgaattattcttcaacacccattacctccactgttttgcattcgatattcattgcgaccgtcgaacacctcaaaatcgtcgagtgcagccgcgatttgttcttcctcttccacacttccaccggacaatgagccgacggacgccccttccgccaattcgtccgcgtcaattgctaaatgcttcagcgtactttaattggtctgactcattgggcagcacctgattcgaccgactcggcagcgacttcgctccctccagtggtaattccgagttggtcgagcatccgaccgtacagcgcgtgtcttttgaagggggtgtttcgttatcaaaatgggcatcggattgcgctttgggcttggtttatttgcctgttcctgaatttgctcaaaccatccatccgatggttcgtcgttgcgcagccgggccaaaaacttgttgacaattgcttcgctcaacggaactcgaaggttcacttcctgtgacagatactgatggtacatgaagagagccgcttctcgaattgtctcccgcgcgtcgctgtccaaagtgtcgcccgaggccaaccccctcaactgatgctccatggacacgttgaaacc

SEQ ID NO: 91881 - DNA, 606 bp, Heterodera glycines
  SCN-specific regions: Sequence locations=1-504,528-562,586-606
cgaacattcaaatgaaatccattgacagcactgaaaaagaaaattcatttggcggtggtgccgaattcggccattcccttttcgtttctggcattgaacagcgtttttcggtgttcgtttcgcccggcacggcctctctcacggcgccgtcccttttgaaactgtcgttagtccaaagttcagacggttctattgaatttttgaattctgacggaaattggaccaccgaagcgcaatttctaatccctccgcttgacgtggaggaaaagcatcgaattttggtacgaatgtgcaaaggaatcgaccgattggagacgtaccaatcggaacagaaaaacgaaggacaaatcgaagagaaatgcgaactcaaattcgaatggttcgctgcttctgattgcaaatctctgcttagcgatgattttctgatcatccgccgctcttttccgatcacttttcgcccgattatgcttctctcatggcgcacttcttttttgtccgatcgcactcttttccatgtggacatttctcgcaaggattgtgtctctgctgctttcgctgtcgatgtgttccccacttttgtctctctcctatctctcaaactgattg

SEQ ID NO: 91882 - DNA, 478 bp, Heterodera glycines
  SCN-specific regions: Sequence locations=1-28,69-302,324-414,438 -442,464-478
catcttcattcctcctcccaccgtttttgcccttcttcccatccccatcatcatcatcaataaatgatgatgattgattgggttgtcacctcaacaacaaacagcaggtcggagttggaaaatgtgtgtcggtgatttgtttcggggttatgatatgttgtacagttgtcagtcggggggtctaatttttggtggagtttattaattgcacgactaattggcacacttggacggaatgtggtgattcaaatttaaaaaaaataaattgcggcacattaaatggtcaattgacctgctggtcggttggttcccttttcaaaaaattatgttacataactttcagtattgttatggtcaaaagaactcgaaaaaacactgttttttttgttgaacatttttggccaaactttcttgaaacttaacgaaatttttagaaattttgcacacatataaaatttttagaggtatggaatgattt

SEQ ID NO: 91883 - DNA, 646 bp, Heterodera glycines
  SCN-specific regions: Sequence locations=1-447,469-646
aaatgatgaagaccctgaatgcttttccttctacgaaaatctgtccttctctccggacggcataaatttgttggcatttgctcgtaatgcgcgactcggctcacacaacgcttcgatggcactgtgccggtttaaatgggatggcgcagtgtcaccggctaatgagcaggcggaagtgctcatcccaacgctggacagtccccagctggtggacatcggtcggcagagtgtgccattccccggctgtttcgacccgtcggtgccattgcgggcgtggagccgagacagccgcttcttcttcttcactaccgtttggcataacaaaacgaaaattatccgtgtcgatttgcacaacggaggccaatggacgtgcatcccaacggaacatttggagggcagaaaattttcaaaaacgaggcaaatggagcgtgaccgtattctcttccaacgccaacgctttcccaccgtcgcctcaattcaccatcagccggcgacttcgtccgcctccggcgttttggtgccaattccgacgacggacggcgccgccgctgtgcccggcagcgccggaggctatcagaggcgatattcgacacatcgagaacagcagctgcagcagaggaacagaagggacagcaaattcagcagg

SEQ ID NO: 91884 - DNA, 565 bp, Heterodera glycines
  misc_feature (562)..(562): n is a, c, g, or t
  SCN-specific regions: Sequence locations=1-6,40-565
ttgaggttttaagaaaattggttttaaaaaattgaaaaaccaaatcaagcagcaggaatgcccgcaatgtcagctgctgctagtgaagctgatttgcgcaatgatttgatgcgattaatcattggtgaagagcacttgttgaaaattaaagcacaatatttggacgagcggacagcgcttaacctgcgaagaccagtgaactacatagaggtggagcagtactttcagaataaatatggtcgattactcaacttttattacaccacctcgacgcgcgaactgatgattcagatccacaaccaacaggacttggaccaggtcattcaattgcatgaaagcactggggggaaccaacgacgaatgcgtttgattctatcacagaaacgtgatcagccggcccaagtcggccctctgttcgatcagcaacggcctccaccgtcgtcaccctctccgcttggcattcaccgaaattcgcagccaaactgcggcaatgaccgtgtggcgggcaaccgaaacattgtcgaggcaccgctttcctcctgctcgtcctccgtgtggtcgntgc

SEQ ID NO: 91885 - DNA, 343 bp, Heterodera glycines
  SCN-specific regions: Sequence locations=1-18,40-147,171-343
cctaatctcaaatccacctgaaatatggtgtgtgctgatcccccccccccccccctctttcccattttgattcgagagagtacagcagtattatgtatcgcaccaagaattacgatcatcaaccgcaggacacacaacagcaatggcagggggtggggtggggacaggtatgtgcaaaaagtgcacatttgtgggtgggcagaaggggggggggaatggcgattgaatttggggtgcgcaatgtttctttatgatggacgggacaaccagttcctcctccatattcccgctgctgatgaacaacaacaggttagctttcctgaacaatttttgttgctattga

SEQ ID NO: 91886 - DNA, 621 bp, Heterodera glycines
  SCN-specific regions: Sequence locations=1-621
gaacgttctaaatgtgcaatgcaccaagaaacaatccgaaattgtgaacttcgtgtgtcttgggctcgtcccgtgaacatgccaccgctgccctttttcgtcccgctgcctcttcgtgagcttgccatgcccgacccaccttcgggtttgccgttcaacgctcgacctctgacagaggagctgcgttcatttctgcagaactatggagatttgccaaagttgggagtaccgctaactgaggaagagggcgaaagagacacacaaatgctggaggactacaaaaaggttggggccacaccttttctggcgccttttcactccaccaaatctgatctgatccgattaattcgtcacgttcaactagcagatgattgagaatgccactgtgcgcgttgtcattcccacagagaggcctttattgacacttattcaccgtgttgtggaatttcttgtacggagtggccctctttttgaggcaattttgatggccagagaacgtcaaaacccaatgtatcgttttctgttcgataatcatcaccctactcatgtctactaccgatggcgtctttacacaattttacaaggcgatgaccgtcaaaaatggcggctggagaagttcaa

SEQ ID NO: 91887 - DNA, 619 bp, Heterodera glycines
  SCN-specific regions: Sequence locations=1-420,442-558,580-619
cccgttttagaatattatcgccaaatttttgtgattaaaaattaagtgcaattttggggaaatgctgtgccaaataggcaccgtggggaaaaatgcgaaattcttaatgcatatctttattctatttgagtccggcgatattagtcgcctgaccattcggccgatcaaaatctccgcgcatgcaatcacagtcaaatggtatgcgatcagtcgtggctgcatggaaaacattccaattcacaaatacttacttttctacacacttgccacggacgattacaattggaagaaaaaaaaggtgaatttgagaaagggactcagtgccattctgacgacatgcgtcaacacaattttcttttggcttgtgacttggcatttgcgatggtcccattccaaaatgtttcaggagagagcaattagaaatatttgaaattttaaagtttgttaataagggtataataaagtttgcacattttgaagccgtgaaatgtggtttttaaggtatcaataatatttgtaagttaagaatttacctttttctaggaaatgtactgatttcttttaattctaaatttttcaagcaaaaaaaaatttccttaaaaattgctagtatgaaggg

SEQ ID NO: 91888 - DNA, 651 bp, Heterodera glycines
  SCN-specific regions: Sequence locations=1-533,556-651
ataactgcctctggtttacaagtcgtacgcaattttgacgaagttgcttttgtccaaaatcttgtttattacattgaaacaggatatcgaacgcctaggactttggcacttgggaacgtggtgacaaaaccaatcagggcattcgcgagctgaacgcaagctcaattggaatggcaaaggcggctttgcaagcgattaatgacattggcgacctttttggagacggttctaatggttctattgttcacgttcttcccgatgaaatccaacaatgctcagcagtactctgcaatatgcttccgcatgaaagtttttcaaaggaaacggatgccgctttgctttccgtcatttcgtttcctgcttttgctgtcgatgatttttcactcgcaactttgacacgcgaaacaattctcgctactttgggcggtcgctacggttgcaagcgatttcttcgtgacggctataaaacagtgcttgaggaccctaatcgacttcattacataaattgtgagttgcaaaaatttgaaaacatcgaatgcgaatggcctttgttcttctgttatttgtatatcgacgccgcttatcggaaagacgaaaaggcagagaacgctttttggaaacagcttcaaacgcttattgtcgccgatagca

SEQ ID NO: 91889 - DNA, 494 bp, Heterodera glycines
  SCN-specific regions: Sequence locations=1-34,56-64,99-133,207 -320,344-375,432-432,490-494
ggcttatcgatccttttgaatgtgtaaagtttccagcaagaggtgtcagaaaagtcacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgcgaatc

SEQ ID NO: 91890 - DNA, 593 bp, Heterodera glycines
  misc_feature (439)..(439): n is a, c, g, or t
  SCN-specific regions: Sequence locations=1-384,419-593
gccataagaagagcaatccttaaccagctcaatcacccaaatttatacttctttaacctcaagtcggttcgctcgcttaactcttgtatgaattttcatctgtaatttaatcccatttctgaatactcttaagcttattcactatgtacatgcagtgtaattctggtttagttgctttcctgatttgtgttcttcttactttcgtatttttattttataaccaatttgaatttgatatcacttttaaaagcataatgcttatggttgaacaaaaaccctcctcattcttcgaaaaggtaattgtccatttcgatctgaaaggagctgcaccaaagccacattatattaaagaattattaccgttcattaagaaattgggatttactgaaattcttatggagtatgaagacatgttcccatactcttttgggttgtcggntttaagacgaaagactgcttttgatgaaatgactaccaagcagcttaaagagtctgccaatgccattggattgaacatcatcccattaatacaaacattcgggcactttgaatttgctctaaagcatcaagagttcttttcattgagagaggac

SEQ ID NO: 91891 - DNA, 522 bp, Heterodera glycines
  SCN-specific regions: Sequence locations=1-522
gcggagccgtccccactggtgcaactgtcctttcaggtccctctgctcaatgtcgagctgtgccatcgtcgtccgtcctttgacggcagtgttgtgccgccactgttgccgcaaccgccttcactgatggccaacaatgccggcagtgaaacagcagcagacgaaccgtttccacgggcattctttgaaggcaaaggcaccgccaccctttgtccgaacgacagcaaaatctttaccgttgccagcattgacattttgccaccgtcggaaacaacaccggcaatttgcagcggccacattggcaccatttctgccgagacagtgtcgttcccgctcgtggtagccgcgctgcgccctctgaagcgcgtgcggttcgcagacgactgtggccagtgcctggagacggtgcgtgtgatgaccgagcccagcgactacccgccaaagatcagcccagctgttctccgtcgaatacgtcgtgcagcagccgcggcttcctccgcaattgctgctgcccattccgcc

SEQ ID NO: 91892 - DNA, 581 bp, Heterodera glycines
  misc_feature (480)..(480): n is a, c, g, or t
  SCN-specific regions: Sequence locations=1-2,31-503,528-581
gtccctttctcctcttctcttctcttccaatggctcctccgtctcacttttcttcgtcctccgccgctcctccacgagcgtttgtgcgtcaatgcgaattctttgagcgttacggcgagtgcaaattcggcgaccaatgcttttatgcgcacgacgacgaaatcactttgggagttaaaaatgcaatggaaatggcccaagcgattggaaagggcggcactgctgggggaggggtggaaattcgatttgacgaacgagacagagaggtcaaaatagtcagagtgatggacagttcgtcgacgggcagaagccgagggatggacaacggcagaagagggaacggaaggggcggcttcggcagagcgaacagaggcggcggagggggcgcagcgggcggaagcggcgcattggcatttattgggggaggcggtggcggatttggcgagggccgaggcaggggtcgctttttccgaggcggangaggcgcggggggagcacaaatgcgtggccgaggccgaggccgtggcattggaattggctttctgtcgcctgtgcgcgggtccggcaacattttcagcgag

SEQ ID NO: 91893 - DNA, 645 bp, Heterodera glycines
  SCN-specific regions: Sequence locations=1-645
taatgtttttaattatcataattgcatcatttttttatacaaatgatccgacccaacattgttcttctgatcactgacgatcaggacattgaattgggttccatggcatttatgccgaagacattacgcctcctccagcaacgcgggacggagtttcggaacgcttttgtgtcgacgccaatttgttgtccaagcagaagcaccattctcaccggtctctacgcgcacaatcataaagtgatgaccaacaacggaaattgtgcaggcgaagaatggaggtctgacttcgaaaaggacactttcgcggtgtacttggaaagaaccggcttcttaacgggctttttcggcaagtttttgaacaattacgacggaagttgggtgcctcccgggtggacgaaatgggccgcgttggtgcgcaacagtcgatattacaattactcgcttaacaaaaatggacgcaatgaatggcacggaaatcgttacgaaaatgactacttgaccaacttggtggccaacctttcgctgcaattcatcgacgagtctgttttgctgaacccccacgggcagccattcctcgtcgtcctcagtttccccgctccccatgggcccgaagacccggcaccgcaatttggcgaccttttcgaa

SEQ ID NO: 91894 - DNA, 646 bp, Heterodera glycines
  SCN-specific regions: Sequence locations=1-520,585-603
aaattacaaaaatttccccggcggcgcctcttggcgccaccggatgcccctctccaacccccaattttttgaaaaaaacgcgccgcaaaaaaaggcagttttaaaaggcaaaaaagtcgtcgcttggttgcaaaaattggcctttttgatgaaaatctgttaacaaatcagaacgaaattacaaaaaaaaatttccggcggcgcctatcggccgccggaacccccccccccgttccacaaaaatatttgggaaaaatgcgccgcaaaaaaaaattgttaaaaacctgattttttgatcccaactgaactggacaaattgagcattagtaatctaaaaaaccagccatttttttgttgataatcttttaacaaattaaactcaaattttcaaaattttccccgtcggcgcctatcggcccgccggactccctctcttccccagaagatttttgaaaaagcgcgccgaaaaaatgatgtgaaaagcaaatctgaatttctaataatattcgtcatttagtccaaaaataattattttttgaaatgattgaagaaaatttgatttgaaaattttattaatttaaaatccccggtcccgcttcactctattttatataagaaaatttaaaaaatatatatttttttaatg

SEQ ID NO: 91895 - DNA, 587 bp, Heterodera glycines
  SCN-specific regions: Sequence locations=1-9,32-53,109-150,220 -469,507-587
gtcatgttgtttttataaataaatttgaaaaatagtaagggaaaatttgatggttaattaaaattaaataaaagaaatttacatatataaaaattatttgaataaaatgctgcgcttaggaatatattaaagtgacctcattcaaatgacattattatattgttttattgaattctttttgtataatataagaatttttatttttgtatataataaaaagggcaatattagccaaatttttattaaagtgatcaataacatagacatatattttatttttgccgctttttacgtaacatatacatatattttatttttgcagctttttacgaaaaaattttaagctcaaacttggtagcggattacaatggctactcgatttttgaggatttgcaacttggggacccgacatttaaggacccgacttttgaaacaaattcaatgacaatcaatcaaggggatttatgggtaaaaaataatttaaaaagttatttaatatttatttagccaaatttgataaacaaaatcacacaaattggcgaattgtaccgcagtggcaaattgtttgagaatccttccgctgtaac

SEQ ID NO: 91896 - DNA, 497 bp, Heterodera glycines
  SCN-specific regions: Sequence locations=1-182,205-497
ctaaatcacctggtccatttttttttttacttttaaatccgaagtcgaacttttcgtaaaattatgtcttttttgcctatatgaattcgccaaccaatttcaataattttcattcaactactaaatgtgttccgcttgaaaatggctctgatagagagaagggttcgaccagtaacaacaatcacaagagaaggaaggataatgttaaaagtgagttgatagacaacgccatcggaagtccgaaatcgaacaaacgggcatttttttctgctgattgtgcactgaacccaacggcattggctgaaatgatgccgagttcgagattaagcatgggaatggccggccgtttgcgtgacatcgtggcgattttccctcaaaatgatttggcttctcctggaaaactgctctttcgggaacaaatgacaaattcggaccaaagggtattttctgccaagggacaagcggatgttccggggatgaacgccaaggaaataagc

SEQ ID NO: 91897 - DNA, 644 bp, Heterodera glycines
  SCN-specific regions: Sequence locations=1-3,26-58,245-431,479-644
agacaagtattaaaaagaaaagctaacaaagagctatgaaaaaagaaattttaaagctaagaaaagaaaaaaaaaagaaaagcatatgataaaaaaaaaacgaaaagcccagcaatgaaacgaaaagccatgaaaaagaaatttttaagctaagaaaagaaaagcgggcgaaaaagaaacgcaaacgaaaagccattaaaaagaaaataaattttaaagctaagaagaaaaaaaaaaaaaaaagcagtccgagtataaaaaaatgccaattcaaatgttgtcactcacataaaaaaaactttcgttccatactaattttctactatattgctttttttttaagcgaaaaaattaaattgggctttattgttatggctcaacaacaacaacaacaaaatgtcttggggcaaatggcaccttttggccaagtcataaaaaaataataataataataaataataacattcaattatttaaaggttgctcagttagtgcaaccaatgctcgtcaacgcggcacgtcagcaattggcggtgctttattctgttttacatattaaatttatgccaaactgtcatttcaggagcctttctgtgcggacggcacgcacagcattcaatttttgaatgactgcgtttcttcgt

SEQ ID NO: 91898 - DNA, 123 bp, Heterodera glycines
  SCN-specific regions: Sequence locations=1-123
caaaaaaactcagtgtgggctgtgggcgatccacaaaaaaactcagtgtgggcgatccacaaaaatactcagtgtgggcgatccacataaaaactcagtgtgggcgatccacaaaaaaaaaaa

SEQ ID NO: 91899 - DNA, 658 bp, Heterodera glycines
  SCN-specific regions: Sequence locations=1-343,384-658
ggccattccttcgtggaggcactgcggctggccgggctcattcatcccgtcatctccatgggcgtccatgccgcgtgtcgtccagtgtgccagtgccaagaaccgtcgctgaattgccaaaatctgtcctgaacagcatcatcttgcgatggcgatcaagcttctacaggcagggattctgattttgtggtcggagtcagcaaaaaacagcggcaaacttttcggaaaatggttcaccgctcggacattcatttggccatctgttccaacccgaccaagccaattaagctgtgccggcagtggaatgagcgcgttatgggggaatactggcgacaggatgatcgggaaaaaggaattaaaatattcttttatttgttctatttgctgccttcaacctttgacaaaggctatggacccaacagcgactgacgatgaaaaaagggccagatggaaacaagattataaatgccgaagcacgggccgactccgttgtgagtttgaagatgatactctggacaggtggcacgaagaaatggcgaagcaacggtcccgctctgcttcttattcacgcgcgcgaaaagaaaaagcgcagcttttgccggtagcgccggttgtaaaggcaaaaaaatacttctgtgacaaatgtcctgccaatttt

SEQ ID NO: 91900 - DNA, 644 bp, Heterodera glycines
  misc_feature (543)..(543): n is a, c, g, or t
  misc_feature (558)..(558): n is a, c, g, or t
  misc_feature (588)..(588): n is a, c, g, or t
  misc_feature (590)..(590): n is a, c, g, or t
  SCN-specific regions: Sequence locations=1-364,387-644
cagaaaaggaacattggcagttattcgccataacccttcaaagggcttctcaaagtggtttcggcatcgcaatttcgggtggtcccaaggaaagtgccattctcgtcagtgacgtcataaaatcgggtccggccttcggtctgctccaagtcggcgatcggatcatctccgtcaacggctacccactcgaacacgcgaattacgcaagtgccgtggcggtgatgaaagacgcacagcaacttaacatggttgtgaagcgacgagtgccagtgccttttgtggagtttgaacagcgaacgctgaaattcactctgtccaagtcgcgcaaaaaggatgacttcggcatcgttttgggctgtcgcttcttcatcaaagagattttgaacccgaaattggcggagaaagagccgggactgaaggagggcgacacggttttgaggataaacggacagacactggacggattcactttggacgaagccgcgcgactgttgcagcggtcgcgcgagaaactgtctttggttgtgcagcgggacgtgccgnaagggaacggccggnccggtcccgctggccgagccaaacgacggngnacgaacgttttggcagtgtgccagcgaacgccccgccagtcgcccacccccgtt

SEQ ID NO: 91901 - DNA, 578 bp, Heterodera glycines
  SCN-specific regions: Sequence locations=1-143,177-191,214-391,416-578
cgctttcatatgatcagcaaaaggcgacaccaaatgaatcattttggccgaattttcattgaatttttctgctttgatgtcattcagaatggtgccaatgccattaacctaaatttaattaaattattggcaaatgccattggtttatttaatattaattcattaaaaaataattagcaaatgcaattggcttaattttatattaataaaaaagcgatgttttcacattttcattcaattctccgttgatcactttcccattggctttttctcggattgcgctttgctggagatcgatgccaaattcgagaaagaaaatgggaatggtttcttttatctccataatttgttcaacggaaattgggaaattgcgcgtcattttgatgcttaattaacccaattaagtaaaattaattaatgacatcatttaatctctctcatcattaattgacatacaatttgtctgtggtagaaaggttcaagaatgtttcaaagacaagcttctgttccttttcatcccgatggatgcaaatttgtacagaaaatccggcaacattcatttcattaagatggtcttg

SEQ ID NO: 91902 - DNA, 656 bp, Heterodera glycines
  SCN-specific regions: Sequence locations=1-48,70-635
tttggtacttcggaattcagaaagtgaccgtgaacacgggtggcggttcactgcttgagtcactcactgatcagccaagttgggccaccgataaagtcgatgtgactttcgacgacgtgcgcgggatggacgaagccaaggcggaggtggaagaaattgtcgattatttgagggacccgcgtcgttacacttcgcttggtgctcgcttgccaaaaggtgttctgttggttggccctccggggacgggcaaaacgcttttggcgcgcgctatcgcaggcgaagctgactgtccattcttccacgcggtcggctccgagtttgacgagattctcgttgggcagggcgccaagcgagttcgtgaactctttcgtttggccaaggagaatcagccttgcgttgtgtttatcgatgagattgactcggcgggctcgaaacgaacaaacagtgccattcatccgcatgccaaccaaaccatcaaccaacttttggccgaaatggacggctttgaacagaaccagggagtgatcgtgatcggtgccacaaaccgagttgataatctcgacaaagcactgcttcgaccgggcagattcgatgtgcaggtcactgtatcgagggcggacttgccgagccgaaaggacattttcagactgtatttg

SEQ ID NO: 91903 - DNA, 658 bp, Heterodera glycines
  SCN-specific regions: Sequence locations=1-342,373-462,502-630,652-658
cacggattagggaaaatgcccatccgaagggattttaattagggcggcaacttcataagggagtcgaataggtttggttcaaaggactcccttcctatcgggttgggcttttgcggtaaaaccaggtttggggttggggcggctacttcaaagactgtactccttcataggcacgggatgggcgagcgatacccgcaaccttttgacagtctgtgcaattttatatagggtatatatttcactgataattaggtatttcatttcacatcagcactaatttaatgaattcatcatgtcattttgctaacttcttccgccaaaatttgaagggcaggcaaaatcttaaaaatttataattttaattgttaattagttcgtccttaattacttgtttggccaatttgtttatgcccttttccgggtacacaaactactcccggtcgcggcatctgaagaaaaaacaaaataatatattcaattattaattaaattaattaattacgcacataaaatttcatcaccgtgtgctcatagtcgtcagggtttacagatggaatctcataaatatcaagttggtcgagaattgaatgtaatattgtcggttgcgagctaaaaaaaaatataattacttgattaaactaattaattaaacagaatc

SEQ ID NO: 91904 - DNA, 679 bp, Heterodera glycines
  SCN-specific regions: Sequence locations=1-463,485-679
ctcgtctcgccaccgatgccccaaatgtgcaggtggcaattgaccagcgacttgccgaagtgcttcagggcgtcgtgtcgttactcgccggaatttcggtggccttttactttggttggaatgtcgccccgattggactcggcacttccattattctcgtcatcctccaaagcttcgtctccaattacttaaagcgtcgtggcatgcgcgacttgcaagcggctgaagaagcctccaaaatggccaccgaatcgttggaatatgtgcggacagtgcaagcattgaatggacagggaaaagcgtaccggacattctccgaggcgatgcgaaagccccaccgaatggccatcacccgaggcctttggacttctctgtcgttcgccctcacttcctccttcgtcagcttcaacttcggcttcacctattgcctgggaatgcttctgatccgtgccggtcacaccaccccttttgtactgttccaagttgtcgaagctcttaacatggcctccttcatgataatggccgcggcagcgtatttccccgaatatttaagggcacgcttttctgcggggcttatgttcgcaatgatacggctaaagccgcgcattaacagtctctccgacaaaggaatcaaaacgcccatcgaaggccgtctcgaactcaaatccgtccaatttgc

SEQ ID NO: 91905 - DNA, 501 bp, Heterodera glycines
  SCN-specific regions: Sequence locations=1-84,106-501
gtttgccagagaacgaccggagaaggtgcgtgactgtttcagcgccgcccttcctttccgcgctcatctgtccgcgtcccatcgccacacattggctgagctgaacaaaattgcagcgcatctttcgtccgggtcgaatccattgcaaaaaaaaaagtcgcttcatctttctttccgaggaacgaaaagcactcatttctcaaatgaaagggaagcgcaaaagaaacagccaaaaacgcataaacgacgaccccaaacgacgaaagagcgggacgcactgacgaagatttgccatgctcaaaagttgacgcagcaattgcgacgtgtccaaagcgactgggaaagcgcgtcgatggttctgagaaggggcgacgcagtggtggtgaaggcactccggcaggacggtttcagtctctgtgacaacgccgtttcctccggactcgtccccgtcgctcttttgggtccatttgacgagaggttcaccgctccggtctctcccga

SEQ ID NO: 91906 - DNA, 633 bp, Heterodera glycines
  misc_feature (508)..(508): n is a, c, g, or t
  SCN-specific regions: Sequence locations=1-398,423-633
gctgattattttggtttgtaactttcttgaaatgttaaaattctcttgttttctcgtattattacattattcagactttgtgctttcgaatgatgccaaaaagatagggtttattcaaacatcaacaaagttattgtataaaaaccaggtattgtcaattgattggactcataaagtgcactagagccgtaaattttacccataataaattcatataagaatttttaggacctcactgacaatgaacactcaagaactattacgttgctaggaaacacgagtgttggcgaggtttaattacgctcttttttgatttttttttaaaatctttttaggcgcctgacaaagccctgcataaaacaggcaaaatgattgaggtataaaccaggcccgtgcccaggagagggagagggggacactgtaccattatttattgaaaatttgacccataatggcaaaacttgtcgcttttggtgcaaacccgctaaaaagtcctgccttttctcangcgttaaaaatttaacgggtgcccccttgaaaattttttttggatatatgaaaggggtctttttaggatttggcttctctgcagcacaatcggctcagcaaacctatccaaccgacactctctga

SEQ ID NO: 91907 - DNA, 701 bp, Heterodera glycines
  SCN-specific regions: Sequence locations=1-135,161-313,349-619,650-701
aaaaaacaaagttcaggaagaatttccgccgctttgaatggctcgtgttccaatcgccgattgtgcgcattctgctcgaaattctgaacatcaccgtgtttatggtgaataaacatcccaattaaaatcgaaatctaaataataaatataattaattaaacaaaattgacattttattaggagctgagcagtcgctccaatctgttcttccaactgtccaatttgataggcatcatctctctttttgtcggctcctacggctcctacataattgtgccaatcggcgcttcgctgctgcacgaatatcggcacgtttattttaaaaattaaatttttatatttttatatggaaaagcggcaaaatgtttccaaattaattctcaatcaaatccgattcaattatttccgataaaaaggtaattaattttcaatgcaataatccgacacgattagtccgttattccgtcgcattattatttgacttgcaaaaacccattcgcttatcccttggcattaattggataatccctcctcaaatcttccgaattagtaattaattacattttgaaaagcattgcttcttttggcttaaatttgtctttcgcttttcctccctccgaaaataattaaaatttattttttttaatttcagttttttgcttctgttccgtctcgtcgacttctgccaattgttctggtcc

SEQ ID NO: 91908 - DNA, 619 bp, Heterodera glycines
  SCN-specific regions: Sequence locations=1-20,42-212,234-242,264-470
ctccctctcaaaatgagttcttcgtccattttcctttcctttgcgtcttattctttgataattttggcattgtgccgagcccaaaatgaatcagctgcccaaggcgatgcgcagcccccgccattcttaacagaggccagccaagagaaaatcaacgaattctaccaatacgtcacgagcctggggcatttaaaagaaacggaaacagcggaaaaagtgaaggaatgggtggacaaacaatcggaggaaattcagaagaaatacgtcgagtttgagcaggaaagggaacgggcgaaggccgagggcgaagcggcgcacgaagaagcggtgagaaagttcagcgaagcggcgaaaaaggcggacaaggaactgaccgaaatcgcgaacaaccccaatttgtcggcaaatgataaggcggaaatgatcaacagaaaagtgcagtcactgcccaaaaaagtgagggacgaaataggaggagcaatgggcggaggcggaggaggtcaatagcagcggaagaagtgaagaggaaaggaaataataagaaggagagggaaaggagaggagcgaaaaaagagtgatgggacaaaaaggaggaggaacgagaagaaaaggaagagga

SEQ ID NO: 91909 - DNA, 593 bp, Heterodera glycines
  SCN-specific regions: Sequence locations=22-327,377-491
cccaattttggctttttggctaaaaaaaagtcctaaattaaaatgaaattgttaaaatcggaaaacgaatatttgaaattaaagaaatttcttataaattttagattattgtgaatgcgagtgccgatgaattttacaaacagccaatgttttatttcttggcacatttcaggttgacaaaaaaaaaaattttaattcactcgaaaatttatgttttagtaaatttgtgccgccaaattcggaggttatttcgtcaacactttttgacaaaaaaggcactgaattgccagataatccggtggaaaattcaatttcctacgcttttggtaataattaaattaataatatttaataatttcgattttatttttaatttggtttcgttttgttttagataatttcacgaaattgaacagcgaaatattatcggaaaagcaacaaattgaacacatcgcctttgtaacacctgaaggtggcgaaactcacttttgaaaattaatttataaaaaaaaaattagaaaattagaatttaaaattaagaaaatgttttattaccattatatattggttaatttataaattataatatttta

SEQ ID NO: 91910 - DNA, 569 bp, Heterodera glycines
  SCN-specific regions: Sequence locations=1-15,87-351,377-530,552-569
agaatgtagccagcagacggggacgaggaggaggaggaggacggacggggaaaaaaggggagaaatgagcgaggggaaagggagggaccgactgatcacaattaaggagggcttacaaaaaacaatcataatgcatacatacatagacatataatatttcctttttacaatacaacacattatgttaattgattcctttctagaagcagaagaagcagcggagggagacaagcagcggcaggtggtaaagcaaaaaaaaaaaaattgctttgctgtgttaatgggggtatttatttattatgattatgaatagtgtcttggaagagatttgaacagaagagaagcaaatacatattggaaaagggtaaattgttgttgtcgggcccaattatggtaatgccaaatacaattaaaatcttacaatagaatggatattgaaaagtacaaacatccggcaggggtacttttgttgcagtttaattggactcgatgataaaccatagggaggagaggaccattttgatttggaatttttcatcaaaattaaatcagggatttgtcggaatgcc

SEQ ID NO: 91911 - DNA, 623 bp, Heterodera glycines
  SCN-specific regions: Sequence locations=1-78,100-119,238-271,295 -339,361-368,390-623
caccaattcatgcaagagataaataaacaataataattgttttgaaatatgcagatgttataattctcttaagaaaacaaataatttaaagaatgaaaagtaaatattattacatactcaattatataatttaaatgcattatcaatttatagtttatttcaacttaatttcaaagttaaatttaatttttaaaatgcaaaaataacattataaaaacaaaataattaaaatttttactgaactattagtacaataattaggacatatttaaaaaatctttgattcggaaaaaactttttctgattgtcaatataatgacaaaagttttttgttgttaatttgagggttaatccttttgattaaaacaagaaaagaaatatggtaaaatttaagaatttaaaaacggcttgaatttattaaatccttattttgttaacttaagattaatatattttagtaacttttagctcgatttcgttactcatataggtatttttgcgttgcatcagtttccctccatgtagatgttttcttcgaattttcaaaattattccttatccgatgagaattcaatcaaaattttaacattattgttgctccccgaccccgagcccaccgaccg

SEQ ID NO: 91912 - DNA, 620 bp, Heterodera glycines
  SCN-specific regions: Sequence locations=1-230,254-345,367-620
atttccacctccgtccggttctcattgggtgatcaatgcaaaaatgaattcgcttttgctctcctatctgatcatttgctgggttcatcttggacgcctcgacctcgtcccccaacttattgactgcctcttggagagaccactcggctcttccgacgaagaaaatgcctttttggacattgctcggtcccttcattcaactcatcaacttgtattggccgttgaatatatgcagaaattgagaaaggaaaggcccgagttcaatgaaagcaccgatttttggtttctaatcggctgcttacatcaggctcttggtcaacttgggcttgcacgaacggcgtatgagactgccatctctttccaaccggggcacatcgacgcacggattaacctctcaacaattcttcagcaattggaccagtccgaacttgcactcgaaaccctcaaagacctcaactatgattcttgctcccacatccctgatgaacggcttctttgtcgtcaagcggaggtgcttttggagcaacggaaggccgaccagtacatcagctgcttgcgtctgttgttgatacctcatttttatcaaatctatcgttccgacgacgcatgttctgtttctc

SEQ ID NO: 91913 - DNA, 633 bp, Heterodera glycines
  SCN-specific regions: Sequence locations=1-24,46-372,396-633
gtaacatccagatatgttcaacggcaaaattgtgcaaaggctttggtgaagttccaaagccatttggagaccttcgatttgaaggtttaattggacaggactaaatcctgtcaaggcaattacctttctcccagtatttctgagttggtaatttttgatgtttaatggaagtctcctctctggactttccattaacttttcaaggttatgtgaacggcaattgcagttcactaaacctgatgaatggtcaggtatgcaatcagtgcatgcctgaactccaagactgcaattgaaatcaattgcttcttgccgatttttacagttgaagtcaattgccaatggctctcgggtcagagccatattgctcccgtcaaaaacaaaatctgagtttaagacgggagcgggcggaaaagttactccgatcggagtaatactgatgttgttccatttcagggttcttcctggataaaggaacacctgagtggacttgggtttttcgcccaaagtttccaggcgaattattgtataaacaataaattcccaggaattacagcccatgatttcatagactgtcttggacttttcctgagcataccaacgataaaaaaggcacgcactgccgcctaagaagca

SEQ ID NO: 91914 - DNA, 502 bp, Heterodera glycines
  SCN-specific regions: Sequence locations=1-502
aggaaaagacattgctagcaagacacttaatattccatccagaggtttttatttgtacgtcaagcccactgatcgtggacgtttcgtcaaattggctgaggatgctatcaatggtcgaaaaaatcgtttgttcctgtcaatgcaaatttgcaataatattaacgaattgttgcggaattttgaggggctcgtgccagtgtcagaggatatgaatggcacaccgtacaatgtgatcattcgatctgaatctatcgtgaccgatagacgtcaatattacatcgaccttcccgaaggtcggcgtggatcctttttgcggattactcttctcgagacgcattccgcgatcctgaactcggtggtattgcccttggaggggatcggccccttgcaccatgcactggactctattctggacgactatggacgaaggttccttgacgaggcaccctaccttcgccactctctgatgattcgcactgatgcgaaaagatttttttttgat

SEQ ID NO: 91915 - DNA, 535 bp, Heterodera glycines
  SCN-specific regions: Sequence locations=1-325,372-535
gttaccacaaattttgttcttttttagttgtgatggaaagtgctgacagcaaaggtggaaaagacgccgaccttcagaaggctttgtgcgtctcgacgatggctgtcgcaagtgccgttttcgagcacgcgcttccacctccacttttgccacttgcgtcaacagttgtctccaaccccaacacttcgatttattttctttcgagtggaggcaatgccgatgtccgtattcgctgcaattcagtcgccgaagattcagtgataagcgaaagtggaaatgaaacggatacgcaaatgggcaaaatgagagaggacgacaaaatgacggaaaaaatgggaggggaaagaaaaggaaagggagaaaagaaaaggcggaggaggcgacgacggaattctgccgggcaacgccaattggctattcatcagcagagtctgaattccctttttcggcacatccaagtgtttccactgaagcaatatcgcgagctaagaatggattatttgcgaattaagaaaatgaggatgggaacactgaa

SEQ ID NO: 91916 - DNA, 459 bp, Heterodera glycines
  SCN-specific regions: Sequence locations=1-82,118-168,198-295,320-429
ctggaacaaacagccggtgaaggtgctggtcggaaagaacttcgaacaggtcgcgcgggatgacaccaaaaatgtgctggtcgaattctacgcgccgtggtgcggtcactgcaaacaattggcacccatttgggacaaattgggcgagaagtacaaagaccacgagagcattgtcattgccaaaatggacgccacaggcaacgaagttgaggacgtgaaaattcagtcattcccaaccattaaatacttcccagcaaactccaaaaaggccatcgactacacaggtgaacgcactttggaaggcttcagcaaattcctcgagtcgggtggaaaggacggtgccggcccatcggaggaggagaaagcggccaaagaaggcgaggaggggggagacgaagagggacacaccgaactttgaggaaacggaagattgcggaagaagaggagggagaggagagg

SEQ ID NO: 91917 - DNA, 451 bp, Heterodera glycines
  SCN-specific regions: Sequence locations=1-147,169-361,383-451
gattaagtacatcaaggctgcgcaccccggcctggacgtcattgccggcaatgtggtgacgggcgcccaggcgcggcgcctgatcgaggcgggcgcggatggcctgcgtgtgggcatgggctccggctccatctgcaccacccacgaggtgtgcgccgtgggccgcgggcaggccaccgccgtctaccacgacgcgcgcgtcgccaacgagctgggcgtgcccatcattgatgacgggggttttcacaactcgggccacatcgccaaaggcctggtgctggacgtcaatgactgactgtgcggctccatgtttgccaccaccacagacgcgccggacaagcacttcatgatccccgaggaccttgtgatgaagaaccacggggaggggtctctgcaggccgtgtccaacggcttcgagacccactacgactttgacacgcaaagcctcaag

SEQ ID NO: 91918 - DNA, 502 bp, Heterodera glycines
  SCN-specific regions: Sequence locations=1-502
attttgaggaagagagcttcgaaaagttgggacaaatccgagatgcgctgaacagtgttaaagtaagggcgtggcgagggaccagtgccgtgttaattccgtctgcgctcggcacggcaccgaccgatggcactcgttcacttccttcacccatccgttgaagggccttcccgcgtgggtgtcctctcgaattattgattcatttgctactcaacaacagaaaaatgggtgtgaggcgttgtccagctcggcactgttgttgtacactcaggctttctgcaagtttgttcagctgatcgatgcccattccgaactgttggccccgttaaaacaatgccaaaacgggcggagtttgcctcgttctctgcacctttgtgaacttcccggcgcatttgttgctgcgctcaaacattcgcttcaccctgaacagagcaacgctttgcaatggttcatcaacggtttgaatccccattggcaatggactgctccgactttgcccagg

SEQ ID NO: 91919 - DNA, 588 bp, Heterodera glycines
  SCN-specific regions: Sequence locations=1-171,198-278,311-341,383 -481,503-588
gtccaattaagcccgcaaaaataatcgaatattttattcaaattcatcatggaggatgaatgtaacggtaatggtgcctcttcgtcttcatctcttttgggacggctccgtcgctttttgccccgaattgcagccgcaaatgcagctttgtcagacacgatgggtgccggcggtggtgatggtgctgctgttactgtactggacgacgatgaggaagacaactatagaaacggcggtgcccatggaactgacggcggccacgacgacggcaagcagtacaaacaaaaacagcagcagcagcaggaagaagcgccggcagtgactgtgcatgtgatcgactcggacgacgacgaagacgaggaggaggaagaagaggaagtgattagcgaggatgacgacgacggtgccgagatggtcgttgagaatgggccactaggaggagaaggcggcattggtggaggagttggtcgtcgggagattaagcccaagcagttcatccaatttgacaccattctctacaaaattgacgacgacgaaaagagtgaccatgacaacgtcggcgtcaagacggagggcaacaacaacaaa

SEQ ID NO: 91920 - DNA, 235 bp, Heterodera glycines
  SCN-specific regions: Sequence locations=1-52,75-154,176-235
aaagaatttctacgaagttcatgaaaatgttgtcaaaagagagcaattggaaattgacgaatggctggcaaagaacagcagcaccattagaggaaaagatgcgccttcgtccagtcttggggttgatgagacgggatttccaaacaaaataatcgaacatttgggcaacatttttgacaaaccgaccgcaatttccaacattgcttggcccatttgctttaatgggccggaaatt

SEQ ID NO: 91921 - DNA, 641 bp, Heterodera glycines
  SCN-specific regions: Sequence locations=1-267,289-464,486-641
attgtatttacattttatgtgctattccattctctgatatggattatgtccgtacactgacaagtatggtcgatgtttgtctaacgctggaaccaggcttttccactcttgaagatttggcatttctcgacttggccggcggcgccgtccatctgctgggcaccgcttattcgtcaaaagatattgaagcgatcaaggagttttcgaggtccctcatatggtttacatatcgcaaaaattggccggcacccatcggaggcttcgacgggccaacctctgacagaggctggggctgcatgatccgagttggtcaaatggtgttggcgcaggcactcatcaaattccatttgggctcggattggcgatgggccaacgaaatggtggaccaacgggcggacaatgaacagtttcaagcctatctgcgcctgttgaggatgtttcaggacaaacgaactgcacaattctccatccaccaaattgcacaatttggcgcttcggaaggcaaaccaattggcgaatggttgggcccaaattcaatggcacaagtgctgaaaaagattgtcgtctacgatgaatggtccaatttggttgtgcatgttgccatggacaatgtcctaatttcggaccacgttcacacaatg

SEQ ID NO: 91922 - DNA, 681 bp, Heterodera glycines
  SCN-specific regions: Sequence locations=74-299,322-406,428-510,533 -659
agcagcagcagcagcggtggaaaatcagcagcaaatgcttcagcaacagcagcagcaattgcaccaccaacagtcccagggcaatctgatgagcggcggtgtactccttccgccaggtgcccatccgccccatttctcttccggcgcattccctcccctttcttcggcgggtcagcagctttcatttcccatggaatcagcaacacatcaacaacaacaagtactgcccctccaccattcacaacaacaacaacagcagccggcggcattgatcggaatgtttcagaggcaaagtcgcgaggacgaggggcagcaacagcagcaccaatcacgacaaaaccaagctgggcaaatgcagcaacagatcaaccaacagcaagtggaacaaatgggcaccgctggaagcaacacaaccgcaaaccaacagcaacagcagtccacgcctgcccccttgtccgtgtcgtctgtctcttctgctgccctctctccccatttgatggttccgttttcctgcccgtccacttcttccccaattgatccttccactccactgcaattcatttcccatcatccacaacaccaaggcgttccgccgccgcctccctacaaatgcatccgatggccatgtcggaaggacccgttgggcccatcccttctcatgctgcttttcctgcctcttct

SEQ ID NO: 91923 - DNA, 647 bp, Heterodera glycines
  SCN-specific regions: Sequence locations=1-82,112-138,160-190,212 -368,396-492,519-530,552-647
gcttgtttaagacgtgccctgtgaagtgcaagcggtacttccatcagacgtgcagtacggtgtgtttgtgccagaagccgcccaagaagaagaagaactgagaagactgcagtaagaataccggctccgactaatgtatttttgggtggccccctatagccaagtgacagactgcaggccgacccctcccttcacccctttctttccttcatcatttcccgtttgccctaattttctcatcatttcatccatcaatcactcctcgttcgctacttcgttcaatcctccccgtcttccccatttgtccgctcgacggacattcgcggctaacgttcagtcgcgacaagagaattattcataacttgaccttaaatgaaccaaattttcaaattttgatatctttcgtagcactaaatttttctattattctgcaaaatttcaaaaattcgttaagtttcaaaaagtcataatctaagaaactgaaaaatttgaccaaaatgaatcaaattttataatatgtatcattcgataacctaaatatttaattttttcgtaagattttgattattttaataacgaagccagagatttcgcggctgcttctcatagagcaattacggaagcaggaaaaattaagtctcgtcatc

SEQ ID NO: 91924 - DNA, 674 bp, Heterodera glycines
  SCN-specific regions: Sequence locations=1-491,513-605,627-674
acattagtcgacgcactcgccaccaatttaaagaaggtttcatccagccttgttgcgcgacagatgctggccaaacggaagcaacacgtcggcgaaagcttagacgaatttgcccaagagatcaggactctagtatcaaaagcgtacccggatacgtcgcttgaaatgaatttcgatgcgttagtacttggagacatggaggaagacgcgaaaagggaacatgacgagcgactaaaaagattcagatcgggaattgccaaggattttttccgctcgaacatgacggcatcaatcaaagaaaaaattctcttcatggatgaacctcagtcatttgaagaagcgatcacacaggccaaaagggttcaacaaatgcagggagcgttggcagaagatctctggaaacaaacacaaggaaccaaagccgaagttgccttggccgaaattaatgccgtccggactgaattgaacgaaatgcgagaagaacaaaaaaagcaagaggatcagagggtcaattttgtccaacgtactgacgagatggcaccacaacgctacggccaacaaacgcaaaacgcttatatccagagggggaacagcaacaggggatttagagggagaactcggggattccagagttaccgtggaagttttaatccaccaaattcaaatcagacacc

SEQ ID NO: 91925 - DNA, 409 bp, Heterodera glycines
  SCN-specific regions: Sequence locations=1-409
gaaaagtgccgaaacaatggtactacggctcacaatggttcgccccgccggccgaaacgacggactcttaccggcaaattacccaattgatggagtcctgcaatggcccatatgttaaaatggtcgcaaaatttgggcatttttttagacggttttaatcctaggccagtttgccggacgatgcgcggatgatccgtgggctttgtgcgcctcctgcaacctccgcgtttgcgcttcacagggaggaagagcacgttcatcatttgaactacaacttggggccgggtttaaaggttttggctgcctaaaatggagaaaaaaatccaattttgttcagttgtggctgtttgttgatggccaatgggagaagaaggccatggagctggggaaggcattgtttggcgaccgt

SEQ ID NO: 91926 - DNA, 684 bp, Heterodera glycines
  SCN-specific regions: Sequence locations=1-227,249-684
gtataatttgacaaagtactcgcctaccatctggacgatatgcaatttgcatttggtaacgactgattcacttttgcgacttattcgataatcattttgtgcactctgtacccatgaatttggagatcgtgcgcacaaatggcctcatgggcttggacaggtggcgcccagatttggcactccatcgctttcatttgggtgtcttctgtcgtggagacgctcatttcgttgccattctcatattaccacacatttttcattgaacaaaagcacggatttaacaacgaaacagtgccatttttcttcaaagaccgtgccatgaaattgggtgtcagtcttgcgctcagctcaccggttgtggccctgttggtgtggatcattcgaaatgggggcccgaacttcccgatttatgcatggcttgccctttcgctcatcatttttgtgatgatgtttgtttaccctgaattcattgcgccccttttcgacaaatattcgcctctgccggacagcgaattgaagcgcaaaattgaggcgttggccgaacgtgtgggctttccgttggccaaactttacgttgtcgaagattccaagcgttcctcgcaccagaatgcgtatatgtatggcttttggaaacaacaacgcatccgttcttttcacccttttatgagtaaggcaatgaacgaa

SEQ ID NO: 91927 - DNA, 521 bp, Heterodera glycines
  SCN-specific regions: Sequence locations=1-233,258-521
tggtttgagccgcgcgtgttgcgttccgcccgtccctttgtgcccagcggcggcgaacggcgggacgaagtcggaaaaacgggcgatgaccaggcagtggttcagatgatgtgcgatttggtgttgggcgagattcaggcggagatcagccgagtggagaaggaaatggaacgactggcgactgctcaaagaatggcacataaaagttcgctttgcggaaagtcgggacgaagttttggactcatttcgggcattggtcgacgaaatggcgagggaacgaatgcgaagaaaatgcgtagtgcaaagtgtggacgaacagcaacaactcggggagaacaacgcagcgaaggacacgccggcgagagaggccaaacagccgaagcagcgtccgaacacggcacgcactccgacggtactttcggcattcgctctgtacctccccgacggaggggacgtctgacggacaaagagggaattgcgcgcagactgacggcgatgagacgggcggtggaaggggcgca

SEQ ID NO: 91928 - DNA, 615 bp, Heterodera glycines
  SCN-specific regions: Sequence locations=1-103,125-615
tggagagtcatttccagccgcttcaaatgttccgcggcgttgggggctgacaccacaatatcgtccaagcagacggcgactccgtccattccacgaaggacgtcttccatcacttgttggaaaattgctggcgctgacgcaacaccataaggcatacgcgtaaattggtataagcctttatgcgggcaaatggtcaagcattccttggctttatcatccaacattagatgaagataagcctccttcaaatccaactttgaaaacttttcgcctccgatcaacacgctgaacaattcttctgggcgcggcaacgggtattgatgaatgtcgagccattgattaaccgtgactttgtagtcgcaacataagcgaattttgtttccggctttgggtacaatcaccaacggtgttgcccactcagacgttgtcacctgctctaacactccatctttgacccagttgtcgatgaccttctccacttcgggtctcaatgcaaaaggcacgggggcgtggcttgcacttcttcgattgcacttccggcttaaatttcaacgaaatttgccttgtgcatcggccgagtccgtcattgaagacctcaccggactttagaagcac

SEQ ID NO: 91929 - DNA, 679 bp, Heterodera glycines
  SCN-specific regions: Sequence locations=1-679
cctacattctattggtgccgctcaaagagcacgggatggacgaacaaatttggaagaagttggcatcgaatgtcgtcgaggcattgaacgcgtcacggcaaaatccgttccaagtggaccaagcattcaaaattgacgacctcttcaacaaaaacattccaatggggggacaggcgcagcaacatttggcgattattgaccagtcgtgcaattttcaacaatgggtccgcgttttgtacttcttcatttgtgacaagattggcgacccacttttgcgcactttgttcgcctctttgtgctgtgtgaagcacgacgcttcaattctgggcagaacaatgtgcaaaaacatcccccacatgatcatccaggctttggtcgaacaaaacgacgcaattcttgacaaatttgagcaggaggcacttgcggtgttttgcgcggtggttggaggccaaatttgttgggccaacgacgcgatggtcgctatttgtgccatagtggacgcaatggaacgcttctttgttggccgcactgctgctgcaattgttggcacgaggccaaaggacaaagatgtcctttccgaacggtttgatgcgttgatcagcaaaatccttgcccaacccaacccggacagtctgacggtggtgccgttgagtgtgttggccgcccaaaagtgcaacta

SEQ ID NO: 91930 - DNA, 641 bp, Heterodera glycines
  SCN-specific regions: Sequence locations=1-641
tttcagaccagtaaatcaaacttggacgacgatttaattcagttgaaatgcaactgaatacaagcaattatcattttttcaatggccagccaagcccagcgggggccacccaaagcaacaacaaaaatttctttagtggacaaccaaattacagcaacaataacagtaattggaacagtccaaaagcaaacggcactcagccaaaggcggcttcgtcatcatttgccacccaatcggcgatcaaaaaggacaattatcaggcccacgagttggtgctgaaccgtcccaaggccgaggtggacaaatggatggcggacaacgaagtgaaactgagtggccatagtttgacaggaccagtgaccagtttccaggagtcgacattcccagcaccaattgttgcccaactgtccagcgtgttctccgcgcccactgccatccaggcaatttcgtggcccgtcgcgctggccggaaaggacttgatctccatcgcaaaaacgggcagtggcaaaacgctgggcttcactttgccagccattgtccacgtgctgaacaaccaacgaccgcagcagcagcgtcgtcctggcgaaagtccggctgttgttgtgctgttgccaacccgtgagctgggccaacaggtggag

SEQ ID NO: 91931 - DNA, 511 bp, Heterodera glycines
  SCN-specific regions: Sequence locations=1-8,36-511
gagggacatggtggtggtggtggtggtggtggtggacgtgggggcatattgaccaaacgcaaaggcagtaatgccgctgctgttgctattactgctacaagaagatcaaggggaaggaaaattcgcggaagcggcggcgcctcttccgcgctgctgctgcacacatttaaaaaggcggcgtttggaaagaagcggatcggtagtgctcttttgttcaagccccaactttggtgacacacaacacttactcgcacaatgagaaaactacgcgtgaaaagcacaaacaaagtcaacagcaacaacaagaatgcagcactgcaggcccaaaaacgtgagctgttggttgaaaaggtgttggatgagctgtacaaggacatgcggtccaatgccgcgttcaccagtgtggagccgctgctgcttgaggcacgtccacaacaccccgggcgacacatcagacgggccgaggtgcgccgttatttggctcgccagcgcgtgtacaccctgcaccgtc

SEQ ID NO: 91932 - DNA, 526 bp, Heterodera glycines
  SCN-specific regions: Sequence locations=1-303,325-404,436-526
cgcaattccagtaaaagatgagaaaggcagaattgtgatgaaaaaggtcaaagtgcagcgctacatggccggcaaaatcccagaatttgctcaagacttcgattctgatgaggacgcacaacaagcggaagaagaagtggagacggacctcagacagtttttagaagagaaaagagaacgcgaacgacgtgagaaggacgaacacagacacaacagaaaggatgggaaaaggcatcgcgaaagacgtgaccagcagctggacgagttcaaaaaggagctgaaggaggaagaggcattggcacttggggaggtggaggaggaagacgaacaaacgcgggaggagcggcaccaacgggcgatgttaaggcacagacggacggagcgggaggaagcgccgttggaacaggaggacttggaggaggaggctgacgaggatgaacggcagcggaggagggaattgctgaagcgaattccccaaagacaagaggaagaggaactgctcgccaaacagcccgacgctggcgaa

SEQ ID NO: 91933 - DNA, 611 bp, Heterodera glycines
  SCN-specific regions: Sequence locations=1-156,189-385,415-551,581-611
aaattattattcacctttgtcgcccttcttaacactgtatcgtggctatttatcctaataactcacttcaatctgaacttacgataatgtaattgattctatttgaaagagcatgaaattctacacctgaataactgctcagaattttaaaatctctttaattagaattttaaaaaattattattaaactttgtcgcccttttttggtcaataaagctgaattagttgaaaactgttcctcagcctctcatcatatcaatatactttattacaaggacaatttgaacgtgtacttgaagcaattttataatccccggccccatttataagaccgatttttaaatagatttctgcacctgaataactgatagaattttaatttctctttaataaaaattaaaaaaaattattattcacctttgtcgcccttcttaacactgtatcgtggctatttatcctaataactcacttcaatctgaacttacgataatgtaattgattctatctgaaagagcatgaaattgaataactgctcagaattttaaaatctctttaattaacattttaaaaaattattattcttctttgtcgcccttttttacactgtatcg

SEQ ID NO: 91934 - DNA, 669 bp, Heterodera glycines
  SCN-specific regions: Sequence locations=1-64,89-145,167-306,347 -436,469-555,577-669
agcaaaataagcaggttaattgaatttactatgatttaaattaggtgattgcaattacagacaattaaaactatttttatattttaaatccttaatttggtgcccaaacttcctcctcacattcatttataattttgcttacaataattcattaaataaatgtttagataatttatagttctttctgtacttattacatatgcttcttcattctttcacaaattctttctttctttatccactaatttccgtccattctcttttcacatggcgaagcagaagttgaagagaaaggctaaaacaatgtaatataaaaaaaatttaaaaaaaacatattttattaattgtttttccaatgaaaaatattatgtaaaatcgtttgtcattttaaaaagcaaaaaataaaacaataatccatttaaaatgtaaaaaactgatttaaaatcaattatatttttaaaattttatggatgtaatttcgacggtcctaaaatttaagtctggagtcggaattgctctcggaaagtgcaaataaagggaaaacattgaaagtagttttaatttttaatttaaaatgttgtcttttaccatgcaaaatgccaacagccaaaatcagggcaaaggtgccaaagtgattgccaaccgtccacccaaccatcgcaccgttgc

SEQ ID NO: 91935 - DNA, 667 bp, Heterodera glycines
  SCN-specific regions: Sequence locations=1-30,52-549,571-667
gttgtataaaaatcagatattgctgctaactcatatgtatatattttatgaatattcctttttattgcatatgccatcgcatgttatgtaatgcctatttttatgaaaatgagcccttaattttacataaatagcgcctgattatggcctttttatgaaaatgccatcttaaattaaggctgaatgtgggcttactctaggttttcgcttgttgtgttgagacctcgatttgtgggggtgaggggatctttgaccttttcatggcgcaaaaaggcactgaatggcatattatgcataaaagtgcaatgcacaaatataagatatgagatgaaaaaagatgaataaaagtgcataggcataaggattgataaatatacacttatgggttggcatatgcataagagtgcaccttcataaatatatacataggagaggcacatgcgtaaaacgtgcatattcacaaaatctatacatatgaaatggcatatgctgcataaaaatgtatattcataaatatacacttatgggatggtatatgcataagagtgcatcttcataaatatatacagaggagaggcacatgcgtaaaacgtgcatattcacaaaatctatacatatgaaatggcatatgctgcataaaaatgcatattcataaatataaataata

SEQ ID NO: 91936 - DNA, 680 bp, Heterodera glycines
  SCN-specific regions: Sequence locations=1-27,54-141,168-680
attcgctgttccctttggccaaaagtgtctttttcttttgctccttttcctccaattcggcaatttgaatttgcttcaggtgacgggcaagttcttgaaaatacagcaattcatttttaaaaaagcggctcaattaaacaaactttcaaatttttaaaattcaaaatccccctctttttttcaccggtgtatcgcagcaacaaatcggcgttgatctgattgaactgggcgttgtccgatgggttcatgtattccgacattttggtcttcagatagtcgagcgcgaacgaattgggcaacaaatcgctgatggcaatggcatggaaataatgctgaaaattcaaaaaaatgttggaaatagcggcaaaaaggggcggggtgggtaattagtgtaattagctaattagactcaattttgttattagctaattagactcatttggtatgtctttaccgaaagatggtttatcgagcggaggaggaacagccgtgtgacggggtccggcaaatgctgcaagtgcttcttcagcaaaccgacccgattttggtattgcgcttggtcgtccaagttggggaatgcaatgtcatcctgttcagaaataaaatgttttgagtaaatgaaacccttcccaaagggaaattgaaaagcctttaatttactatcgccactaattacccta

SEQ ID NO: 91937 - DNA, 537 bp, Heterodera glycines
  SCN-specific regions: Sequence locations=1-537
cactgcttttgcatacattcattctcgcgcattacaaaatgtcgattatatcaaataaaccgatgaatatctcgtttagtaattcctgtagtccggattgcccgggcctcacgtggtgctcctgacatccctaacagtgagaacatagacagagatgcggttgctggtttagtaaaaagttgtacaaagatttcgcgtccatttttaaagttcactcactcccttcccccaaattctggtgcatgtgttgctgagggttggtgttgtcatctggcggagaagaacacgttggcactgtttattccatccaaacttttctcatctactttatcgcgcgagaattttgtcgatctgttggagtactgtgaggagcacttgaaggtccgtcgcattttggcttgcttcaacaagtcggacatcaatccatgccagggcattccacgcgccctccgttgcattggcttcaccctcctcccgcccgaacgttaccccgctggcattgacaagaacaccatttttgcgatgggttacaaaatc

SEQ ID NO: 91938 - DNA, 575 bp, Heterodera glycines
  SCN-specific regions: Sequence locations=1-575
agcaggaattcgcggcggaaaaatacggttacactgcagtgaaacaccaacgcgaggtcggcaccggctatttcgattacgtcggcctcgccgcggccggcggtgtgtcgtctaccacggcactgaaggacagcacggaggaggcgcaattctacacggcaaccgcgtcggcagatgaggacgaaattgtgaagatcacggcacaggaaatgccaggcgacgaacgaattttgacgcccgcggcacttcgctttctgcgggaattgcacaacaaattcgagcagcgtcgccagtcgttgttggcacagcgcaaaattctgcagcacaaattggacgagggcgactacttccccgacttcgacccgaacaccgaagaactgcgggctgaccgcagctggaccagccaggccgaaattccggtcgacctgcaggaccgacgggtggaaatcaccgggccaaccgaccgcaaaatggtgatcaacgcgatgaacagcggcgccagggtgttcatggccgactttgaggacgcaaattctccaacttggcgcaatcagattgaggggccaatcaaattg

SEQ ID NO: 91939 - DNA, 458 bp, Heterodera glycines
  SCN-specific regions: Sequence locations=1-3,198-367,438-458
cattttctttttccttttcctccattttttcttccattgcctctttttcttcctctttttttgttctttctttttcgctttttcctttttcttcaattttactttctgttgtctcctgagtttgttcactttcattttcttcgttcatccctaatttttgtccatttttcttccttcgatttttcttccgctttttcttttgctgatcttcaattttttgatccgaaagaaatgccatttgtttatcagtgccctcaaattctttttcatcaaatggaatgccaatatgttggaaaatttctttgatctgttccttgttcattaattccttcaaatttcgtcgataatctttgctctgttttaacacttaaaaatttaaaaaaattttccgttacttgccaaaactttataattttaatttactttttattatatttccaatttttctctgaaccagc

SEQ ID NO: 91940 - DNA, 644 bp, Heterodera glycines
  SCN-specific regions: Sequence locations=1-464,500-573,623-644
attttcctgagttattactggtcatacttatccatttttctgagcagattcaattccaattactgagctattactgatcatatttatcctaacttttttctgatcacttttgattccacccgtttcgcccaactcacttgtcctgcccaaattggacacaatgcgcgcgaatgtcgtcttggcatgcttgcgtgaagcggtagctgaagtggtagtcccgaagcgagatcagctcaaagtgattgacgtaggagcggcatttggtgctcatttcgtccgcctccttatgggctgccaaacactcctttaaaatatacggtatgccaacaaatgtgtgatgcaggatactgtaaaggcgttcccttgccaatgtaggttaccataatttgtttaaaggaacggttttgttgggtttttgaacaaaacaaaaaaacaatgaactgacgaaatacggataaatgttcaaatataagtataataattaaattaatttttatttctctcttccacccactttttagaagtgattttaaaaaaagcaaaaacctattaattcaaaatttatgataggcctttttttaaaaaacaaattaaaatttcatttttattttatagttaattagaacgggtcacgccgttttcgc

SEQ ID NO: 91941 - DNA, 575 bp, Heterodera glycines
  SCN-specific regions: Sequence locations=1-38,60-392,414-492,514-575
cgacaaattggcactaacgaagcatttgacaggccagcggatgcggcactgcttttcgaggacattgacgacaaggacgtgacgtatgcgccggagattcagtcgttggaagttccgccggaccaactcagccaggcggactcgctgaatttggtggacgaggaacaattctcggaggagcatcaacgggtcattgtcactgatggtgaagacgaagtgccaccgaaggaagccgagaagcaaagagaacggcatgaaccagaaaagttagaggagcaagaagccggagaagcaccgcagcgagagttgacgccgcatgaggaggaaaatctgcagcggatcatcgacagattgcgcagaacgccgtcgccacggcctcatcggatggaccaagcgcaggtgccacaggcgccgcaatttttgcgcagttacttcaacgacgagtccacctcatcactgtcatcgacgtttcagtccatccggcaaagttcgcttctcagtgccctgggcgtgaccagcacccaggagatgttgcttcggctgaccagcctgggggcgttgtcagacgcaatgcg

SEQ ID NO: 91942 - DNA, 534 bp, Heterodera glycines
  SCN-specific regions: Sequence locations=1-473,495-534
tgaaaaaagggaaagtgtttaattagggtaattagtgacaaaatgggtggcagtgattagctgataggatttaagataatattttgatcatattgtttgaattggaacattattatcacactgattgaccagccgggcagattaatttgacagtgcaaaaattagtagaagtcgggaccggaattggaaatcaggccaggatagggttactagatttaaatccattttgtcgggatcctgatcaaacatttttcagaataaatcgggacaaggatcccgggaaaatcccgaagggctccccgatcccgttcggtctccaaatatcagtaacctatgacaatcctcataaaaacttgatcaaccacccattagcagagctaataggcgtgaagccccggggccacctgttgctgttggtggatgagtgacgcggcagcagctgcaacattagcaaattgctgttgattctgttggttgtgatggttttgttgctgttgcgggtggttgtgcatgcccagcggagacgacatcaaa

SEQ ID NO: 91943 - DNA, 630 bp, Heterodera glycines
  SCN-specific regions: Sequence locations=1-265,287-630
cgcttttccagttcttttgttatgtgataaataggtttgagttggtcaacaagtgtacgaatcaattcccaatcagtttcttaaaaaaatgtgtgaaaaaataaaatgacaaacaacctgaaaacggctcaatattaatattagaatttccaataaacagtccaatagccgtcttgttttcataaaatctctcacacatttgataaacagagttccatctttaaaatgaatttaagaatttttatcaaagacatttaactgacctcacttcagttgatttaattaaaacatgatttggtaaatccatttcctgttgcagtttttgaaaatattctctttgaactgatgatttccttattttcctaatgacttttttgattttttcagaaagcggtaaaaaatccgagtaaattttaataccatcaccgattgacttaatttttcatttttaactagaagaaaacacagacttacaagttgcattttatgtaaaaaacaatcctgggaatcacatccaaggatgtttgtgccaagcttcatcgccgactgagcatcacgtaaaacaagatgtatttttgaaatgtcaatgccaaatttgtccaaagattcttgcaatttttcacaaatttt

SEQ ID NO: 91944 - DNA, 646 bp, Heterodera glycines
  SCN-specific regions: Sequence locations=1-646
ataacatccccatttttcagacttgttcttcattttctttgtttttcatttatttttcatttgtttttcattgtccctcccccatttgtcccgtctgaccccaatgccttcgggctccctttctcccctttccctccccatcattccccagccccaccccctatcccgactctcgacacgacccgtatcccaaacagctctctttagagctcaccccgcccccctctctctctctctctcgccttcttcgtcttgccgtttgacggttggcaagccatcgaagaaaggtcagcagcatttcttgtgtaaataatctcaaatattccttttttacagccaaatttgtcccggcccctgccacggcaaccggcttcgtcgggcccgcacggcgcttggcccgcgcacgttcgccaactccaactggcgttcgtgtcgctgcgtctccggtccgctcgtaccggccgaaggacatcctcgccccgccgaatctccccaaggatatcgacttggggattttcaaaaagccgattgccgtatgtttgtagtcaataattaaacaacattttcttaaattattctcaaatttagggccgggactggagcgaggactgtgccacttgtgcggcattcatgggcgccatgtcag

SEQ ID NO: 91945 - DNA, 639 bp, Heterodera glycines
  SCN-specific regions: Sequence locations=1-418,441-639
attttttcaatgcttaagccacggccactgtttcgtcaatttgtccaatccaggttttcgtccccaaattcgtcggttgaaccccacaaaaaaataacaactgtgccaatctctgcaaaaaacagtgccaccattctccacgagtttgtcaactctctaaaaaccgtcaatttgccgccctcggcggtgccaaacgcgagcattttggacaaaattgtgccaaagccgggccaacgcatgcgcattactgatcgcattcggacatttgagcaaattgtgaccgaaattgactttctttacactgtgtccacggaagtgccatcggcactctctgatgagcattgggtccaattgttggacacggtcagcgctgctgaacgtgaacatttgctgcgcaccattcactacgcccagctggtggagaaggcggcggccgcggaacgccaaacactgaaaaatggcacaaaaacgttggacgccattgctggagttaatgatgatgatgatgatggttgtgttgctcattcttcctcctccgccacaacagcaacaaactctccaaattatcagcagatgtttggcgacgaattctgtgaccaaagcgcactgaaaagccgaatggacacacatttcgggttg

SEQ ID NO: 91946 - DNA, 641 bp, Heterodera glycines
  SCN-specific regions: Sequence locations=1-91,120-127,150-160,182 -199,221-290,312-396,423-641
gattaaaaaaacctaatttcgaaattttgacttttcgactttttgttcgattcgggtccgaggttcgaaattgagaacgattttcttatagaaatttatttctatattaaaatattaatgccatagaactttattttaaaatatttgtatcactgacgtattttccactgaccgattttccggtcacgaacagtcttggtatcatatgaaaaatgttaaaaagtcatgtttttttacaactttttgcaggctagaaaatcttttcgcctgcgccaaaacgacctggtccctattttattatatatttttttggaaaaccctaattattctagaaaatttcttctatgtttgatttttcggtggaaaacaactgctctcagtaaattacaactgcttcaaatttaaaaaatttgaaaaataatagcgcagcaataaaacttttttgatgaaaattgagactttaacttgtgaaaatgtggaaaaattaaataaaaattcatccctcactctgctatttttttggaccgggattcccgactcatgttcctggaaatactccccctgtggttattaaatattatattttcaatacagcaaatgcgacgcaaaggaatgattcggaagcgaatgatcggcgacga

SEQ ID NO: 91947 - DNA, 631 bp, Heterodera glycines
  SCN-specific regions: Sequence locations=1-436,458-473,496-631
aataagcaatttgatatctcagaaaaaagttatgagagtttcaaatttttatcaggttgtaactcaactccaaaactgctgttttctaccaaaatgcgaaaaactaatcattttttattgattctaaatgtccaaagagattttgtgtccttataaccaaaactattcgaatttgcaagttccatctttttcatgtgttagagacacgaaaatagtacgccaaaacgagagggagttgacccatagtgcgggcattgcgctgtgtcaatgtgtatataagcaagcgctgtaagcaaaagaaatcacttggcttcactttcttttttcctctttttttcttttttttaactgttctttgtctaaactcgcgttttataaagtcctgttttagcgtattcagaagtgccgcaaagaagtctttacgagcccaatttgccgaatcagaagtttggaaatggaattgagagaaacgaaacaaatggacgtggtgacaaacttggaaaatgtgagtttaaaaattagacagagacagttaaaaacaacaaagttcaaattttcagaaggctcttcaggcggagttgaagcatcagaaactgttgaccgaacacaacgcactgatggtgaaagtggc

SEQ ID NO: 91948 - DNA, 529 bp, Heterodera glycines
  SCN-specific regions: Sequence locations=1-162,184-220,263-443,465-529
agaagaaaaagagcaatttaccagtgcccgaagaactgtagaaggtgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatgtgtcaagaattagcagaagaggccaaacaatcaatcgaaatagccaaaaattatcggcaagaaattgggcatatttatcggaccgcttactcgcagcccgatttaggcattggagacttggcaaataaactaaaagaaacaatgcgcaaaaaccaaatacggtttgaaaggcaaagacctcaggaagaatttagggatgaatttattgcttataaaatttaagaaaac

SEQ ID NO: 91949 - DNA, 649 bp, Heterodera glycines
  SCN-specific regions: Sequence locations=1-101,177-649
gatatttgttcactgataatgcgagaacgaatgtgtgggaaatgtgcggccatatcgctaagcaaagtggtaaaactgaatgcgaactgctcatggatggttatttctaaaagaaaacaaggaaaaaaaaaattaaaatatacttttagaaaaaataaataaaatatacttttaaaggaatgcatttaaatcaaaaaacacactgttcgatttgtcaatcgctccatcatcgtactaacgcaaatttgtcaacgacctaaacgatattcagaagcaattcatggaagcacaaatgaccttaatgcatcggcaaggaaattgccaaacgtttcggcatacttaacaaggataattaacaagaagtcggccattgtcctaccttcccatgtgagtacagcacataaatgccagtgcaaagcaaagctgaacgaacgttgtgattgaaaggatggccgctgattcctgcagtcaatcccccgaggagctcattttgaagacgcgaaagcgaaagatcattttgattagcaaggcacagagcaacacaataacgattcgagaaggcaaagtcattacacattggagccatcaaaaataaatgattaattaaggaaaagcaagcaaataatatataatttggaaaaaaaaccca

SEQ ID NO: 91950 - DNA, 390 bp, Heterodera glycines
  misc_feature (377)..(377): n is a, c, g, or t
  SCN-specific regions: Sequence locations=1-390
gcttaaaagcattgtacagcatacttaaaagctaatataattttcgtatatttttcacaatttatttcaaaaagccaaaaaaaatgattcaattttgaaacgaaatagtgcacaaaagggagggatggttagacgaaaagaggaattttcagaaaagagcgcaccccatctgatattcccatttttccgttccacaactggccaaaggcgactatgctcattgacacgtagttgttcaataaggtacttggactttccacagtaaaatgtggtacaaaattttggaactgtcccgcctcacggcggggcttaaaagcattgtacagcataattaaaaccgaaaataattttcgtatatttttcacaatttatttcanaaaaaaaaaaaaa

SEQ ID NO: 91951 - DNA, 642 bp, Heterodera glycines
  SCN-specific regions: Sequence locations=1-173,226-361,413-642
atgacctttataatgcctatttttgcttctttcggggatttttatgcttaatgattaggcgcctattttgtgccaatttcgtcatttttggaacctattttcaggattttcggaagattttttttcttggtaaaaatttttggttaatcaattatctcaattatccttatacgaaaaaaaaaactttaaaatatttaatatttcatttacaattaaaatatataaccaacattattttttgattgagttttttgtgttttgctaccaaaaaagtgttaataaaaaatttaatttgcctatttttgcgcctatttaatgcatattttgcgattttttctgcctttttatgtgcctattttgcaaaaaatattttttttattgaatatttattaaaaaaaatcttttatttttacattttcccacagtttgtcaccatctttcaattggtcagctccgcgtgcattttacacagtttgaagccgtcaaatcggcgtcatggccattacacttattatttggagtttgcaaatgggacgcgaatccggcaaatggcggacgtcatttatgacgaacgacaaggtggcaaatttgtaatatgcatgagtttgggacagtatacatttgtatggcgatcagggctgc

SEQ ID NO: 91952 - DNA, 642 bp, Heterodera glycines
  SCN-specific regions: Sequence locations=1-11,65-428,450-577,599-642
cacaaaatttgccacaaaaatcacagttttcacaaaatttgctacaaaaattacattttcaattgccttttaattggaaagaatcggagggcactcgtcaattaacacttttaaatttccatgtactttttcccccatttacaagttcggattcgctcatttgttaatttaatcaatgttttcctctattgttcatttcaatgtcactttttgatttgccattgaccgaccggttgataataataatgcctttctttttgcagtcatttattaatgggggcaatgccattcaatgcccccccccccacttaaagccgtccctttacaaatggcggctgtccttggcgattgaccgccgttttgtgcttcattcattaagggaacaaaacgtagctgctgaagagcacaaatatccgtttattaggataattgaatggataaacaacaagagaaaatacttgggaatgggcgaatatttcttaaaaaatcggtcaaaatttaataatcagtgacaaattgagggcagcaaaaggatattagcaacaacctatgatcacttgaagtgttaattgagtgattagcatgtttttcaactttccaccgttgtcattacgtctatcgcatttcgtccgtgagtgcttc

SEQ ID NO: 91953 - DNA, 589 bp, Heterodera glycines
  SCN-specific regions: Sequence locations=1-154,177-589
ctattgtggcacgaatgtcctccgatttatgttcccctctcattagccaacaacagcaacaacaattcgtggcacagcctttggcccataatgttcaacagcaagtgacgaacactgagttgggcgctaatttattagtcaacgcaattgctgctcagcaacagcagcagaaccaaatggggccttttctggaactgttggccaatttgaacacatcgaatcaatcaaccgcatctgttcaccaaccgcttcctcagtttaacagtcctttggccgactctcaaagttcgtctttgatcgatgggtctgcggcactgaatgcttttcagttggtacaacagacggcacagcttaatcaccaaaaaatgctggttgaacaacaacagcatcagctcatttccgctgcaacaatgtcaatcaaatcgcctttgagttcgcaaagtgccgtttttgccggttccgaaggtggcattcctgcgctatttaatcgattgtccgcagtgccatcaatttttcgttcgatgggtccaagtcactccaagccaattccgttgctggatgaacaaatggatctgctacagtttaagcg

SEQ ID NO: 91954 - DNA, 455 bp, Heterodera glycines
  SCN-specific regions: Sequence locations=1-455
tgcttgaccacgtgacggacgcggccaataatatccattcccacaatgacgacgactctctgctgagggcgtacattcaggaatgggagaattactcccaactctgtcggtaccttcccctgcccttcaatttcatcgagaaaaatctcgtaaaaacgccttcacgaccaaagacggagtcgcaaagagttcgcaatgttatgttggactattttttcagacatgtttttgccgacatttctcagcgaattctcaatgccgcaatgggaatggtcgagcgggagagaaaccgcgagttggtcaactcacaaatgatcgtcggagttcgagagtcatttggtgatttccaaagccaaacataattacaatatctgtttttgtcccggctgcccaatgtttgaattgaacgtcgaagccgaagacccacttcacagttacaaagagcgatttgagcg

SEQ ID NO: 91955 - DNA, 226 bp, Heterodera glycines
  SCN-specific regions: Sequence locations=1-226
aatccgaagaaggaataaaatgacgccaacttttttggaatacatgtttatcgttatggaaaactgaaaataagtgtgccttaaatagtgatgtcagtgctgatcgatcgatttttatccaacatcaccagcgagtcgtttttttttatcaccaccaacattattcctccagcgggcaccgcctgattaaatttgatgctcactgctgtggtcccgttccttatca

SEQ ID NO: 91956 - DNA, 96 bp, Heterodera glycines
  SCN-specific regions: Sequence locations=1-96
ctttttgacggctgattagccgatatgtgaagttgatcggaatacaatggcctcacattgccatctgatccacgaaaactaaaaaaaaaaaaaaaa

SEQ ID NO: 91957 - DNA, 624 bp, Heterodera glycines
  SCN-specific regions: Sequence locations=1-81,114-423,446-450,472 -560,583-624
atttccacctgctgcttctgttgtttttgtgcattgacatcttttgcgcgacaatcgttttgtgttcgccgtccccgcccaaaaagagaacatttccatttggaaaaggtttaggaaattcgctgccaatttcagtgccggtttggccaaattcgttgtcccattattatcaataaccgatcgaacaaaacgcagtcagccggggtgtatggcgcattaacgtgcaatggaagccccgctggtggggtcagagtgaaattatttgacgtcgaccgctggttcgaatcggacgatctgttggccgacggatggaccgctcagaacggcactttcgctttgtatgggtccgcaaaagaggcgacaaaaattgtgcccaaagtgaacatttaccacgattgtaacgacacgaaaatttgtcaacggaaattttcaatctttgttccacttcattttgtgaacgaaggaaaaattccgtcgcaattttaccatttgggaacgattgaattgtcggagaaattccctcacgaacaaagggactgcttacactgataaatcagtgcaataattatattttattaatatgcaaatggtttttttaattcattttgtaaattggcaaagtca

SEQ ID NO: 91958 - DNA, 644 bp, Heterodera glycines
  SCN-specific regions: Sequence locations=1-644
gaagtggaagacgtggcaagtgaaaaatacatttaaagagcctttaatcttgggaaattggcaagggtaaaagttgtttttgtgaccaggaaggaaatccaattcaaatcgaacacgataaaacagtatatgtattgttaagaaactggttttgggcaaccaacattcgtatttccgcaaattgagcgacaccaagcggaggcaattcgctaatttgtaccaaagggcgctggtttatttgatatctagcgattatgaactgcacggaatcctcataacaagagtcagattaaattagacaaatggattaaagaaatatgtttttttgttttaaattagttacaattcaaatcctatgggctggttataaaaagatgcgtttcagatagaagtgcccttgattttgaagcacattcaaatccattggcgctgcaccggcgacgtgcagcgcgacgaagaaattgactaattgttggaaaaacacgcggattctctgcgcagaaaattaagcgaaatgttttttcatacgccaattcctccatttgtttttgttgaggaccggcgacatttgtacgaacaggaattgagcaaattgttggagattgccgactacggcatgcagtacagggcggtcagccacgtgg

SEQ ID NO: 91959 - DNA, 650 bp, Heterodera glycines
  SCN-specific regions: Sequence locations=1-3,82-135,163-172,196-650
tccaaaaaaaatttgaaaaaaataaatttcagataaaaatatatatttccgaaagattaataaattaaattttaaaaaaatgcaaaacctaggctttttaataataacgtacgttctatagaaacctaacagatattctcattttttaaaatacaagaatttagtggataacaaattattatatattattattttctttggttgctgtcgatggtcacagaaatggataaaattgctcattgcttgctggtctgctgtttattaataatttttttttcgattgtacggactatggagaaaatgaaaaatgtataaattaacatttgttgcattaatcatccatcaatagggatgcgatttttaggcaaatgcctaaaatttttgcgcacttaatacttacagttaagcacgaaaaacgcattttccgcttgatttggcgtgtctacgatgacttttataatgcctaactttgcctattttggattttttgtgcttaatgcctatttcgccatttttgacgaatttttcaggatttccggaaaattcgttaacaaaaatgcaataaaaatgaaaaatacaccccctaagaatcgacttgaaaattttttagaaaatacaaccccctaagaattgaaaaaaaaaattcacaa

SEQ ID NO: 91960 - DNA, 653 bp, Heterodera glycines
  SCN-specific regions: Sequence locations=1-302,337-342,365-653
aatgtccaccttcctgagtccaatctttggttgcgctattaatttcaaagtgtgcgaaatgtttgaagacattttgcagacattgagcttgttctcgggggattataggcgccatcgaagtcaaatgtttttttaccaaaacgaagtgagcaaaggcatctaacgaaagagggaaaagggcagtcaaagagactgacaaaagagggaccattggaggggggaaatgtctcttgcgattggtccgtcccgccccattgcccaagccgacgcagagagaagagcaaatcgcgatgcaattcacctaaatctatttgtttggataatattgaaaataatcatttcgtaaaatgtttatttttatgtcttttggaatatagatccgcgctcatttgaggaccgttctgttcacgaagtcgttgaacaatcccagtgttttcgttgattcttttgcaattccaacgaacatcggctccagaaaagttggcatgaaaaaaatatccgagtttattgaaggaagcaaaattagtaaacctaaacgaaaatcttaaaaataatagagcttgaatttttgtgaattgcataaattcttaacgccaagaaatgcatttaaactctaattcctaatcagcccagcctcactcaccaattgacga

SEQ ID NO: 91961 - DNA, 250 bp, Heterodera glycines
  SCN-specific regions: Sequence locations=1-250
actgcttctcgtcaatataattgcttatgagctcaatccatacaatactttgggaattcgtcggacagccggtccaaaagacattaaagatgcttataagaaattagccttgcaatggcatccagacaaaaacaagaatcccgagtccaaccagcggttcagtgacgtcaaacaagcttatgaaattttgtcgaaccctcatagaaaaaaggcttatgatactttcggcttcccagatgatcaattcgaa

SEQ ID NO: 91962 - DNA, 655 bp, Heterodera glycines
  SCN-specific regions: Sequence locations=1-83,106-342,366-418,441-655
gtcacttctttgctcaatgggaactttcgagtggaagaacaaatggtcgggggagttgagaacggagaagggaatcgcgaagtgatggccgcgtgggccaacctcgagaatgggttccactgatgcgagagagagagagatttctttctttgtctatgtttccgaatgaatggctcaattttcttttgcctttactcagtgttcgcaagcttttctaacatgacaatccaagctaattcaggtttttataataatctcttgcactttgctccttagctgagaattttccatttcgaatatttacgaacactgctttgttttatttgtgctgttctcttctcattttttctcctgttttttcctttgtaagacgattaccaattttatttattcagtaattaacattttacaatttctctatttattgtatttattttttacaaataatcagtttttacttgtttttttttgtagtttttacatagttaagcgtaatatattaccgttaatccatgtttagagcattatctgtcccatcatcttcgaattgccggttttgtttctctgtccttccctcgtctctttctctgtccattgcctttgtccgttgtccccattggctgcttaacattgccaataacatttggtcgatgtc

SEQ ID NO: 91963 - DNA, 302 bp, Heterodera glycines
  SCN-specific regions: Sequence locations=1-302
atttgcttctctcttcgtccatttctctgctctttcatccccatggtcctccgtacccccaatccgaactgctccaactccatttgcgcttgcaacggacgcaccgccgcgcgatgcgttgggcgcggcttaacactttcgaggcgggcgccggcttcaaatcgctgaaagattggggggggggggcacaattagggcgaggaaaaggtaatcaattaattagtctactaattaataacgggaaatggtaagacttctgctaacaaaatgagtgactgactcttgggaaaaaaaaagaaaga

SEQ ID NO: 91964 - DNA, 631 bp, Heterodera glycines
  SCN-specific regions: Sequence locations=43-431,482-631
aaattttgatattttaatcaattttattaattaagaaattaacaaaaaacatgaattcatcacataactcattaacttaattaattttttgtgatttttaaatgctttttgctttttgttaaggcctcgccattgccaaggcgtcgtcgccgcccgttgcgcgaattgttttgaatgccgacgagaattggtccacttttcaaacacaagaagaggtgaaagttaaatattgctaatttaacaatttattttttcagggaaaaatcgacatttttgtggtaaactaaatatattttttcgaaaatttttggcattttttgccaattttgaggttttactccacgaaattggccatgcgcttggccttcgccattcgggagacgaacattcagtgatgttcccaatgtttgagcgttctgttggcgaacatgtaaaattaaattaattaatttaaaaattaaaaaaatatttaaataaaattctctaatttatttcagttgccagtcatttcaaatgatgatgtcgagcatttgagagcactttacggtgattaactgctaacaattcattaattattttcttaacatttgtgtgtgtttgaagtgctaattaaaaaatggaaaattctaac

SEQ ID NO: 91965 - DNA, 647 bp, Heterodera glycines
  SCN-specific regions: Sequence locations=1-338,362-506,528-647
cccattcgcggaacaattggaacgcgaatttcgcgaggcaacgatggctgacaacaacagcaacaaccgcaccgatgaacgcgtggatgagaaattgacggcggagagtgaaccgaaaaaggcagacgaattcgtgaaggaagttggacaagaaccggctgccgaggtttatgtggcacaaattgtggatttgaccaccgaaaaagatggaaagtcagaaaaatcggagaagaccactccctgtgtccattcggttgtgatgcgcggcgtatgtgccggatgtggacaggattttcgtcagccaaatgaatttatcgggaactcggctgctattttcaactttgaacaacagcagcaaaagatgaaccagaccgtgcccatttctggttccttcggtgttgatgaccaccagaaaactgcaaaaaacatctatccgtctttggaactattggaaaaagaaccacgcggagggacactgatgggctgcgtggatggagaggaggtgtgcaccgccggactgccctacccgggctatcagaagccaaagggtcagaagcacagtcgtcactgcgagtggaagcacaaaaatttggtcatccagagtttggttgaacagttggtcgggatgggcttcgacaactgcaacg

SEQ ID NO: 91966 - DNA, 631 bp, Heterodera glycines
  SCN-specific regions: Sequence locations=1-307,329-587,609-631
attacattcgcacttgcgtccatcatgcccaggagaagggctatcgttgtgcagttttaaatcacattggtgttctgaaaaatgttcagcttacgtcacaacggattttttcttatggtggaaatggtgaaatggaagcgatgttcagagttcttgccaagttgtacccgcgaacttatttcattggcattggcttcagtatgggtgccaatgtgctgactaactgtttggcttctggactcgatccttctatttcttcgcgcattcttctcggcatttccgtttgccaaggctattgcgcttcggatgcttcttcccttttattcgattggcaaggcgggcgacgtttgtacaattacataatcactgaaagtgttaaacgattacttcgacggaattacgcaatggttgttctgccccatgtgaagtcgggattggtggatgaacgaaaaatctggtcgtcgacttcgcttctttggcttgacgaattttacagtcgtcgggtgcacaactttgcttcagtttcggattactattcccatataagctgccttccacgcattaaagacataaagattcctatgattttcatcaacactttggacgaccccctcgtgcccgaagctctttg

SEQ ID NO: 91967 - DNA, 647 bp, Heterodera glycines
  SCN-specific regions: Sequence locations=1-154,177-647
cttttgcttgttttgcaactgttaatcccccaaattgttcggatgatgtgagtgccaacgaatccctcctctgattttccattttcccccgcaaattcggcacgccgtcctttttttcccggcatggacaacgaattttcttcgctggaagaaattttcgcccaatttttcccgggccaacaatgctccgccgccggcagcagcaattggcgttgggacagaaatttggcagaaaatttgcttctggagaagactgttcgcttcaaagaggatggcttctgtgtgcagtttcacccacttttttcttatggtacggccgcggtttggggcgaatgcgcactggacgaattggtacgggcctattgggaggtggcggaggacgaaatgtacggctcgtcaatgatgttcggtcttggcacacgggatgccctccaatcggtgccgttcggttatgtggatttgatcggtggcgttggccaactcggcgaccaggcttacggactgacgcataacggctttgtcacccatgcctgtgagagtcgaccattctgtgagcagctgcgaacaatgaacgacattcattgcacatgcactgttggcattctgtttgatggtccttccgcgcggattggcttctcattggacgg

SEQ ID NO: 91968 - DNA, 132 bp, Heterodera glycines
  SCN-specific regions: Sequence locations=1-110
acacttccctggtcaaagtgcactcgctgttttccctgctcagtctcaaccgtgcctatgtgactcgccgtgggcgtttgattggcgttgtcgcacttcgcgatgtgagcaaaaaaaaaaaaaaaaaaaaaa

SEQ ID NO: 91969 - DNA, 632 bp, Heterodera glycines
  SCN-specific regions: Sequence locations=41-87,135-470,494-632
caaatgccttccgctcgaacttctgtacgaaattgtgcctttcatccctgccgaaaatgccgcccctaatgcgctctcgtcctgttcgctgctgcacaaacttttgctgccacgtgtcatcaaatggaaagagaaagcgatggacgaaagaataatcgagctatttgaccaatttaaagaagagatggagcagaaattaatgaacaaattggacgaaattaaagaatttttaagccttgaatttaaccaaaaattcgacgctttggagcaaaaattcgagcaaaaattcgacgctttggaggtgcgcgttggccgcctggagcgaggcactgccacaaacacaaatcaaggaaaaaaatcgctgaacgtccatgaaagattggacctcatctttgaaaaattggggataattcgtgtaaacaaatcgcgttcgcctgaaccttcctgcagcaacactttgcccacatcggaaacagcaaataatacaaacaccggcgggctcgaaaatgacggcaacagaggaggagaaagtgagaaggaacagacgaagagttccaatgacggtgctctgccaccaccaatgcctcctttgcgctcgagtttacagggaaagccaccgcccgttccaacgc

SEQ ID NO: 91970 - DNA, 639 bp, Heterodera glycines
  SCN-specific regions: Sequence locations=1-165,188-639
ctaagtgtgggcagtgtggagcagttggaatcggaagacttggaggacattggagtcaaaaagctgggccacataaagcgcatttgcttggcactgaagaagctcagaaattaccgtgccgaattggtcgacccacccttggccgtatgtccgctgctctgtcctccctcttcgtcttcctccgtttgccctttgtcttccgtcgttggcattcctttggacattcactcgtcggcattttcatcagaaaatctgtttgtacagtccctcagcagcaaacgacgcaattcgcaagcgcaacaatcgaacagtcagctgacggcggtggaaattaacgagaaaaattgtcagcgaatttcctttaccaatggcatttcgacggatggcacgcgattaatgagcaaatggacagaagatggcggccaacgagttcaaatgcgaaatgtttcctttgagagggattcgctggacgaaaggacggcgacagacaaaggaccgccacggctgaatttgtacagaaccagccaaatcattgcgcagttgcccagggatcctccgcccgaattagacgaggccgacgaatgggaagacgaacggggcacaaatggactgcacggagatgggcaccatgggcagcct

SEQ ID NO: 91971 - DNA, 481 bp, Heterodera glycines
  misc_feature (4)..(4): n is a, c, g, or t
  misc_feature (8)..(9): n is a, c, g, or t
  misc_feature (16)..(16): n is a, c, g, or t
  misc_feature (18)..(19): n is a, c, g, or t
  misc_feature (30)..(30): n is a, c, g, or t
  misc_feature (32)..(33): n is a, c, g, or t
  misc_feature (40)..(40): n is a, c, g, or t
  misc_feature (56)..(56): n is a, c, g, or t
  misc_feature (58)..(58): n is a, c, g, or t
  misc_feature (63)..(63): n is a, c, g, or t
  misc_feature (69)..(70): n is a, c, g, or t
  misc_feature (72)..(72): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (94)..(94): n is a, c, g, or t
  misc_feature (96)..(97): n is a, c, g, or t
  misc_feature (107)..(107): n is a, c, g, or t
  misc_feature (129)..(129): n is a, c, g, or t
  misc_feature (135)..(135): n is a, c, g, or t
  misc_feature (139)..(139): n is a, c, g, or t
  SCN-specific regions: Sequence locations=1-375,397-481
ggcngaannggacccncnnagcaggcgaanannggccacngagaaacgaccgcccngngaagngcaagnngngacncncgcngaagggcgaaangnnaaggaagaancgccgagattttttttcgaagngcaaangatnagcgaactggagccgaaatactctgtgcttcccgcctcagtttttgccaagattttgcagagagttggtcaatccacaaaactaaatctatccggccgtcctgctgacagagatgtccaacttttgagcacatcccgtctttatcatgttgggaataaacttgttgccttcacacctcaatttatggacgtgaggcgttcgcatttggtgtacgacattcgtgtgctaatggacgaatggagttctgaacttcattacatatacaacagttggaaacaggttagcatcagaggacgacccctcgtcctgttgatgatttcagacaacatgctccaaacggac

SEQ ID NO: 91972 - DNA, 653 bp, Heterodera glycines
  SCN-specific regions: Sequence locations=22-248,271-653
gttttttattttgtaaaaaatctatgttagcatggaagaagataatgccggagacataataaaatggctctacaaagattcgacaaaattggattgcagcagtgaaaaagtgaaagttacaagcgaacatttgcattccaaactttgccaagtcaaattgcgagggaatctgctcggttttaagccattggattttgcttctgaaccttttctgattgtatgtgaaaaaataaacgtccaacgttcggaacaaaacaaaaattctttggccattcggcaaagcaacaaagaattgcacttggaatttcagtcggagaaacaatgtgaccagtgggtagttaagcttatgacttgctctcatcgtatagtccaagccgaatacgaccaggtcctttacaatcgcttcactcagcctttgcccgcttcgtctctaagccaacaaatggtcaacaatttcgcctactttctcaccgccccttcagtcgtgaacaattcttttctttgtctcagtctcacaattttccctctcgtcaaatcaaatgccaagaagtgatgtacgagagcaaattgtccatggtcgtgccgcgagaaatccttcgactttcgcataaatgggcgacggaattacgcgacgaattattggacaaactttg

SEQ ID NO: 91973 - DNA, 659 bp, Heterodera glycines
  SCN-specific regions: Sequence locations=1-101,127-357,395-558,580-659
cagatagatccatgccaaactctctacatattgtgccaacaatatttcggcatggcttggcgtggtgatgccgtaccgtttttccggggcttcctcgtccgttttttgtttggccgtttttgtccacgggctcggcggttgtttccaactcggacggacagatgcgttccgttcggttctcgttgcagccgctttccgggcaaacttggcacttgtgaatagttaagggtggtgggcaaaatttttccaattctttaaagcattttttttcttccgtggcacatgcgttgagcacaaagttatcatcgcccttctctgatgagagataagaagcattaaaaatgccgccggcggatgtttaaaaaaaataatagtaaatttttatataaattttcacaaagttttcaaaaattgtcggttcccggttccggaggaaaattgaggtcccggtaccggcttcataggcccgggtcccggttttgccaaaaattctcggtccgttcaactttacgtgtgactcaccgtctttgtatcggtaaatttggcattccgacccccctccccttacatccaattttggcacattttggtgccattttgctcatatgactcaccaaaaattttttttcttttaaaaaaaagcaccgtctttgcatcgg

SEQ ID NO: 91974 - DNA, 644 bp, Heterodera glycines
  SCN-specific regions: Sequence locations=1-167,190-644
caattattaggcaattgccattttttctaaaaatgtcatattatttcatggtcgtttaatagcaataagtcaaaaaaattttatttagaatcatccttatgccgcccctagataaaattttcagttgccgtctcaaaggaattgaattgaatatttttcgaggggacattgtgatggctgaaacagatgccattgcaattttatgtgacccagactttaagctcaatgcgggtgtcggaagggctatcagaaacacaggtggtcaggacttcatgaattctttaaacgaggagaaacgcaaacagcgtggttcacgtgtgatctctgttcctatttcaagtggaattcgctctgcttctgtgctgttggctcccgtttctggcatggaccgtcattctctcgaccaagtttattctgcaatcatccaaaaagctttggaccttcggattgagagtctttcgatgcctctgcttggaagtttattttcctcacttgataccgcttcaaattatttgtgggcttgccttcagcagttttcttcatttggtcgtttaaagaaaattcaaatcgtggacaccaatgatttccatatgcgatctcttcacaaattcatcattgccaaattgcgtgctcaatcacaactc

SEQ ID NO: 91975 - DNA, 568 bp, Heterodera glycines
  SCN-specific regions: Sequence locations=1-55,77-107,150-237,262 -493,516-568
atgctccaatcggcggcacattccaatggcataaccaacggcaacaatagcaatggaacaaaaagcggcggaaaaagcggcaaagctaacggaatcggcacaattttaacgacgacaacatcaacaacaacaacaataacaacaacaaccaatggcatttcggctgccgctgtttgtctccaatcgccaagcacttccagcagcggtgttttcttgcactttggccaactcaccgccgtcctcctcctccaccaccacagcgccgtcgtccgcttcaagcgtggcgggcgctggaatggcgcccattttgccacaactgttcgccggcgtcgacccggcgctggtcatgcaactgctcggacttggcccacagttggagcagcaactgttgctgcttgcggtccaggatcggctggctcagcaattcgccataggtggccatgccggcggcattgacttgcagctgtggcaacagttgacggcactcgggttgctcggcggcggtgccggtgccgtcggagtgccaccacaacatcagcagctgcaccacgcactgctcggcggtgac

SEQ ID NO: 91976 - DNA, 663 bp, Heterodera glycines
  SCN-specific regions: Sequence locations=1-106,128-238,261-597,619-663
gtttgagaaacgaccataaagtgctgtaattcaaaatttctttcctaattaaacgaattttttcaacaatggcaaacggctctaccgataaattcagtaaattgccggagttggccaagccgtcactctatcaaatctttgtcagtctcaatttgaatacattcaaattcaaaggcaaacagacgatccatctcgagattacgaaaccaaccaattatttgaaactccattcgaatgctttggatgtggagaaggcttctctgaagttagaggatggcaccgtctttccggacttaaagcgcgaaattgatgcaaaatggacactgctcaccgttcagctgcctcaagagatcaaaccgcagaaagccgagttggaatttgtgtacaatggcgaattgacaaccaacatgaaagggttttacaagtcaacttacaaagacagtgaaggcaatgaaatggctgtcgcctccacccaatttgagagcacttacgcccgcaatgcctttccctgttgggatgagccgacttacaaagcgcagttcgacattaaattggaggtggacaaggccctgactgcactttcgaacatgaatgtcacggaggagaaacacacggagacaggcactaaaacggtcacttttgccaggactccgcttatgtcta

SEQ ID NO: 91977 - DNA, 298 bp, Heterodera glycines
  SCN-specific regions: Sequence locations=1-192,214-269
aaagagaaaaacattcacaaaaatggtaataataaagcagcagtctgacccgttattattcggctgtaaatatgacatcatgtgcggcgtcgcgtcattcacaattaatatgtaaaagaacaattaatgcactagagagtgtgtgtcgtttgtgaatcgaaagagatggagagagaaagcgaaaagtgtccatttggtggtcaaaatgaaacaccaaagggtgaaggagtggcggagattgatcagttaagtacacacaataacaacggttatataatataaaaaaaaaaaaaaaaaa

SEQ ID NO: 91978 - DNA, 160 bp, Heterodera glycines
  SCN-specific regions: Sequence locations=1-133,159-160
aaatcataaagcaaaaatcattttttttaattttattccaaatttaaaaatcaataaaacgcttttttgaggcgcgctttttccaaaaaaaaactttttgtgaagagggggcaggcggcgccgccaggaaaatttttgaaaatactttaaacttaatatt

SEQ ID NO: 91979 - DNA, 650 bp, Heterodera glycines
  SCN-specific regions: Sequence locations=1-31,87-87,173-176,198 -198,242-259,315-315,401-404,426-426,470-482,543-543,629-650
attgaattcaataccccttcaatttggctatcatgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgtgtcttcgtggagggatgcatatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcagatcttcgtcaagacgctcaccgggaagaccatcacccttgaagtcgaggcgagtgacaccatcgagaacgtgaaagcgaagatccaggacaaggagggcatcccgccggaccagcagcgcctcatcttcgctgggaaacaactcgaggacggacgc

SEQ ID NO: 91980 - DNA, 505 bp, Heterodera glycines
  SCN-specific regions: Sequence locations=1-399,421-505
agggatgacattgtccatttgctgtgcaccattttcaacctacagacggcaagaattggcacgctaattctaacaagtgctcggcgaagatttttccttcgaactgaagaaggcactctctggggactttgaggaactgattttggctttgttggaacctgctgctgtttaacatgcgcagaagatgcgccgtgcgatgtccggtctccgcactcacgaatcggttctgattgagattttggtcacgcataggaaccgacttattgctgagatgaatcccgggtacgatcagttgtacggacatccgctggagaacgacatctgctgggacaccacccgcgcatatgaacgactgctcgtgtcgctgtgctacgattcgcgcgacgaatgttggagctctgacccgctcagagcggatacgacagcacgtgctctcgttcaagagagcgaggtggatagcggggtcaacgactttctgttcaagcaagtgctggccaacgaggat

SEQ ID NO: 91981 - DNA, 649 bp, Heterodera glycines
  SCN-specific regions: Sequence locations=1-123,191-378,401-478,500 -573,595-622,644-649
taaacgaaccaaaatttaatttaaacccgggttatggcgataaaaccgggttaagaactagggttgcacccccgaccccgcccccgaccccgaaccccgacagttttggccattttcggggaaaaccccgaccccgaaccccgacgcttccaaccccgacaaccccgaaccccgacccttaaccccgatcggggtcggggttaaatatacacccttaagaattgcatttttgtaagaaaaaaatttcaaatttatttaaacattttgccaatttttaaattatctatatactagtacttagatcaacaaatttttcttgtttctgtacttttctggttgatatgtatgtactttttctaatttagataaaatgtctgaaatatggttcttttataaaaaatcgcaaacatcggaaacggctttatgtaacctttgtcacaattctttttcgtgtaagaaatcgtcgactaaaggattgtgggatcatttaaagatgaagcataatgacgaattcgagcaattggaaaaaaggaaaggaaaaacaaacaaagaagtaataaatttagaaagttctattatttttaaaattatttaggggcaagaaaacaaaattacgaaattttttcaacaatctgatcaacaaaaacaa

SEQ ID NO: 91982 - DNA, 634 bp, Heterodera glycines
  SCN-specific regions: Sequence locations=1-106,129-634
ttgctgggtgtgcacatatcaagtcggagtacgtcgtattacgaagtgaaacgcaacagcaagaaggaggcaacaaaccaccaaatgaatccaatccattggaagggaattcgcacgagggaattctgccaagaaatgtgagggcacgcggaatggaccgccaaagagagcaaaaaatggccaaggcccgagcggaaaaccgtcaaaaaatcgtaagaatttgtccgtcggttctttttgagagcgaaggaaggaagtgcaaatatggagagaaatgcgacgcggagcactcgctgacaaaatattgggcgaagaaaccgccggacattggcgagttttggcacccaacgccaaacaccatctttctttggaaggtccgtcctgctttttgttcgaccaaatgggcaagtgctctttctcattgagctgctgtttcgcccgagcccatacgaatgagtcggatttgagccagaagagcaaagcggggcactcggaatggcagtccgttctcaacacgcacactttgcccattcagcaacagctcagaaaacgcacttacgacttttctcgttctgaacgtgctctgcatgaatcaccatcgggttgtatggaacgcgaagcaccgaagtgggac

SEQ ID NO: 91983 - DNA, 545 bp, Heterodera glycines
  SCN-specific regions: Sequence locations=1-308,330-545
ggaagaattgttgctggattggtttactgaatggaagctttgaagtgacaattggagaaaaatgctgacaatttgttggaccactgaaatgaaaccaaaactgggcctttcctccgttcgtcgcccttccgccgacctttctcttcctcaaatgttttgtctcttcacaaccgtttcattgctctgcttttgctgttcgatcagtttactgatcagtgatcgcatttcgccgtccatcaaatttattgacatttgattagccgtcaaaatctgttggaatttcccctcctcagccgctgctgctaaagctgcagggatggcgtaaatgaatttggtcggcctttctctcgcgccatcgctttgcgaaatgccatccgccgaattgcccagaggaatttcgacgattgacgttggccctacgaccacttccgctcccgaaggaaatgccaacaatggcgttgtaacagttgctgcatttgccactttgatgcaccggcgcaatttcgagtctaacttttgtcccctgggagttgaaccgttcataa

SEQ ID NO: 91984 - DNA, 579 bp, Heterodera glycines
  SCN-specific regions: Sequence locations=1-201,223-539,561-579
gttcgccaatctctcgtcccggctcgtagcattgctttggttggaaatcagtcaggttacggtattcccctgagcattactacagtaaccgtgccttatactgccaaatattcatgcggaaaaagccgcagccgagtcggccaaacacatcctcggcacagccctgtgaattagcgtattattttttggcacttttcactttgatttgtccctttttcaatttccacttagtgcccaattatttccgtgcccctttttctttaattgtttcgtttggttcacttgctgttcgcatccgctgtccgccatgcacatcgccttcatacagtccgaatcgaattcaactgaaacggcaattaattaattaaagtcacattaagcacccaatgaatgggataggcttaactgttgtggaaaatcaaattggccatcacaaaattgcataacaaagtgataatgaggagagggagcaaaagggcggacaattggacggtcatttcgggggatcaatttggggagaacaaagggagcagagggagcagtgtctggtgaggaacagcaggtcggacaatggcagca

SEQ ID NO: 91985 - DNA, 645 bp, Heterodera glycines
  SCN-specific regions: Sequence locations=1-645
attcaattggccaccccctctcatttcgcctcaaagggccaaattgatcgggttggcctcaaccgtaacaaattgttcgttgccctgcgaaatgcgcgtgagttggagctttggtcagtgcactgtttggtcccgtgctcgtggaagtgccttttctcttacaagttccacgaacttttctatgctcattgtgcactttcctctcaacaaaatgcaattttttcgatggtcgcagcattttttaatattgatggcaattcagcagaggatggcggcatcaaaattcttcgctatgatttaacttacgaaaagctatccgaattcgatttggacttcgattgtgtggacactttcgagggagtcactctcgaaagagtggcaatgggctgcggacagacggaaaatcggctgtttttgtacgaccggacaatggttaccggcgaaatccctttctggcaaatttcgctcgattggacaaaaatgaccttttccatcaaatcagtcccaattttggatggtcatcatttctgtgctcattgcattcgctttcccgttgttttggatggcgacagaagaattattttgcgaattactgaagactttcaagttgtcgtttatgaaggaaaaagtgaacgatgggaggag

SEQ ID NO: 91986 - DNA, 654 bp, Heterodera glycines
  SCN-specific regions: Sequence locations=1-28,50-300,323-326,348 -471,517-654
gagagattgaccaatcggtggaagggtgatcaatgacaataacactactgtctgatcacagaatgataggcatgaacggaaatgaataaatcacgaatcattcggatgaaaggcgacggttcgccaacgccgccgcgcaaatgcccccgggcgttgtcagccgaatggtgagaatgaagaacagtgttggcaccgggagaagcccacctgtgcaaaaaataatgggcaatttctaaaatgaatagttcccaagtttttacaaataattagagcccggaaccgggatttcgatactgggtcgggattgactttcacattaactcaaaaacttttcaatgaaattttttgtaaaaacacctaagcttacaatttattaattgaaggaaaaattccagcggtgggcatactatgccaaaattccagttttgccaacatagcgccaaccgggattattcgggacgctataacttcgatttaaaaacaaataataaatcattttttctaaattttaacttttaagtctaaagcagaaacaaatattattaaaaagacaggaaaacccaaagaaactgtatttttttgtgcacaattttctattttttccaaaatttcaaatttaaactaaaatttacatttcatttttaactaaatatg

SEQ ID NO: 91987 - DNA, 279 bp, Heterodera glycines
  SCN-specific regions: Sequence locations=1-189,216-279
ttagtacttatggggccggttgcgtctcaaacattttgttcggaaaaatatttttttttgatttatccgaaggcgcaaatattaataatttttttcttaaaactcatacgtatgaaaaagttacaagcatttttctaattcggagtgaaattgtgcggggtggaaacatagtgcacccatatcagaaaattgtttttgcatttttatacatttcatttgttttaaatcttttaatatagcccgaatatggaaaacaatcaaataataacgaaacgaaac

SEQ ID NO: 91988 - DNA, 628 bp, Heterodera glycines
  SCN-specific regions: Sequence locations=1-268,290-628
caacatttgacagagaacagtcttctaaaccacttaataccactgccatggctctcgaaaatgccgcagtcgcattttttaaaccgaaaggcatgtatcgcatttgatacacattgtcctctgttatgacgccacatttccatgatgtgtcatcactgagtctgatttgcatatatcctgaggataaatctaagctactgtaaaatttgcaacttccgactttttccataattgactctaatctatggagtgggtatcggtcgggtatcattacttcatttaattttcagaaatctaaacatggtctaattccatcatcctttttctgtacaaccacaaaaggtgtaacccatggtgtctcagattcaaccattactcctttattaagcaattggtcaatgtgcttctttaattcatctctgtatttatatggcattcgtcttggcagtgaagaaattggagcttcggttgtcgtgtcaaaatgatgttcgccacctgaaaatgagcctaaatcatattggcttttgaaaatatgtccttaaattcttctaaaagatttttaagtgcttctctttctctttcataatgtcagattttgagaggtcaagccttttgataaaatcttggg

SEQ ID NO: 91989 - DNA, 623 bp, Heterodera glycines
  SCN-specific regions: Sequence locations=1-34,68-199,245-342,371 -426,448-585,607-623
caaataagaattatgaacttgaaaatttttgatgaaaatgccgaataaatggagaaattttgaaaatattgacacaaggtgaagaatggaaattaaggaaataaaatattccagaagtttcaaaccaagctgaaaatatttttagtagctttttcggctgaaaaagtgtattaatatgaaatccaataaatttgggccctaataaaaattttaataaaaagaaaaattgaaaatatatttttttgcctttttttacttaaaaattctaaaaagtattaatagtaaaaaaaggttcattaattaatagagagaacttggcaatggaccgggaaaagactcgtcaaaatatttaaattttctttaattttttccaatgatgatatacacactctttttggtctttaaaagttataagtagagcttggattttaagtttttacttattttttacgggtagtatacttcacacgaaaatcatattttctccgaacaatttaatttaaagcgactttttagcacctaaaacgcctaaaacgggggttaacacctattttggcattttcgaactttagcacctattttggcccttttccagaaatttcatagcaaaagtgcaataaaaa

SEQ ID NO: 91990 - DNA, 575 bp, Heterodera glycines
  SCN-specific regions: Sequence locations=1-2,57-332,369-448,505 -523,545-575
cgataataaaataaattaaaatttaaatatctaaaaattaaaaaaaaactaaataagaaatttcgttttgcaagcgataataaaaaatagagaatttactaatgcacaaattccattaaatattagcaaaagaatgtaatttaaaatttggtttttacgtcaattttgtattttctacagttttttacaggtgaaaaagaaaatcatcgccttcaaaaaggtgaggaggcgttaaaaaaaataaataattagaaatcgtatataaatgtcaattcaaataaccatataatctaaattataaaagaagaattatcgagtttcttaagctttcgtatatttaaaaatgaaaaaattatttattaaatttacacgaaattattgtttttgatttattttttatcccaaaaaaaacgaataaccacaaaaagtgccaaaattaaatgtcatcttaataaaaacaataacaaattacattataattttactttaataataatatttattcgtataaattttcttgtaaagttatgatttgaataaataaattaactaattagtccataattatggtcgcg

SEQ ID NO: 91991 - DNA, 533 bp, Heterodera glycines
  SCN-specific regions: Sequence locations=1-26,70-215,237-260,282 -379,401-415,437-533
cccatccttaataaggcaaaattgcgtttaaaaaataaaataattttaaattgatttatttatttttatgtttaatgattacagcattgaaaaagcgcaagcgataagtgataaaccgatgaagacaaggacagcctttttccaacctaaaaggaaactcaaataagccaaagtctttaggtttttatgagaataatcgctttaatttgaatattgggcggagaaatgtgtttataaataagattttccaagtccgagccctgctgcttgtgggtatccaccgtaggcatatgttccagagaaacaaaattctcgacacgaggcagagattctcaagcatcgacaattgttgggagcagctcctccccccccctccccgaaaaatgaaaatttaatttcagtttttttaatactaaaactgaagaatatttacagattttttattagaaaaaaatttattttgtaagaacttagaaagacgtaaaaattttagttttttcgagcgggggatgatgcggggaaactaattagga

SEQ ID NO: 91992 - DNA, 657 bp, Heterodera glycines
  SCN-specific regions: Sequence locations=1-146,168-657
tgcacaataatcccgacctcgtgatgccgcctaaaccctccgacaaagaaaaagctatggctttctacaacattgacttttccctgtccaatcagcttcgtttggctggacaaagtcccggttcttcagtggactcgcttagtcctaacaaaagtcaacaaaaagactacatgcaacgcaaaaaggactttatacggcgccgaaggtgtcaagcagaccaagacagggcctctaaagtcatctctaaggaatgtccaaaatggcacaagatgcacatgaaatgaatcaatccgtggagaaagaaaacgacgccaatttacgcccagttattggctggaaagagaaaatggagcagcacaaaccgcgattggactattcggacgtattcgacgctgtcgctggagcggatgctggtctttgggtttgggagattgagaacttttatcctgtgcttgtcgactcgggttttcatggtcaattctatgaagctgactgttatttggtccttaaaacaactcgggagacaaacggagcactgacacatgccatttattattggattggtgaaaagaccagcctggacaaggccatgtgcgcggcggtacacgcagtcaatttgcgaaatcatttgggagcatcttgtcggacaattcgtga

SEQ ID NO: 91993 - DNA, 659 bp, Heterodera glycines
  SCN-specific regions: Sequence locations=1-533,555-659
attcccccacttcatcttcaaactccactgttcttgtcgcactgtttaaagcactccccgaagaattatacagtcataaacttaaaattggcgaaaacagacgaactgaaatcgaagaagaattggcgaggcatacggaaacactgctctctaaattgtttcatttgtgctctttggatacttctttgtctgaagaaaatggatttcgaacgaaggtttctttttttttctcctttagcattttcaataaaggccgtcgactgcttggcttcttggctgctgaacccccgttgtcctgttgccgtgctcactcgttcccctttcttccgttcggttctttccgtgctcagccaacccaacacttcgcagcatttgcacgacgcggccacagaatgtgcggttaatgcgttacaattaatcgacgattcgaaagttgccttgacaatgagcggagagctgagcgaatttgcccagcttttgcagcagagcatttttgaaactgccgacgtatttcgattggccatgcgggaagaagactcagaaaagctacaaaatttcactcgcctttacgctgaacagtccaacgcatttctttctgcgatggccaataattccccgcagggatttggcgatttgcgaatgttggatatgcttttgat

SEQ ID NO: 91994 - DNA, 469 bp, Heterodera glycines
  SCN-specific regions: Sequence locations=1-469
cagccgcgcggcgcttggcctttgccaattggtgttggtcccgcacaacattttgctgctcaaatcgacgcgagacgcgtggcggctgaatttgcgcgacaatgagctgatcgttgactaggcgcacaatctgttgcagacattggcctccatccacgctgtggagctgagcacgggccaactcaatctctgctccgcgcttatccacgactatttggagcgcttccgaaagcggctttttttttttaaccttctgcacattcgccaattgcattcgcttacggtcgctgtgcacaatttggccacttctacggcaaaggaggacgacggcggtgccaaggagagagtgctcaccctgacccaatttatggccaaattgggctccgcctcggacattgacctggtccgtctgctcgactacctggatcagtcgaaactttgcagaaagttgcgcgactttcgtcttcag

SEQ ID NO: 91995 - DNA, 534 bp, Heterodera glycines
  SCN-specific regions: Sequence locations=1-65,87-203,225-534
aaacaaatttaaaaaacggtcgcgaagcgcccgcccaagcccaacaaaatttgaaaaaaaggcgtgaagcgcccgtctggccccaactaaatttaaaaaactggcgcgaagcgcccgtcctgaggccgcgaagcggccgaatgttcttaataaaattaaaaacgggcgcgaagcgaccgtcttgaggccgcgaagcggccgaatgttcttaacaaaattaaaaactggcgcgaagcgcccatttatgagtccgcgaaacggccgaatgttcttaataaaattaaaaacgggcgcgaagcgcccgttatgaggccacgaagcggccgaatgttcttaaaaaacgggcgcaaagcgcccgtcatgaggccgcgaagcggccgaatgtccccaaaaaaattaaaaaacgggcgcgaagcgcccgtcctgaggcttaacagccggccgcgaagcggccgaatgatcccataaaattatgaaatgggcgcgaagcgctcgtcctgaggccgcgaagcagccgaatgttcttaaaaaatg

SEQ ID NO: 91996 - DNA, 473 bp, Heterodera glycines
  SCN-specific regions: Sequence locations=1-473
agtaacagaactctgaatacatatcaatgtcatttcaaactaaatcctactcagcaacaatacaacttacggatgaacaaagggagcggattaagcaaaacagggaaagggcactgagaatacaggcggaaaaggccgagcagagaattaaacagggtccaactgcagcagcaagtcaacttcttccccacgtggatggaatggccatttccaacaacaaaccaccaccgctaattggagaaagacttgtgtgccctcgtcacattcaaattcaaccccctattacaacaaaaaattccaattcgccccgaccttcgacgagttctgtgcagaaagtacttgttcaaatggacttttcgctaattaacgcgaatcgctttaaggtgcaatttactccttttaatagtgatgtgatggacaaactcaagtcaattccttcacggtccttcaatgcagacgacaaaacatggtct

SEQ ID NO: 91997 - DNA, 625 bp, Heterodera glycines
  SCN-specific regions: Sequence locations=1-625
cttcattacgcaattgagcgcaataatttggatatggttcgtcttttgatgtggtacggtgccgacatttccttgccattctcgcaatgcccactttgacccgttgcgactttcgctttgtgtcaacccgaattcatcggttcaacattggctttcaagtcgcgtggacgctttgtcaaataaaatccgcttttttgttcgtcagttatgcgcccgctgtttctccatccgatcagcactttcacctgtccattttattcggtttggtggccgctgctggccgtttcaacagaataatgcacaaattacgcgtgattgtcagcttaatttacgtgcgaatggttgctcatctctcgctcagttgctcaaacaaaatgccaattcaagaattcttctctttattgtgcccgtttcgttccgcacctccgaccaattttccgctgcttccgacccaaaaattgttcatgttgaattcccagacagcacattcattatttcgacctcaattatgtacaactcgcaaccgccggccaaggcattgaataacactgtattcagccaaagacacaacagccatttctatgcgtttgaccttagttcttcgaccagttgtgttgaagggctg

SEQ ID NO: 91998 - DNA, 636 bp, Heterodera glycines
  SCN-specific regions: Sequence locations=1-422,451-474,509-573,597-636
gcgagacagagcatttctgactgaattcgctttagacgggcgatccgacgggccgtggcaccggcggacagtccatttggggcggtgattttgaggacgaatttcacccggcactacgacatgacaaagcattcagtcagtcttcgcactttttctgtctgtgcttttacaccttcgttttctgtcttttcaggagtttcgatggcaaatgccgggccaaacactaacggttcccaatttttcatcacaatttgcccggccgaatggctcgacggaaagaacacaatttttggccaagttgtggaggtgattttgtgaatttggatgagtgcgtttcacttttatttgctgcagggattcaacgtggtacaaaagatcaaccaagtgcccgtctataaaaaggtatttcctaattgtaagcgaattttaatttaaaatttaaaatttttagagtgggagaccccgagaagagatttcaatcatttccatttctctgaagagtgtttagcttatataaattcattgctttacaataatgaacgaatgaatgctctcattttgttgggccaatccgaaattatgtttttacttttaaattccaccaaaaataaataaaagtgccacagaatggatgtg

SEQ ID NO: 91999 - DNA, 530 bp, Heterodera glycines
  SCN-specific regions: Sequence locations=1-84,106-250,280-530
tcgagcataaatgtggccaattcgatgtctccaattttggcattttcgaacatttcccttttggtgggcaattccttggccaaaatgctcaattttgtgtccattatgcgatttttcaaaatctgcttgattcttatcaccgccccgtcttttccctttttcacggcttccaattctttttttgccatttccaaatatttcacctcacaaaatgtttcatttttctttataaattcgatgagattgcccaatgtttgctcaatttcatttttattttcacggacatttgatcaaccaaatacgcctcaacttcaaccaccaaagtgccaaattgccttccaaactcattaatgattgcccgcatggacgacagcaattcggcattactaaagacgggaaaaggtcaaatttggcatcgctttccgccggcgttaggccgtggaaaattttaacgcagaaatcctacaaaataagaatgccaacattaggaaaaaagaaaaaactatgccagtttttgatttattcctttt

SEQ ID NO: 92000 - DNA, 565 bp, Heterodera glycines
  misc_feature (460)..(460): n is a, c, g, or t
  SCN-specific regions: Sequence locations=1-534,556-565
gctcttcgctttgcccgccggcgctttaattggctcttacgcttttggcgcgttgaatggttttgaacagattcatgccattggcgcgttcacttcatctctctgttgtgtcggagcaatttcgggcctttcttctcaacactctgcccgaattgggaattctttaggttttaacagcaaacattattttaatgacctgttcaattaggaatgattggagtcagtggtgccttactgaccacgctgggcacattgaacccggacccgcagacattgagccaaatgtgtgctgccatcgcttccggttccctcatcggctcaatcgtcgccactcgcataaaagtcaccgatttgccccaattggtggcactttttcacagttttgtcggaattgctgccacgacgacgtgtgtcagcaattacctagccgagttttcgcactttttggccgaccccgcangcacggctgcggtgaagacttgtctctttttgggtgcttacatcggtggagtcactttcaccgggtctttgatggcctatggaaaattgcagggttattattttt

SEQ ID NO: 92001 - DNA, 645 bp, Heterodera glycines
  SCN-specific regions: Sequence locations=1-235,258-298,321-615
caaacacaccgctagttacggcacgtaagaccgggaacgaaaccaccatccccagtcagtgtgttatgtgcctgctgctacgtccgtggccgtgatgagacgacgtggtagggcccgtgcttggcctagcacgtggcttaagactcaatgagtgtcagctcgggcaccgccagctttttcttttttttcattatttttttttacacttctgttgaagaatgaattctagtcttatcggtggatcactcggctcgtggatcgatgaagaacgcagcaaactgcgataattagtgcgaactgcagaaaccttgaacacaaaacattcgaatgcacattgcgccattggagttacatccattggcacgcctggttcagggtcgttaccataaaatgcactgcttgtgcgttgcttcgtgggatcatgtacttgtacgtgttcttacgttacttgcttagctcggctgtggggttttggtgtgctggcgcgaacttgtggttctaattcgcgttttacggaccgtaactcgggcgcaccaatgctttgcatgctgtggcggagtgcctggattactggcattcctgctttgatttttcgacctgaactcagacgtgaacacccgctgaacttaagcatatcagtaagcg

SEQ ID NO: 92002 - DNA, 631 bp, Heterodera glycines
  SCN-specific regions: Sequence locations=1-141,163-631
tcatgcattttctgtccgtcccttggaaattgctcttcgccacaatccctccgaccgattattggggcggttgggcctgttttactgtgtccattttaatgattggcctgctaactgcggtcattggcgacttggcctcacaatttggctgttgggttgggctcaaagacgcagtgacggcgatcagtttcgttgccttgggcacttccgtgccggacactttcgccatttaattgtcagctgttcaagacaaatacgccgacaattccattggcaacgtgactgggtccaacgcggtcaacgttttcctcggcattggcatcgcgtggacattggccgccgtttaccattggttccagggctccgtgttccgcgtcgacccggggaccctcgccttttcggtgaccattttttgcatcgaggccgtcatttgcataattgtgattgtggctcggagacataaggccattggcggcgaattgggcggtccgcgcaacttccaaatggccaccagtgcgttcttcgcctgtctgtgggccttttacattggcatctccgccctcgagtcgtactgtgtcatcgccggcttttgaaccactcaattggcactctctcactctgtccgtccgtt

SEQ ID NO: 92003 - DNA, 541 bp, Heterodera glycines
  SCN-specific regions: Sequence locations=1-422,445-541
agcttaaaaagaatgaaaaaagcttatttaggtagaaaattttttactttgaaccatcacaaagtaaatttttatgcaaaaaattcgtggaaacgttgtaaacaaaaaataaaatgactagtattaagctgcttttagaagttatgcatgttaaggacataccgaaagagacggacgaacgaaaacatattgaaagaatgaataggaaataaacggcacaaaaactgatgacggatgacttctggctaccaaaagcgccgttcagagttccaacgaaagccggcggcattgggagaagcggcggcactcgaacaagagtcggcatcttccggcgtcttctgtccattggaattgggcgaagagttcggtggagagtcgatgcacggtggttctgtcccttgctcaatctgcggtttgagaaaattgaaaaacaatttgattttataaatttgcttaaacttgccgcgatcaaaatgtcataaagatgaagcagtattaagtcccagttgtccagagtgccgtaaaatgtgacaatggcggc

SEQ ID NO: 92004 - DNA, 588 bp, Heterodera glycines
  SCN-specific regions: Sequence locations=1-422,446-588
ccatcagcgccactcacatttcgtgccaccagcagtctccattcgtcatgcgatcggattagtccccatgccattcaagaactactagagttttcccggctgtcgggtcgaatgagacggacggtaattggccaacctgctaattattttgtttccactaacactttccaggccagccccgattcccgactgtccagcagaagtcccagtccgtcctgtctgtccagcggtcgtacttcgccagcaatgtccggcattgtttcccgcctgaaaaccaccaactttttgccgtccaccggtgggatgcgcaaattgagcagcagtccgcatctgctgggtatctgtgaggtgggttttctcctgactcattcattcaatgttaaaattgcttccaggagactgaagaaggcggagatatgcaagacttgctgggccaaggcaacagcgccttctgccccgacacattcatcaccagcagagccaacggcacaagtcggcgtcaagactttcagtgcaatggcaaaagcgcttccgcggtcgtcgttcgcagtgcgcggtccgcctccatgggattgggcaccatcgggg

SEQ ID NO: 92005 - DNA, 526 bp, Heterodera glycines
  SCN-specific regions: Sequence locations=1-449,471-526
tcagcttgtactcgcctgcctcccggtactcgaccacctccaacttgcggccgtccggctgcaaagactcgccgttgcggaaccactgcacgtcgggtggcggctgtcccggcttgccggcgcccagcacccgtacacacatttccgcagtctcgtgctcccggacgcgctgccgattcagcccgtccacaatgcgtgggcgttcaatgcccggctcagaggcgcgcacagtgcactcggacaccgcttggccaacactgttcttggccaccgcgcggtactgacgaaagtcgctctccaccacgtctttgatcaccatgcgccactgcgtgtgagttgcgtcgtgttggatggacacacgcgtgccggtcagaatgcggaaactgtcctgcacagtatggaactcgatggtcggctggggaatgccagtcacgctgcattccaacaccacctggccaccgatctgcgcttcctggtccgacagaatgcgtgtgaactgtggtgcttgggctgcaaaatttaaata

SEQ ID NO: 92006 - DNA, 651 bp, Heterodera glycines
  SCN-specific regions: Sequence locations=1-163,198-651
agctattaattttttatattgcttatgcttaattgagtttcactgttagactaatgaagacttccttaaaaaccaagaagaagcatctcataaatatttgagtacaaaagcggatctcaatcggtcatgaattttagcgcaaaatatgaaaaatcatttactgtaattttaacataattaattaaattttaaataatgtaacttcggatcattaaaataattattttgcttttaatttgatcactttcacttttcgtacttcgccactaattgcactttttcgtacttcgtctcagtacgacacgaagcatttaaataccgtaaattttaaaaatatcattaaaaatggaaatgaattttcgaatattgaccatatatttataaaaatggaaagaggatcagataaaaatgcaacagtctgaaaaaaacaaaatgttagtgaacaacggaatcgaacccgcgctttaacacaatgcgtattacgcactaaccactgaactaccattgctcaaaatttcgacagcttaattattacctaaatcgaaacacgtgaccatttcatacaaattaccttccagcttctcgctgcacaacttcgtccgcttcacgtcgcattgtgcgccgttcggcagtcgatggtcgccagccgaa

SEQ ID NO: 92007 - DNA, 665 bp, Heterodera glycines
  SCN-specific regions: Sequence locations=1-177,203-665
agcagcgctcgttgaccagcagctcttgcgttattcaaattaatgctttaacaaccaaatccgaagcaataaacaccaaaacaacaacaacaatcaaacaacaattttttgttgttcggtcattcaccaacaaatacataatttttttaattgcgtaaatccgtgcatcgcaaattgtgcaaaaaagaagaaaaatttgaggaccgaccacaattttgcgttttatcttgcggcctttgttagcaaaatgctgtcacctgaccaattgcctgacgaggtacgagggatgctaaagccgttcatcatttccaaggagcgtttggtgaaaatcagcgaggacattgagacggaattgaggcagggcctccaggaaggggccaccaccaacggacgcacttccattccgatgctcccttcctatcttccagcccttccggatggaacggagaccggaaaatacgttgccatcgatctgagcggcaaaaaccttcgcattctcatgctgacactgcagggcaaagacaaagagccgataattgccactaataatttcgttgtcccttatccgatcatgaagggcagcggagagcagctattcaatttcattgtcaactgtcttcaaaagttccttcgcgagtttcacttggaggaggccaacctgccca

SEQ ID NO: 92008 - DNA, 306 bp, Heterodera glycines
  SCN-specific regions: Sequence locations=1-84,106-306
ttcttgactttttaatttttttatttcttgcggctagtatcttctacaataatttgtcagtttggtcggatgtgcgtcaaacggaaaaaataattaaaattttttgggggaggttgtctgacgggccatgaaactcacatcgccaaaatttcttaagtccatctgcgctcaattggtcgaaaacatagagtgcgccgtcatgttctaacttaactttgtttcgttttgttttaattttttgctgctggtccatattatataatttaaatagccttaatttagtttataaactcattaaattataaa

SEQ ID NO: 92009 - DNA, 649 bp, Heterodera glycines
  SCN-specific regions: Sequence locations=1-197,219-418,440-443,465 -551,573-649
ctttactgacaaatgagttaaagacttctaattgagatgttcatgttgataacatgagaaatttcggtttgtcttctgatcagcgtccattgatttggagccgaacagacagaaggttttcacacaacagtctcgacccaaatgaagatcccgtcagtggaatagagcgagtttcgtccacatcgacccttttttcaagacgaaggagagaagaacggctgcgagaacaagaggaagtgcggagacggcaatttagtggcagtcggaaactttctgatggcgcatcggaacatacactttccgagaaatatgaaagtctcgactatgaattaatcgagaacgaactttatcgtgctgctgaaaaggataaagggcatcagcgaaaattgttccgacaaacggtcgaccgatggatcgtttgttttttgattggtgttgcaaccgcttcagttgcagcattcattgacgtgctcgtttattacaattcaaagctaaaattccacctcatcatcaacaatttaattcactcttgtgaggagggcagtgtcggcagttcgggttgtacgtggacaattctttgggtttgggcattatacaattgcgctttggttgccgtggcatcgtttttggttatcgttgtctccccagt

SEQ ID NO: 92010 - DNA, 634 bp, Heterodera glycines
  SCN-specific regions: Sequence locations=1-232,255-365,388-634
ggcgcctattggcaccgccgtacccccccccccctctcccccacaaaaaagctttaaataaatacaccgcaaaaaaaagcggtgtgaaaaataaaataaaaatatcctcgataattggctcagaatcgcaaaaatcggcctttttggacaaaatctattgataaattgtattcaaattttcccaggcggcgcttgtcgtcaccccggtgccgcaaaaaaatctgttcgaaaagcatgaaaatttgttttttaatttatagaaagaagtctcagtctcaggaattttcggtctcgaacagcctaattttgatcatgattttttgttacaaataatttttaccacccattaaaattttgatagggaagaaaattattttctcaaaaacttcgtgcttcgagctttgaaaacttcgggtttttggggcttcgaacttcgtgctttgaaaaaaattgggcttcgccttcggcttcgagtgctaagccgagcttcgcccgtccctcgcatttccttcttcatacttcaaaatctgaaagagattttaagtgttttttgtcacctaaattattatttctaatcagtcatttcagtccataatttgacccaaagtgctttccgacaaaaaaataatacatt

SEQ ID NO: 92011 - DNA, 646 bp, Heterodera glycines
  SCN-specific regions: Sequence locations=1-646
ctcaatatttgcactttaattagccggacaattggcaattaacatgcacaatgcgattagacgagcagatccctccggcgattatgagcttctgcagagagtcggtagtggttcctatggagaagtgttcaaagcccgtgatgtccgctcgggagaattcgctgccataaaaatcgtcaaattggagacgggcgacaacttcgcagacattcagcaagaaattctcgtgctcaaagaatgcgtacatccaaacatcatttcgtattatggcagctatttgaagcgcgacagactttggattgtgatggaatattgcagtggcggctctctgcaggacatttacgaaatgatcggacctttggcagaactgcaaatcgctttcatttgccgagagacattgcacggccttaagtatttgcaccaaagagggaagatccatcgcgacgttaaaggggcgaacatccttttgacgcacaatggcgacgtcaaattggcagactttggaatcgcggcacaaattactgcaacgattgggaaacggaagtcgttcatcggttcaccctattggatggcgccggaggttgcaaacgtcgaacgcagcggtggctacggctcggagtgcgacgtttgggctgtgggaattacg

SEQ ID NO: 92012 - DNA, 648 bp, Heterodera glycines
  SCN-specific regions: Sequence locations=1-648
aaaagataggccactgtttttatgacttcgccaaattccgcttttcgccatgagagtccggaagacgtcgttttcgacctgttcaaattgcctaaccgtgacgaagcgtcgattggcaaattgatttcagttttacgcggctttggccttcagccggacgacccgcggctgcgcggcacaatggacaaaatgcgcgaggcggagggcacacacgcggaagaacacagcgacgcatggcgtcacatgatccgcgagcagttcaaaacctgtgttcatccgtgcattgcactgattacgcgtgccattcgcaatcagttgatcattccgaattggacggaattcacaggaaaagtccgagaactttttgaggagtgccatgcagaaactggtggccaagtggccacttacattccccaattggcacgtgccgacccggaaaagtggggaatggccatttgcacaatcgatggccaacagttttctttgggcgattcgctggcaccgttctgttttcagtccgtctcaaaggcgttcaattacgccatcgttgcctccgatttgggtgattatgtgcactctttcgtcggccacgaaccgtccggtcgattgttcaacgaaatttgtttggacccaaacggaaaaccgcac

SEQ ID NO: 92013 - DNA, 632 bp, Heterodera glycines
  SCN-specific regions: Sequence locations=1-632
aatgtcggaagcagctatttctctgaaaactaaggcgatgcaggaagaagctgaaaaaaatgaacagaatttcgaatttgtatgtgagaatgatggctttcgctattacaaagatgtcaaaaccggtcgccagtgttgtttggactctgccggtttttggtacattctcaacgaagaaaaaggagcttttgagccaatggcatcgaattttgtggcagagaagctagccgaaaagccaaggcggaagcaggacaaaatgcagagcattctgaagaatgtggagcggttcgggatcagatttgaccagcatggaaagccggtgtttccgaagaacgaaaagggtcatttcattttgccaaaggatgagaaagggtcgcccttcttccccgttgatgatcgaacagtgcctatttttccatgggaccacgagaaaggaatgccaacatttcctgtcgatgacacggatgagccaattttccctagaaatgatcagaataagccgattgtgccggtggatgaaaatgatcaaccaatctttcctgtcgacaaaacgggaactttcatttttccggtggatgagtcaaactgtccgatccccgcgctcactgtctatggcacgcgtgttgtaccga

SEQ ID NO: 92014 - DNA, 639 bp, Heterodera glycines
  SCN-specific regions: Sequence locations=1-275,297-639
tttatgcctcacaaataattttggtgtgtagctttaaaaattctacgggcccactgttgatttaaaaaaaaattcaatttttggccccaaaacggaaagtacctattacccacttatcccttactttttttttgctttagattagacctgtcttcgttacatatttcgcataccaattgatgtccgcctttctaaggcggagaatgcgcggtttactccgtacgacattctctgctgcgaattcgaccgacacggtcagttcgtttggtggcaccgatgagcagcagcaacaacaattccagtgtgacgaagtggaggaggaactgatgcttatgatgaagctcaacgggcacaaaaatggcgtgggtccttcttctgagtccgctacggtttacgagcagattttgaatggaaagaatgggcggagagttgaaaatgaaccagaagtttattcggtgggaatagcactgcaaactgacagaaagcataatggacaaagaattgactcattcagggcaaaacggggttggatttgccgacgatacatttggataaatttgaaacggaagtgaaagcttgtcacacagggcccgacggaggactcacaaaagttcaacccatacgacaaagagccatcgc

SEQ ID NO: 92015 - DNA, 654 bp, Heterodera glycines
  SCN-specific regions: Sequence locations=1-46,68-143,167-654
attaattgttacctattttactaatctccatttgaatatggacgaatcttacaaaaatgttcattatggttattggatacgaaacctccatttactccaagaaaacgctccaataccacggccagtcccgtgctattgccgtttgaaagtaaagccaaattattatggtcttgaataccatggaccaatttcgcgcgttgaaactgaaagggtgttatattttcccactcaatcgtttaaatttttagaattactaaaatttagttacttctggaattcggagaaggtgcttttttggttcgcgaatcccatcgttgtgccaatgccttcactttatcgatgaattttgagaacagtgtgctcaattacaaactcttctacgacgcattgtgcggcaaccattatgttggcgaaaaaaggtttgactccattttcgagctggtccaagatggtctgatctgtatgtacgtggaaaagcatgcgagtgattacattgaccaaatggccgattcggcggagtacgaattgagtccctattccttttacggctcatttgtggccgggcagaatttcgtgtcacaaacgcacccccgtgggcacaattggcagatttttacctttaaaataccgacctattgcgacttttgcaggaat

SEQ ID NO: 92016 - DNA, 642 bp, Heterodera glycines
  SCN-specific regions: Sequence locations=1-124,147-173,212-254,295-642
ctttctctcacagacaccgattccttttggcatcacaaacataaaatgctaatggatcaaattatatcggatactttgtgccctaggcaatataaaaggagggccgaatccacacaaatcagtcagaaaaataaaattaggttgggggaaatgacgcttcacaacgtttgctcttttaaattattcaaaatatgaataaaatttaaaaaatgtaagacttttgtacattttttttattctccaacaattctcagtaattaaaaatatttgttgttaattattttaaaattttatccaaaggactccatcaccccaatagttgttaaacgatgcttctcaactgctatttttcatcttaattatatgcggaaaagtctccacccgaacattttgaaaaatttaatttttgcatcagaatttgaggattttattatgcgtaaaatttgtttgaaaattttcgtgtgtttttctttcttttcgttcggtttttaattttcgtgaaaaataaatatttcgttccttttgaaaagcatttttttttttggtttttgcacaccatggtacgggttggtgcggttgctggttcgaaacatgccggatttttttggcattagggcagcgaaaaaactataaatttgcaca

SEQ ID NO: 92017 - DNA, 553 bp, Heterodera glycines
  SCN-specific regions: Sequence locations=1-223,245-553
aattccatcgccaattcgtttcgggccaacaaattgcgtcgatcaccaccatcccagcaaatgcatgtctgttcgtttcgatcattgacactgttgctgacgatggaggacaaatggcgagggcggacgaaaacggcacaaaaacaacggtttttttggaaaagcatcgcattgaaggcactttgttccgccaacacttagccatcagtggaggcaaaaaccatttggattcaaacatttacggcccaagccaaaatcgaacatttgcggcttcgcacataacatgaatctacgggtcttattcattcgttctgatgcggtgtttgacttgcacggacatttgggcgccgtcgaccgttggctgctgggcgcggcggtggtggtcacgccacggccggctgctcacgcggcaatgcgccgcagtgagcagcgcctgcttccgctccatttgaatgtgccggcgccgagcgtcgaccgttggcgcgagttgccccctctgttgccggtgatgcgaaaatactttgtccgtttggtggccaatccggcactgctc

SEQ ID NO: 92018 - DNA, 639 bp, Heterodera glycines
  SCN-specific regions: Sequence locations=1-103,125-150,172-240,262-639
cagcatggaggaagtgcgacgccatgggaaagacgctgacagaatttgggtcattttccaccagggggtttacgatgtaacagaattcattgcaaatcatccgggtggcgacagaattctgctggcggcgggggcctcaattgaacctttttggacagtttatcctcaacataagacggacgaagtgatggaaatattggaggaaatgcgaattggatcgttaaggcttgaagatctccaggaaattgaaacccagcaaaaagatgctccgtcgggtgatccttttgctgccgacccgcctagacatcccgcattgatcgtcaacatgcaaaagccatttaacgcggaaactcccccgtcgttgctgatcgacagttttctgacacccaaagaactgttcttcgtccgaaaccacatggctgtccctcggacaaatgaagaaacgcacaaagtgcgcatcgatgggattggtgtggataagcaaattgtactttcgcttgaccaattgcgcaacaatttcgagcccgtttcaattgtttccgccattcagtgcgcaggaaatcgtcgatccgacatgaatgaattcaagaaagttcaaggcttaatgtggacaggaactgcgattagcaacgcacgatg

SEQ ID NO: 92019 - DNA, 651 bp, Heterodera glycines
  SCN-specific regions: Sequence locations=1-14,44-432,457-459,496-651
gtttgagctatacacccgcccccgccgcctccggcgcggcgccaccggtgcctggggatgatgatgaagtggaagaggaatgagcccgcatttgagcggccgctcgaagaatggcgggagcgccgcaaccaacacgcgcaaaacacaattcacccgcctccggcgccaccgcaggaggaggaggaggagcactgggcccaggcatggcctgaggaggaggaggtggcaaagattagcaacgaggaaatggacgatgaagagggaaaattggcgcctgaatctgaattggactatgacgaactaaaccgaggggatttctacctaatcggaggtgtccatgacccgatcaatcttcgttttgaggctgcgatttgcgcgagatgatgcggaacgtgtggcgccgcattgacccttcgaaacgtgccatgttcggcggtggccgctcggccggggtgccttcgcacggcggaggagcgcgtggcgggcgcggcggtggaaacttggccgaaaaatgaccaacgggaaaggacggtttaatttatctgatacatggcatttatattgagcctgcaattgtttcgttgctttatcctttttgaattgattgtctgtttttgatttttaaaaactcagattttttaaaaaaaaaaa

SEQ ID NO: 92020 - DNA, 433 bp, Heterodera glycines
  SCN-specific regions: Sequence locations=1-433
ctcagtcggcactttctcttttccctcacaattttgcatctgttcgccccccttttcgtcgcttctgccctcaatttttactttcttgtgattatttttgtgcgcactatcattgaggacggatcaccgaagcgggcgatcgcaggaaatgcgttacattttttccgggtcacaatggttgcattatttgaaatgattttatgccataaattgcaagatgaattcgagcggggcaatcagcagatatccatcgaaacgacttattttatgattatgatgcccttatgggctctcctcattgctttgtcagtccatgcatgtcgactattttagcaagaaaatgagtaccaaatatttattcgttttacaatttatttcttattctatatatatgtatatgcttattattttttgtataaattagtgaaatgcc

SEQ ID NO: 92021 - DNA, 658 bp, Heterodera glycines
  SCN-specific regions: Sequence locations=1-510,532-658
caaatatggaatttcgaaaaaattctcatatgataaatactacatatacccaccatgggcagtggataaaattcaaattgaatccgttgggagaatggaactcaaagcatttaaaatcaaccatacaaatgccaatataacggaggaggagtgggccaatgttcggcactttgtccgagtggttgacaaggaaaatggccgactgttaagcaaagatgaacagatcaatgtgaaaatcccgaacaaaccggacggatcgcttaaattttgggtttatttgctgtacgaaggcctgcgatggcatccgttcattggtaaaacggccatgaagatgatttttgagggcacaaatgtactgtattttagcagctataatagtatatggcacgaaaagaattttacgctgggcaatttgaaaaactgtaacatcacagagcagttgggcaagtcaaatataacggaattcaacattggcattcacgtcatggacaatgccggcaaatacaatgtgacatttgacacgggtggcaaagtgacagagtgccaatacgaaaatccggaaatgccaccatggacagtgcaatacatcgcggttatacttaaaaatgaccctcagcagttaattaagccggaaatcagttgtattccgcaaaatcgt

SEQ ID NO: 92022 - DNA, 643 bp, Heterodera glycines
  SCN-specific regions: Sequence locations=1-298,320-330,352-643
ccgtcctttcttctgtcgtaattggtgaaattcagcagcagcaatcgccggattcatttgtgccaacatcttttgggaggcgacggcattgttgggtgtgcaacgatgtttggatggacattttgcccctttttgaccatgcccaactcggcctcaaattggcactgatttcgccacgtttcgatgttttagtggacgcccatttcaatggcaaaagcgaattgacaatttggagacaaatcacaattcaaaggttcaaaggaccaaaagcgaaactgtctgaatggatcgatgacaaatgggtggcatttcctttgccggaccgtccgctgcccaacaaaattcgttttaggaaccttcggattgagaaccccgaccattctgtgctcgcatttctccgtgccaatcagcaaatttttgaaaaagccaccaatttatgtttgtctgtttcttcatgcttccatgattgccttttttcattcgtcgacaataatgtccagccgatttgggatgtttttgcctgtgaaatttggccgatttttgcgccaaacattcgccgctttaactttcgcgatggtgatcatttggacaatttgcgtcgccgcatttcgcccacaattctcaccgatctcaacaaccttag

SEQ ID NO: 92023 - DNA, 375 bp, Heterodera glycines
  SCN-specific regions: Sequence locations=1-23,45-269,294-327
gaacaaatgcaaagcgtttcttccgctgctgctgctgatggccgttcattgagtacgaaagcgggcgcaagcggcgccaatggggaggaaatgggagaaacgccgaaggggcggagacggaaggggacaaaatgaagcgaaaggcaaacaatgaaaggcgaagaaacacatctaattaatgaacacggcgtccggaaactgagctgctgtaccataaaagatttgtgtgtggcgaagtggtctgtgagaaggtcaccaaagggggggtgggtcccaggttcgattcccagtgcatgctattgatgtatttcgatgattttaatgaataaataaaaggaaaagtgaaaaaaaaaaaaaaaaaaaaaaaaaaaaaaa

SEQ ID NO: 92024 - DNA, 268 bp, Heterodera glycines
  SCN-specific regions: Sequence locations=1-214,239-268
tgtcggggctccagccaaagtgaactttaaattgatcatagcttaaattcgaataaattataccaaaagtggtttaatttaattgcacattaaagatgttacacatatacgaatttggtcaaaactaccttagtatgctggcggttttatgaaacgacattttcaattagcacgctctttcaaagcgattgacccccttccctccccccttttcaataattttattattttttttattcgcaccttccaaaattttataacaccaatg

SEQ ID NO: 92025 - DNA, 378 bp, Heterodera glycines
  SCN-specific regions: Sequence locations=1-378
cgacaaaccaactgaaaatgtgccaaatttttgacgccgaagggcgaaacccgcggaaagacagcgaaagccatgcgcccatttccaccacttattttgcgagtgattccgctggatttgcttcgcctgcggagcacaaagaaggcggagaagacgactcaggactgtccctgacggaggaagaagagaaaatgccggaacagagccgaaaagcgtcttcctcctccgccattcccacctttttggtctagtcgtcgtcctccgtccgtcggaaggacgcgtccgccgtccgtcccttcacctccgttcatccgccgcgttccttcccccaaaaattggccatttccgccacggccaaatcgccgttgagtgtcctgc

SEQ ID NO: 92026 - DNA, 432 bp, Heterodera glycines
  SCN-specific regions: Sequence locations=1-398,420-432
atttgagcctgaggccccagcccaattcgattcccaagaaattgtttgaattggtcggatttgccacctttgttcaatttgtcgttgtgctggtatccaacattgcaaagctggtcaaaaaagcgacagaaaagcattcattggcacaaagtgaaggcaatcggcagcaaaaatcgggcaaaaatggattttcctgcaaaatttgctcttcccaaattgccttcggccaaatgcgtcgctccgtctgtttgccctgcggtcactgcctctgttccgattgtctgctcactctctcctcgaaagacttgtccaacgacacttcttcggtcgaatgccccttttgtcgcatcaaatgcccctcaaatcgaattgtgttccctttgaatttgtaattggtcaatttgcttttcaactgagctgaaaatacatgaa

SEQ ID NO: 92027 - DNA, 151 bp, Heterodera glycines
  SCN-specific regions: Sequence locations=1-151
ccctgaactctctgacgtcctcctcagattgcaccgactcggacgcacgtccttccggaagctgaaggataagcgcgactaccgacgacggcgtcgcttctgctcgtggctttacctctccaggttggccgccgccaaagagattccgttt

SEQ ID NO: 92028 - DNA, 646 bp, Heterodera glycines
  SCN-specific regions: Sequence locations=1-646
tgaaaggccccaattgtcgtgctgtctcctgcaccaaaaactccaaatgattaacttttgcatttcggtgaagaaacgaaagcacaaagaaatggaagcgaacgaaacggagaatttgggcggaagtgccaaagatttgccagcaaatcgaaacactgcggacgacgagtttttcgatgcgattgaatcattcgatcaatttgacgtcgccatttcgtcggagtgccctcgggggagaagccttccactcgattcgaatgaatttttaaagagcaatccaaaccaacgaatttttgttccttttactcaggaggagggcccaatgacggaagaccaaattgagcagagagagtcctttctgtgcaatttggaggacgccaatttgaggacgaaggcgcagtccgagctgttgttgtccgacatgcaagcattcaaagccgcaaatccgggctgtgaattggtggattttttgagatggcattcgccaagggatctgacggaagaaggcgaactctctgatcggatgaaaattgctgggaatttttggcaagagacttgggactcggcccgtgcgattcccgcgacgcagcagcaacgcctcttcaacgagacgcgagaagttgagcaaattcttcaatatttcgcg

SEQ ID NO: 92029 - DNA, 411 bp, Heterodera glycines
  SCN-specific regions: Sequence locations=1-411
cccgcagacgccttgagagcaagtgcacccgcctccatgcatttttttttctggcggacagcgcgggaacaatgggccacctggacccccgggagcgccaggagcacccgggcagcccggcaccggaggaggacagccggaacccggagagcccggcgcacctggacccaatggccagcctggacaagccggagagcccggagcgcctggacggcccggacaacgcgaaaacccacggccaacggagacagcccctgcaggcccacacgggagaggctggtgcaccgggacagcccgggtcaggatgggagcccagggaaagataggcggggccgggtaggcagggcagaaaaggactgccgggaagcagcggacaggccaggaattggcgaaagcccagggccacccggg

SEQ ID NO: 92030 - DNA, 631 bp, Heterodera glycines
  SCN-specific regions: Sequence locations=1-5,28-60,82-400,422-631
caattaagcattataatttataatattttctttgcctgtactgataaatgtgtttcggtcgaaaggagaagaaaaagcggccaaattcgcctgcttacgacaaaaaacccgtccatccttctgccgcgggtgtcgtcgtttctcccactccaatcgcgccctcgggcccttcttcggctgttccgccttcgcttgttcctcgtactgctccaacttctgctgctccgagcgcgccgaacaaaaaagccgacctaggcaaagctgtcgtccgtccttcgcgtcctccgggctcgaccaaaccactcaaatcaaccgcaaccacgccggtgggccttccgcatccgaaaaagggcgttagcgcgggaatagatgttccatcttctccgtattcagcggatccaattgattgtgcaaaaacaggcaaatggaaagctgtttctcgtcctccgccgccgtcgtcgggcaaaaaaacggatgcaaaaaccaaagctgtctctcgtcctccgccaccaccggccaagaaaacacataaaggcaaagtcgttactccgccgcatcgtcctccgccttcggataagaaaccattcgtcaaagccaaaactctttcgcctcgttttccgtcactgttcac

SEQ ID NO: 92031 - DNA, 639 bp, Heterodera glycines
  SCN-specific regions: Sequence locations=1-70,92-155,196-573,595-639
cgccgactggcgaagaattggcacaaatcttgctcaaggaggactgcagcaatttgcaaaataagctcgtccatgggcaatggattaatgttttgtaccgacgattgaatgatcaggatgttgagaactcgcaatcaaaaattaacaataagaccaacaaatggatttgtcccttttgcaaacgcgacaatttctcgactcctgacttggtcaatgagcacacgcgccgtggcgattgtcccgtttctccgattggaattcgtgttaaacttgacaacggactcaccggacttgttcccatgaaattttttagcagcgaccaaaacaaaacgttcatggacccaaccaaatttttcaagcctggccaatcgcaatattttcgaatcatcaattttaaccccgaacgtatccaatgcgacctttcgtgtcgctcggaggatttgaagggcgacgagcaacagcaaaagttcgacccgtattttgaccacgtgcaaatggaatctgttcaaaaagcgaagaaaatcaaaaaggcccaaaaggacgatgaaaacaaaaatcgaagaattttccaatatgaatattttgcaaattatacggatgagaaggcagcggctgcaattcgccggatgaaacagggcg

SEQ ID NO: 92032 - DNA, 654 bp, Heterodera glycines
  SCN-specific regions: Sequence locations=1-654
gtccaattaagcattttatggaggaaagcgagaggataattttgtgcagggaaagggaatgtgctcggcgtggcatcgccgttcctccgctttttgtggctgctccgatggtccgttattcgaaacttccctttcggcgattggtttctttgtacggctgcgacttttcctacacgccgatgatttacgctgactgtttcatcaaatcggagaagtgtcgacaggtcgaattcgtaccgtccccttttgatttgccaattgtgcaatttgcggccaaaagggcggaagaatttgcgagcgccgctcaactcgtttatggacattgccgcggaatcgacttgaactgtggctgccccaaaagtgatgtgcgctcggacggatacggctcaaaactcttggaagacccgcaattagtggccgatattgtgcgacagtgccgcgcttccatcgccgatcccgactttaccatttccatcaaaattcgcattcaatacccaatggaaaggacagtcgatttgtgcagaaaagtggagcgtgccggtgtttctcacatcgctgtccatgccagaactgtcagtcagcggtcggagccgccggattatgcggcggtggcactgctgaagcaatgcttgcaagtgccaattttcgctaacg

SEQ ID NO: 92033 - DNA, 497 bp, Heterodera glycines
  SCN-specific regions: Sequence locations=1-475
tctccaatccgtcctttcgaattctgttcaaaaggctttcagacaatcattgtcgcctttccctctcctcccaaatgcacaccgtcgtcccaacgacaagtgattgtgcaacgaatgttcaaaagtcgtcagtgattgggcccatcggacagccaatcgctgcgcccgaatcagtcaaaggaattggcctcaccgacggcggcggggcggcaacggaggcgacgtctgcacggataaagcaatttcccactcctccgtctcgtgacctttgctgtggttcgggctgtccaaactgcgtttggattcaatttgctgacgaagtgatggattatgtgaagagtttgcctttgcacgacggagtggaaaaacagcagaagaaaatggtcggagatgcattaaatcaaaacgttgaggacaaaaattagcgcgtttatttgttaatggaaatacaggccaagggattttaaacgaaggcaaaaataaaaatattattctgt

SEQ ID NO: 92034 - DNA, 616 bp, Heterodera glycines
  SCN-specific regions: Sequence locations=1-509,532-616
acaaaattaaaaaacgggcgcgaagcgcccgtcctgaggccgcgaagcggccgaatgttcccgacaaaattaaaaaacgggcgcgaagcgcccgtcctgaggcagcgaagcgtccgaatgttccccacaaaattaaaaaacgggcgcgaagcgcccgtcctgaggccgcgaagcggccgaatgtcccccaaaaaattaaaaaacgggcgcgaagcgcccgtcctgaggccgcgaagcggccgaacgtcccccaaaaaattaaaaaacgggcgcgaagcgcccgtactgaggccgcgaagcggccgaatatcccccaaaaaattaaaaacgggcgcgaagcgcccgtcctgaggccgcgaagcggccgaatatcccccaaaaaattaaaaacgggcgcgaagcgcccgtcctgaggctgcgatgaattgctaaattacatcaatttctagcgacgcggcgaagccgcgtccctgagcgcgaagcgctttccccacagcaacagaactcaattgataatgttttgtatgttttaaaataacaaatgaaggccatatattaccaagccacgcatgcacaccatagccaactggtcaccctagttatatatacgttatat

SEQ ID NO: 92035 - DNA, 397 bp, Heterodera glycines
  SCN-specific regions: Sequence locations=1-117,139-397
ctgtctccatcctccgaatggcccgtacggccactttgtacatggctttgcccatgggggcgcaggacagtccgtacaccctgtccacgctgacaaacctgcctctccttgccttggccagattatgccctgcccactgtgcgaagctggtccaagcggccgcccggaaggacagtgaccaccctgtcagcaaagagatcctggacgaccgagtacgcccgctcgttgtggatgagatcgagacgctattgccggcggacccccaagacaggcaggacacgtcggaagcttaggatccgctagaccagccagacatcctgctagtgagggatgtgtctcacgccctacgcctggtccgattggaccgtctggaacgcctggacgcaccggaaacgct

SEQ ID NO: 92036 - DNA, 647 bp, Heterodera glycines
  SCN-specific regions: Sequence locations=1-647
gtttcatggcatcaatagcaaactcaacaaagctcacaattggctcatttaaaactgtgccacggatgatttctccttttgttacgcgatttggtgtcggtggtttctgtgctccaaatttggcaattgccaatttgacagtgaggaaaagcttcgcgagctgcgcttttcccccggctgaatgtgaagacgttgactacgcttttgaaatgatgagctcaactttgcgctgtggcaacggcgtgaccagcgaaattggcttcgatgtgcaaaatttgggctccaaaaatgcactaattgtaacagacaaaaatgtcaccaaaacgagggcatttaaggaagtcgccgcttcgttcgcccgtctccgtttgtctttcgctgtgttcgatgaagtcaaatgcgaaccatcgcaacaaagcattcaaaaggcaattgattttgcccgagcgaaaagttacgattgttttgtggcggtcggtggcggatcagtgattgacacggcgaaggtcgccgctctgtacgcgagcaattgtgagtccgactttttggattttgtgcagaaacccatcggcaaaggaatgattccgaagcatccgatgctgccccttattgctattccgactacggcaggcaccggcagtgaaacg

SEQ ID NO: 92037 - DNA, 654 bp, Heterodera glycines
  SCN-specific regions: Sequence locations=1-18,41-654
gttgtttcacagtcacttcctcgcgcctcccctccccccgtttctgtccatcccattgccccacttcgattgactctgatgcccatttatggtccccctcccccttattctgagactgtttcccgctctgctgctacagtgccatcatcactggacgaaatccaatctcaggcaccgatttggacagttcatcgaccggaatccatcgaaattgtctggcccccgagctatgcggagagtcagcggattagtagcatttcggcgggtggccgtgccttacggtggaattcgcagcggcactccttgggcagctgcgaagttaactccgccacgtcaatccgtggcgttttgcacttgccgtcctccttctttcgaccaccgttgggtggaccacccaataataataggccaatcagcgactgtgccttggcctttcccacagaaataacagtgggaaggtcgacggcaccaatgccgacggagggcaccgccgccgcgggagagacgcgctttgcgaatccatgggcggacagagtccgcgacgttttcctctccctgctgacgcgcattttgctcatctttctgttcattgtgttcaccaggattttgattgcgcagctgtcaccaaatgaggagtaaaaggtgccggtgatt

SEQ ID NO: 92038 - DNA, 558 bp, Heterodera glycines
  SCN-specific regions: Sequence locations=302-558
tcatgccaaagcaatgccaaggacatctggtcagaagtgagtcagctgaagggtctgccgttgatcgtcagcggaaaccgtacggcacgtcaagtgtacggtggcagcggcggctacggaagctgccaagactgttgctcaggcggaggacccggcccggctggcccgcccggacagcccggacgccccggaaaccctggagctcccggatcgcccggacagcccggacactccgtccagactccctgtgagcaagtgcacccgccaccatgcacaccttgccccggcggtcagcccggaaaccccggccccccgggaccccccggacagtccggagcacctggccagcccggcagtggaggaggagccccgcaacccggagagcccggaccgcaaggaccccctggccagcccggagcacccggacagcctggagcacctggacaacccggacagcccgcaacttctcaggaagctggacctgctcctcctggcccaccaggagaggctggtgcccccggacagcccggtcagcctggagcccccggtcagcccggc

SEQ ID NO: 92039 - DNA, 487 bp, Heterodera glycines
  SCN-specific regions: Sequence locations=1-487
ctcggttttcaccagtgatgacgaggaacgtctgacgaaggaagtgttcgaaggtgacaattcgctgaaccttccgcttcacagtgattcacaaccgatcactgaccgcatgacacttcaaacggagctgcagatcactgtggatgatgacgatcagataatgcacacaagtgtttagcacacattgttctggaaagaccttcaaatggcgtggagtcccgacaattacataggcgtcgaacagcttcgcgtgtctccagacaaagagcagtataacgttgacgaccgcaattaccaactgccttactggtccgatgtgatcatcaactaccttgacaatgtggtgacagtccctccagacgtgtacaaaagtacctgcattaacgacgaggaatacttctctgtcgacgaaaaagtttgccatttcgtgttcgactcgtgcacataccaccaaaatcaacctaccatggaatttgcacacgccgac

SEQ ID NO: 92040 - DNA, 433 bp, Heterodera glycines
  SCN-specific regions: Sequence locations=1-398,420-433
agacggcgctaagtgaggaattgaatgatcaggaaatacttttaattagtacacgtgaagctctacattgtttctactgccaaaaatcggaagttgcaacaccaacagaagttttgataagaaaagatggcacaggaattacaagaaggcggttccataatttgttgatgctcggccgggacgaacatttattcgaaattgagtttgcgctgactgcgaccattggtgaaaaaatgatattcggccagaacttcgatgggtgcaaaagtgacattgaacaggcaacaagtactctcaaattaattctggaagaagatggcttgaaaaattttggaagcatgatcgacacaaccgtatttctttttttgcgttggaaacagacaaaaaaacaattatttggcatttaattcaaaaaatttgcagaaaaaggatc

SEQ ID NO: 92041 - DNA, 652 bp, Heterodera glycines
  SCN-specific regions: Sequence locations=1-652
caaaataatcgatgtgttcagacgactgacacttcaagcacgccatggccaatgccaccgacggatgtgacaacaccaaatccaattcggccagtacaatcctgttacaatgagcacgaatgctgttctgtatggtcacaaaagggtgaatgtcaacgcaatccgggcttcatgaattcctggtgtaaggccagctgtcagcaatgtcaacctgactatgatctttaccaagaatgtgatgatcgtcatccgaattgccaaagttggaccagccaagggcaatgccaacagaacaaattttggatggcagaaaattgtcgtcaatcatgtggaaaatgccgcgtttcacgtcaacaggtgtgcagcggagggcgcgacagtcagcaaaatcaggatcgcattactttggcaccaccaaagaacagatgcacttcgccaagttgccacaatgaaaatatttgttgccagctttggggcttggccggcgaatgccatcgaaatccgacatggatgggctgtttttgcaaagtcagctgtggtcgatgtattccgcaagactacgattttggcggctgttccgattatcaccagcggtgccgtttgtgggcccagcaaggtgaatgtgggcgaaatgcgtggatgttggaaaatt

SEQ ID NO: 92042 - DNA, 624 bp, Heterodera glycines
  SCN-specific regions: Sequence locations=1-69,91-380,402-422,445-624
tgttccggcgcctgacatgggaacgggagaacgagaaatggcttgtattgctgatacgtatgctccaactgtgggacacactgacaaggaagcatcggcttgtgtcacgggaaagcctattgttgctggcggtattcatggacgtgtttcgacaacaggacgaggactctggaagggcttggctgttttcatcaatgatgaaaagttcatgactaaacttggccttaccactggcttcaagggaaatacattcatcgtccaacgattcagtaacgtccgcttgcactcccaccgttatttgcacatagatggtgcaatttacatcgtagtacatcaatatgactgcgcaatttacaatcctaatggaatccatcccaaagatcttgatgataggaaaatagcaaatggatcaattcgcggctatcctggagccaaggatttgaagccattcaccaacttcatattcgagaactgctacatccttgtgccggccgcttgcgagaaagctattctcttgtggaatgcacatcgtatacaaccaaatgtcattgctgaaacggacaacagaccgacaactccggatgctgatgcaattttgatgaacagaggcgactgtcttattgt

SEQ ID NO: 92043 - DNA, 637 bp, Heterodera glycines
  SCN-specific regions: Sequence locations=1-637
atttgctttaattatattcatgaaaaaaatcgaaaatgctacttctgttgcatcgaagttaacagaactttggtgcgaaattttctcacggcccccgccagaaaatacaaacaaattatgggaagaatataacaaaatcaacagcgagctgcagctgttgaaacttgttcgttgcgatcaatttcaaagacaaagtcggcttgagcaaatcccttctttcatgaattggtgtgtggaaatgggaattcggcattcgggcttggatattttgtgttcaccccacggactttgccttagtgctacagaacctcttgaagagggagcaattgttgccgaagtccctttatcggccattttttcgacggacgtagctgagaatattgtttccctcaagcacattttacaagataaattgcttcaaagcatggagaatgttgctttggcaatttgtgtggctcatgaagttctgcgtgggtcggaaagtcaatgggcagcttatttcactacgttaccatcgaccttcccaactccacttttctacagcgaagagcaattaactgcattgaaaccgtcgccggtatttgaggagtctctgcggatgcatcgtgccattgcccggcaatttgtctatttttac

SEQ ID NO: 92044 - DNA, 124 bp, Heterodera glycines
  SCN-specific regions: Sequence locations=1-124
attttgtcgcttccaaaagtgtctcaaagaaggaatggtgcttgaggcagtgcgcgaagatcgaatgcccgggggccgcaatgggtcggcaatttaccacatgcacaaacggagacatcgtaaa

SEQ ID NO: 92045 - DNA, 313 bp, Heterodera glycines
  SCN-specific regions: Sequence locations=1-313
taagtctgcgctgattgtcgacggagtggcacggggtttaaacgaagcggcacacactttggacaagcgtgacgcgcacttttgtgtgctggccaaaagctgtgacgaggcgtcctttgagaaattggtgcgctcattgtgcaaagagcacatcattccgattttggacgcggaggacaaacccgaactctttcttttttttggccagggacaatacgaccaagacggaaaagcgcgcaaaaccctcggctgatcggtggcggtggtcaaaaactaccgacgggaccaagaggcaaacaatgacttgcaggaa

SEQ ID NO: 92046 - DNA, 640 bp, Heterodera glycines
  SCN-specific regions: Sequence locations=1-166,188-640
atttcatcccgcactcgcctctctcttattctacgtcttattcaccaatttcgccccttaaagaacagcaacaagtgaaatgcgctgatccttccgtcgctgacctggggaagacaaacgttggttttgggccgacgaataaatcaattctgaagaatccgacgacacttttcttcaaggaacaacacaaaaaatttatgaaaagcaacgaaaatttagtcgactcggtcaaaaaggcaacggaaactacggcggcgcgaaaggaagcgctaaaaacagttgcatttggactgacaacacgccttgaagataccgttctggcgaataaatctgtgccgtcttcaagccgactcggcaaaactgtgattttctcccatgaagcgcaatctctgcataaaattatattggctcaacaaacagaaattgccgaactcagagggaagatcgaagaactgactgcgtcggatgatcgtcgtcgtggcgaggaacgtgaacaaaagaacacaattgccgagttggcctcgcgtttgggaatggtcgaaagggcattaacaaacatttcaaacaccggtcaaaaatgccatgaagagaatcgtgaaaatggcaaaccaaaagcctacaaatgcactggagcggacaa

SEQ ID NO: 92047 - DNA, 653 bp, Heterodera glycines
  SCN-specific regions: Sequence locations=1-7,29-402,424-475,497 -585,607-653
cagcaacaaaatcttttaaaattaatttattctatatggaagagcgtcgtcgccgtcaaaatgctctattgtcaaagttcaggaagcgcaccaagacggatttttcatcttcaccaacttcgagcagtatgcctgccaacgatggtgttctggcggagagcaatgtaacaaaaacggataatgattgtggagggagcgacgaggacattcaaattgtggagacggatgaacagcggaaaactcacgacgaattaagacaaaaggctgccgaagcactgatccgtgaggcgaaaaggtcggctcaacgtgcacaactttatggaccacaaggatggtaacaaaatttgattttcatatcgaattggaattgcacttcgcttcggtttaggataaagccgagagttctgaacacaaacaaagcatttttggccaggactctcaaatcagtggaaattcatcggagagaccaacagacggagaaagaagcgaagagagcgcggaaagtgagggaacagacgggggaatgacagagacgaacaaaaacaacagcaaagataggatcgggagaaagaacatatcatcgcctttttgtatatttttggtaaaaaagaacttcagaacgtacactgaaatctgtattttgatattgtgtc

SEQ ID NO: 92048 - DNA, 658 bp, Heterodera glycines
  SCN-specific regions: Sequence locations=1-447,469-658
ggcggaaatgtgcgttcgccagatgcaaagtgagggactgtcctttgaggaggcgtgtggccaaatttacatgatggacatcgacggactgatcaccacacagcgcaaaaacattgagccaaggcatttgccgttcgccaagaatttgcccgactcgcagtctctgcttgaggtcgttctgtcggttcggcccggcgcgctcatcggcgcttcgacggttcgtggcgcattcaccgacgacgtcattcgcacaatggccgagcacaacgcacgaccgatcattttcgcgctgtccaacccgaccagcaaggcggaatgcacggcggaggacgcctatcgagtgaccaatggcaccgcgctgttcgcctccggcagtccgttcaaaaatgtcgaattgggtggcaaagtgtacaaaccgggccagggcaacaacgcgtacattttccccggcattgccctcggcgtcattctgttcaaagtgtccaccattgacaacaaactgttccttatggctgcacggatggtcgccgagtcggtgaccgaaaagagtttggccgatggtcgcgtgtttccccggctcaaagaaattcgggagatttccatcagaatcgccatgagagttgcggaagagtgttaccgggacggcacggccaagctg

SEQ ID NO: 92049 - DNA, 418 bp, Heterodera glycines
  SCN-specific regions: Sequence locations=1-418
tctgttgggtatcatcttcacactcatgactctgccatcttggtactccgagatgacccctatcgaacccccgattgcacaaacggacctcataccttccgcggcagcatccaacttgggccgaactgacttgattgaccttctaatggtcctgaccccaacctcataaccacgtgatcacccattcgactgcttgttccgtgcgaatcctcaactgcccccacattgctagagcgcttgcctcccagaagcaagctctccccctggtaccccctgaccgtccagaccacctggacaccccagacagcctgcacccccatgaaaatccagagatcctagacagcctggataacccgctcctacatgttgcccatagattatcacctgcccacgatggcctcttcgtccgctcagccgc

SEQ ID NO: 92050 - DNA, 641 bp, Heterodera glycines
  SCN-specific regions: Sequence locations=1-641
tgatcacttactgtcaaatttacgttccgatcaggcgattttcaactgcttactacgcacactttcggcatttttgcaacgtccgtaccttcgcctatttcaaactttcgttggcgtacggcgatgatcgcgaaatgctttttgttttggcctggcgttggcagaaatattcgctttgcttcggacaggcgcctgtgcccgcggggagcgcgtgggacggacgaaaagcggcgcgacggcgttggaatccgcatgtgctcgtcactcagtcgctcacagaacgtttcaaccgcgacaaggacctgacttggctagttaattacctgatcaacacgcatcgttccctttgctcaatttacgatttcgcacgcacccaaatgcattccacgaaaacggcggcccaagtgcacggcacagaagccgcttttccggctgaactgatgtgccatctcagtgccttggatgagagtaccattcgtctctcatacggctctcggctggccatggaatttcttcttctggacgacaaccgcgtggctgtccgcgactgcagcgtcggttccgcgcgctctatcggcggcggcggtccttcgctggccgacttttggcatttttggcgacaaaaatgtgtgatggcatgt

SEQ ID NO: 92051 - DNA, 650 bp, Heterodera glycines
  SCN-specific regions: Sequence locations=1-118,165-246,268-442,465 -481,505-534,556-650
caaggattaccgtctgtatctgtacaaataccagcaaatcgggtagttctgatcagaatcgactaggaatgggcacagagcgtcggccgtcgtcttttgttttgcgaatgttcaaccatttgtttttactcctttttgttttttcttttttgtttgtttttgttgacattattaacttgaaccgcttgataaggctagcgcgatatttcggccgaattcgatcacattttgttttgccaccgtttgttatccctttctcccattggtccctctcttgtgcccagtgtaaatttgtccaaccaattcacatatgaacagcacaattaccgcctcctctcgtgcctaattggtacggtgtcccacaaggaaggaattgctgcttctgttctatgtccgttccccgggctttaccacttgttaatacgcttgtccttccactgactcgttgtttgtttgttaatttctgtaaaatttgtgtttgttttttttataattttaattaaacagaatttctcttgttctctaccattctcccttttcctcacactctttcctccttttttttgtttctctgtaactctgtgaatatgcgttgttctctctctctctgatcaccgaatgaatccaccaaaaaacaaaagcaaaaaatc

SEQ ID NO: 92052 - DNA, 429 bp, Heterodera glycines
  SCN-specific regions: Sequence locations=1-15,39-98,202-240,267-406
caacagcaacaccgtcaccagcagcaacaccaacaacatcatctgaaagcagcggcatcggcaccgcatttggtggtgacggagacgacgagcagtgccagcaacacaaccacagtaccatcaattacagtaacatcaacaaccgcagaaacaataacaataccgccgccattatcagcatcatcaccaccaccaacaccacaattatctgttattaatagccatgatagtaccaaggatggaggaggaggaggaggaggagaaggtggtgggaatggcgatgcggacgatgaccaccgtattccaataccgtaacgcatgatggacgaatggctaccaccatatgccatttgtgtgtctattgtcgtcgttactactgttgttgattaaactgtaaaattggtataaaaaaaaaaaaaaaaaaaaaaa

SEQ ID NO: 92053 - DNA, 598 bp, Heterodera glycines
  SCN-specific regions: Sequence locations=1-86,115-598
caaagattgcaaaattggcaaattgctcatcaaaacgaataaattcactagcgagcccgaactttattatttgcgtttgccaaaaaatatttgcaaatacaaaatctttctgatggatgccattgtttcttctggagccgcggcaatgatggctattcgcattctgttggaccacgacgtgttggaggaggacatcgttttgctttctttgctgatggccgagcgcggagttcattcgttggcttacgcttttcctcgagtccaattgttgacgatttccgtggacaaacagatcaacgagcattaccgaacagtgcttggagtggacgattttgatgagaattgtgttgggcctgattgtgaggtggttcagttggttgcttcggacgacgacccggacgaagacggcgatgacgactcgtcctcttcctgaactgacactttttgttgtacgcaaatgcgtccccacattttgcttgttttcattttcctggttctttcaccactagtaattagagcagctgtttcctacgaaacccattcaggtttttcaactgtttttttatttgtttgtaattgtgagacacggttcattatt

SEQ ID NO: 92054 - DNA, 648 bp, Heterodera glycines
  SCN-specific regions: Sequence locations=1-340,362-648
cggcagcaaccccgccttttttcagcagttgatgcaatccttccccggcttcaacagccccgaaattgttgaacagatccgcaacaacatgccgcagctcacttctctcatgaccaacccgcaaatgctgcaggtgatgtccaatccccgcgtggtcgccgccctgcaacaaatccaacaggcatctcaggtgcttcgacaggaggccccacaactttttaccaactttcctggggcggacatgttctctaaaaccttggtggtatggccggccttttcgggggcatggctaacgctgcgagtcaggcacagcctccgacttccgccggtgcgactgaggcgggcccacagccgagtgcccctcctggtcaaaacattccgagtggttttgcggaattgcttggttctctgatgaatttaagcaccacagtgaatagcagtcagcccccggaggagagattccgtgcccaattggagcaactcactgcgatgggattcactgatcagcaggcgaatattcaggctttgttggccagttttggcgacctttcgggtgccattgagcggctgctgggcggtggcgggcaagggaatgccgataccttttgagagtgacgaagtgctttgaatccattcctgaaagagagc

SEQ ID NO: 92055 - DNA, 624 bp, Heterodera glycines
  SCN-specific regions: Sequence locations=1-624
gagaacgcggcctactgctgcttcctcgtgctgctcacccgcgtgatcgtctcatatcgactcacttttctcatcccaatttcgttggtcaccgagaacatgcagcgcgctgtgcgccgtgatgcgatcagcacgcaaaagttgcacttccgcaaaacgctggcccattgttggcacacgccggagggcaaaccgtgccccgaggggcgcccgccggccgagccggagcccgagccgtacgataacaacgtggccgagatgagcattgacgagattgtgaacgggaacaccgattttcccggcctcgtgccgctgatgcttcagtttctgaactcggccgacgtcgacgtggacactcgttgcactgtcagccagtacctgtcatttatccggaagcgcgctcggggagaaatttggacgaccgccaaatggatgcgtgaatttgtccaccagcatccgacgtacaaaaaggactcgcacgtgccggacgagtgcatttacgacatgatgaagacgatggacaagatttcgcgcggggagcactgcgagaagttgttaggctgtttcaagacgaagacggaacagcgtatcccatccgctgtgaagcgtgccgaggaggagatg

SEQ ID NO: 92056 - DNA, 580 bp, Heterodera glycines
  SCN-specific regions: Sequence locations=1-208,230-580
cccgtcagctcaaaattgtcaagcccaatctgagcgtcgttcttctggagaaagagagtcgcctcgcttcccatcagagtggccataacagcggagtgcttcatgccggaatttattatgccccgggcagtttgaaggccaaactttgcgtcagcggaatcgatttggcctacaaatacttggaggacaatgaaatcgcccacaaaaaatgtgggaaactcattgtggcccttgacgaggcggaaattcgccgtttggaagcattgttcgaccgtgccaaacaaaaccaatgcaaaagcatcgaaatgattggcgaggatggcatccgtcaaattgagccgcactgtcgcggtcgaaaggcaatttggtcgccgtacacgggaattgttgattggacgatggtcaccagaaaattcgccgaagacttccagagaatgggtgggactgtcttttgcgattggtccctcgagggcattggcccttcgaatgactccgcccatcccttgcgactgatcggtgcccccaacggcgcccaaatcatcgactccaaatttctgatcacttgcgccggtctcttctc

SEQ ID NO: 92057 - DNA, 484 bp, Heterodera glycines
  SCN-specific regions: Sequence locations=1-283,306-484
aaaagaaaaaaaacattttcttccaagaaccgccgcaataattgcgaaaatgaacatcaatcgttgggctcacttatgacgtcacttggaaaacggcgaagtttccgagtggccaagaaaacgaaccaaccgttatggacgaagctgaaacgctacatttgcaacgatgtttggatggacactttcccattttttaacaatgcccaactcggactcaaattggcactgatttcgccatgtttaaatgcgctggtggacaaacatttcaacggccagtgtttatggaagaagaagtggggcaaagcaactcataactgcgcggaattactgaatttcttgagaaatgttctttatttttaagattattgagtggaaaaattgatctgatcatttttaatttgcgcgactgtcgccggagttgaataatttatttactcgattgtctgacattttgtttggcaaattattaagagttttgtgcact

SEQ ID NO: 92058 - DNA, 662 bp, Heterodera glycines
  SCN-specific regions: Sequence locations=1-248,271-662
tgagaatgaaagggccgccatgctaacatccaacgaaaggctgtcggtgccgctgccccaaaagagagactccgtcgaggcggtccaaatgccactcgtcacccaaggggtcgaaatcgaacggtcggtgcattcggagggccaacgaacggacactccgacggaatgccccgttcagttttgacaaacagtcatttgctcacaaacggcgtaacaccttctcaaatcgtccattcctctcaacgctcgaactgttggccagcagacagaccattgacaaaccctcgtgcacttccaactccaatttggcgttggaagtgagcaaagcgggcattgccgacctgaacaggccactttcccggatggacatcttttattccggttccactgtcactttgacaagccgcatccggcgaagagaagcgacgatcacctcgacaaatgccgaggcaggcggagagctcaccgcttcagccatcgacggcgcagtcgcggcgcccgcccggtcgaccctttttctgagcagtgccggcctcgccgatgtggcgaccgcgcgaacggcaggcggcggaatttcgtccaaatggacgtggcgcattatgaagtccatccgtccgatgttggacctttctctgctgcaaagtcccactttcattctgctc

SEQ ID NO: 92059 - DNA, 646 bp, Heterodera glycines
  SCN-specific regions: Sequence locations=1-18,40-123,145-646
ctttcatctgctgcttcacctgctgtcatcaacaacgcaacgccatggtgctcttcgcattgctccctgtccagctgatgctcgtcgtcgctgctgtctgcctggtgatcatcacccaatgctgcggcggtggacagaagaagaacacggaagagccgcaagtgccggcggaaccggaaggagcggaagccagcgccaaaccgacgggacagagtgcagcacctggtggaacttcagcagccggtggaacttccgcagcgggacagccagccgaagcctccaagaaatcattagctccagcggggaccggatcgacggtgccttcagcgtacgcggcgcccggcacggggacgaccttgggcgcgacatcgcagaaagcagtggcggcatccggaggaggaacatcggccgtgggcaccgcatcacagaagtcggcagtggcacctgctggaggagcgtcggcgctgggcaccgcgtcgcagaaatcggccgccggaggaactacgtcacagaaatcggcagcggcacctgctggaggagcgtcggcgctgggcaccgtgtcgcagaaatcggccgccggaggaaccgcgtcgcagaagtcagccgctgggggaaccgtgtcgcagaaatcggcagctggaggagc

SEQ ID NO: 92060 - DNA, 641 bp, Heterodera glycines
  SCN-specific regions: Sequence locations=1-247,269-641
ataacaggcatatgcttcccgatgctgctaaagagctttacgctggtggaaccgtgaacaatgtaattgatggccttgcttttcattggtattcaccgcctgattgcccctacgaagtgttgtcagaattccacgagaaatatacgggcaaatttttgttagccaccgaagcttgcaccggcgcggcggaacgtgccgaggaaaaggggccatccatgggcaattggactcgcgcattgttgtatagccatgacatcattgaggacatgcgcgattgggcagtcggatgggttgactggaacatttgcttggatatgaaaggtggcccaaattgggtggacaatattgtggatgcaccgataattattagtgcaaaggatgatgagttttacaagcaaccaatgttctacgcaatggcacatttcagtcgcttcattacgccaaatgctgtgcgcattggttccgaatttggtggccatttgtcgtcatcgtcgtacaatgccaacaataaacccattgaatttgtggcattccgtagcccggacaacaagcagcttgtcatggtgttgttctcgtccgtcactcagacaaccaaagtgaaaatccatgacgggaagcggacaattccgctgacaatacca

SEQ ID NO: 92061 - DNA, 660 bp, Heterodera glycines
  SCN-specific regions: Sequence locations=1-628,650-660
atttgctgggtaatcgagttaaacccaaggctttaaagccagaaaaattcatgccgccaaaaagggatgaagttgaactgttcgatgaaagtcgcatgattcgatgtgggaaacatttccttgacgctttttccgatgagagtcaaatcactgtgctcaccggagggggaactacacaaattgaattgattcggtctttcgacgaatgcgaacttccggagccaataaagcgtaacatcgaattgaaatagtacactcaacctactccaatccaaaaggcggtcatcccactgatcgcaaacactaaaagggacataatgggccatgcccaaaccgggacgggaaagacggccgcctttttgctgcccatcgtttgccacgtccagaaattggtggaggcgaggggaagcggagttgtgaacggcactcacccagtcgcgctgattgtggtgcccaccaaagaattggcggaacaattatatgaagaggcacgggcattcgctgcggggacctccgtctccgtctgtcacacttacggccatatgccaatggcgctgagtctgcgcgaaaaaagcgacggctgcgacattttcatcggaacgtgtggccgaattcagcaacttgtgtaggagagattattcaattggaacattttggctt

SEQ ID NO: 92062 - DNA, 654 bp, Heterodera glycines
  SCN-specific regions: Sequence locations=1-8,30-584,608-654
caataagaaatgcacagaacttcaatttatgcgaaactgcaggtgaagtatagtcgtcgtgccaagtttaccccgagggttgctcgcccgtggcgtcagcgggtcatcgcctgggccggccccgacgccttctcacgcgaccgcttttatgaactagactcgtggtacaaagcacggattcagagacccgaactgctgcccaagttgcatatcattgacccggatttaatcgtggacaattactaaagcaaaattcaacgacgcaaggaacggacccttgacattgggtttagaaagaatgaggcggcgcctgccaaagtgacggaggaagcgatgcaaaagttggaagagttgtccgcaatgaaccaattggtcatcgatttggactccgtcgactcgtccgaccaactgagtcttgcggaacatttcaacattttcgaagatttgttcatgccgggcattttcttccataatgttcagtccgttgaagtgaacttcggaggaaacaacccacaacaaaaaatgctgtttggtaatacgattcgcgcctcgactgccgcacatcctccgacggttaccatcggaggacctcggactgaggcgaaggcatttacaacgatgcttctgctgaatttggaaggtctcggccaacaa

SEQ ID NO: 92063 - DNA, 650 bp, Heterodera glycines
  SCN-specific regions: Sequence locations=1-10,32-557,579-650
cacgcgctcgtccagtctgggtccaatgtgtttctgatacgtactgagccaattctccacgaattcttttatcaattggtcatcttttccttcggtaacatcggttcctacgcgttaaagttaacttcgtctgactgttgtgactctgctgggcgtccgcttcccatccgcgaactgctcgccctttatttgaatgacaatgagcagcgcaacgaaaacagtgaaagtgacgacaccgaagcgcaaataaagacgtcgacaaaagtactgctcgagcacaaggatttgctgtgggacttcttctccattcaaattgttgaatatcattcagaagaagacaaagtgccatttcaaggacatccgaagccaatgttgagtgcgttaccctgcattttggaagggtatttgccccaaatggcgtccatccccgcgcttattaatcatttggcaagaaatgttgattactctgacgaagtgctctgttattcgtcaattgcgcgagcactcagcgattttttcactccttttgtggttgaaaataactttgacgaagaggatacaaaagtgatggaagagcaccgacgaattcagatagtgcttcgttcaattattttcccaactctgaaaagtcgtttccttcccccgtcttc

SEQ ID NO: 92064 - DNA, 657 bp, Heterodera glycines
  SCN-specific regions: Sequence locations=1-8,30-387,424-602,624-657
gccgaaaggacattttcagactgtatttggacaaaattgtgcatggcgacattaacgttacccaattagccaaaggaacgaccggatttactggcgcagacattgaaaacttggtcaaccaagcagcacttaaggcagccaaagaaggggcaaaggaagtggacatggcccatttggacgaagccagagatcgtgttttgatgggacctgaaagaatcaaagggcgactgccggatgaggaagagaactgatacaccgccttccacgaagcgggacacgccatcgtcgcccatttctctgaccattcgaatcctttgcataaagtgaccatcattcccagaggcacttctctcggccatacatcgcaactgccggacaaggaccgtcaccaggaaacgaaagcacagcttctcgctcaattggacgtgacaatgggcggccgtgtggcggaagaattggtttttggccaggaacacatcagcacggacgcaacttcggacttgcggcgcgccacaaaggtggcggaacgaatggtgaaattattcggaatgagtgaccgggccggacttcgcgacttcactgtggaaccgattgaatctgagcaaggcttttgtgtggaaaggggcccgagcaccagcgaaacgatcgaccgggaaa

SEQ ID NO: 92065 - DNA, 573 bp, Heterodera glycines
  SCN-specific regions: Sequence locations=22-192,215-573
tggccctttgccttttggccctccccgtcttttccatgtcccaattggaatattttgtaccctcacttccgcccgcgtttaccagccacctgttggtgttctgttacccggtcactctgatggcccagacgatgtccgtgtggattttggtcggcattacggtggaccgcttcatcgccatttgttatccgttcactgtgcgcatccattgcactgtgcgccgtgcccagctgaccatcgttgccattttggtcttttccgtgtgctacaatttgatccgtttttgggagtaccgtatcaacaattcgtccgatggcgacggcaccgacgccaaaaatgagcaaatgccgccggtggtcggactgttgcgcgagaattacctgtacatgttgctctaccaaaacgtggccacaatgctgtcacagtttctggtgccgctctgtgtgctttgtgcattgaattttcaggtggcgagaacaattttggtggcggtggagcaaaggcgagaaatgtgggccgaactgagcgcggcggaacggagagagcacaaaacggccaaaatgatgctaatgg

SEQ ID NO: 92066 - DNA, 566 bp, Heterodera glycines
  SCN-specific regions: Sequence locations=1-373,403-480,502-566
catccccaataccaacggcttatccatgccgaaattgatgccaaatgccaagaaatgaatgccaagggaattgtggaggaaatttcgtttaagccagcggatgtgaacgaactgcgctacatggaccgctgcattcgggaaagtcttagaatgttcccggcagtgccagtggtcgagcggcaactgcaaaatgatttggcggtaaatgggaaagtttggccccgcggggcattggccgttgtggcaccgattctgattcaccacaatgagcaagtgtaccccaaccattggcaatttgacccggacaatttcctaccggaaaaagtggccaaacgcaatgccttcgattacattccattcagtgggggtccacggaattgcattggtcagaaatttgcaatgctgcagctgaagattgtcttggcacaccttttctgcaattttcgtttttctaccgaagtgccattccttcaaaatttgccagccttagagccaatccttcgtccccaaaacgggcttcctctcaaaataaccaaaagaaagtgcgaaattattatgaacgaaga

SEQ ID NO: 92067 - DNA, 630 bp, Heterodera glycines
  SCN-specific regions: Sequence locations=1-147,169-381,404-630
atcagtggcgagtctttgctcgtcggatggcttgggaattgggccgattataacggcgtccaaaatttccctacggcgctcactttgccgcgagtgctcaaattggccccgagcagaaactttcttttgacccctccccacccatccgtcgtccaactgagggaaaaagaattgaacatggacgacttccgaacatttaaaattacgcaattgccgaaaaacggtgccgtagaaattttcttcgaaatttactattggcgactgcgaatttacggttcgatagtgctagaaatgcaacagacggacaaaggcgaggagggcaaaatttcattggtggcatcgaaggacggattggaaatgattttgggatggaaaaacggaacacaacacagatacattgagaggaaagccaggccaacttcactgcaaattttcatcgatgtcggatcagtggaagtgttctcggaccaaggcgagtggagttgcaccgcacgcatcccagatgaaggccgagtcgacaatattcgactgattgggaggagcgaagtgctcaactcgcaatcggccaaaatgtggtcaattaaatcggtgactcaaacggacgaaacgacacaataattttaaaaaatg

SEQ ID NO: 92068 - DNA, 453 bp, Heterodera glycines
  SCN-specific regions: Sequence locations=1-391,416-453
agcaaaaatgaacccacttggacgagtccagatggactcagcagcgcggaagcgcttgatcgccgacgatgaagaggcgcgatcacgtcaagcctgcgaacgaacatgggcgcctgggcgtttgtgcagccgcgcttcctctccttcctgaagcatgaggaccggcgcttccttatcttcctgaagcgtaagccccggggcctcacttacgcgggccgtgcgccgagcgcgtcgaccgccgccggcaacgaacacacgctcgagtgcgaaaatatgaagatgatggaggccattctgaagaagccgatcaacaatgaggacgaataattgctgggtgattatgaatgtgattattggatggtttcctgattataatggtcctttaggatttaaaaaaaaaaaaaaaaaaaaaaaactcaagggggggaaccggaacccaaatcaaccaaaaaa

SEQ ID NO: 92069 - DNA, 226 bp, Heterodera glycines
  SCN-specific regions: Sequence locations=1-226
tatgttggctatcatcttcgcagtcgtgactctgtcatttttctcctcggagatgagccacatgaacagcaaagtgcgcgaaggacttgaggccttgacgatccacatcaactccgcctgcactgacttgatggacgtgttacgggtcgtgacgcctcggtctaggcccggcgatatccccttgaactcggtcttcagtgccccacgtcaactgcccggacactgc

SEQ ID NO: 92070 - DNA, 216 bp, Heterodera glycines
  SCN-specific regions: Sequence locations=1-216
gttaagcaccgctcacagtcacatcaagtggtcgtagtgtgaagccgtctaagagaaaatttgaagaaaccgagcctaaaaagccaatgtcgacaaagggacagacaaaaactaccactccaaaagcagcgaaaattgcagcgccccatgaaacgacgactccgtccttttctgccaacgatcgcagcaacaattcggcggagaaagtcaaagctg

SEQ ID NO: 92071 - DNA, 602 bp, Heterodera glycines
  SCN-specific regions: Sequence locations=1-461,483-602
aatcaatcaacagatgttcagctatgacaaggagaaatggactctcgaggagaaaattcgtttgttggaattgttcattgacaaagacagtggtctttgggaagacagagcaaatgcactccaagaggaattcagtggtaagcgaccgactgactttttcacgcaaacaactgttaaacgtgaattgaacaacatatttaataagcctaaccctgagcaccacatttttggcatgccaacgcatccacgcggcaaggaagcggctgaactttggctgaaacacttccgaagggaattggaagagggacgagagaggcgaaggcaaatgttcatggtcgcaatgcgcaaacaattggacataatccgacggtaccagcaaggcaaactgcccaaagaggagttggatgcccttttggaagaggcacgacaacgggacgcacaacgtccagacaaagagcagtacgaagagaagattaaacaacacatggcaaaggcttatttcgaagatgttaaaaacgtacaccttttaacattgtttcaattgtaagcattcttacatcagtttcttattaattaggttcgtacctttgctgactactttc

SEQ ID NO: 92072 - DNA, 611 bp, Heterodera glycines
  SCN-specific regions: Sequence locations=1-611
gaataacgacccggaacgagcccaagctggggctgttcaggacgacgacgacgaccggcttggccgcgtatcgaaaggcaggaaaacagcgcattgcccaattacggacggaattggccaatgaacggacggcacgtgcgcatgaacgggcggaacttcaaacggcattagcctttgaacggacggcactggccaatgctcaaacggctttggcgaatgaacggacggaacggacgcaggaacgggccaatgctcaaacggctttggcacacgaacggacggcattggccaatgctcaaacggctttggcacacgaacggacggcattggccagtgctcaaacagcattgacgcacgagcgggaattgctatttgaagttgagaatgagcgcaactttttgcgccgcttgttgctcgaatcctttagcgcagcaaggaggcgctcaattgcagggagggcaattacaacaagcacaagatcagcatgttcaccagcctgagtttaccaaattgccgatgtaatagaatgcctccgccgaccatgatcttttttcgcgtgtcttaattggcctaaaatgttgtctcattgttgataaaaaagtgttgtaaaa

SEQ ID NO: 92073 - DNA, 481 bp, Heterodera glycines
  SCN-specific regions: Sequence locations=1-108,130-481
tcagctgtttcgaatcattcgagacaaaattctcacctcaaggccaattacggttgctgaatacatgcaaaatagcgccgcttctcaacttggatattatgctggtcaaaatgagatttttggagagcgtggtgactttgtaacttctgccgatgtgactcatatattccgagaattcactggcagttgggatgttcatgacttggaaatgacctcttggaacgaccggaggctattgggcgaactcgggccgggctcgggcgaattgatggccgatgtgcataatgtgctgcgccaatttgatgtattacaacatgtagaagtttgtttggatgaaagttccgagcgtttagtggagcgccaacgacaaactttggagaagaaattaggagaagatttacttagaaccattcgatggtacgattcattggatgatgtaccacaagggttctccctgtgactggccgatgaattcctcgac

SEQ ID NO: 92074 - DNA, 626 bp, Heterodera glycines
  SCN-specific regions: Sequence locations=1-491,515-537,559-605
cgcattttgtccattttgcaggaggcccaaaccgattgcactgacacagagtgttccacgagcactggcggcgaccccacgggcactgccgggtccaacgttctgctgattgccatggcctggggactgtttgccatgcttatgtttttcatgcggcctgcttcgatgcgttccggcggaaacgatcgcgaaaatggccaaatcgcgggcaaaccgtcgtcagcagcgaacggacacaacaacgatgatggcaatggcccaccgcccggcgacgttttctgaatacagcgaaaggaacggaggagacgaagacgcaaacatggaattttttgaccagcgaatgccttttccgtcgacgatcactccgtccgtccttcgatttgtcctccatcactttccctccctttttctgtcgctttgcctttcctttcgtttcgctgtctcccaaaaaggctgatgaatggcatttttcaactttgagctccgtctcaaaattggattgtttgtctttttgccggtgcttctcccccccccccctttctcccacatttctttctccgaatttcgtgcaaatgttttattccaaaaagaaaaatgattcttcgattaaaaaaaaaaaaaaaaaa

SEQ ID NO: 92075 - DNA, 650 bp, Heterodera glycines
  SCN-specific regions: Sequence locations=1-419,445-650
gttgattatgacctacttggtgaggtcaaaacgcatgagctgaaggagaatgggactgaaattgctgtaactgaggccaacaagaacgaatatattgaactgctggtggaatggcgtttcaaccgcggaattgagcaacaaacagtggcatttttcaacgggttcacttcggttttccccctccaatggcttcagtatttcgatgaacgtgagttggaactgctgttgtgcggaatgcaggagattgatgtcgatgattggcagcgacacactgcctatcgccattacgctgttcaaagcaaacaagtgatttggttttggcaattcgttcgctctttggaccaggaaaagcgttcaaaactgctccaatttgttactggtacatgtcgggtcccggtcggtggtttttcggaacttatcggttcaaatggtcctcagctgttttgcattgaacgcgttggcaaagaaaattggttgcctcgttctcatacttgtttcaaccggcttgatttaccgccctatcggtcgtacgaacagttagccgagaagttgacagtagcaatagaaatgacagaaggctttggcaacgaataaaaatggggacaaattgagatatcgactctctctaaataaaatgtgtagtgaccttg

SEQ ID NO: 92076 - DNA, 619 bp, Heterodera glycines
  SCN-specific regions: Sequence locations=1-13,53-297,319-476,499-619
ctcaaagcgagttcatcaccaccaccaccactagagccaccatcaacgccacaaacgttcatattcatccacccgccatgtgttgatcaatttcggcttccaatttccgcatgatttcaaacttggcagtggtcgttacagcaaagtgaacaaaggattttaccgcgaaccaaatcgttattttgcaatcaaaattaccgacttggaagccgtatctgacacattcaagcataactttgtgccccatgaactcaaagtctggcgcgagttgagtcacccgaaccacctccgtttgtacaaggatttcatgaacaatgactttctgttcgagatcatcaacttggctgttggcggtgatatgatcaattatttgcggaaccatggaccggtcaaagaagcggtctgttctggctggatgcttcagctcgtcgacgctttgagttacctgcaccaaaagcgaattgttcaccgcgacttgaagctggagaacatcctcatttttgacagagatgtgatcaaaataactgactacggattctgcaagcagtgctgtgacgacgaactctcttcaaccttttgcgggaccaagtcttacaaagcgccggacatcctgcaaagc

SEQ ID NO: 92077 - DNA, 639 bp, Heterodera glycines
  SCN-specific regions: Sequence locations=1-608,630-639
tgcatgtcgatggagaacactccgaaacgggcaaaagcagtgcgtcctccgacaacgaattgcaacggaaagagccgtctccgccgtcaacttcgaagtcatcgatcgccggaattcccaatgattttcccaaattgcccaaatttccgctttctgcgctccctgccgaaattcggcgtcaacaaccgatggtaatgcgacaggcgccggagattccgaagttcgcttcaaaacccgaagtgcccgatggtgggcttggcctcgccggagagtccgaacgaccgaattccgtttccgagacaagcttaaacaccgtttcaaattcggccgatgtttcggagtacggtgggctgtcggatgattcaccggcccctgggggactgatcggaacagttttggatctgttcggcttcaacaaggacggtaaaccaacacccgacgctggtggaatcggaagggcggttggcaatttgttgggcggtagcaattcgccattgcccggcaaacaattcatcaacaatgttctgtacaaaacactgacctccggctccgtgctgccctcctccgcctctgccaatgcttccgccgaccccctcaacgccacttcggccctcggccttccctttcctcagtccgtct

SEQ ID NO: 92078 - DNA, 602 bp, Heterodera glycines
  SCN-specific regions: Sequence locations=1-602
ataatggtggaattttttttgaaaaagccattaaattaaaaatccttccctaatttagtgttttctgtattaatttaatggttttcttactcttactgttgtacatctttccactttatttcttggtgccttttggtgctgctcattgtcatgacactctctcctattacgaagattttgatccgagaatgtcagatttttgctggcttccgcctggacatgatgattgtgtcgaagcgagctgcttatttgaaactgcgggaaaaagttggacaaaagtgtcaaagggttgcactttcaacggcactagggaatgcgctgagcttgaacagaaatgcttaaccgatggtggcaaacttttggtagactgctcagtttgcaattccacctcgtattgtaacgacaaaattccaaacgaaattgttgtgtgtttgaatggaactatgaatgatggcgagaaaaaggacgaagcattcaccgaaattaggtgtgaagatgcgcaatgcttctcagtgcgttgcattgggacggacaattcgacgcttttccacacaaaaggatgtgttaacatggacaaattgtgggatgttaaactgccactt

SEQ ID NO: 92079 - DNA, 629 bp, Heterodera glycines
  SCN-specific regions: Sequence locations=1-575,597-629
atttgatgtattctactgtaattgaccctttttcaaagtctgaccccgaaattgggatcagaaatcaatttaaactttacaaaaacaaaagctacgattggcgatccaatgttattgaccctcacaacaacagtcgtttttgttttctgcagccattgactacgtacactccttggatattcgagaccactgatcaaaattttcattaccaacggagcaaaatttatgagcaacgagaaaaattggatgggctaaggcccttagatgaatggatggtctccactttaccgagtcgaccaggattatacattctcttcggattattttctgaggagcaacagcttcgttggctgggaaggagtctttttgagtaccccgaaccgcctaacatcaccaatttgtcgtccaatggcacttattccggcagttccgtcttcaagacatgtggagctgagaaattgcgatggacgacacttggcctcgattacgattggactagcaaagattattcgatggaagaaaaagcactgccgatggaaattaaacaaatttccaaattggtgatcgatgtgcttggttcgttccccctcgtgccggatgctgcgattgtcaattactatccgaagaat

SEQ ID NO: 92080 - DNA, 628 bp, Heterodera glycines
  SCN-specific regions: Sequence locations=1-278,301-628
ttttatcgatggtcgtttcaatccatgccattgaaggtgaacaattttgtgccgttgtctgcacaaattcacacatttttgtgcttaaatgcgccaagaacggttcccaatctgtcgaattggcttttcaagtcgatttgacttttccaaatgcggtgaataatcagcagaagttggggaaggacaacgaatgcaatcagtcgattctctcttcagatgtttcagccgaccacaaactcctcgcggtggcaacgaccacaaaacacgtccttctctttgagttgcaatcgctgggaaatgcaattggtggcacttgggaagaaacgaaatgccaaaccattcccaagacaccgaccgcaatacatttttccgcttgcggtgacactcttttggtcggcactcggtccggttctctgctgcaattccgcgtcaatgatgccaatttttgccctggcggtgccatcgaattgctctcccatttctcaatgcttctcgaccattgcctttcgccgggaaggcccaatttccttctatccgccgatcgagacgagaaagtgcgcgtttcgcgctatccgaacacacaaatcatcgaatgcttttgccttggccacacttcctttgtcaattc

SEQ ID NO: 92081 - DNA, 603 bp, Heterodera glycines
  SCN-specific regions: Sequence locations=1-168,190-603
ggcgcgttggccagacgaatgctgaacatccaacgcatttatcacactggcgtgatgcattccaaattcatcgtggccgatggtcggcacttttacctcggctctgccaatatggactggcgttccctttcccagaagatggaattgggtgtgatggtgcgcgactgtccctgcttagcgcaggaccttctgtccatcttcgacatttattggcgtgcttctgacgcgaaaacggccacggaaatgcacgcgcaggtgaagaagttggctccagccaaatttaacccacaaaggccgttgaaactgatggacggcgagcagcgattggcagttcatttggcggcatcgccccaggcgatgaattgcccgggaagggcgtgggatttgacgggaataatcgacgcaatcaaaggggcgcggaagagaatatttgtgcatgtgatggattatttcccaatgtttttgtactctcagaatcggaggtattggcccgaaattgacaacgctttgcgtgaggctattctgcgcggagtgaatgtgcggataatcgccgccgcgctgcacttccccaagacggggctgcgcttcctcaagtcgctggaa

SEQ ID NO: 92082 - DNA, 630 bp, Heterodera glycines
  SCN-specific regions: Sequence locations=1-332,355-423,445-522,546 -604,626-630
ccggcggcggcgacggaggcgtcattgacaaaattgagcagatgttggaggagggcatgtaccgaatcgagtgccaaaagaggcctttccgtgttcggcgaaagggacagccgactgtgtatgtgagcgttgctgacggcggtaataacgcgactccaacaacaacagcggcggatagtgtgaagaagccagtggtgaatgttgtcgttgctgaccaagaggagcgggatgatgatgccatgccaaagaaagcagtcgtgaacgagtacctgaatgtgcccagcagtgtggatttgttgctgcgtttgcggggattggacggcgattgatgaggcgcgcgcccctccccccaccggcggcctttctctttttgacttttgtgcctcccttttgcccgtgttctaatgtatttcttcctgctggctttctctcctcctctctttcactttttttttgttttgtgtgtgtcttacaatattttcctcattttctctgcccttccgtggcttctcattttggcatatatttcccctggtttgatcttttttgtccttttcgccgatcggcagctttttcttccaaaataagcagaaatttgcttgggtttcattcattattaataattacggc

SEQ ID NO: 92083 - DNA, 542 bp, Heterodera glycines
  SCN-specific regions: Sequence locations=1-445,475-542
cgattccacaattattcgagcccaccaaacaatgaatggcacaacaatttcaaagagaaatttctgcgtgccatcacttcggtcagctacaaaatttatttcaacgcgaacgcggactcatttgaaccatttgaattggtgaacgaacgaacgcaagaaaagctcagattagtgttggcaaatcaaacaatttggggcagcaatgaatggataatgaagcgatgcccaattggggagacggcggcggcgattcattgggaggatgaaaatttggacgacaatttgaacaatgtcgacttttgtcgttatgctggctttaggtgcattgggccattgtctccgccacaagcagcagaagacgaagaagcgggacaaagcagcgaagaggcatcttctgacaatgaatgacggacacagtaacaacgacaacaacaattatcgccagaagaaatgaattaattaattaagaaatgatcgatcattatgtacatttaagtgatcaaatgtattctatggagaacaattgcaaatacatgtgataa

SEQ ID NO: 92084 - DNA, 637 bp, Heterodera glycines
  SCN-specific regions: Sequence locations=1-637
ccaatactccgtcagtactgctgatataactgccaaaattggccaactccatcatttgggaccttccgaattcgcacagccggccaaagaagtgcgccatttgttggccgacgtggaggaactgctcgagcagatggaactgagcgcgcgcgaaattccttcgagcagttcggaacgctcaaaatacgaaacgcgagtgaaaagttatcgcaatgacaaacgctaattggacgccgaactgagaaaggcaattgaaagggcgaaatcaaacgccgaacgcgacgaacttttccaatgcggcgacggatcagtgagcggtgaccagatggacaaactcattacaaacaccgaacgtttggaacggacgtcgcgcaaaatcgaagacgcatatcgcgtaacggtggaaacagaacagattggagcggaggttctggagaatttggggcagcagcgcgaaacactgacacgcgccaggggacggatgcgcgaggcggacgccgacctgagcagaagcaaccgaatgctatcgcagatgattcgcagagtgattcaaaaccgactgattctgctggtggttgcggtggtgatgatgttctctctactctttctgctctacaaggcactttgaaaaaaactc

SEQ ID NO: 92085 - DNA, 629 bp, Heterodera glycines
  SCN-specific regions: Sequence locations=1-2,25-63,85-629
cgcttgccttttttctgtgtttcagcgaacaaacgaccaacgtcctaatttctgaaaccaccattctccaaatggctgctccctccattcgtctcatcaccacgtccaaggcgcctcctgcgacgggtcacagccaggcagtgctcctcaacaaccagacgctgtacatcagtggccagaccgggatcgcggcggggtcgacgaatgtggtgccgggtggagcgcgagccgaggcgaaacaagcgatgaccaacattggcgagattctgacgtacgccggctcgtccttcaagcacgtgatcaactgcaacatcatggtggccgacatgagcgacttccaggcggtcaacgagacgatcaagaacttcttcaccgaggacacgtaccctgcgcgcagcttcttccaagtggtcaagttgccgaagagcgcgtacgtcatgatcgacgtggtggcgatcgttcagggccagagctgagctgaagaaccggagaacgagcgcggcagacgaataacagagatgtgcataaacctgtctattgtatatttgcgtgatcaacgttcatatcgatgtattgtccttttctgatcactgctatgtgtatatattgtatgtttgctgtgttgcgcc

SEQ ID NO: 92086 - DNA, 458 bp, Heterodera glycines
  SCN-specific regions: Sequence locations=1-458
ccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggagcctcgcccgcgtacgagccgccagcgccggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaaataaattgaattgatggtcaaa

SEQ ID NO: 92087 - DNA, 630 bp, Heterodera glycines
  SCN-specific regions: Sequence locations=1-13,35-56,133-134,193 -448,472-591,613-630
ctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggagcaccgggacagcccggcaaggacagcggctactgtccgtgcc

SEQ ID NO: 92088 - DNA, 625 bp, Heterodera glycines
  SCN-specific regions: Sequence locations=1-117,139-248,279-625
gtttgtgccttctcctccgcaacgctttttgggcgcgtcgttgggtggcggagttcaaccgccttccaagccatcaattgggcaccaatcccaagtcaagaacagtcgcgggaagccaccgccgccgccaactccaccgacggttattcaacagcaaaaagaacaaagtccaccggtgccaaccgcggcgagttcggtagcatctcctcagcaaagacagtcggtgctaacagcggcgagttcggtggcgtctcctcctcctccaccacctcctccgcccccaccgccactgttccaatcaaagccaactctgtcggacaattcagtgccttccaccagcactgaatcaaaggcgtctttcgtcgatccgactaacaataaacgttccgaccttctgcaacaaatccaacaaggcaccaagctgaagaaagtgggcccaccatcaactgaacgaacgcccgtgccaacaaacgcaccgactttacgggacaacatgatggaacagattaagcaagggactaccctcaaacatgtcgatgcatctgatgtggaaatcaatcgtcgttctgtaggaggtggcgttcaggaaattggtgggctcgcaggcgcattagccaaagcgttg

SEQ ID NO: 92089 - DNA, 352 bp, Heterodera glycines
  SCN-specific regions: Sequence locations=1-352
gttaagtcgaacttcaaaaaatgctaactcgttggcactataattggctgtccttcggcttggtgccatttacatgcacgttaatcccacttacacgaaacgggaaacacagcattttgtgaacgacgctaaacccaaagtgatggtttcgcttaacgcatcagaggacgcctcatttactcaggccggctttgatgttaagcatgtgctgtgtgagaagcgatagtgagaggaggcactgaagcaagagcccagctgtgaggttgaacccgcacaaaaggacgacgtggcatgcattatgtacacaagcggaaccacgggaagaccaaaaggtgccatggtcactcacgga

SEQ ID NO: 92090 - DNA, 582 bp, Heterodera glycines
  SCN-specific regions: Sequence locations=1-548,573-582
aaacggtgggccaacggatgacggaagtgaacaatcgcattcagcagcagaagacggcgaacagttgcagctgaagccgcaaagtggacgagctgagggcgcagttggagaagaaacggtacgcccaagcgcaggaattgtaccacgggcaaatcgattgaacgcaaagtcacagcggaagcgattgattgtgatgatgagcgttgaccaagtggacattgacatgcgcgaccggtgcagtgccggacaaaaggtgttggcatcgatactcatccgagtcgccctcgccgacgtttttgaggggaactgcaggattttggcactcgatgaacccacaacaaatttggacgaggataaggtgggtaggcgcaattggcactgattgggagagggaatcactttcattcattcataggcactttttgattttggtccaaaaatttcccatttttatggtttctcccctttttcggctaatctgtcctctgttctgtcgcgtttgtcaaacacattccgtttcatgtggaaaacattggcgaaacgttgaaaagtttggtccaaattttaaaaccgacgccgtcg

SEQ ID NO: 92091 - DNA, 598 bp, Heterodera glycines
  SCN-specific regions: Sequence locations=1-45,70-212,237-334,356 -375,412-598
gcaagcaccaccatcacatcacacacagccgcagcatcgttctgcttcatcattcattcattcatcggttatcgtccgtcacgcgacgcatcatgaggaagttcgcctacttcaaactgtgccaggccgtgctcacttccgtttttctgtggcaaattctctcaacccaccaattctgtggcgaatttgacgagcctacggccttcttcaattccgctgtctcctcttcctctgctggcggccattgcgaccaacagttcacgctcatcggaatggactccaccactggcgaatacggtgccgtgccggacaagcagaagtggcacatgcaactgatggcgagcagcggcggcggacaaggccaaccaattgatgaacaacaacagcaacagaagaatcagatggaggaattttcgtcaaaattgccgactgttggacgtcactgcattccgattgcgttttctctcgtcaacccctggcttcacgacaacaaaagtcatctgcagaaggtcgttgatctgtttgccatccaactgctgtgcggcgtgctgtctctttttggcattgccattcacgtgttggaccaaccgcgctcttg

SEQ ID NO: 92092 - DNA, 581 bp, Heterodera glycines
  SCN-specific regions: Sequence locations=1-76,99-581
caacttttaagtgctttggtcgcgaaccgcccggatgataattgaaggggaaaatttcaagaagacaaatgatgagaaggacagaaagaagaagtggtggcaatttccttccggctgcaaattattcgctgaacttttcttccgcgcttcgatggtcgccgtgtgttttgcatttgcttatgccgtgccaactttggacgatttggtgcccttagtcggcagtacttccggaatgctcctcgccttcgtttaccccgccttgatcgatttgttcacttttgtccctcattaccgtgcggaaggacatcgtcaaaaggcttgttttcgccttcttctgaacctttttcttgccagcgtcggattgtttggcatggtggccggtttatacgcgagcgtcagcaatttgataagtcatggatcgaatgaatgcaatgcgatgacgacgactgggacgccaactattatgtggaacctttataatgggacaactttgtctagcagtattcagtgatagcccttctgtttcatttgtaaatatgttgtatttgattgtctgtacataaacatatgaataataaaaa

SEQ ID NO: 92093 - DNA, 499 bp, Heterodera glycines
  SCN-specific regions: Sequence locations=1-350,391-414,443-499
caaacttctcatcactgcacttcgtgaccaacacccggatgttccgattcacgtgcacacacatgacacttctggtgcaggtgtggccagcatgatcgaatgtgcccgtgcgggtgccgacccgatagacgcggctatcgactcgatgaacggaatgacttctcagccttcgatgggtgcaatttggggtttcgttggaacgggaaccggactttcaccgggttgggaaaatgaccccgttttccccaatacaacgctttattggggaaccggcccctacatttttcccaacccctccaaatgcccccggaacaataaaaaaggggggaactccgaatgtgaaaaaaacaccaaacccccgcggggggaaatttaaaaaatttcattttccgggtttttttctcggggggggggaaaaaaattttcaaggggggaaaaaaattatccccgcggggaatttttctttgaaaaaaaattaaaaagatccccctcccacaaa

SEQ ID NO: 92094 - DNA, 587 bp, Heterodera glycines
  SCN-specific regions: Sequence locations=1-587
cactggctgaacacattgccaaagtgcacttgcagcaaaagccattccctggcggcgttcacgtgcgtctgttgccgaacagcaaaaacaatggacgaccactgattcagtcggccaacatcagcagcaccaatggagaacaacagaagaatctgatcgccgtcgtcgagcagcacttggagcagtacaccaaggacctcgttaaggaagggcagcgcgaggccgaactgttcggtctccgacacattggcgacggcacaccgttggagcagaagcgagtggagcaagcggcgaatgacaacaacgccggagacgaagcgcaaactctggcgaacagtgcggagacgacgagcgaaaagcgcgaagcgatgcacgactggctgaacaccttcctgccgctgcttcatgccaacaaattggacacgcaatgtgccaaccagccccagtccgagtcgacgcggttgttcatggcgttgaaggcgcaggacgacgcgagggagggcaacgacgacggaactgctgctgctccgcatgaattgttgttggccaagcagcgaacgacggtggaggaggagagcagcgagttc

SEQ ID NO: 92095 - DNA, 271 bp, Heterodera glycines
  SCN-specific regions: Sequence locations=1-62,84-144,166-271
tgttcgcgggattgcctccgtgtgctctctgttggttatcatcgccacagtcgtccctctgtcatctctgtactcggagatgaaccaaatgaacagccaactgcgcgaccgacttgaggccttccttgtccacaccgactcggtctggactgacttgatggacgtacaagtggtcgtgactccaccctccaagccccgtgataaccccttccactccatctttcgtgccagacgtccactgcctggacactgccagtgcgctggcctccaa

SEQ ID NO: 92096 - DNA, 654 bp, Heterodera glycines
  SCN-specific regions: Sequence locations=1-15,37-654
ctgtctccttcttcattttgttccccttttgactgcacttcagcaacaatgctcatcagagaatatcgcatcgtcatgccgttcgccattgaggagtatcaaattggccaattgttttctgtgaccgaggcatcgcgacaggagaccggcggtggcgaaggcgttcaaatggtgcgcaacgagcccttcgaaggccaaagtctgttcaatggccgcttcacgtccggacagttcacgcacaaaatcatccacttagatacaaaagtgcctgctcttctgagggcgattatgccaagaggttcgacgacgctgcatgaacggtcgtggaacgccttcccgtactgcaaaacggaggtgaccaacccggactatatgaaggacaactttctgatccggattgaaacaatgcacttgagcgaccgcggcaccacaaaaaatgcactcggtctgtcgaaggatgagctgaacgaacgcaaagtggtgcgcattgacatcgccaacgacaacgagtttctgaaagcagccgacatccttgacaacacccgaccgtcgacattccgttccgtgaacacaggccgtggtccgttggagcagcagtggcagaacaactgcgagcccgtgatgtgcgcgtacaaagtggtcaccgtcaatttc

SEQ ID NO: 92097 - DNA, 600 bp, Heterodera glycines
  SCN-specific regions: Sequence locations=1-235,257-600
cgctttcttctgttgtattcatttattttgccgctcttttgaccatttacctgcgttttcccgaattgaggccggaggaacgggcgcatttccgataccctcagacaattgatgacgccaaaaggcttggccgtgtgcttatccattacaaagaccaacatttttacaccgttctttcgggcgtcgccgccatttatttgatacttcaatccttcgcaatccctggctccatctttttgaccattttgtccggttaccttttctcctttccgttggcgttggccctcgtctgtctctgttcggctgccggtgccaccgtttgttatttcctttcgcaaatgttcgggcggagtttggtgatgtattatttccccgagaagttgtcaaagtggcaaattgaggtccaaaaacaggcagacaatctgttcaattacattgtctttttgcgtgtcacccccattttgcccaattggttcattaacttggccagtcccattgtcgatgtccccattttgcccttcttcttcggcactttagccggagttgctccgccgagttttctgtttatccaggccggcaccacccttcaaatgatgtcca

SEQ ID NO: 92098 - DNA, 502 bp, Heterodera glycines
  misc_feature (69)..(69): n is a, c, g, or t
  SCN-specific regions: Sequence locations=1-127,149-296,318-502
ggcctcccactcacttgccattggatttggagctgttcaccagaagcgggacttacaatcgaaattccnagcttagggagacgaattggctggcgaactcatgcatccatttaccacccaattggaaatgttctctcaaaaattggaagattttggcatgaagcatcgggaccaaattcttaaaaattctcaatttcgacggtatttcccggagatgtgtgtgacagacgaagtcgaccctcttgcgtctagtacaggcttttgggccgaaaaacttggagttggcactttttattatgaattggctgtgccaataatcgaagtttgcatgtcgaccacacattttgactgagggctaattaccatctactaactgcggaacctactgatgctgtcacggaaaagaactctgatagtgccgattgcccacgacgacgtgattcgtgccgttaagaagctgacggttctcgggcacggcttcgaattgatcgcacttggcgct

SEQ ID NO: 92099 - DNA, 632 bp, Heterodera glycines
  SCN-specific regions: Sequence locations=1-313,396-514,536-632
taaaaactcatatttttttgtaaacgtaacatttgtaagattttgataacttaaaacgaaaagttgcgctttcgaatgatacaattaataaatttttggttactgcccggatcccggccccataaatacgctcgggttcaggattcagacagatcgggatttcaatcccaatatactcaaaatttcatttaaatcaaaatttcccctttactttaacaaaaattggttttctgcaccgctgtgtttgtatttcaccgattaatgcatgcgttttgcgttttccaggcccatttagacgttcatttgaagcgcgaggaggaggagcagaaactgcaacaggaaaagaccagcaaaaaggagacgaaaaaggccaagaaaaaggagttggaggaggacgtcattgaggacgaatacgacgactacgatgagcaacttcacagatattgaggacgtttccttttgttcgactgactgactgatttgagattccgactgattcattgatcgattgatgtttggtctgatcattttatttgctgttgcctttggtttctacaattcgtttcatacaaaaaagaaaagtaaattaattcgaaattgaatgatcgaaatcaaaaaatgttgtcggattc

SEQ ID NO: 92100 - DNA, 556 bp, Heterodera glycines
  SCN-specific regions: Sequence locations=1-283,305-556
cacggtctcgttccacgagttcatctgaggattcttcaaagccaaacaccgctgttctgagcgggtggacagaccatcgtccatgcggacatctttacaccaatcttattgccattgagatgaagattttggcacatcaaatgatccaatgggagccgcatgagattctcaggcatcacgccgtaaaaatcacatactcatgtgtcatccatcaattttaactcaaaaaaatcatgctggacaccggcagattcgacgaattgaagctgcgggaggaggaacaacgggagcaagcggaggaagacaaaacgaatgaagaaaaagtaatcaagaagctgacgtcgatgtcgttgactgatcgaggattaatgaatgccaacgctgacgccaatgacaaagcgtcggcacaaattggcatggtctcactgctcaaaaaggccaggggcggctcgctggagattgactctgtgggcgaaatggtcgcagtggcgacggaggcggcgatggcactgaacacggcactgatgggacggctgaagcaaatggaggccaaaaa

SEQ ID NO: 92101 - DNA, 454 bp, Heterodera glycines
  misc_feature (426)..(426): n is a, c, g, or t
  misc_feature (428)..(428): n is a, c, g, or t
  SCN-specific regions: Sequence locations=1-163,185-235,257-422
gcgacccgaatccggacagtgcgctggagatggacatcgcgattatctaccgcaacgaccgcgagcagtacaaccgaaatgcccgtgaatggacgcagaagcacgcgatgaaatgagacgacaaacgaccgatggatgggagaggatgcagaagacaaccgccgaagaggaaggaggaggaggatacattcaactgaccctattcccatatatgatcccaactgtacagattgtattattgtatctcactgtatgtacagtatttgtcgcccggttatcgtttaagcgaccataattgtctgttgttggttgatcaccattatcaatgtgttgtatctctgtgttatcatttcaaatgatttgtgattaattgttggcctaatgtgtgtaaataatgtgaagaatccaaagatttgtttgtgaaananaaaaaaaaaaaaaaaaaaaaaaaaaa

SEQ ID NO: 92102 - DNA, 531 bp, Heterodera glycines
  SCN-specific regions: Sequence locations=1-531
gctcaggcagccaagtgcgcggacgacggtttcaagcaggtggagaatgggtgcaagttggagtgcgcacattggctggacgcgtacgcgccgacgccggccgcgggcaaacagcgggacgcgcatccgctgaccaattgcttcgggcgcaacgtgaagatggaggcgatgcctatgaacgaatgcatgcgcaagcgcgtggacaattactgcacgagttcagcaacggcacgaatttcggtgcccgcgccggactacgccggttggatggaacccgccatcgccagcaacgacaccgcctttgagcagcggcacaaaagcgcctttctgcacaaggcgcgtgccgctttcttcgcattccgcaacttccaaaagtgcatgaacaattgcgccaagaaacggtctatcaaatgctttggcgacgaaggttgtgccatttctcttccgtccgaccgtgccttggctaaactgttctataaccaatgcacccagcagcaaaatgtgccgaaaaacgcgcgcgatgcttgctat

SEQ ID NO: 92103 - DNA, 643 bp, Heterodera glycines
  SCN-specific regions: Sequence locations=1-320,343-502,524-643
gccccttcggcttaattctcctaaataaaaatgtgcttctcaccacaaattgatgacacacgcaccaattgcaaatttgtcttccagcaaccttgtcgatgctctatcaaacaactcgaggccatcaaattcagcaaggtggtaagcggtcgaaacaagagtgtaggatgtaatccgactttttgctgcttttgctgtggcatttttggccttgtgatgttcgttttactgttggtgctgttctgcgtcgcgcaattctctgccccaaattcacctgatatagggatttctatatcttttgtgtccatgatcttaattgtggtggtcattgttctgtgctgtatgtgtggagccgaattcggtcacagttcgttggaagtactgtacaaatgtccgacgtgtggcaaagaaacgcacagaaattatgagtgcttcattgacgtctcttacaactggggccgacgacacggcgatacagaaatgtttcgctaccgtactttcgcgggcagtttgtggggacagtacacgaaaaatgtcacaaaaacgatactgcagaagcggatgaccatgaacaactttgaggtggtggagcacaaatacgatgtgatgagcattgttcaggacaattatttcaagacaaccg

SEQ ID NO: 92104 - DNA, 349 bp, Heterodera glycines
  SCN-specific regions: Sequence locations=1-349
gcacatcgacgcagtcaaagcgtatgggatgtctggcgaagtgtcttatgacgtcgaagcactcgctttaggtgaggcgcatcggtcgctgttcagaaattcgttggagtttggcgacatcaaagagaatacctgcattatggttgagttccgagatccccaattcccaatgcacttcatcttcaaagccaacaggctggacggcatcaaggaattgcctcgtgtgctcaaaccgaacgattgggaccaacgacggcacggctccttccaaccccaaatcggattcagtcgtgacatcccacgtgcaaatctctccatggcgggccatcgtacgctcaaacaccacata

SEQ ID NO: 92105 - DNA, 588 bp, Heterodera glycines
  SCN-specific regions: Sequence locations=1-382,405-588
gcaaattgcgtctcgttaccataacaaacggaagagggcaatggaccaaatccaacaaatggcgccaaagacgccaaaattcaattctgttcgctcttccggcggtcgtttggccacaatgtctcctgccgcccgcagtcttttgggcgataaacttggcattcgactgggcactgatcggatcaaagtttctccaagtccgaggggttcggcttcgagaacggtcttcagcccggcaatttatcagatgatcaaagtgaagaatgagcccaagtcgggcgcaacgacgcccaaacgggcggcagcgacgccgacttcgagcagttcatcagttacggacgacctcctgagaattccttcacctggtccttcaacactaatcaaaaacaaagaacaaagagaagcgcagcaaagaaaagtttcggaaacggaagaaacccaacaaaatatggtaaaaaggccatcagccgcggatttcttctgatgtatgaattcaaatctacatgttctcctagcaagtgaaaaagtgacgtattttcaattatgtttttcccatttatttttttcaacgaataaatacagtgatat

SEQ ID NO: 92106 - DNA, 591 bp, Heterodera glycines
  SCN-specific regions: Sequence locations=1-184,207-591
agcagcaaatccagcaaggccgtctcgacgcttttcgtgctcaaatttgtgcgccaaaggacgcggcgatgacgcacaatgccacgacggatgatcagatgctgtcgctgtacgacattttgccgtttgacaacccggacggcggggtttggaagcagggatggccgatcacatacgacccggaaaagattcggacagagaaacggctcgaagttgactcgcacaacgacccgggacgtggaggacaatttgttgacggagagtcgcttccatcttctgctcgagcacttcgaccgcttctcctcccctccgtcttcttccgccgaggggacaatcgcttttcattcattggccgcccaccattcgtcacttcgtctccattatccgcccatttcactcgctggacaaatggacgaccccaaagagtttaaagcccgtcgtccatttgggtccgtccttcgccattccttcccctgcaactttcacccggtgactctgcgaatgcttagccatccgacggtttactcgcccaattcctcctccacgcgcccccgggacgaagcggcgctcattttgcaccgatttggcatc

SEQ ID NO: 92107 - DNA, 651 bp, Heterodera glycines
  SCN-specific regions: Sequence locations=1-493,515-651
taaagacgccaccatggctatgacgtttatgcttgggaaggacaacggcattggcattgttggtgtctcttctgcgaatgccggaacatcgctgcccattgctaacaatgccatcgctacttcggcgtctgagtcggcgagttgttcctccgtgacgccttcaccatcgccttcaccgattgttgccttcaatgctaccaacgacgctctcaattcatcatcacctttcgtaactctccgtaaacagccgcaatgtcagcagtcgacgccaccgactcagccaatttcgagtagggaaagtgaagcggagcgtaaggccaagtcgcgtctgaagcgttccacccgacgttctacgcagggtgttactttggaacaattgggcgaggtgaatatgcgaaatcattcaccaaaacaccacggacgagcggagattggcaaggaacagaagcaaaggatggcaattggacatgacggcaactgcgaattgcaaatgccggcttctccctgctcgtctacgtcgtcgtcctccgcctatttgacggccgcctctcaccgcgccgttgaccaacataattccaaagtcgaacgcgtcaaggagaattacaatagcactaaaaatgaagctactccatcgccctcttctaccgcttc

SEQ ID NO: 92108 - DNA, 604 bp, Heterodera glycines
  SCN-specific regions: Sequence locations=1-41,78-604
gattgcctcggagtggtctcggttttctatccgagtggacatcgtcactctgccatctctgtactcggagatgagccttatgaacagctgattgcgcgacggaatttaggacttccgcgttaatacctattcgacctgtactgactggatggacgtgcaagtggtcttgactgcgccgtccatgccccgtgataaccccttcaacttcatcttgcgtgccggaactttatttttctgacactggcagtgcgctggcctccaaaagctaagctgtaaccctggtctgaacggcccgctctgatcccctggacagtccggagattctgcaggcacaggacgagcgcggaatccctgactgcctggaaaacccgttcctccttgcccgccccagaagatgaccggcgcgcgctgccttgttggcccgctcagccgccccgtatgacagggagcgcccggtaagcaaggaggcccagtagtagctggaattctcgcgcaaggtggaggactttcaaagtcgggatcgattgggaacttaggacagcctgtactgtctggattccgaggagccgctggccaaattttgatgtctggagctaacggtatt

SEQ ID NO: 92109 - DNA, 607 bp, Heterodera glycines
  SCN-specific regions: Sequence locations=1-53,86-607
atttggccgtttaatgatgagcaaggagctttatgagcgcaaaatgcgaaaaattgaagcacaaaaagaagagaaagtgccagaaaaattcttcgccaaagttcactactattttaaacgttattggtacatcgctttgcctgtgcatttcgcagtttgcagtgtttggttcggtgcactttactttgccgtcaaaagcggcatggacgtggtggcactgttggaacgaatgcacatgcccgaccattgggtggacaaaatccgaaatgtgcccccgtcggctggcttcgcagttgccgcactcattctctataagattgccactccgttgcgttatgcctgcactttggtcggcattcgtatcgctttcaacactttgcgtcgtctgggcaaattgcgcaccacgcgcgagattgacctgacggtgcgccaacggctcgacctgctcattgagcaccgggatcagaaacggagtgccaaaagggcagtacggcatcagaacaatagcatgaagaggcattcgctgtgttcctcgcggacgaggacaaagttggactaattagtgcctttgaacttattgttgtagcatagagaactgctgaccgac

SEQ ID NO: 92110 - DNA, 505 bp, Heterodera glycines
  SCN-specific regions: Sequence locations=1-14,37-93,116-505
tccgctgttggacgtcattttgttgcttgatctgctcggatttacactcattttgcctttgattccgtcactaatcgaccatttttcaaaacgacacacaattaaatctgatccaatttttgctgtgtttgattctgttgcgcatggccttaaaacttttctaaacgttccttcaattgaaccaaataatggcgttttctttggaggaattctcggctcgctgttctcatttctgcagtgtctctcatcgcccatttttggctcattgaccgatttgcatggacgaaaatcgcttcttttggttgctgtgattggctcactgatttcatattgcctttggactctgtcatccgaaagtttttcaattttctttgtttctcgactgatcggaggcttaagccacgcgtcagtttcggtagcgatcgcaattgtcactgacgttatgccaacggaagagcggggcaaaggcatggctttaattggaggctccttctccctggctttt

SEQ ID NO: 92111 - DNA, 628 bp, Heterodera glycines
  SCN-specific regions: Sequence locations=1-628
cggcaattaacagaagtcgtccctttgtcgcaatccatgggccaccggggacaggcaaaaccaaagtcattgccgaaatcgttttgcagcatgtcaaaaagggcaaaaatgtgttggtctgtgccccgtcacataatgcagtcgataatgcaatggaggcgtgcaaaatgaatgggttggacaattttgtacgtttgggggaagaggcggacgacggcgcactgagcgaatatcgaattgggaaattggcacaaaaccacgccgaatacgaacgcattgagaaggacattcggaactcacgagaaatcaaaagtcaaagggactttctggacaagtcgcggctttgtaattccatttgaaactttcgccttcagtgaccgacacattcgccgttttcattcgcttttgaggaaaatgggcaaaaggaagaacaaaatctgcgaaagcatccgaaagggcacaagtgtgattttctgcacgtgcacctcgggacaggcactgcgctttctactcaagcgttggttctgccccgacttggtcgtgatggacgaggcgtcccaaatggtccaatgcgccagttggattatgctgcttcacgtcctcccccccccccctttttcacgttctt

SEQ ID NO: 92112 - DNA, 623 bp, Heterodera glycines
  SCN-specific regions: Sequence locations=1-623
ggaaagtggaggtgtatgctccaggattggacggcaacaagaaatattacgtacacgtggagacaaggattggcatccacgggaagccagagagatgtgtgaaccctgacaaggagggatgtggcggcatagggtcgtgtgtccactgcgacatttgccaaacgattggcggttttcgccagttcatccaaatcttcaaaggggataagccggcggaatgcagcgccaaaggccttccccccggcacttatgacaatttgtcgctcaaagtgtgccttcccagcaaagacgagctgttgcccttcctcgaccaaaattcgagtcgggctgaacaactttgggatgttttcgtgagcagtcgcgctcgttctggcggagaaatccctttggtaatcgccgcccgcattttcgaccgcccaatcaacaaactttccatcaaagaactgaacgacgcactgcacaacaccaaaaagggaatgattgggtgccattggatttacgcaactgtgagaagtatcaaccaagactgaccagcgcaactgtccgccgttggctttgcatttcatcggcccattaattcgctcatttttgtccattcacacggaattcgacacgaaactttt

SEQ ID NO: 92113 - DNA, 640 bp, Heterodera glycines
  SCN-specific regions: Sequence locations=1-158,185-232,254-305,327 -460,485-540,562-640
agaaaactttgcaaaaaaaaatggccgacttcgaagggcgtgtcaaagcttaccgtttcgtggcttacacgacggtttctttctccatcatctcacttttgtcggtgtgcttgacactgccaatgctgaagagttacgtgtccaacgtgggcatgaaaatggactctgagctcagctcatgccagcacaatgccaaagacatttggtccgaagtcagtcagctgaagggaatgcctctgctggtcgccggaaaccgtactgcgcgtagcgcatacggtagctgccaagagtgttgctccggcggtgcccaaggccaacccggccaacccggacagcctggacgacccggaaaccccggagcgcccggctcaccaggacagcccggacaaaccccgcagacgccttgcgagcaagtgcacccgcaagcccgccgccaacggagcccgctcctgcaggcccacctggagaggctggtgcacctggacagcccggtcagcctggagcccctggacagcccggcgcggccggacagcccggcccgaagggacctcccggaggcccaggacagccaggcaatggcggagccccaggccagcccggccaacccggacagcctggaaaccccggagagcgcggaatc

SEQ ID NO: 92114 - DNA, 400 bp, Heterodera glycines
  SCN-specific regions: Sequence locations=1-400
gaaatggtactacccttaccactacccgccgtttgcctcctatttagaactgatcgccgatttccaaccctacttcaacatgcccacgaaaccgttcaagccattggagcagttaatgggtgtgtttcctgctgctagcagagctcatattcctgaccggcggcgttggctgatgaccgactcaagttcgccgatcattgatttttacccggaaacttttgagattgatctgaatgggaagaaatatgcttggcaaggcgtcgctctgctgccatttgtcgaggaaaaacgtcttttggatgcacttgactcggtgtacaccactctcacaaccgatgaaagtactcggaatgacaccggaccagaccgtctttttgtctgcaataaacacaaattgttt

SEQ ID NO: 92115 - DNA, 568 bp, Heterodera glycines
  SCN-specific regions: Sequence locations=1-568
gttctcttcatctctttcccgccaaaacactgtcctcaatgtcatcaaacaaagatgagttcgataaatcgcaggaacgtatgaaggatgcggttaaccaagttgccgaggaacttgatcttagttatattcggaagatgcaatgcgagatgcatttgtgctctgccggctgttatgaaggacgaggcgctttgaaccgcaaacaaattgatgactgtgaggagcaatgccgaataaagtaccaagcggtggttgccaaagtggacgatgagttttcggcttggcaggatcaacttaaccgatgcataagcacttgccaggacaagcagcatcagcaatttggcaccgacttcagtaagctgtccgagcagcagcggaagcagttcagtgacaatttggccaagtgcgctggcgtttgcatggacgaacatgtcaaacatttgcccaaattgaaagaccgaattgtcacatttttgaagaaaagctcataggatttgatttgattttttgttttgtttgatgatactttcagcactttgccattttattgtggttaaaatattgttcg

SEQ ID NO: 92116 - DNA, 443 bp, Heterodera glycines
  SCN-specific regions: Sequence locations=1-443
aagtaacgctggagggcagaactcgactcccgcagagagtgcaggaactcgtgatcgacattggcaatgccatgacaagcattcaacaaacttcgggttctacagatttactgattacttcgattcgaaatttcacttcttctgatggaataatggcaaattctgaacaaaatctcgtcaaaattcaaaatcaaatggaccgaattgagactcaaacgaatggcgctgagcaaaaccttaaaaatgtttcatcagtgaacaattttcttgatgctttggagcaaagtgcgtattgtacaaattttgacgacaaaaaaaattgaggatgaaaagggggaagaaaagagggaggaacgaacagcagaagaatttcaaatgatgatgacccaattgtgtgcattcgtttttcagtgattttgaacacaatgaaaataggcaaataa

SEQ ID NO: 92117 - DNA, 576 bp, Heterodera glycines
  SCN-specific regions: Sequence locations=1-576
ggacaatttgtacacatatgccacaagaccatcgtgtacagcaacaaatggatgcggatcaccttatcttttctgtgatttgacaaagcaacaaactcctgagcccttatgttgtgccaaaataaagtccggaggcgattgctcaatttttcaggggaacaatgaagagccatgttttgattccgtttgtattaatggcatatgtacagcaagcgaaaaaggcacgacaacggaacatggtgaaacaacaccacaaaccgagacaagttcaaccacgcttggtacaactcaacttggtgagacaaccgcaacacctacgacagggaccagttcaaccaatattgatacaaccctaattggggaaacaacttcaacggcatcggatcacttctctactgtgttttctctgtcaccctctcttttgacgacagaaccaactgatcagatcaccctttccacgataagcagcagcacaaccttaggcacattcacacccaacactaccgtgtcctcatcatacactcaaaatccatcatgttgttgtgtgtgtaaggaatgtgatgaagaggaacaata

SEQ ID NO: 92118 - DNA, 623 bp, Heterodera glycines
  SCN-specific regions: Sequence locations=1-45,67-222,246-479,501-623
ctgaaaacaaccagaaggaggaaacggcactgattattgaggagaaaataaaagtgaaggagggaagtgagaatggcgagcaacaaaaagagaagttcaaaatgaaccccgctgccgccccatttattccaaagtcaaaggatctcaatacaagttcggctgttgtcactgcaaatacgagtccgctaatgtccaacccaattcctcctttcatccaattgcctgcttcaattccaacccagggaatctcgacccagaacattgttttctatcatcaacaaccccaaaccgttgtctcggcgcaaataccttcaaatgctgcgtcatatcaccaacagacacaaaacgttcttcctgcacaaatcccttcctcagtggcttaccatcagcaacaacaaactgttgttccggcacaaattcctccgaatcaaattttctatcagcaacaaccgcaaaacgttgtgtcggcacaactcccttcaaatccgctttatgctacttatcctgttgcgaatccgggacagtcaatagttttcgtttctcccactgcaccaaatcaggcggttattcttcagccgggtcttgcacaacattttattccggtctccgctgccgcatttcca

SEQ ID NO: 92119 - DNA, 645 bp, Heterodera glycines
  SCN-specific regions: Sequence locations=1-5,29-100,122-460,482-645
tgtctctctgggtcttgtcgatgggcgaaatgtttggctgagtccgctgcgtcagtgtcatgccaatgcgttgcgcgttgtgcaaaaattggcaccgggacgcgtgttggtcagcagctcatgcagtctgttgcacgtgccatattcgaccaaatttgcgcaatcgttgaccaaaaagccggtgaagggaatgctgacggggccaatgaccattttgaagtggagctttgtgcgcaacgaccaaccgcagaaggacacccttttccaggttgcgttggcattgcgcgacgatgtggccgagttggagaaggagggcatcaattgcatccaaatggacgagccggcattccgcgagggattgccgttggacctggcacagcacaacgaataccttaagatcaccgtacaggcattcaaaatttccactggttgtgttgcggactccactcagatttattcccacatgtgctactccgactttggcgacattttcacgcacattgccgagttggacgcggacgtcctttgcattgagtgctctcgctcggatttgagtctgctctcctgctttgaccgctttggctatccgttgatggtcggccccgggatttacgacattcactccccgcgggtgccgtccgtcga

SEQ ID NO: 92120 - DNA, 499 bp, Heterodera glycines
  SCN-specific regions: Sequence locations=1-499
ccattgtgtgaaggtgaacaatttgtgcaccaaatattgtggctgcctcgactgtgacaaccgtttcccgggctgccgatgcgctccgggcaattgccgtaccaaacagtgtcactgctattacccccgttgggaatgcgacccggacgtgtgcaagtcctgcaactgcgacaaattggatggctccggataaccaatctgcaaaaaagtgtccatccaacgtggactgcagaaacgactgattgttgcgccttcccaggtggccggctggggatgtttcgtcaaccaggacattgaaaagaacgactttgtgtccgaatattgtgacgaagtgatcagtacggaggagagcgaacgccacgacacaatttaccaccgcgtcaaatgcccttatatgttcggacttaacgatgagcaagtggtggactcaactcgagtggacaatgtcattcaattccccaaccactcccaaaacccgaactgtcgtgccgaagtgatt

SEQ ID NO: 92121 - DNA, 638 bp, Heterodera glycines
  SCN-specific regions: Sequence locations=1-28,81-124,146-638
gataagtgggctttttgatgataagacggaagaggaggaggaagaagaagaaggagagttgaaggaggacaacgaagaagcacttacaagccttgaaaaatcgcccattaccgacaacagaatcggagaatttggggatgaacagcatgaggaagaacaagccgaattcactcccatggggtgcgtactgaaagggggatgaattgaattgcaaatccattttaaatcccagcattggctttcgccagaaaatgggaaaataaactggacttgagccaatcaaacaaattgatgtgttttcgaaatcttcacctcatcagaatcgcaatggttcgtatcggtcggttgaagcgcgaattggagaacgcacaacagtcaggcgacgatcagctgctgttccgctgttgtgatgcgttgatggaccgtatgccggaccaattgcagttggactcggatgagtgtactgtggcattcgatctcgacaaatttgacgagggcgccgtgcagactttggagcaacttctgctgatcgatccgctgactcctctcaatggcaatagctgatctccgatataagaatacatgtgttttttagactatgtaagaattttagcagatcttttatacagtattcattc

SEQ ID NO: 92122 - DNA, 559 bp, Heterodera glycines
  SCN-specific regions: Sequence locations=1-85,107-521,550-559
gtccaattaaggaattgccctgaacatggcacggtgcccgttcctgttcatcctcctcatccctcttctcctgctggtgctcatcaatttccctccaattttggcatggatattgaagcgagacgatgtcctcttagcttattctccaaatgaacttaccacagatgaaacgaaaattattggtgaaaagcaattgtgcccagccagagaatggtctttggaaaaaacttttgggcttcccattgatccgaattctgaatttggcaaaatgttgcctggtctttctacagaattcaaccatgcacttcccggcattggaaaatctcttgaatacatattatgtacctttgacaagatgcactgtcgtcagcgtttttgtcaactgaacatccttgcatgcgtccgttccgttacatgcacccgtgagtcggatggaagatgcatgccatgctgcatggatcattttcagtacacttgtgtcaacgattggaaggaggttgaggcgatgtttccgaccacaaccacaactacgaccacaacaactacaacgctggcccca

SEQ ID NO: 92123 - DNA, 647 bp, Heterodera glycines
  SCN-specific regions: Sequence locations=1-148,172-227,249-647
atgatgttaaaacaaatattttctgtcctattttttgtgctttctgctccgatttcagtcggacagtcggaggaagtgagcgaattcgaacaacccgtggtaacatttggtaattgtgaatcgaaacggtaaaacaaagtgtttggttgagtgactgacaatggcacattcgaagcaaaagcattgcctatttctgatcagtccaattccattcgaaggattgtggcacagctgccacagaatggaagccgtgcattgagcgtcggttggctgatcaggtgttcggctcgtgctgcgaaagatttgtgccgcccgaatgccgcggcctttgcacttacgaaagtcacccaatcgaagcgcgaatattattgatgcacacaattcagccgagtcggtgccgtatgtacaaatatttgagtgccattgtccattgtgccgcacaaacgcacgacaatacgcattgttgccgcgaaatgggaatggaagagattgggcagaactgcttggacttgtgcagacctcaacaaaatccgcgcattcggtgggggcgtcaatcgctgcggaaagacctcgtccaatgtttgtcgaaatgggatcaagtgatgttctgtcatcaggggggcctttggtcgcgaaaaatttcgaaa

SEQ ID NO: 92124 - DNA, 629 bp, Heterodera glycines
  SCN-specific regions: Sequence locations=1-507,530-629
aacaaatcaaacatcggttcaaacaaatcctccaacaatttcattgtttgtgccaacaaataatacagttgaagcattacctgcatcccttccaacggcatcccaatcacccatattaacgcaagacataaatggaacaacatttagtagaattccaaaaccattagaaacgcgcaagtccccggaacaattaaggaaggaagtgcaaaaggaattgccaaaagatacaaaagtgccattagaattaacgccagaattcaaacagcaaaaagcagaggagcgaagaaaagatgccgaagctgcacagcttgagaatgattggaagggaaaaattgccgagttggaccgcgctcgtcaggcacttggtgaggaggcacgcgccgctgcacagggccaaagcaatgacgcactgttccaaggccttcaggcagattatcaacggaaattagccgaaatgacggaggcaaaacaacgtaaagaacaagcacaacgcgacgcagccgaacaagcgcgaaagatggaaatgctgcagaaagaatggaagaaaaagatggacgaacttgacgctgagagacgccgccaggaagaagaacacaagcaaacgcattggcacagtcgcaagcggaggc

SEQ ID NO: 92125 - DNA, 331 bp, Heterodera glycines
  SCN-specific regions: Sequence locations=1-331
ggtcaagacattgtggattgtccgacacgccgaaagagaagacaacctccactcgaattggccaaaggatgcgaagcctccaaaattgaaatcggataaccgtccattatcggcaagaggcatgcaacatgccaccgaattggcagacaggttttcgaatgtccacatcgatcatagttttgcgtctccttttgagcggactgtgcaaacggcgacttttcttatctcaccgaggaaaattccgatccaagttgagcccggacttgcgcaggctctttacctttgcgaaagtccggctggctttgaggaatcggatgaactccatacgcgg

SEQ ID NO: 92126 - DNA, 598 bp, Heterodera glycines
  SCN-specific regions: Sequence locations=1-86,111-464,486-598
ccggcgggcagcttttgtttttttgaatacttaatttttaattatggagtcgtcatacttggccagacaaattcttgatcggtgcaacaatctcttggcaaatcgttctcgatacacaagcaaggaagaattcgctcgcactgttcttcaaacgctttttggtgatccatcagttgatcttcttcttctaaaaccgcacttcgattctctacatgccgatgcgcttaatcgactgaacgcattgattggttttgagtcgaccgtttttatgaccatttacgtcaatgatgcactttttgacgagttcatcgagctgttcagtcgacactgcattcgttcaccagctacggttaaggaagcgactgagagcgtttacatgtggcttttggccgattatttgcaatatctgttgcccgtcgatgaacagaagctgaacttgctgaagaactctacctggatttctgctcctttctcctctttaccaacgtcggcagtgacgagtccgcgcagattgctgcgccccgaagtgttggcccaatgtgccccacttgagcacgtttctcttcggtcgggcgccttcaaaacgctttacccgcga

SEQ ID NO: 92127 - DNA, 277 bp, Heterodera glycines
  SCN-specific regions: Sequence locations=1-277
gaaacacactctgattgctctatggattgcctctgcgcgctctctgttggctatcatccacacagtcgtcagtctgccatgtctgtacacagaaatcagacgaatgaacaacagagcgaccgactgaatggatgccttccccatcaacacccactctggatggactgacttgatggacatgcgagcgggactgacccctccaaccaacccgatagataacccctctaactccatcttgcgtgacaaacaccgactggacggagactgtgagtgcgct

SEQ ID NO: 92128 - DNA, 614 bp, Heterodera glycines
  SCN-specific regions: Sequence locations=1-14,36-212,235-342,364-614
gtctatatccgccttttttgctcctcttttccactattttctcgctatttcccattctttcatacattgcccacaaatggccgaataattccatattttccataaatttgccttttttttcttccattcttttacaaattatttacattaatttttgttttcatttcattcattcattcttccatcctcatcatttatgtcgtatccatttattaattagttaattagttaattgcctctcatcaaaaaaccttcgctttgtgccaaaatttatgcctttcgcttcagcttcatcatctattgcttttcatcattacaatcacttttctcacttaagttagtgtttgttccctcaccattctgcagatatcaaacagtaacaaatatcacagtaaatctccaaaattacattaccagtaaccaatatcttttctgtttttaaacgtgcaaaatatttctgttttcgttttatttttttaatgttttgtactttcccattacgatattaaagttattttctgctgttcgctttacttattgtatagcccatttgccattctctgactctgtattgttaattccaataattgctttgttttaaaatatttttttaa

SEQ ID NO: 92129 - DNA, 621 bp, Heterodera glycines
  SCN-specific regions: Sequence locations=1-39,61-356,379-621
cataaatccgaagaaatccctacaaaaatgtcttcttccccgtccgtctctgtgctcgccatcgtcgcaattgtctgtttgatgtgccaatgttgcttttcggcaccgcatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctcgaatggcggcgatcgaactcttttggccgacatcgaagcatctcttgccagtcattctgctgatgagtgtgcccacagcctcggcttcgtccgtgccatgttcgccattgccgcctctgcttcttctcatgccagcaacaacagcgaatggcaggcattgagtacacagtttgttcagaaagtcactgaaattgactcgaaatgtgcagagtttggcattagcattggaaaagtgcccatcgatggccccaagggagaccactcccaacgaaatgtgcctagtacggacagtgtgatttccatgcccggattgaccggctcacaccaacattgaactgaatgatgagtgacggaatggaataaacta

SEQ ID NO: 92130 - DNA, 449 bp, Heterodera glycines
  SCN-specific regions: Sequence locations=1-78,100-449
atttttattcaaagtcgacctgatcagacagctgaagacggacattgagttgctcaatgcgccgaccacttcccccggctccgcccttctgacgccaaacgcgtcgacgcggacgcgcgaaagcgccgcgcaagggacggcgaagcgcactcagaacaacgcgcagcagcagcagctgcaaattccaaatgcaaagaattcgccgtcttttttcgttttcccttcgcccgcggcgcaaacgaaaaattttcaaaaaacgcaaagggaggggaggaaaagctcatcagtgtcagcagcggagaacggacaaatggacgaacggcgatcgctgttggacggcagcatggaattcacagtttaaatttaaagagacggagcagcgaaagaaccgtttaaagaacaaaacaaatttatgtttcataaacattttaaattttatgaaataaaat

SEQ ID NO: 92131 - DNA, 395 bp, Heterodera glycines
  SCN-specific regions: Sequence locations=1-338
ggaacattttttccaattggaaaatgaattgggcctggagaatgtcggcatttgcttggtggtgttcgccgacaattctaacaacacttggcgggtgcaggccatccctgtttcggacgtgagctcttttgacaacagaatttcttattctgtggaggggacaccgcgatgatcaattggagaaagaatcgggcatcgaaggggccatttttgtacacgcaaacggattcattggagggacaaaatcactggaaggggcaatgcgaatggcagaggaaacgttgaaaatgaattaacaatcaaacgcgttaatttttttgttatttttactatttgttgtattcattttatttaatgtaaagtgagaaattgaaatacaagtcaaaagatgtgaa

SEQ ID NO: 92132 - DNA, 631 bp, Heterodera glycines
  SCN-specific regions: Sequence locations=1-56,78-116,139-269,291-631
caactgaaaagatgcttgacttccttatgagttgttgttcattgaatttgttatttcttaattaacccaattaaactcagaactcacatttgtctcggaacaaaaggaagtgttggaaaatgcgatgaaaattggtttcgatgtgcccaatttgtgccgcgatgtttacagacgcttcaaagacaaacacaattttgggcaaaacgtcgcgagagaggcgcttagaaaagcggcggaagagctaattttggcatggaaatggttggcattttgcgaaactgaaactgtttgggatgccattattgaagcaaattttctgttgcgtaaattcttttgtgagtttttcttaacagaaataatttgaattgtgagtgtttcgtcatttcaattttattagattattgattttgttaattttacgatttgcttttatttagtgtacggtttaatgtcggaagcacttcaattgatgcaattggcacccgaaaagctgcccgaaattgctttgagaacattccaaacggaatttccggacaaagaaattcccatcaaattaaaagacgcgcaacgcgaattcgactgttaccaactttattttgaagcgatcagtcgttacaccgaatggcaaaat

SEQ ID NO: 92133 - DNA, 641 bp, Heterodera glycines
  SCN-specific regions: Sequence locations=25-490,512-641
attttttataaatgaggaagaaaagaagtggagttcacacgccgaacagcatctgtgaaaaagagcagaaaaagcctaaaattggaaatgaatctgctgaagtgtgccatttccaagcggagaaatttgttggagaatattgcactgtccacacgcggccatctctcacagtgaaggcactctccttcaatagctcaattggccgtttgtgtgtaatccgtcaaaatgaatcgactgtcagccagcagttcccgtctcaattgtcccttgttgaattttacaatgcagacaatttgccattgattttcctggaaaaaagcattccggtcaatgaccgatttgaaacgcttgtttgggtggacaattgggcggtgtttggagggttgggaggccgtctgaccgcactgtcaccattcaccagcaaatttggtcgtgttcaactgtgcgtttctgatattcttgtgatgactcgtgctggagaaaaccatcagtttgttgctgggaacacttctggtgaattgctcgttgtaaacaaccgcgacttcgacgaggagggaaagtgcaccaacaaagtccccactttttcaactgtccaaaccattaaattgtccaccgatgagcacattaccgccattggatgt

SEQ ID NO: 92134 - DNA, 646 bp, Heterodera glycines
  SCN-specific regions: Sequence locations=1-61,83-646
cgacgatttgcttacaccgacagaggctgatggttctttttccttcaaaaatattccttctactgaaatgacaaaatcatttcttgagagggacaattttgagagcgaattgggtgcaacgcagcaggatgacccttttggcgaggatttttgcgatatttcaagtaacgaaataattgacgtgttcgctgatggggatttggccggaagacctgtcatcgtattttacgctcatcgattgccttctaataaaaatttcgaccattacaaatttcttcgatttattcaatttactcttgacaaaattgttgattccgattataccatcatttacttccattacggactccgctccaacaataaacctccattgaaatggctcatccaggcgtatcagcttcttgaccgaagatacaaaaagaacttaaaggctttgtatcttgttcatccatcgcgattcatccgtttcctatgggcggtttttcaaccgttgatttcctttaaatttgaacagaaaatgcattatgtcaacagtctcaatgagctgaattcgatcatatcaattgtcactctcaatctaccagaaccgataataagatacgaccgctctttgcattccgcaacttccaacactgtgtttgaccac

SEQ ID NO: 92135 - DNA, 445 bp, Heterodera glycines
  SCN-specific regions: Sequence locations=1-445
tactctacttgttctggggattgcctccttgtgctctttgttggctatgattttgacctgcatctttctgtggtctgtgtactcagagatgagcttcatgaacaacttagtgagacaccgacttgaggcctttcgcgtctacactgattatggctggaatgacttattggatttgtaagtggtcgtgacgaccgcttccacacttcgtgataaccccttcaactccatattcagtgctatatgttctctgtccggacactgctggtgcgctcaggcctaacagccaacctgtccccctggtccgcctggtgcgttgggactgcctgcacagactggacagcttgtaggcatacgactccccggagagcctgcagagactggtcaacctgctcctccttgggcgcacctaaacatcccctgcacaacttgccctgctgagacgcca

SEQ ID NO: 92136 - DNA, 632 bp, Heterodera glycines
  SCN-specific regions: Sequence locations=1-9,54-217,239-408,430-632
gtttgagagtgccaaaaaagtttgaaaaatgccgcctccacctccgccaccgcaagccaaacagcagccgcaacaagcggcaccgccccagcaacagtcggttgaggaagagcagcaaccgcaagacccaaatgcgctcaaaattgttgtggccaatgttgacattgcgcaggcggagggcaacgaccgtcgcaccaaaagtggcaaattcactttggcccagctcagagccaccgacggcatttgccctctccaaaacggcaccaatcagttcgactcgcagaagctgatgaccaactttggcacgccgcgtgacgtgaagggcaaacatttgaagcgcatttgggagttggagtttccggaggaggcggctgactatcagcaaccgacggcgccggtcaatgccgcgccacagcagcagcaacaggcggcacagcaacaggcaccgcccaacttccgttgagtggcgcaggcggtggcacagacgcggaacggacagagagcggaaagaaaacgagacattgttgaacagagaaagagagaaatgtacggatgtgttagagagcattgtgacgacggcacaattttcaatttattttttgattaagcaaaactttgtacgaataaaagcg

SEQ ID NO: 92137 - DNA, 386 bp, Heterodera glycines
  SCN-specific regions: Sequence locations=1-123,151-217,244-327,372-386
tttattacatggcggacaacgacgaagagcatgagaggctcgccgaacaggggcgcgagtggaaagctgcgcgccgggcggagagcattgccaacttgtttggcggtgcgccgcccccggcccaggatgaggaagacgaggacgaagaagtggaggacgaaggggtggaggacgagcagcgccctcgccgtgcgcgaagcgcagggcgacgcgggggtgatgaggacgaagaggaagatgaagggggtcgggggcggcctcggcgtcgtggggcgcgagtggaaagctgcgcgccgggcgcagagcattggcaacttgtttgccggtgcgccgcccccgcccccggcccaggaagaggaggagggggtggaagaagaagtgtagga

SEQ ID NO: 92138 - DNA, 651 bp, Heterodera glycines
  SCN-specific regions: Sequence locations=1-349,372-528,551-651
catcattgttttctatttgttaattgtgtcaaagcatcgttctgctcatccatctgtcacagcaaacggaagtcgtcaaacgcggcttcagcatggagaagaagatcgtctacttcaagctggtgcaaattgtgctcactttggcattcatttggcaactcctttcacttcaccaattctgcggcacttttgccgacccaaaggccttcatccatgacatctctgttggccattgcaaacgctttacgctcatcggaaaggaatcaaaaagtggcgaatttggcgctgtgttcgaccaggacaaatggcagaaccaactgtcgatgagcagcaccaatggccgaccaattgaagaacagcaacaccaattcatggacgaattggcagcgaaattgccatccgctggacgccattgcattccgataacgatttcgctttttgactggattggcaaagacagaaatcttctcaacaatggcactttgttatttttttccctcctattgtgggccgcattttggtcgcttcttccccttggcattgccaccatcatagtgctacactctgtggaaggattccccgtctatgtctgtgccttcggttctatctacttctggtgtgtttctgctgcggtttcaccaatttgctgct

SEQ ID NO: 92139 - DNA, 622 bp, Heterodera glycines
  SCN-specific regions: Sequence locations=1-38,61-301,323-622
cacactaattgcggaggccggcttcgcccggtgtttgtcggcactgaaaaaacagagaatggacgcgtcgaaactgctgccgaagccatcgaaaaaagcgagcgatttggtgaaagacagcaagaaatttctaaacagcattggcagtgcgttgtacgcctccaaggtggtcagctacgcccagggcttcatgctaatggctgaagctagccgcgagttcgactggaatttgaattacggtgccattgctttgatgtggcgcggcggttgcatcatccgttctcgattcttggaccgtattcaaaatgcttttgaaaagaatccgtcgctggtcaatcttttgctggacgactttttcatgaaagccattggagacgctcacgactcgtggcgtgaagtcatttcgaccgctgttcagcttggcatcccaatgccagcgtttagcagtgccttggcatttttcgatggctatcgtactgaagctctcccggccaatctcatccaggcccagcgcgattatttcggtgctcacacttacgaactgctcgcccaggccggcgttgctgtgcacaccaattggacgggcagaggagggaaagtgacgtcaaatgcgtactccggc

SEQ ID NO: 92140 - DNA, 283 bp, Heterodera glycines
  SCN-specific regions: Sequence locations=1-143,165-283
ctgtgttggtcggctcaaacaggtgcgagcgacggccggcgcactcaaaggagacgtttctaacggaccaaaagcacaagaacatcggggacggctatcgctgaaatacccaacggaacacggaagtgcgacagattggaacgacatggaaaaagggaggcaggacatctttttttttcagcaccagagagccaagccaagtgagcaaccggtgtcgctcaccgaagctcggctgaacacgagaacacctcgggaaaagagaggtgaaactatctacgaaacg

SEQ ID NO: 92141 - DNA, 637 bp, Heterodera glycines
  SCN-specific regions: Sequence locations=1-388,411-498,520-637
caattaagcaacaccccccaaaatcagccgactccgtttgattgttcttcggtcgttcactctttgaaaaaccttctacagttgaacagagctgtccaaaacattctcgaaagcactgacaaggcccaacctgagcttttcggtcggatcaatcaggtgaccaattcgttgcgatcgctgcgcgaaaacgttggacaaattgaggacatcgatcggagtgaggaagagcagcgcgaactgatcgaggaccttcagcggcgattgaagaccaaaaatgacttcttcagaaacatcggcggagaaaatcggaacggagaagggacagcagcagacggagtttagcagagaagaggaagttaccgccgatggccgtaacattcgtcccgttttgtgtccccattgtccttccgtcattttgcgtcctctttctgcgaattttttgtcttccgccgacggtccgcgcattgcgttgccattgccgcgtcagaaaaaaagggcagacgaaggaggagacgaagcagtacagacaacggaacacagccaatggtggacactgacggacatgatgcaattcgagaacgttggtttcacaaacgcctttcgtggccgacgtttcttggcttgcgctgactgcgaa

SEQ ID NO: 92142 - DNA, 629 bp, Heterodera glycines
  SCN-specific regions: Sequence locations=1-80,102-629
gcaaacactgctgagagaggcaggcactcacacgccagaaaatactgacaatcatcagagagaatggactggcccagggtctgctgcaagtgcttctgttgtccctgtccgcccacatcacccaacagttgggcatggcgcctggcggcgaattccgcgccgcgcacgccgcctccaaattggtgcccggttgcggtgtcattctcggcgaccgaccgctcaatgtgacgctgcaacgcgcgctcagcgctttgaacatcttccaacgcatgaaatttttcttccacttgaccgtctcgctgggcatggaaattgatgaggccgaagttgaacgctgcaagaacatggacatgctggaagagatgctccaacagatggccggcgaatttccgcaagtgtcgcgcattttggtggacgaaagagaccagtatatgacccaagtgttgcactcgctgctccaacggagcaccatggagaaactgtacgcaagcaaaaagtgcaatgcgccgtttgagcctgccaatgttgtcgcagtcgtcggcatgggtcacgtggctggcattcgggcaaattggacaaagcacatcgactccacctctctcttgaccgtgccacgtccctcgatgaaa

SEQ ID NO: 92143 - DNA, 558 bp, Heterodera glycines
  SCN-specific regions: Sequence locations=1-174,196-483,515-558
gttgccgggctgtacgcattcgaacgcctccgatggaacaacggggccaaagaggagcgactgaagacccaattcagacagcacttggaacaacgcctccatcaaaccgaaagtatccacaccagcagctgtgagcagcaagtgacccgggagctggaccaagtttacgaaggactcaaaactgtggttgggggttttcatcgcgagatgaaagagggaattgaccagtgcaagtgccagaaggattcgctcgagggaatagtcaaaagtatcaacacaataaaaaacaagaccaactttgtgggaagcaccttagacgaattttcaaggcgtttcttgaatgcgttcttctgatcgacaatatttgcacatttcgaagtgattaattcagttggtgactttgctttaggtgtgcccgttgattgatcccgaacctctcatgaataattgtgtatttttgctcaatgcccactttcgtttttgaatgtcatttcatttttatagttatatttgtgtcttagaatacgagttctgttcaaataaacaatggttagccaa

SEQ ID NO: 92144 - DNA, 629 bp, Heterodera glycines
  SCN-specific regions: Sequence locations=1-210,235-629
acaccatcaactcaatgctttaccacatgcataggattggattctttgtgataaaaattggccctgacactccagcagttggccgactaatgcgtttgacctgtgaatcgggcgacgaagatgttttcctcgacgaccatggcgttgaagatgaaaatggcactgtcatcttcaggaaaagaagccgaatgagcagacgtcggacgaaacgacaagaagaagaagaggaagacctcgttcagacaatgattgacacgggcatttgtattcgcagtcttttgccggcagcagctgatgagtatcctgacgagaaggttgacctcaccatgagcacaatgcgcgctccatcagtctcaatttacaaaaattctacaattatcctggagcatattgccaaattggaattttatggtcacacaaacaagaagaagttgggcacatttaaagcaacatcagtggcacaaattgacgtcaaaacggagggcgatttgatcaaagccaacctaacactgcccactttggtgctcaccgacattggcactgacataaaaagtggcatgacccaagatgggctcgactcactgaccggcctggtgaaggacaaagtgcccgagtcggccaacaaaaaa

SEQ ID NO: 92145 - DNA, 145 bp, Heterodera glycines
  SCN-specific regions: Sequence locations=1-145
gatagacaatggttcaggcgtggtcaaggcggggttcgccggagagcagtcaccgaaatgtgtgttcggcaactttgttggtcggcccaaacatgtgcgagtgatggccggcgcactcgaaggagacgttttatcggaccaaaag

SEQ ID NO: 92146 - DNA, 496 bp, Heterodera glycines
  SCN-specific regions: Sequence locations=36-49,108-155,177-211,234 -461,483-496
atctctgtactcggagatgagccaaatgaacagcacagtgcgcgacggagttgaggccttccgcgtcaacaccgactcggcctggactgacttgatggacgtgcaagtggtcgtgacgccgcggtcaaaccccgtgataaccccttcactcatctttcgtgccaaagtcactgcccggacctgcccgtgcgcttggcttccacagcaaagtgtccccctggtcccccgggccctctgtgcccctggaaatcccgaaaaacctgtaagggaagagaacccccgaaaacctggaaaactcgggaaaccggtcttcttttcgccccccaaaaattcccctttcacctttccccggttgtccccccggccgcccccccagaaaagggggccccccgaaaaaaaggggagcccccgtaaaaaactgttatcccccccttaagggggggggaaattggaaaacccttggggggccccgggccccccggaaaaacctggagag

SEQ ID NO: 92147 - DNA, 577 bp, Heterodera glycines
  misc_feature (273)..(273): n is a, c, g, or t
  SCN-specific regions: Sequence locations=1-44,66-401,423-520,548-577
cgcgatgacatcagcaacaatttgacgaccgtaagcaacggatacgccgcctttccgcccgccccaccgcgatttttgggcggcccattacgccatgccaatggcggcgcttccgtggctcacccgcagcattttttggcaccgccgtcgcccttccgtcgtgccgcgccgtgcccaggcgacagcagcgagccgctgctgcggcgcagtctccgctcgccgaccatgcgacggctgcaggagtcgctgcagagtttggcggaggatgtgccnggtgtcgccggcggcgctcgtctgcgcccgcggcgacgtcggcagaacggagacgccaaagccgttcaattgcaggacttcccagtatcgttcgctgaatttgaaacgcgacacagaacgccaaaagcaaattttgggacatttggcgcaagtgcgagcgcagctgaagaacagccaagtgcaaattgagcggacaatcagtgagaagcagcagcaaaatttggcctagagagagagaaaatggccaacggaaaagaaagaaaggaaggacagacaatccaaggacacagaaccacttattaat

SEQ ID NO: 92148 - DNA, 322 bp, Heterodera glycines
  SCN-specific regions: Sequence locations=1-322
tgacggagttaaggtcgttccagtcaacgccgactcggcctgaacagacttgttggacttgatgatggacgtgacacctccgccgaagacccatggagacagcttcaactccaccttgcataccaaacgtcatctgaacggacattggcattgtactggtctgccaaccccgagatgtctgcctaggatgcccggaccgaccgaatcgactggatagcccagattacctggacgcccgggacagcccggaccgtgtggactgtgaggcgcaccaacacctcagttgcccgttgaggaacagaccctgccctgcatgccccgc

SEQ ID NO: 92149 - DNA, 641 bp, Heterodera glycines
  SCN-specific regions: Sequence locations=1-167,189-328,358-436,458 -494,516-531,585-641
cggcgggtcagactccgttggcgagtcagtgccatccgccgcaaattccgcgccgaaactcatttcaattgatcacaatcagaaatattgttgagggactgcgcaatgcatcagagcctatttcaacctcacaggaaaagctgagcagatatccgtgcgaagatgaagcaaagacgctgctttgctgtgcactgcccccggcgctcccttcgccctccctccgtcccctcccctcccatttccaattgttttcgcaaccgtcgcccgaccaattacccaccacaattagcgatttgagcagaacgacgacgccgcaaattgtggagccaaaaaatgaggaggaagcaaaggaaagtgatcaacagaagcaaaaagggacagggaacagcagagagagcgaagggacggagaaaaagcaatcaatcggtgggctaatgggggacaatggacaaaccacgcaaaaaacgaagcattgaacgattaatttctcacccacgcacttttcatttgttttgccattttggcatttttttctcttcccttcccttacttcctcttcctctactcatcccttttcttcccttttcggctgctcctccgacgactttcgcgccgtttctccgtcctcccctccgtccccc

SEQ ID NO: 92150 - DNA, 607 bp, Heterodera glycines
  SCN-specific regions: Sequence locations=1-203,225-439,474-607
gtcggaataaaacatcattcccctgcttgtctactgtttgtcccaatttctattttgccaaaatttttgccgggccgaatttgcctctgtttggtcccgacaagtggtgcaacggccgggaacctctgcactgatgaatgcttgtgatcagcgggtggcagacgctggtacaagggcgacaggacggagatgagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcataagaaataaaacaacaacatacaggcagacttgcagcaactgaaccccccgacaactttgctgtggggagtgtcgcgactcacgtcacgagaaataaaatggaaatgataaattttataagcatgatgcaatttcattaaaaatggggaaaaccttaatttaattggaaatgttccccctcttcgtcgttctattcaaaaaatatttgtttgtttacattcaattcttattcatttctcacacaaaaatgtattaatca

SEQ ID NO: 92151 - DNA, 439 bp, Heterodera glycines
  SCN-specific regions: Sequence locations=1-372,395-439
tcgcattggtttcaggattgcctcggtgtgctctctggtagttatcatcttcaccgacctggatcagccgtctctggactcggagatcagccaaatgaaccgacaattgcgcgacggatttgatgtcttccgcggcaacaccgactcgggctcgactaacttgacgtacgtggaactggtcttgacaccgccatcgaagccccctgacaaccccgacaactccttcgtccgtggcaaacggacaatgcccgagaccggccactgcgctgggcgtcttccgccaagccggccctctggctcgcccgggccctccagaccgactagacagctcggacggcctggatgcgcaagacagcccgaaaagactgtacttgctgggcaaacctctccaccttgtcgctcgcatagcctcgcctgctcacgatgcccttctgcgccg

SEQ ID NO: 92152 - DNA, 605 bp, Heterodera glycines
  SCN-specific regions: Sequence locations=1-133,155-187,212-278,300-605
gctttctttggttgaccctccattttacagccttctctgctccctactgatgtttccccctctcccatattacatcgccaggcgttgttcatcagcttcgtcctcctcctcctcctcacccattgcgttgttttctgccgcttctcctcccacgcttaggccgccggcgttggccaatgcgcggcctccgcaccaccaccagcagcagcgcttggcggagaaggcgggcaccaccgtgctgctgctgcacggcggcgaaccccgcacaaatttttatgccagggcacatttgggccgagtgcttgtcgaccgactggccgtgccgaattgggttggcatgctaatcgctgacttttacttcgcctgttccgcttttcccgcccgttgcattgccgactctgtgcactttccgcagaatgttgaccagctcaattggctgaggctccgtttggagcgcgcattggcacttttgttgcccgaatttggccccttccgttgtctgccggccacgggccaagccgaggaccaaaccaatgttggacgacaattgcacagcgcaatccgccatggcatggacaatttgctgctgtttccgctccaaccgc

SEQ ID NO: 92153 - DNA, 651 bp, Heterodera glycines
  SCN-specific regions: Sequence locations=1-246,299-390,412-443,465-619
tgcttccctttgtccaaatgaccctcattagcaaatgttcgcttctcctccttttcgtcgcgcccttttcccatgcgtttttctccggctttgaggtttctcccaacgcggcacgtctccgtcggcagtgcggttgcggcgggtgccctcctccgcccagcggcggtggctctgtccaactcggcatcagctgcgactcgccgcgccctccaccgccccctccgtgctgcggttgtcagtcgtcttgcggctgcggtggcggcggtggcggcggatgtggcggcggttgcggcggcggtgccattaaactgacaattggctgcgactccccacgccctccgcctccccctccgtgctgcggttgcgggtgcggctgcggttgcggcgggtgccctcctccccccagcggcggtggctctgtccaactcggcatcagctgcgactcccctccgccccctccgtcctgcggctgtcagccctcgggcggctgcggttgcaatcgccgcaagcgcatggcttttctgcgccgcgccgttgctcagcgctctgttggccgtcattaagtgcaaaatgaagcttaattaggcactgcttattgatgacgtcaattgccgacccgaatgatccattttattattaatattttgtaac

SEQ ID NO: 92154 - DNA, 633 bp, Heterodera glycines
  SCN-specific regions: Sequence locations=1-397,422-525,547-633
cagactgaacctgaagagaagcccaaaacatttgcttttggattgcaaactgatcaaaccggtttgatcgattcggagatgcaaacagtttcagaagagaagccgaaaacggtcacttttgcaatgcaaactgttcaaaccgatctggtcaattcggagatgcaaacactgtctgaagagaaaccgaagatgaccaacgacgaggttcttgaactcaatgtctcgaaattgcctatggatgattcgtcatttctcagtaatcaaggacggagttcccctttgttggacgaatcattgcgccgtaaatacaatgaaaagtgtgaagaaatggcagaattgcgtcatgcatatgagtttcaacagtcaatcatttctaatcaactggacgaaattgcgcggctaaagcaacaacaacaactacgaaatggcgttcaaaaaaatggaagtccgtcctcgactcgtcacccaaccattactgctgctgcttcgccgtcgtccgttttccctagcggtgctctgcccaccatttcgggtcgaccacgcgctgcaaggcgaacttattgcgaacattgcgaaatgtttgacgcacacgactcgtcagagtgtccaaaagaagaggcaaaaagagcagaa

SEQ ID NO: 92155 - DNA, 583 bp, Heterodera glycines
  SCN-specific regions: Sequence locations=1-176,200-239,262-390,415-583
agaacgcatcgcaaagtgagcagtggcgcgagggaggcgacggagtgccgcccttccgttcgaccgcaaaacttttggtcaccggcggacgcgaatgggatgaagcgggcggatgggcactgttgcgcattgtgccacggaacgcgagcaccacagctccgatttacacacttcactgatgaaaatgatatttctgaaatttaaaattggccttcggaatcaatgatactgtggattctggaatggaaagaaagaaacgatttggggggggagtgatcggataagcaaactctgctgttttattcttttggcagttcccacgcgatttgtgccttttgttatgctacagaatcctttttcaattcaatatcaaaaggctttttccgtcggtttaattaaattaattttatttttcattagttttggtagaatcaacactgattaactaattgcgtcttgttaagcattgcccgccgaatcgcttttcccgtctcagcattcgtccatcttcttccgctgccaatgggccgtcctctcaattcgttcctttgcccgctgatttggccgaccccgggacagaatg

SEQ ID NO: 92156 - DNA, 645 bp, Heterodera glycines
  SCN-specific regions: Sequence locations=1-86,114-332,354-410,432 -503,532-645
ttatcgtccatcgtctacaacacttcatcacacacgaagcggacgtggccggcgcaacaacttcaatggaggattactgtttcgacgcaacggcagcagcagcggcggagcagtctcggcgtcaatcgggagcggcatcggaccttgtgcaaggagacggcctgtcaagcggcttcctggacgcgatcatcacgaaggtcaaccgctcgcctcctcatcgcttcacggatgagatcagtgacgatgaaatccgccagctctgcaaagcggccaccgacgtcttccgaatgcagccgacgctcgtcagaatccacccgccggccgtcatcgtgggcgacatccatggacaattcgcggacctgaagaagatcttctcaacgcatggcctcccgccggagcagcagtacgtcttcctgggcgactacgtcgacagaggaccccagtcgttggagacgatcatcctcctcttctgctacaaggtgaagtacccctccaacttcatgctgctgcgcgggaaccacgagtgcgccaacatcaacagagtttatggcttctacgaggagatcgaccgccgttacccgcgaacgggcgctcgtcgactcttcgacctcttcaatcaagtcttcgcctggatgccattcgtcg

SEQ ID NO: 92157 - DNA, 634 bp, Heterodera glycines
  misc_feature (580)..(580): n is a, c, g, or t
  SCN-specific regions: Sequence locations=1-26,57-84,109-164,190-634
gaaagtgataattctattaatttctcaatatttttgttattcattttatgtcttgcgtgtccttgtctccgctcgaccaaatatcaaatttggatttcatttttcgctttgttttcctttttgtcatctccttgcaaatgtcccctgcattctctgctccaatttttctgctcattggcgtgctcttcgccaatgggtcgaccgaaagacgggccgaccaaacttcgaatttctcaaatcgaaattcggcacagaatctgtgcccattctgatcggcacggacatttgtccaactcaaatgccttttagctcatttattgacgaatatttcggtttttctccaactgacaatgaaacaaagaacaaagtggcctatcttaaagattggcacttccaaaattctcatcccgaagagtcggatttgtacgaattgcccgcctttttacgattcgattgggccaattacgaacgatggacagtcactgatcaacagcagaatccattcgggggcgattaccgttttggttatttcggcaccaaagggagttggacgcctttccactcggacgtgctcaattcnttctcttggtctgccaatgtttgcggccggaaagtgtggtatttgctacggccg

SEQ ID NO: 92158 - DNA, 631 bp, Heterodera glycines
  SCN-specific regions: Sequence locations=1-631
cgacggcgacatcaactataaaaaacggtgccgtcgatgaacagcagcagcagcgacaacggcacagttgcggtggatgctgtgccacttctgctggtggtggtaccgccccacaaacgatgccaacttcgacgacgacgccgttgttgccccggtccagctgttcgacctatcgcattgcgccaaaccggtattcggatgaggaaattcccgagtcgccggagacatcgccggacgaggagttcggctccatgctgaagccggacgattgggtgggcggcgccggcagcggggccaccgccacgaggcgcatgaagacggggcagaagttgatcagttgggttgaccgaattgcgcacaccaagtatttccgggaagcgtcggagctgaagctgatccgcaaaatgatggaggagatttcgtccatgcgtttgctgctcaatgtccaagtgaccatgctggaggggcgcatgtgctgcaattttccgcctcctccgtccgaccgactttggtacgccttccgcacgtcgccccgaatgtcggtcaaagccgtgccgcaagttggcgaccgctccgttgaactgtcccttgtcagtgaatggattgagaacaaactgcagctgatcctgga

SEQ ID NO: 92159 - DNA, 640 bp, Heterodera glycines
  SCN-specific regions: Sequence locations=1-208,230-640
ccaatttgtgcgagcacagccgatcgggtggagaaattcgcaattgggttcagttgtctgttcggtcatttcgactatggccttggcacttccgatgcaaaagcgatgaattggcacaatttgctccattctttgctcatttcgtgcccccaaattaaaaccattgacgtcaaaattttcttcgaatttcgtccgggcgaacacgagggttttttgcaccattttgctgaaatggtcacccaatttgtggacaacattttcacatcgctttccgaaggcagcgcaaaggcacaaattagcgttttgttggagttgagttgtggcattttcgcatatcaggatctctccctgaacacgtgcgatctcttcaaaaggggtgaacatgtcgacttgcaagatgcatccgaagaatactgcgcaagggaatgccgggtggtcgacccgaaggggagggagcacaaatgcgtgtttcaggtgttgggccaggaggtcagctacggttcggatgagctggcggatgtgctctcccttcagtcctatgacggtcattattcgtattacgatgccaacaatgattgggaaaatgattacgatgaagacattgattatgatttgtacgactccgattattattaggagg

SEQ ID NO: 92160 - DNA, 618 bp, Heterodera glycines
  SCN-specific regions: Sequence locations=1-420,443-618
gttggattcgctcgtccgaattcattctcagtcccgactgaatcagcgggtggacaatggtcgtgttgaaccaaggcaaaaagcggaagggcaaactgaacggaaaccaaacattgttaaacggcgactcgagtaccaacgctttcggcgctctgccggcgtcgctcagttcggcgacgagtcgcgtggcgacgcccgtacccttgaaaatggagtgtaaattagcaaaaaagaaagcggtttgtttgacatggctaaccatggaatggccccacacataaatgtccttcgacggcgcttttagtctggcgtagtcataaatggcatgcgcatcggcattcacgccgtcctcattcggatgccctgtcgagtcaccataacctaacaaatgccattttcccttaccgcaatggcactttacttttgtttctttcccactcaccgcgatagtccacggcaagcacgtggaaatccatggcggacaaaatgttgtacaattcgcaccggtggctcgtggtccgatcgaaggaatttccgtgcaggtaaatgaacaatgcgttgggcccttcattcagcgactgctccatctccgcgtcatccatcgatcgttccttctca

SEQ ID NO: 92161 - DNA, 630 bp, Heterodera glycines
  SCN-specific regions: Sequence locations=1-303,325-630
gacagacggacgacggcggaagaggggacggaaaaggcagcaacaaactcaagcagttcaaagagctttaaaagcagaaagccgcccccctccgcttcgatacgcgtcgtttgtgcgacttttgttaaccattggcggagtcgcgttggcggcgccggtctccttctgttactgctccaatttctctgggtgcctccgtatctttgcttcgccaattatctcgagcgttgtttgcttccgttgcgcgtgtactgctacaacgcccccgacctgttggccgtccgaactccgctgcgcgttggccctgccgcttgtgccacccacttttttgccaacaacgcggcccattgggcacaacggcactcaaaacaacgatttccgtcccccaattcgacctgttctctgaatggcactttgcccgtccttctccgcccgtggcgtgccatcgcggacaacgaatcgtcaattcaacgcataatcgtgattcgcagtgccccgcgagcatctgagtaccgtaagtacattcgcgacagttggaagccggcggtggagcggctgaatgggccggtggttttcgtgtcgggcagagatgggactgaactggcagaggagaatggccaacatggggac

SEQ ID NO: 92162 - DNA, 460 bp, Heterodera glycines
  SCN-specific regions: Sequence locations=1-113,142-193,215-279,301-460
tgttctcgggattgcatcggagtgctctctgttggatatcatctccacatgcattgctctgccatatctgtactcggagatgaccccaatgaacaaaaaagtgcgcgaccgatttgaggccttccgcgtcaacaccgactcactctgcacagacttgatggacgtgcaactggtactgacaccgtcttccaatccccctgataaccccttcaaatccatcttccatgccaaacatcaactgaccggacaatgccagtgcactggctctcacaacagtgaagatgtccctctggctctgcccggcccgaacagaccgtctggacagtccggagagtctggaggcggacgacagccaggacaggcagcacagcctgagcaaccagctcctccatgaccggcccagaacatcccctgcccacgcatgccctgctggctccgcccggccgccccggaggacagg

SEQ ID NO: 92163 - DNA, 415 bp, Heterodera glycines
  SCN-specific regions: Sequence locations=1-334,357-415
ttccgctcactttcaatttcaaaatgttctccgtccgtttcttcgctttccttctgctgctggccgtcctttgcttttccctcgtcgagtgcggtctcatcggcattggtgccactcccattgaagccgcttggtgcggcgtcatcggccaagagtccacccattgcccgggaggtgcccttcacggcggatttcccgccgtcggcggaacatacggatttggccgatagaaagcggcgcatttggatacggattcttttggactactgacaaatcgctgagagtgaaataaataagttgaaataattgaataaatttggatagaatatcaagcttttcactcaaaattgttcatttatttgtggtttcaattacttaatgatcttaaaaaaaacgagaattgaataagaagaaa

SEQ ID NO: 92164 - DNA, 418 bp, Heterodera glycines
  SCN-specific regions: Sequence locations=1-284,306-348,370-418
ttcttcaccttcggaccatttccaccataattggtttgactaccccttttggcgcgatttgtactggcgttgggccgagcccatctttgaagatggcatccacgtctaaactaatatcaccaacgacagtaaccgattcgcagtcgaaatggaaacttatcaattccgcccagaggaacttcaggtgaaaacgatggacgacactttgctgattgagggacggcacaaaaatgttcgagacagatacaattacaccaaaatgtatttcgtccgcaaaaacgaaatgccggccaatgtggagacccactcgatcagcagtcacatccacagttctggccgtctgagcgtcgaggcccacaagcgttggcaggccatggaatgcaaacgttccattccaattaacagcggctcgcgtcgt

SEQ ID NO: 92165 - DNA, 624 bp, Heterodera glycines
  SCN-specific regions: Sequence locations=1-49,71-219,241-387,409-624
aaaaatgttgtgctgtgaacatgacggcgttcggccggacattgtcacattgggcaaggccctttcgggtgggctttatccgatttcggcggtacttgcggacgacgaggtcatgttgaccatccggccgggccaacatggctccacttatggcggaaatccgttggcatgtcaaattgccattgaagcattgaaagtgattgaggatgagaaattgtgtgaaaatgccgagaaaatgggcacaattctaatggacgagttgcagaaattgccaaaacagaaagtgaagagtgcgcgagggaagggactgttgtgtgccatcgaattggacaacggcattgacgcttggcaaatgtgccttcgtctaatggacaacggagtattggcaaaacaaacgcacgaacacacaattcgatttgctccgccattggtaattaatgaaaaggacacacgaacagtggccaaaatcatcggacggacattaaatgcattcgattgattgtgaaaattgtgacactaatacatatccaccagggatgtgccgagccagacaaaatccgattccgattaaatcgccgattccgattatggccaaaaatccgattaattgcgattccgattcgg

SEQ ID NO: 92166 - DNA, 220 bp, Heterodera glycines
  SCN-specific regions: Sequence locations=1-128,152-163,185-220
gcaagagactcacgttgttctcgggattgcctcggtgtgctctctgttggctatcatcaccacagacatcactctgccatctctgaactccgagatgagccacatgaacaccacagagaccgaccgacttgaggccttccgcgtcaacacccactcactctgaactgacttgatggacgtgcaaatggtcatgacaccaccctccaatccccgagataac

SEQ ID NO: 92167 - DNA, 648 bp, Heterodera glycines
  SCN-specific regions: Sequence locations=1-82,104-648
atcccccggtcactttgttgctgcaaatgtcttcagaaattctttggtctactgtttttcttctattggtcgattgtgccaccattcttttttggttcttttttggccatgtcaaaaaacgacgacgcccacataaaaacgaaatctttatctgcggcgactgttggcttttggtgttcgattttcttgcgccttctcaactcggcctcgaaattgcactggtcaaccgccgctttaactgcatcgtcgacgaacacttcaagacacgcaaatggaaattgggctgcatgcgaatttgccacaaaattggagaaaatggcactaagcaattgcaaattgtcaattccgatgcaaagccattgccaattccgcaaaatccgttgcccaacaaagtcctcggattcagacacattcagatccattacatcgatcaaaatgtcatcgcatttctccgccgttttcaccgtcgtattttcgatgtttgttcaatggttttgtacattcacacagacaatgaccgcattttggactactttttgctcaacatttggccaatgtttcgtcattcaatgcgtctgatgaatttgaattccatctctttacgccgtctgcgccaattggccggcccgtcactgctcagcgattgtc

SEQ ID NO: 92168 - DNA, 56 bp, Heterodera glycines
  SCN-specific regions: Sequence locations=1-56
aggtgagatcagcaattgtggacctggacagttggaatacgggggcggctgttgta

SEQ ID NO: 92169 - DNA, 637 bp, Heterodera glycines
  SCN-specific regions: Sequence locations=1-637
ccctcactttcgcttttcctccgatcgtcccaaatgccccgtccattgcccccgcatttattagcccttcgctttttcctctgcttctgttgctcagctaatttcctgcaattactgctccaacttgtgctcgccccgcactttgtcagtgcgttcagcgcaagtcaaagggattgccaagtgaatgagctgttcattgagtgcggcacttgcgagggaagctgcagggagccgatcattacaaactgtcgcaaggagtgcaaaccgccacgttgcgagtgccgtgccaaactcggctatgtccgagcccacgacggagcgtgtgttccgttcagcgaatgcgcaacatataagggcacttctttggccaaggaaggcacgaggccattgaccggtggtgtcaacgctaacaaagagcaaaaggaaatgcacagccaattgcgcaatgagggcaaagaagcagtcgctcttccgccctccatcagaccgccctccgcaagcttgcatcattcgaccaaacagcacaaattgcaagaccaagtgatccaagttggtccatcgccgccagtaatcgttaggccaagcggacagagccatccggtgggcacttcccacatgaatttgtttgccgatctcg

SEQ ID NO: 92170 - DNA, 634 bp, Heterodera glycines
  SCN-specific regions: Sequence locations=1-163,185-634
cgagcccaccgcttaattatctgaacgtcacttcgcatgcactcatcgaatttgtgcacgacttcaacacgcgctacggcacgcgactcgcgtacacttttgacgccgggcccaactgctgtctgctgttcgaattggaaaccttcgacctgcttcgccatgcgttcaccaaatgcttcagcttcgggtgcccatttcctccttctgaaaacggcgaaacggcaacacaaacggagcagcagaaacaacagcaatcggacgaaaaagaggaagattctcgaaaggatgcttcgttggagccgaacaacgaaaacggcagcgaagaaacgaacagcgaaacttttccatgggctgaactgcgggacatccaaattgagcggatagtgctcagcaccgtcggggtcgggccccgtgtgctctccttcaccgcttcttcctcctccgcttcgtcgttgtcctcctcgtccaacgacagcaacggcaacatcgccgcctccaattgcggtgcgggcgccggtggcgggagcggcgcttttggcggtgccgcgcgcgtggactgcaaaatgctctgatggatggcaccggccgatcgattggatttccgtggctggctgactggtgatgatggtgatca

SEQ ID NO: 92171 - DNA, 638 bp, Heterodera glycines
  SCN-specific regions: Sequence locations=1-638
ttcacattcatttttgccatcgccaccaattgtgtgcacgcgtaatttctgagaaaaccgacagttgctcacgttcaacaacagcgccattttcaacaacatcgcaccaaaatggcacgccgacgaagaaagaaggagccgcgaaaggtgtcttacaagctgtacgttcgacgggtgctgaaggaagttcatccgggcaaggaaatttcaatgcgtgcgttgaacatcatgaactccttcgtcatcgacgccttggatcgcattgcaacggaggcgacgcgcatggcccactacgaccggcgcaagaccgtcacgcttcgcgacatggagttttcgtgccgactgtgcctgcccgacatcatggccaaacatgcgaaccaaaaggctcagaagacggtgaccaagttctacgctgcaaaagtgcgggaccggatgagaaggacggagttgcgtcgtggcgaatttgcgatgatgcagatggcagcgatgtgagcacactcaacttttggacgaccgccggatgataccaccttatattgttgatgattgttcctatattccccgtatgtgtatatattatgcaatgtacccaccccccagtattgtatgtgtatgtattattcttggctcccggtaaa

SEQ ID NO: 92172 - DNA, 624 bp, Heterodera glycines
  SCN-specific regions: Sequence locations=1-503,525-624
attttccaatcacacgtcacagccgcagcatcgttctgcttcatcggtaatcgtcacgcaccatgaggaagttcgcctacttcaaactgtgccaagccgtgctcacttctgtttttctgtggcaaattctctcaacgcaccaattctgtggcgagtttgacgagcctacggccttcttcaactctgcagtctcctccagccattgcgaacagttcacgctcatcggaatggactccaccactggcgaatacggggccatgcccgacaagcagaagtggcacatgcaactcatggcgagcagcggcagtggccaaccaattgatgaacagcaacagaatcacatggacgagttttcgtcaaaattgccgactgttggccgtcactgtattccgattgcgttttctctcgtcaagccctgggttcgcgacaacaaaagtcatctgcagaaggtcgctgatttgtttgccattcaattgctctgcggattgctgtctctgtttgtcattgccatgcacgttttggaccaaccgcgctcttggggatatgagagcatcgactacgaacggaccactttttgtgctgtgctctggtgctgtcctgccctggtttcatctgttttgctgc

SEQ ID NO: 92173 - DNA, 627 bp, Heterodera glycines
  SCN-specific regions: Sequence locations=1-126,151-389,411-483,527-627
attttttcttgaaaaattaggagttttgggggcgcggcggtgccgataggcgccgccgggggaaaaaatggaaattttgatcatttataaacaggttttcactgaaaattagccaatttataggtaaaattttgaaaaattttatgggaatttaatccaattcttaggggtgtaaaagtcgcatttcgcgccaaaatgcgaaatgcgaaacgccaaaaaatgcgaaaggcgaaatgcgaaaagcgaaacctcggcccatccctgctgctcacccatcagtgaccgttttcacttcatttggccaatttttcggattcgtcgttttgtcacttggcagtgacgcaaatgccctgttggactggcattccgttagccaatgagagaaagccaagtgcagcagcagcagcggatttgttcattttttgttccttttcctttcaaatttttcaattggcatatgatgctgccaatgaagcattcgacatttatttatttaaattatatttaaatttgtatattattttatctcagcagaacgtaatgttttgttatgcccaacacaaatttttgttttaacgctcgctttgacccgggtcaaattgtatttgttatccacataaatcaatg

SEQ ID NO: 92174 - DNA, 319 bp, Heterodera glycines
  SCN-specific regions: Sequence locations=1-68,93-128,157-157,186-319
gcaagagactcacattgttctcaggattgcctcggtgtgctctctgttggctatcatcgacacagtcatcactctgccatctctgtactctgagatgagccaaatgaacaacaaactgcgcaacggacttgaggccttccgcgtcaacaccgactcagcctggactgacttgatggacgtgcaagtggtcttgacgccaccaaccaagccccgtgataaccccttcaactccatcttcagtaccaaacataaactgcccggacactgtcagtgcgctggcctccaacacccaagctgtccccctggtccgaccagcccg

SEQ ID NO: 92175 - DNA, 634 bp, Heterodera glycines
  SCN-specific regions: Sequence locations=1-114,138-634
ttgagattttatcggtattatcatgtgaaaagtgcgcaattctgtcaggagaaaagcggggaaatgttcgccaacgatggaattaaattcattcgaggaattcgcgcagttcgctgtttttctatttcaaaataaaattgacgaaataataactgtcatcctcacgctattttgaaatttcctcatcgtttttttcgcataatctttgcccaaaatggccaatttgtcggccacgccttcccccgtcgtcccctcccatttcaatgcttcatcttcgctgtttcccactgccacggcttttccctcccccgctgcttcttcgccgagtttggccactgctccgttgaatgcctattccgtggtgaacatttgcatttgtgcgccgatgcttttgctgcagctgctcactttgcccattttccttatcttccccaattaccgtcgcaatgtttgctttcgcattttgttcacaaatggcgtcaccgactgacttcagttggccccgttactcatcttcgccgtgcttaatctgatcaccgatcaaattcccatttggttccaaatgtttggcagcagcattgtgctcaatgcgtggaaccttctcgtcatgcagcactttttgctggccatcaac

SEQ ID NO: 92176 - DNA, 627 bp, Heterodera glycines
  SCN-specific regions: Sequence locations=1-228,263-627
atttttgcatcaattataaacatcacacaatcaaatgatgcagaaaaaccgaaggggccaaaagtaacggagaaggtgtattttgacattaaaatcggcgatgaaagcgttggtcgcattgaaatcggcttattcggaaagactgtcccgaaaactgtggaaaactttgttgaacttgccaagaaaccgaagggggaaggttacgccggcagcgttttccaccgagtcattaaggacttcatgatccaaggcggtgacttcaccaagggcgacggcactggcgggaaatccatttggggcgagaaattcccggatgaaaacttcaaattgaaacattacggcgccggatggctgagcatggcgaattccggcaaagacacaaacgggtcacaatttttcatcacctgcaaaaaaacaacttggctcgacggacgacacgttgtttttgggaaagtgctttccgggatgtctgttgttcgccgaattgaagccacaaaaacattgggcggtgatcggcccgagaaggaagtgacaattgcagcggcagggcaaattccggtggaaacgcctttttctgtgcacaaagaggacagcagagatgagctgtaaaacccaaccaaaatggcg

SEQ ID NO: 92177 - DNA, 637 bp, Heterodera glycines
  SCN-specific regions: Sequence locations=1-21,43-637
gttcgaccatggtaatttattttttgttctctcttttcctttattcttcgctcgttccttcattttcgttggccgattctctgagtgattttttcagccgttcaactcacacaaacaattgggctcttttggtttgctcttcgcgcttttggttcaattatcgccacgttgccaatgtcctttcgctgtaccgttcgttgaaacggcttggcatgcccgacagcaacatcattttgatgctttccgataacattccatgcaatgcgagaaacccttcccccgcgtctattttcaacaatgcctttgcccatcagaatttgtatttggaggacactgaagtggactatcgcgggtacgaagtgactgcggaaagtgtcgtgagaattttaacgggcagaacacatacggacacgcccagaaacaagcgtttgctcagcgatagccaaagtaatgtgcttatttatttgaccggccacggcggcgatgggtttttgaagtttcaagactcggaagagttgacaaacgttgacttggcagatgccattgaaacgatgcatcagcaaaatcgttacaatgagttgctgctaattgccgacacgtgccaaagtgagtcgatgtatcaacgagtgtactcacc

SEQ ID NO: 92178 - DNA, 405 bp, Heterodera glycines
  SCN-specific regions: Sequence locations=1-171,195-405
gttggtcgatcaaaaaaaaaattttactaaaaatgtccaaacaatttcttctgttggctttgctgcttttattgctcccaatcggcacattgcaagaatgttcttgggatgtggatctgtgtacgggcagttgctcaacaggatgtgaacaattaagtgaaccaaactgtttttgtggaaaggaatttaaaccattcatcagagaaaatccacggcacctaaaaagcgctgttaattaaagcgtgagagaagcgcgagaaaaagcagaaaaaaggggcggatgtgatgaagacgaaaatggaaaataaattaagtaattaattgggaagaaaattattaagcatgataatttatttttgtatgactaaatggactatcaatcaaaagtttgaataaaacgatgaa

SEQ ID NO: 92179 - DNA, 590 bp, Heterodera glycines
  misc_feature (586)..(586): n is a, c, g, or t
  SCN-specific regions: Sequence locations=1-590
cacttattcaattatattgcgattattctcggctcaatgtgcagcaaatttcgttcaatgatggccaattctgaaattgaggtgaaattgccgtcgaacatcgtcccgttgcgcgaattgcaacgctatccggcatacaacaacgatttggtggctcagaagatggcacgttttttgttcgtcaatatgatggaacccttttcaagaacaaagctgagccttgacgaatttctgctgctccgtgccattttgatatgccatccaggcgctccaaatctttcgcgaccggcccaaaaacttctgcagagtgaatctgaacgctatgcgtgcatcttgttgcattttttgcagttaaaacacggatgttttgcgggtgcttcccgctacgcggaaattatgcaggtggtcgagagtatgctccactcgcagagcaagcagttcgcttatctgggacacctggcggatgttatgctagaggcgccaaaagagtagaaattaccaagaccaaaattgccattgtaaagaccccacaaaaaaacaattcaaaatttgaccaaaaactcataaaatgacttctttggtaaanaaaa

SEQ ID NO: 92180 - DNA, 623 bp, Heterodera glycines
  SCN-specific regions: Sequence locations=1-623
aaacggcggaggtttccgtcccgagtccaaatcatttatttgctctgtcccgcgttggctctgattttgagcattacccaagcattgaccattcacgtgaccgtcactgagtccatttacaccgtccgttttctgctcgtcaaattgctcggcgttcttctggaggtgaacagagcagggcgcttcagcatcgagcagtacttcgagtgcgagttcttcaacgacgacgacattgtgaagccgccatgtgcgggccaaatccacgactcggtgctgtccaagtcgacgatgaccgtggtgatgaccatccacgtgatccccatcgtgatcttcatctatttgctggtccgcaacttgaagtccgacaaattggagcatctgtttctgtacatcgaaagtgtggggacggacctttcagcgatgccgggagagtacggcgacgcggaaaagggcggatatggcaaaatgacacatggagcttattcttcgcaagagcagcagacacttaaggaaacacttaacgaccttttgctcgggtttaacgccaaatttatgccgaaaagggttttttgcgattcaatgtccaaacaacagaaagttaatggcagcaacagttcaagcgg

SEQ ID NO: 92181 - DNA, 476 bp, Heterodera glycines
  SCN-specific regions: Sequence locations=1-476
gccaaaagaacgtgtctgctacgataatcacgagtgctgcgcagtgtgggccaccaaaggcgcgtgtaaaagtgcgccccgttacatgaacacgtggtgtccaggcgcttgccgctacgatggatgtcttccgcaggcggtgaaacgcgcggcaggccttgactattattctcaatgcaagcgttggtccattttccatgaaaaatactcccacgccgaggggtggcgttcgtacagaccgaacttggtgttacgaagggagaagttgcgcaacgaatgtgagcgcaacccgcattggatggcatgcaactgtccgcaggcttgcagcaaagtgaagcgcctaaaggaggactgcagccaaaacatgccaaaggattatgtgctggaaccagtggacaatagttgataaaattgccttggttgtgatgatgatgccgcttaagcaaatgattttttatcgtagataaacgattatt

SEQ ID NO: 92182 - DNA, 319 bp, Heterodera glycines
  SCN-specific regions: Sequence locations=1-202,224-319
ggtttcagctattgcatcttcgtgttctctggtggctatcatctgcaccgacggcgctctgccatgtctgtattcacagattaggcaaatgatcaacacatggcgctacgtacttcaagtcttccggcacctgcaccaactcgtggctggactgacctcatgtcacctgactctggtcctgactgcacctgctaaactacgacatcaccccttcacctccctctggcaagacttacaccaactgccccgattctgccgttgagcaggactccaacagcccacctgcccccctggtgctcccgcgtcccataccgacccc

SEQ ID NO: 92183 - DNA, 606 bp, Heterodera glycines
  SCN-specific regions: Sequence locations=1-606
ttggagggcgacccggctaaaagaggcatcataccaaatgcggcacaacaaatcttcgatgaaattgagggaaggcgtgaacaggcccgcagatctggcaaagtgatcccctctttggaggtttccgctcagtttattgagctgtacaacgaagaactcattgatcttttgtcaccggaccggggctcatcctccatcaagatcatggagaacccgacaagtcacgaaattttgctgatgggcgcatcatcgcgaattgtcaaatcgcaggaggacattatgtccgcgctggtcattggtgcccaaaaccaaacaaccgcacagctgcagcgaaagtacgccgcattggagacgcgtgtgcgagaatacgagacggaactcgaaaacgggcgggagcagatggaacgtgccaagcgctacattgttgaccaggagaacagaccggagaaggacgcacgtcgcacactgctcaaattggctgaaatgttcgagtcgcccattcccacaacatcgaatgtggcccgtttacgcaaacagtttgacgacgacgacaacgatgctgatgacaattagagaccggacactgcttcaatcgattaatcgggg

SEQ ID NO: 92184 - DNA, 657 bp, Heterodera glycines
  SCN-specific regions: Sequence locations=1-207,230-657
gaaatttacaaccattggttgaatgatatgcgacaatgggatgaggaatatccttctttggaattcatcgagaaaaagtccaaagagttggtcaccgttttgtccgaacctcccagaggaccgccagtcgatgtcatcagattggctacaatcgaagcagagagagaaaattcgactaaactgctgaaaaaactaaaagaatggcaagaagaacaaaaagttggaaatgcaatgcatcagccttttccgccacctcgtcaacccttttaccctccctctcgtcctattcgattcccgcattggccatttcatcatgatccttcacggccaagaccgcacttgatgtatgggaggtcagtgggttaccatccatatgctaaccagtttcaccggccaatgactcaagcgaggatgcgatctccgttttgctatggcacttctcaaccgtttggcttatatcgttatcctcgtaacattccagctaattccgcatcaaatttccaaccggaagcactcaagaacagtgctttaaagaaatcacaatctgcaatggagtggacgaccaatcgtccggctccctattttccccggaacgattacgcagctttcagtacttcacaagtgggaaacgcgagaggcacttggttctgatttatc

SEQ ID NO: 92185 - DNA, 647 bp, Heterodera glycines
  SCN-specific regions: Sequence locations=1-647
cagcctttctactcacatgtccgagtcggttgggcacaagcaaatgcaattttgcaagcatcgcttggctatggcaaatttgggtacagctggcgcagcaaacgcggcaccgttttccacgatgcgtacgggaaacattttcatggacgagacttccgtcaaggcgatgtaatcggctgtctgattgtccttccctcaccggaagagatagctgcccaagggttagccccgtccgatgtgatgcccgcgtcgcgcaaagactgcgacctgatcaagttcaaacagacctacttcttcgaggagaaggacgagccacagcaagctcagcaacggctgaagcctctccagggctccaagattgaattcttcctcaacggggattcggtcggagtcgcctacgaggacattttcttcggccattacttccccgccatctctctgtttcaatcagcgcgtgttcgcttcaattttggtcccaaattccgccatgcgcctcccgccattcgtaagggcaccgcacaaccgatgagtgcgcgtccggagcaacagcaagtggaacaggcgttagcggacgcggttttcatgacagtcaatgtggaggaattggtacagcggaacgaggattattttgctgctctggcggccaa

SEQ ID NO: 92186 - DNA, 586 bp, Heterodera glycines
  SCN-specific regions: Sequence locations=1-586
ggcggatgcccatcagtcgttgtcccgtgaatccgctcaatgcaataaaaatgcgcaccaaattctacacaaagtgctcacacaattggaggagttgcttaatgatatgaaaagcgatgtttctcgtcttcctaccacattggcccgacttcgtccggtgactgaacgacttggaatgacagaaagagcaattcttggacgtctgacaagcaaagacccagacgcactggctgggcaaagtccattacctccgcccggaccctttgtaactccaatggcacaaagtcgcttctcgggcatacagccgaaattcgccgcacttttgaagcccaaacaccaatcaaagaaagaaaatctgccagagaaagacggaaacgacaaacaaaatcaggaggaaacgcgaccgagcaaagaggaaaaacggactgacgctgatgttgagaagacaagtgataggagtacaaaggaagcggaaggaagttgcaaggaggaggcagaaccagtgcaagacgacaccgtgaaagaagactcaactgtcgaggagaaaacaaaagacagtgatttatcatcagttcagcaacctaat

SEQ ID NO: 92187 - DNA, 581 bp, Heterodera glycines
  SCN-specific regions: Sequence locations=1-149,173-204,226-310,332 -396,422-581
ggaaaacgcgtgagcgaaaagcgaagggaagtgctgagaaaggctaatctttcctggtgattcaccgattaattagcctcgggtgatcagttgttctgataatttagcacaatttatgccacggatgaaaagccgagcttttcgttgcgaaaaagctgcgcaattcttttgttggaacgcgacaaattgcaaaattggagccaatacatttttggagacaacaattgtgagggcaatgatggggaaaatgatggtcaacaattggcggatggaagcgaatcattgcgcgaaacgcaactcttggcctccattttgggccatttgcaaaatgcgcttgaggggcgaatggcaaattgcgtggatgccgaaggggaaaacgtagcgaaatggcaaattggggagaaggaggaagaagaaaaggggcacgaagaggaagcgaaaatggtggcatcgttgtgggaggaacaagtcgaaattgtgcgcggaatggcacggcatttgacgcccattttggacggagggagcaaaagcggggggactgatcagacaaaagtgacggatcagcaacaggccaattctga

SEQ ID NO: 92188 - DNA, 638 bp, Heterodera glycines
  SCN-specific regions: Sequence locations=1-17,39-638
atttaagtcacttttggaattttatttattttaaatatggacgtcattgaatatgaatcgccgagagaacaaacagaaattagtgccaatttgctttccgattttggagtaactgctcagcaagcgtataaaatcgccgttactttttacaaaaacgaagaaaaagcgaatccggtgtccatcgactatttgtacaaattgcgttttatggccctttcgaagcaggcgaaatacgggacgtacagagaagaagtggcggactgtggatggttcgacattatgggcaacgaggcgaagaaaacatggaaaagaatcagcgacctaacttctgaacaggcaatgctcgagttcgtccgacttttagacgtcgtctgtccatcatttcgcgcacaattagaaatcgaacgcaaagcgaagacaaatgagccgaatcaaaaagccaccattgacaatccatcaaaggattccaatggacagtccaaaaacgattgtcacctcaatgtcttagtggacagtgcgtccatccgagcgcaagaagttcttgaacaatttgaacagcaaaaacgacaaatccaagaggcacttaacaaacaaacttaccaccagtttttggcctatgctcaacaaacgcatccagg

SEQ ID NO: 92189 - DNA, 566 bp, Heterodera glycines
  SCN-specific regions: Sequence locations=1-566
agaataggcgaaaatctgctcactttcattcccgaagaaattggacacttggagaatttgaagagcctttacttgaatgacaatccaaacttgcacagtttgcccttcgaactcgtcctctgctcatccctcgaaataatgtccattgagaggtgtcccctgtcacaaatcccctcagatataatcgaaggcgggcccagtctagtgatccaatatctgaaaatgcatgggccctatcggggagttctcaacatgtgatcgttctgctcgcatttttctgattactcaatgacaaaagatgccaatgcctctggactgctgccaattgaagattcatcatttgttgctgtaacataatgtaaagcacaaagcacctcttttgttctttttctcaatacttcagcgaatattttattgttatcttttaatctttcctatcctatttcccgtttcattttgccgttcgttactatcaaaatttatattatgtaagcccgtcatcatgtcagtcattttttgacaggcattattttgtttgccataatattatttacgaatgtatactt

SEQ ID NO: 92190 - DNA, 659 bp, Heterodera glycines
  SCN-specific regions: Sequence locations=1-227,250-659
attcattggtatttggcaataattgtaaacgtccgacatggcatttgctctctcaataccacggacaatgaatccatttttcctacttcaagtcattattcaccagtgccgcatcttatcgtgctcaattcactcatcgacccagctgaagacaaacatttggcagttagggaccaactcggagaatatttgcacttggaatatgcagataaactcggacaggacaccaagacttatttcaataagcaaatgatggacgtggttgtgccgacgatgctgccccagcagaagaacttcatcgactgtggactatttctgctacattttgcgcaattattcctcagcaatcctccaaaatttatatcgaggcacagctcatttcgccgctggtatccaacttttaaaatcaagcataagcgagatgagttaagaagtgtgataatgcaattggcgtcccatgtcaagtcctctgatttcgtccaacttccaactccgaaacggaaaaacaaaaagattggccgtcgttcgcaagtggataaaatgcagatgatcttagacggaatggcactgatgggccgaactcgacgttacagcgactcggaattagacggcattatgaaggacgaacatttctcttgtttgtacagaccgcgctcgtt

SEQ ID NO: 92191 - DNA, 141 bp, Heterodera glycines; identical to SEQ ID NO: 79427
  SCN-specific regions: Sequence locations=1-141

SEQ ID NO: 92192 - DNA, 569 bp, Heterodera glycines
  SCN-specific regions: Sequence locations=33-411,435-569
cctcgtgccgaattcggcacgaggcgcatttacgggagctgccctttacattaaccttgtggaacagccaagccgtctgcaattggaaaccgctgccgcgttgaaacagtttaaagagagttacacacgtgcgattcccatgcaagctggtttggcaattctttctggcattgttggcatcggtggtacaattaagactggcgagaaggcttgggcttttggcgctgctttaatgttggccaatattccatacacttttctatgcatttttccagtcaacaaacgtttgctggctaccaacgaagcaaatgctgatgaaaacactcgtgcagacatacagcgctggggccgacttcacgcggtgcgcactgtccttggtttaattgccactggcgtttatttatacgcagtaagcaaagaataaaaggagaaaggaactttaaatccgacaacataacataaaatgacatatttttaatgtcaattttgcatattcacaaatttgtgtgcgtacactttcaatcacatttttatatttgcactttattacataaaaacattaaagcgtt

SEQ ID NO: 92193 - DNA, 289 bp, Heterodera glycines
  SCN-specific regions: Sequence locations=1-122,144-289
tggcgtgctcgccacaacccctcgtgatggcacaaggcgcaacccgttccagcaagacgcgtccatcattcgcgaccgcgaaatccaatccggacaagtcggtccctgtggccgcacgctcgctggtggcaacaacaacatgcagtccggcgtccaggaaatcctgtccgagtttggcgagctcccacttgtggcccccggctccgctcttaccatgacggttcaccaagtcaatgccgacggcgctggcccttacacctgtgaagtttccatggacggcactggcgcc

SEQ ID NO: 92194 - DNA, 630 bp, Heterodera glycines
  SCN-specific regions: Sequence locations=1-573
aacaaactgaagtaataaatttcaattcaacaatgaaagtggacaaatttttggacaaactttcgcgaaaactttcgagcagttcgctttgcttttgtccagcaataaattattgcgatgcaaactttggataccaccgaaaagcgtcgaccaatgagcggcaaaaggaagaagcggctgaaggggcggcggacgaagcggaccaatgttcacacattagcatcccggttcagtaccgcaaacattcgtccacctcggaaacgtcgtcactgtacgaccaaattgtggaagcggaagttgagaacgaagagacaatgaccgaaacattttgggtccgacgccaacaacagcaccaattggtgcaggcgaccattttcccaattagcaaacccttcgcccgcggcacaatcagaatggcaaagatgccaaagcgcgggtcatcaaaaaaacggcgcaattcattccccgcaggcattttcaatgaacgttttacggatgatctcgtcagtgtccaattgaccatctcagagtttaatatggccaaaaaatgcgaggcactcaaaaatatgaaacaataaaataaaaaattgaattttcatttttaatattattttgataatttaatttaaa

SEQ ID NO: 92195 - DNA, 649 bp, Heterodera glycines
  SCN-specific regions: Sequence locations=1-36,58-523,546-649
aaacaatcgacagattaatcgcatcactcgtcgattgctgtgtcgtctttaagtttgatgggtggttaatcaacatcgaaagtgaagtgaattcggactctgtcgactatttggaatactttctgttctctttgcggaatgctttgcatgataatgttcacaaagatgccaaaattgtttggtatgactcagtgacaacggacgggaaattatcgtggcaaaatgcattgaatgccaacaatttacgatggttcaaaagtgtcgatgccttctacacaaattacgcgtggaaggaagaacacattcagcaaacggttcgaacttttctttcgacttctgaactttttccgaggaaatcgctgttcgatgttttcgtcggaatcgacgtttttggccgtggctgtttgggtgatggcggatggaattgcgtccaaccgatggaaatccttcgccgttacgctttgtccgttgccatttttgcccccggatggatttgtgaaaaattttccggccaaagtcatcgcatcctttttgacaacagttttcgtttttggaattcgttgagtacatttttgtatccacatgctttgcgacaacggaacttccgaacagattttgcggttgcattcgcatcggaacgccccaattg

SEQ ID NO: 92196 - DNA, 661 bp, Heterodera glycines
  misc_feature (541)..(541): n is a, c, g, or t
  SCN-specific regions: Sequence locations=1-27,49-287,309-661
gtcgcattcattttgctgcttttggacaggaaattaagcacagaatttagggattttcttggtgaaaattggcaatatgaagacggcacgaccgaccgattggccaaatccgcacaaaatcggattcaaagcacagcttgcaaagttcagctaaggaatttcctccatgacatagcatttaaaaggcattggccggtcaaagaaatcgcgaagaattgcgacgatttgttcgaagttccctctgctgccaatgctttgaaattccgtccgttttcccccggcacttcccatgtcaaaattcttttcctcctccaattgaatgggagggattctcgccaactccgccgtctcttccgttcccttttcctcccccgtcacttttattttgtccacgtcgacagtcgccgcgaatttatgctgaaaggtcgaagagtctttgagggcggagggattcgcaaattttcgcgtggcaaagcgtcggatggccaccatttggggagggtcgaatttgctcgaccttttcctttggacggtggcgganacactcggcgaaacgaattcgaattgggcgcaatgggattatattgtgaatctgagcgagacggacatgccaattctatcagtggaagagttggaacagaacttggccgagaatcgcggc

SEQ ID NO: 92197 - DNA, 283 bp, Heterodera glycines
  SCN-specific regions: Sequence locations=1-283
gaagaacgcaacgaactctctgaagtcgaacgagttcgaagaagccatcctcaaatacagcaaaactgttacgttgaatcgagaccctattttcttcggccacagagcgtgtgcttattgtcgcctggagcaatatgatctcccgatccaatactgccctacggcattggcattggacccaaactatgcaaaggcttactggagaatgggcgttgcactttcatgtcagaatccctaccattgcgcgtgtgatgcgtacaacaaggtcttggagttggatcct

SEQ ID NO: 92198 - DNA, 577 bp, Heterodera glycines
  SCN-specific regions: Sequence locations=1-294,318-470,492-577
ctttatttgaacaatggaggttgacgtgtcttcttcatctgactcggccacaaatgttttgttcagtttacgtgccgatcggagtctgttggacccgacttttgaccggtacattttgcgtacagaaaaactggcaatgttcaagcggagaatggacgacaaaattcgtttcaaattgccctccgacagccaatggggctaccaacaaattcgggcccacactttggcctcccatcttttcttcgaccatttcgcttcctccgttgaccagcaattatttttcgcatttctcgacgatctccgtctgatttcttttacatttgatcgaacatccaaccgttggtccgtccccgtccaagtcgcggacattggcacttcctccgtggcattgtccccctcatttgtctttgtgtctgaggacgacgcttcttcccagtcgttccccgagagtttacactttgtcgactcgcgcacggcgatcactgcgcgcggactgaacactttcagtgtgtgggatacgggcgagcgacgcccgaccgattggacgacacaaaaatggaggggaatgtttcactac

SEQ ID NO: 92199 - DNA, 640 bp, Heterodera glycines
  SCN-specific regions: Sequence locations=1-143,165-543,567-598,621-640
ttttaaatgatgtcttcgagttcttttgagcaattatcgtgcgaaattgccgaattggagaagttacgccaacaatcacaactcccaaatgttcaaaaggctatcgatgagctaattggaagatggaaagtgaaaaaggaagaacagaaaatgaaaacggacaaagggacagcggagacactttcagccccgacagaagcaccgaaactgatcagcggaagtgtccacgttcgtccgacaaagaaactgaccacttacgcgtttgatgagagtgacaagttcgtgaagctgtactattccctgcccggtatttccgactccgtccccggcacaatttcgaccgatttccgtggaaaactcttttccattgtttgctccacctccaggggattgactacgaaaatccagtgcaaggactttggcagggtttttgaaccggaaaagttggtgggaaaccaaaaaacggtgaccaatggttattttgcttaaaaaggggaaagaaccccaaaattggggatcccttcggaaatttggaaaggaagtggggcaaacggggggaaaaacggtggaaaaaagagcccccccccaaaaagttttgaataaatatataaaaaaattttcccaccccgcaaattacggg

SEQ ID NO: 92200 - DNA, 519 bp, Heterodera glycines
  SCN-specific regions: Sequence locations=1-18,44-156,179-332,354-519
cggacggacggatggacaacatgaatgtgtacaaaacaagtgaatgggacgaatggtgtgcatttgcaaaggccaaatggtcgaaaaatgagacaattcatctttttatttttgcaaaaagcaattcttgggaagtgtcaatgacattgccataaggaatattaaaatatttcatttcaaaatttaaatttcaatagaatctctgtacaattcggcctcgtcagagggaggcgtcgaagtcgtccaattttggcttttttgcgcacatcaactgctcctcgtccgagtcgctcaaagccaagtcggcgttcagttggccagacgtgtgcatggcgctctcctcgagcttttcctcggaggaaacaggcacagcagcggagattaaagtgtcttcgtcatcccacactgaaaggatggaaaaacaaaagatgcaaagatgtgaattgcaatatttccctaatccttccgagtgtttgtcacttcacttccggtcaaaattataaattacaaattttaaaa

SEQ ID NO: 92201 - DNA, 627 bp, Heterodera glycines
  SCN-specific regions: Sequence locations=1-511,546-627
gtcagattggcgaacaatctttccttcgaggatttgaggcgagagaaggaaacgctggagggacgagtggccgaactcaccaaagcactcgacgacgcaaaatggagggtcggagaattggaagcggaaatgacacggaaggacaacttcgaggaacagaagcgaaagttggagtggcgacttggagagatgacacagtggtggaacgacgcgaaatggagaatcggcgaattggaggcgactttgggacacgagggaagcgcacgcaataaccgaggggaaggcaatggagacgacaagtgaaagggaagggacggcgaaaagcaattggtcggtttagcttagctgagactttgggacggttcagggaactgttgagggacggcattttgctcatcagaaaacagtcacatttggacagagacaagtggaagatgatgaaatatgagcatgcactggagaaggatgttcgtctgaggagttgttggttcgaagtcgattctgaagggcatcaggaagtgtttctgattggcacttttgtgaattgggagtgcgctttgttgtgtgagcaaattcctgaaaagccttcacgtcggggcatttggcttgaccttccccccgggcatt

SEQ ID NO: 92202 - DNA, 650 bp, Heterodera glycines
  SCN-specific regions: Sequence locations=1-650
tgagtttcccaaaatgtcctccattccaatactctcctccttttcacgtgctcttcaaatgcgccaacatccgttgctcttcggcatgattcatgtacccgcattgcccggaagtcccctgtcaaaattgagcattgcgcaattggtggacagagtgagtgccgagacggaaatttatgccgagtgcggaattgacggagtgattgtggagaatatgcacgacttgccctaccaaaaaggaattgaccatgggcccgaagtgtgcgcgacaatggcacgcctctgcgcggcgtgtgcacacactttgggcgccaatcgtcgcccaaagatgcttttgggggtgcaaattttggccggtgccaaccgcgcggcgctggcggtcgctcaggcggcggaattcgatttcgtccgcgctgaatcgttcgtgtttggccacgtagcagatgagggttggatggacggatgtgccggcgaattgctccgttaccgacgcgcaattggcgccgaccaaatagcggtcgtgacggacattaagaaaaagcattgttcccatgcgatcaccgccgatgtcagtgtcgcggaaactgctcgtgcggctgaacttttcctcgccgacggtgtgatcttaagcggtgccgccacgggtgaag

SEQ ID NO: 92203 - DNA, 647 bp, Heterodera glycines
  SCN-specific regions: Sequence locations=1-246,268-499,521-647
cctctacagtgattcgttggcccgttatgggaagtccccttacctttacccgctctacggattgggcgagttgccacaaggatttgcgcgattgtcgagtatttatggaggcacgtacatgctggacaagccagtggacgagatagtaattgagaatgggaaggtcgtcggagtgcgaagtggcggagaagtggccaagtgcaaacagctttattgcgacccctcctacgtggacagcactcgtgtgaagaaattgggaaagatggtgcgtgcaatttgcattcttaatcatccgattccgaacaccaacgatgcgccgagctgtcagattattattcctcaaaaacaagtcggccgcagttttgacatttacgtgtcttgcgtttccaattccaaccaagtgactccaaagccgtggttcatcgccactgtttcgaccactgttgaaacggagaaccccgaggctgagatacaaccggcacttcaattgcttggacccatttttgaaaagtttgtgacaatatcggatttatacgagccggtggacatgggctatgagtctcaaatcttcatttcgcgttctttcgacgcgaccactcactttgagaccacttgcttggatgtgctggacattttcaagaggggca

SEQ ID NO: 92204 - DNA, 637 bp, Heterodera glycines
  SCN-specific regions: Sequence locations=1-523,550-637
tttcgcttttccgtcactacggccacccgcgttttgcattccctttctatcataaaattgagctgctgattcttgtaatcatgtcaatgggtggccattgaccgcttctgcatcggtggcacgcgaaaaatggaccaggcaaaacaatgcctgtcccgtttttggcattggctgcgaattcgtttaattgccttatggacttttcttaaatgggtcggccatgaaatttgttgttgcggcatatgcttacaggaggaggatgatgtggagaaaggacgcacaaagaacccttttgatcagcaagtgacaatttcgacgacagcgatgagtgccggtactcaaaatgcgacaggacagggccacgtgcacaaagtgataatggtcggctcaggcggcgtaggcaaatcggcactgacacttcagtttttgtacgacgagtttgtggagaattacgaaccgaccaaagcagatgctcacagaaagcaagttgtgttggacggggaatattgtgcggtcgacattttggacacggcgggacaggaggactattcggcgataagggacaattactatcggtcgggagaaggtttcatctgcgtcttctccatcaccgatttggattcctttgatcaactcg

SEQ ID NO: 92205 - DNA, 644 bp, Heterodera glycines
  SCN-specific regions: Sequence locations=1-212,236-255,308-363,443 -537,559-590,612-644
cctaatttgtgcttccctttgtccaaatgaccctcattagcaaatgttcgcttctcctccttttcgtcgcgcccttttcccatgcgtttttctccggctttgaggtttctcccaacgcggcacgtctccgtcggcagtgcggttgcggcgggtgccctcctccgcccagcggcggtggctctgtccaactcggcatcagctgcgactcgccgcgccctccgccgccccctccgtgctgcggttgtcagtcgtcttgcggctgcggtggcggcggtggcggcggatgtggcggcggttgcggcggcggtgccattaaactgacaattggctgcgactccccacgccctccgcctccccctccgtgctgcggttgcgggtgcggctgcggcggcggatgtggtggtggcggttatggtgcaaatggcggcggcggctgcggcggttccattaagctgacaattggctgcgaaggcccaaaagccccgccaccgccccctccgtgctgcggttgcgggtgcggctgcggttgcggcgggtgccctcctccccccagcggcggtggctctgtccaactcggcatcagctgcgactcccctccgccccctccgtcctgcggctgtcagccctcgggcggctgcggttgc

SEQ ID NO: 92206 - DNA, 442 bp, Heterodera glycines
  SCN-specific regions: Sequence locations=1-110,220-442
aagtgccttacgcggccggcttttcctacaaccgatacaacaccgaattggtgacaagtgagctagctttactgtgcacgaattaagctgtataagctgtattagaaccatctctctctctctctctctctccgcattctgccctatctgtctctttcctatccgtctttcctctcactcttatctttctctctctctctcgttctctctctctctttcgtcttctcgactcctcctccttcttgttagatctttttctcttgcatttctcttcttcaggcagtgaaccgggcgaattttcccttgcggcattgatcaatgaaacgcgagtggctaccgaatgggaagaccccaaatatgtggtgaagccgggcaatgtgcaaagcgtttggctgcattggcccggaatcatcagccgaggccgaatgtacactgtgccggc

SEQ ID NO: 92207 - DNA, 622 bp, Heterodera glycines
  SCN-specific regions: Sequence locations=1-542,564-622
attaaaaccaacctggcaagacaaagatttctggaagctttaattgtttcatcgagggggacttcgaccaaaaagagcgatgccgggaataagaaattgcgaactttgatatcagttcgatcgttgcgcgaacttgtgaaccgaatggttggaaatgataaagttgcaacggataaatctgaatctgattgtaaacagcaatcgtccgttttcccctatttgttggctttgcattctgccatcgatttttactcaattttggatgaaaaatttaccgattgtatatcgactgacgaccaaccaattgctgagattgaagcgtgtgtgaagcatctgtctcaaattcaatgtgatcgtactaatccgttgttggcaaaggctttgtcaatactcgaattcgtctatgacaatagcggttcttcggccattgcttcatctctattaaatatcgccaagtgtcgtttggaattaaacgatttcgttggctttttcaatttgaatctgtatcaaacttttgacaataatgctcaagttggaacgccaataactgccaaatatgatgaaaataatttatcgacaaaaattcccacaaaccttttggcaaaattgggtgcaactttat

SEQ ID NO: 92208 - DNA, 523 bp, Heterodera glycines
  SCN-specific regions: Sequence locations=1-186,209-523
gccaaatgcacttttcttccgtgctgctccttcttcttgtcaatttcgtccttttgcttcttcttcggccttccgtcgatgcttttccccatcctccgccatgggccggccctccgcgcccgtggggatgggggcaaaggccgtggggaggcggcggatggcgacgacggcaccacggaagaggccgaggggacagcggaagctcagaaaggggaggagggcgctggagggggagaaaccgaggcgacgattcgtcggaagaaaagcacagaggcagcaaataccaacagccgcaacaaaatgcacagtcagtggccgtggcaattgccgtggccggcggcgcgacgggaaacgccgcggggtaaacgcatgacgaagcgccaattaagggaaattagcagaaacaaacgcatttgacgactgaccggccgatggccataacatttattttctttattacactttgtgattgtaaaaatatgaaatttcctctttgataattgtgcccacggcactgtccctt

SEQ ID NO: 92209 - DNA, 590 bp, Heterodera glycines
  SCN-specific regions: Sequence locations=1-29,51-322,344-590
gcctccgtccgtgccctcctcttccctttcgcccgtccctccctcccctcggccaaactcttacattgacagttccgactgggaccaactgactgggccctacgcgcgacagccgtggtattacggtcacataacacgggaacagtcggacactctgctgaaaacgcgcggcgttgagggcgattttttggtgcgcgacagcgaatcgaagcccggagatttttccatttcgctgaaagactcggccaaaaacaaacacttttgggtgcaattcgacgccgcgagcgcccaatttataattggcaatcgccgattcgaatccatggaaaaattaatattgaattatatgagttcgccgatattcagcgacggaattgtgaaccttttcctgcggaaacctttaccaaaataaacgacggaacagaaaagtgagggggaaaaacagctgaccaaaagagcagcgaatgaaccgccaaagaaaagggacaaaaggccaaagaattcattttcatttttttgattttcaaattaaaaaccaaaaactcatccgtttgaatgtataaaataacagacaagacaaaacatggtaa

SEQ ID NO: 92210 - DNA, 649 bp, Heterodera glycines
  SCN-specific regions: Sequence locations=1-54,87-649
atcagtgatcaaccaaaacccttctgttactaagaccagcaatgtgggtgaaaatgccagaatggaattggcccaaaaaatcgaaggtcagatcacgggacgcatcgacggcattcgtttgttggagcgggaggacggactgctcgttgtaaatgaggacagaacgctaagagtgctgctcaaacccgagtcggaaatgttttggccttcaattatccatgacttgccgcacatccccacaaaactcacctgcagtgaacagaaaaacacgattttagtcggctttgcaaatggacagatccacgaatattcaattgaaaactatttcaacaacatttccttcacacggcaatggaattcgcacacccaatccatcagtggactcggctcttcacaaccattagaacaaatagtaagttgctcaaaggacaaaacagtgggttgacaatgcacgtcgaccactcgcaaaatcgcaagttactgtacgggtactccttgtaccacacttcaattcaatggccatgcttccatcgattttgtgggcgattcttcccgagatatgtcagtgcttcggctggtggttgggacgcaacatctaccgctattaatcaacacattatctgctcataccgcggcaatcactgatcta

SEQ ID NO: 92211 - DNA, 613 bp, Heterodera glycines
  SCN-specific regions: Sequence locations=1-8,30-61,84-96,119-446,482 -488,510-613
gcattcctgtacatacctgtacataatacctcctacattcctgtacataatacctccataatctctccctcctccaactcttcgatatttcattactccatcggacggacatgcgcgaactgttgttcaagaccgccaaccaggaacagcacactttcactcttgaggtcgaggagaacgaaacgatcgctcaaatcaagcaaaaaattgaggacagattcggcctcgcgttcgaagcagatgagcaagtgctgttttacaatggaagagagctggacgacgcgctgacggtggacaatctcaacattgaagcgccgaatttcattgtcgtcttcgtgatgaatgatttggttggtgctgatgaaggtgagatgttggtgcagcctatgcacatgaacgatcatccggcggcggcgcaagcgggctatgtgaacgaccacgctgcacaccatcaccaccaccatcatcatcaacaccaccagcagcagcagcagaatgggatgctcatcgatcacaacgtgtggcagcagattcttgctcccgtacaacaactggttcagctgacggcgcaagattacccggccatccgtcgactcatggcgctgggctttcc

SEQ ID NO: 92212 - DNA, 92 bp, Heterodera glycines
  SCN-specific regions: Sequence locations=1-92
tccaatggaaagcgatccgtccgttccatccgccgatggcctaccaaatcgcccaattaactctcgagatgatgtaactcaattaattgcac

SEQ ID NO: 92213 - DNA, 636 bp, Heterodera glycines
  SCN-specific regions: Sequence locations=1-636
gtcgcttcgggcagtgccgattgcaccgtggtgctttggcacttcagccaacacttgggcctactcgtcggggattacaatatgcctggggaagagccgtcgcctcgtgccattttgactggacacgactcggaaatcagtgcaatttgcgtttcggctgagcatggcattgtcctctccggctccacggatggtgcccttctgatgcattccacgcagggggacctgctgcgcagcatcatctgctcaaacggcaacggaacggacacattggcaccaatcaacaacattctgttcagcagagactgttacattgcggctttcattggcaacgattccctcgccaccttttcgaccaatggtcagctgctgaaacagcgcgggtacaaatgtgccgagaagattctctgtgccattttgtcccgcgacggagaattcgttgttttcggcactgacaatggccgcatttccatccttcggcttttcacgttgcaattgctctacacttttgcccaatgcgacagtcctatccgttcgttggcactcagcacaaaccagcggctcatattcggcggcttggactccggggcaattgtggtgttcaacgtggacttcaaccgatggcaccattatggc

SEQ ID NO: 92214 - DNA, 624 bp, Heterodera glycines
  SCN-specific regions: Sequence locations=1-624
cgcttaaaggcactctgtcactgttggagcgggtgctgatgaaggacgtcgtctcaccggtgccgcctgaagaagttcgcgcagtgatcagaaagtgcctggaggacgcggcgctggtcaattacacgcgcatttgcaacgaggcaaaaattgagcagcgcatgggcctggacgtgagcccacaacagcgcatcgaggacatgatcagggtgacggagctgtgcattgatttgttgaaagagaacgaggaacaccacggcgaggcatttgcctggttttccgatttgcttgccgatcactccgaaattttttggtccctctattccgtggatttggacgccgcgttggagctgcaaccgcccgactcgtgggactcattcccgttgtttcaactgctcaacgactacctgtgcattgatcaaaacttgcggatgggcattttccacagcaaattgatcagccaattttctccgatggttgtccgctacattgatttgatggagcattcgatcagccaatcgattgagaaaaatttttgccgcgagaaatgggaagtgcgcaaagacggttgctcaacctcggaggatgtgttctggaaattggacgccctgcatgcattcattc

SEQ ID NO: 92215 - DNA, 181 bp, Heterodera glycines
  SCN-specific regions: Sequence locations=1-181
tgagaattctcggcaccgcgtggaaagcgattcgctgaaaatcagccatcaccaaaacgacgccggaacggaggagcagtgcatcgactggaaggtccggggtacgaccgccgattaaaaagacggccgattggccaaaggaaagggaaacgagcggacgacggaggtcaatttccgatct

SEQ ID NO: 92216 - DNA, 656 bp, Heterodera glycines
  SCN-specific regions: Sequence locations=1-27,49-284,306-399,421 -476,520-608
aaaaccaatcgccacccctggcgatggccccctcacaaatggtcaaaagcagccaaagtcatacggatgggttctgccagttgctccaccatcagtcacgtcccccgtgcgcttcgtccagcagttcggcttcatcttcgggctacgcgtccatggttaatagcattgtcaatccatgcgcaaatcgtttggccggaattgacgaggaggaaacagcgattggagggggaggaagcagcagcagaaggcaatcgacgaccattggggagagtggggaaaatgagggcgaagagaaagaaacagcggtgcaagaagattggcaagcagttgctgaagaagagcagaagcaacaacagaagggggccatcggcgcatttgcgtcgcccgaggggacaaattgctgtagcagcaaaaacccattgatgcgagatgattttcgccaattgccttcctctaatggactcgtcgaggcactttccgcctcctcctcttcgtccgcttcctcctcctcttccgcctgttgctgtgcggagaatcgtctctttctatgctcaccgcagcagcggggactgacttttccgtccccaattcgcccctccggcgaatgttcatcttcctcctcatcatccgcttcctcttccgcttcatcttcctcc

SEQ ID NO: 92217 - DNA, 313 bp, Heterodera glycines
  SCN-specific regions: Sequence locations=1-24,47-313
tggaaagcctctcagagtgaatgtgaccacaatggacgctgacctgaacgagctcatcattgagagggattcgctgggccaacatctgttccacaccgtatgcaaaatcatcggccttcgggagatatggtattttgggttgtgcttcaccaaccgcaaaggcttcacctgttggcttcaaatggacaaaaggataaaagacccaagcgtgcccaaacaggaggacggctcactacacttcctcttcctggtcaaattcttccccgagtcggtgaatgtcgagctgatccaagacctgacccggcatttgtat

SEQ ID NO: 92218 - DNA, 640 bp, Heterodera glycines
  SCN-specific regions: Sequence locations=1-303,326-402,424-434,456-640
gcgtcaccatacccaaaacggctgcttgaacatctcgaccaaagcacaagcgaaggcgccgccagtccatcggctgacaatgagtcacccgccaagcgaccgatgaaagcgttcggacagatttggcccatcgccagcgccggtcgaccatcgacgaccactccaacgcgttggtccaagtcggccagaaggcttttgccaattcatgaaaggggttcgccttgcgatgcgccggagagtgtgcaaaaggcgcagtcgtcggacaacaaatcggaccaatctgagaacaacagcaacgacaaacagcagcacgtggacgagcagctcgagaaactgccacggatggacgagcagcaaaaagacgatgaaatcgttttggttgggtcggcgaatgtttgcgttgtccttccggaagaggaagccaacgaaaacagacatcagcaaaagcgggatttcgagcaaccgaacgaaacgatttcaaatgattctgacaaaacagcgaccgatttgggcaccgtttcgaaggaatctgaagagaatgccgtgcaaagtgaagcgatgtttcataagaaactgacgacggacaacaaatccgaaacatttgagagaatcaaaaacaaattggacgaacaacaagaga

SEQ ID NO: 92219 - DNA, 575 bp, Heterodera glycines
  SCN-specific regions: Sequence locations=1-575
cagcgccggtccgactgcacaaatttatttgccggagcaactcttgcggatgattgttatccaatccattttgacgccgacaggcaaaggctgacattgagttgggctgatggacatgaaagtgcatttggagtccgggaactgctcagttgggcaatgttctcacaaaagcattatggcgaagaatgggaggccggcgcggaatgtccgtcgcgttcgctttgggacgccagagggttgcgtgaagtgccctccgtgtccagttcagaattcgacttcgctctattcgctcgtcttttcattcgttttggcgttgtctctgtcagcggagtgaattcgcgcgatgagcgggcgacgcacgaattgtgtgaaactgtgtccaccatttttggcacaatttttggccaattctggacctttggcaccggtttggacactcaaaacgaaatggagtctcatgatgacacggcctacggaagtgaggcgattgggccccacacggacggcacttatttggaccaaccccccggaattcaagtttttcactgtctccgccccgctccccgcggcggtca

SEQ ID NO: 92220 - DNA, 593 bp, Heterodera glycines
  SCN-specific regions: Sequence locations=1-182,204-392,415-593
cactgcacagctgcgagatgcgcacccaatatttgtaccgtaactcgaagagtgccgtgggaaactacggtgccgccatgcaaacgatcgtcgccgccacattgcatgcgatggactccaaacacacataccagcaaatcccggcgatgagtgcgagcacggaagagacgctgatgtactccaacagcaaggaagtggatgagaaacgcttttacaggaacggtgacgacgactttggcacggatggaaagggttcgccttttgcgcaagtgccaaaagtgcagcaggcgcagcaggcacaaatgatcaccatccgcatgaatctcgaaggaatgtggcggatatcacctgttataaatgtggcgaaaaaggccattacgcaaatcgttgtacgaagggaattttggcctttttgtccaacaccgccacagcgagcgaccagcagagagaacagccgcgagacaatcaacagaagaaatacgccggcggagaggggggacgaaaacgcaaaatgacggacaggaaaatttcgattgatattttgttttgcaaatttatttgttgctatttccccctaagtgagaagaactgaa

SEQ ID NO: 92221 - DNA, 527 bp, Heterodera glycines
  SCN-specific regions: Sequence locations=1-7,29-54,76-527
ttttcgtctcttcaaattttctccctgacattaccatctgaaatgagtcttctgttcgttgtgtcaatgtttgtcgatggttgcgccattctttggagttattgggatcgcttcaaaaaaccaaaaaagaaaattttcatttccgccgactgttggctttgtgtcttcgatttgcttgcgccttcacaacttggcctcggaatttcaatgatcagccaccgttttgattattacgtggacgaacacttcaagacgcgcaaatggacgttgaaatctattcgaattcgacgcaaaattggaaagaatggcacaaagcaaatggcaattgtcaattacgattggaaaccattgccaattccgaaaattcgaatgccacgcaaagtcatcggattcaaaagcatcagaatcttatttatcgaccgcaatgccatcgcttttctccgccatttttgtcaaattttcgccgtctgtccaattaatttgtccatccacacggacaatgatgattatcgcattttggagttcgt

SEQ ID NO: 92222 - DNA, 641 bp, Heterodera glycines
  SCN-specific regions: Sequence locations=1-641
ctctgttcttgggtttaacgggtctttccacggacgaacgcttggcgtactgagcataactcggtcaaagccaattcacaaagtggacattccggcctttgattggcctgtcgccaatttcccgcgctatttgtacccattggacgagaacagacagtacaacacggagcaggacgaacgctgtttggcccaagtttcccaactgatcgacactcagaaaagcgctggtcgtgacattgccgcagtgattgtggagccaatccaatgcgaaggaggtgatcacaacgggtcggcccaattcttccgtggcctgcaggaaatttgccaagacaacggcgtctttttcattgtggacgaagtgcagacgggcggtggcatttgcggaacattttgggcccacgagcaatggaatttgccaacatcgcccgactttgtgactttctccaagaagacgctcttgggagggtatttttacaaggacgaattgcgagtgaatgagccttatcgcatttacaacacgtggatgggcgagcccaccaaattggtgctgctcgaaaaagtcgtcgaagtgattggccgtgaaaatttggtacaaaagacgggccaaatcggtgccaaactgttggacggactcaaagcgt

SEQ ID NO: 92223 - DNA, 654 bp, Heterodera glycines
  SCN-specific regions: Sequence locations=1-654
atttggggcagtgaacggcccgacgagtgggtgatgctcggctaccatttcgacgcgtgggttttcggcgccatcgacccgaacagcgggacggccgtgctggcggaggtggccaagggattggcccaaacggtgcgcaccaccgggtggaggccgaagcggacgattgttttctgcgcttgggacgcggaggagcccggactgatcggatcgaccgaatttgtggaggaatttgcggatgttttacgcgagagagctgtcgtttatttgaacgtggataatatttccagcaatgtcacactcaatatccatgctgtgccctcgctttaccaagcagcggtcgatgcgtccaaatcagtccaaaacccaaatggccaagggtcggtgtttggcccgtggattgagaattacccgtcgagaacgagttggctcccggatttccctcacatgggcatccccgggggaggcagcgaccaaaaatcttttctcgactttctgggcattcccgtgatgatgatcacttacattgaccccaaacgtggtcaatacccgctctatcacacgcgttacgaattgccatttgttcacgagcaccttttcgacaacaatcagttggcggtgcataaagcccggggcgaatattgggcggaattg

SEQ ID NO: 92224 - DNA, 527 bp, Heterodera glycines; identical to SEQ ID NO: 92221
  SCN-specific regions: Sequence locations=1-7,29-54,76-527

SEQ ID NO: 92225 - DNA, 632 bp, Heterodera glycines
  SCN-specific regions: Sequence locations=1-162,184-199,224-345,372-632
gagcaatgagtaaaagaaatgcgtttatggactaagtgtgtgcaactgatcacttatttgctgctgtcctttgtcgccttaactttcgttttatttatgcaccaatcgttacgacaattcaaaaaggtgaattgtctctcattcccttcactttcttcctttgctaatgttttggtggttaaggactttctaaactcagtttaaaataaacaggaaaaagtcagtttggatgccgaaaatcaagcgacagatttggaacaaaagctcagccaattggaaggactgattcaaatcgaacggcgagaattggagaaactgaacagaaaaattggaatcaaagcaaataaataccaaaggaaggaagcccaagtgggcaaaccgtgtggaaacagccaattgccattttggtcttcgtttgcaatcgattggaggcggccaaaacgcatttgcaaaagttaattcgctttcgccgagatcggaaggaactcttcccaataattgtgagtcaggactgcgacaacgattctctccagcgaatgattcgcaatgaattcggcaacgaagtccaacacataaagcacagcagcagcgaaagcgaacatttgaagccgccacgggagcaccgacaattc

SEQ ID NO: 92226 - DNA, 543 bp, Heterodera glycines
  SCN-specific regions: Sequence locations=1-543
ctgaccaacgggacggtatccgcaccgggcacggacaagcagctgtcgctggaggaggcggtcctgcgcaaggatagaatccaccgaaaaggctttttcctgctagtttgggcatgccttctctgctacctcctcagttatttgcccggtgcatctgctgaacaaggcactgttgaagccctccacacgcgctgggagccggaagcaattggccccatcactttctctgacatcaactacgattatgaagactacggccaaacaacagaggagccaccaaccacgactcccccgccgccgtccacaacaagtccgcctcccacagaaccggaaccgccctctgccaccacgccaaatccaacagtgccaacaccgacgtggtgccctgttgtcatcactggtttggcagcgctggtcgtccttctgtgcctctgtttgtgttgctgtccgtcagtgccacaatcggttgcaaattggtgccgccgttttgttcatcgcttctgtacatgtgccggcgaaggtctcccaaggacgactgcccaa

SEQ ID NO: 92227 - DNA, 554 bp, Heterodera glycines
  SCN-specific regions: Sequence locations=1-305,327-554
ttaagattttccgtcactaaaaggcgctattttttattacatttttcgaataacgaaaaatggctgctaatatttctgaaaaggatgaagcattgagcgatctcaactgtctcttcgttcagatgaagaacaagaagttcagcttcagtttgatgtcaaaagtggcacagaaatttggcgatggcggagtcgccgcaaaagtccttctgccatacgaagtgtacaaagaggctgtcgatcttttggcttccgctcgctttgaaattgattatcgcgtggtgattcactttcttcccactttcaaagccattttcctccatctcagttttgacgattggcaattggcgatggaacgtttttttgagatcacagaattgcgtcagactcatcgaggctttccacgagaggaaatgcacacgctcagtcactcatattcgcttgctttgttggaaaatgccaatttcaacaaagaaactgagaggacttctgagtttctcttcactgactatggagacttggccaatttcattgacaattgcttcgaatgccaatgc

SEQ ID NO: 92228 - DNA, 484 bp, Heterodera glycines
  SCN-specific regions: Sequence locations=1-13,35-343,366-376,398-484
gcttccgtcgcgtcttctccgagttcagctccacaaattttgtgaaccaatcgttcggatgcgctacccgaaattggtggaaaatgtgatcgacactctaatggaactgatcaatgaagggggtgccccctccgatccgatcaccgtttttcaattcgtcggccttttccgcggcaaatcattcgttgcttttgtggaaaatatttcccacgaagcatggattaactccaatttggcctcggggcatctttcttccattcaaactgtgatggatcccctccggggagtgccggtggtgccgccgttggaaagccttcggcacatcgctttggttctgtccagtgaggagacaacacaaagtgcaacgagttcaatagaaaagtatttccggaaagcctcgtccgacctgcggacggacctcgccgcctgctttttgtgtcttctcgaacacaaaaaaacgctgacgcgttgcggcgcgtgccgc

SEQ ID NO: 92229 - DNA, 528 bp, Heterodera glycines
  SCN-specific regions: Sequence locations=1-132,154-213,235-347,371 -487,509-528
gtctttggaaaatttaaatactccactaatattgactattctctcggctcattgggacacgaggaaatctcgtgcaattacattgatctttcttacattcgggttaatagtccggagcttgtctctgagttcgacggaaaaataagcatttttgttgacgcggtcgatcgaactgtcagcgacggttatttcttgactggttctgcctcaatatccgccgcttgtgcagctccatcccaaagagagggacggatttacggaattgatcgttgggaaacacttttccctgtgcaaattaaattggagttttaccagcgaaggaagcgacagtggctgattccggaggacacagccccgtgggaagtgtgggagctgcagctgaacctcgttcgcacacttagcaatgaggacttctttcggatgagagagttcactgctgaaaaactcagtgacattgtgtttcacatttgcgaactcatcaacaagcctcaatatttgcctaaaattccttcccaacctgagatctct

SEQ ID NO: 92230 - DNA, 636 bp, Heterodera glycines
  SCN-specific regions: Sequence locations=1-315,337-636
aagcagcgcattgatacgctaattgagatggaaaggcaaatgcacgaagatgaccaaagcattgaggagaacaacattgacaccattgagctgagtttgggcgaactccgttcggactttcccaacggattcgccgtcgattggcaaaaactgttcaatgccattgtgcccgatcgcaacttcaccgcctcctccaccgttctgttggtagcgcaaaaaatgaacggacgcactgagaggcaaacgccactcgacgtaatggcggaatatatgcgcaattttgggcccaaaaacgacaccctcaacaagtgggagcagtatgtagagtggctgctgatactgcaacatgccgcactatcggacaacaaaatatttcatcgtattttccgccggcacccgcggtcagccaatgccatgatgagtgctttgctcgtcaacaaatactttttcgagaggcacgacgacgagcagtatatccgggacggcacatcggaggaacgccgcgtggcacaaatccggcacaattgcctggaacagctgaagcatttcttcccagaatatgttgaccgaatgtttgcacttgggttaaacgacgccattgaggaggaggccaaaacggtgctggacaatgtgaag

SEQ ID NO: 92231 - DNA, 537 bp, Heterodera glycines
  SCN-specific regions: Sequence locations=1-96,118-537
gcccccacaaaactttattgggatttttatcttttgcccccttccgatggaatttttatatgccgaaacttttccactttccttttcgttagaccctttcaaaaagggttggtttgagagggtcgccccctgctcacttctcgccttttttgttaacaaaaacgccctgatgatgttcaaggggggacaaatttcccagcgcaatgttttcccgccgggggtaaaccgcaattttcacttctgccacttttgccaatcaaatccccccccgcgtttttttcactgcccggtttgcaattttggcgtcttccgccgagaccaccattgttccttcaccgtttcttgggtgggccacttcaatcagcgttattttgttgccgctgtattaaacctgcgcccagtcgtgttttcatgctgcgttagaaattggcatgcgcttttgctccctttctctccaatcagtctgcccgattttctcaaatgggtcttcccgcaaatggttttgctgttccgcttcttctctttccaccatttttt

SEQ ID NO: 92232 - DNA, 630 bp, Heterodera glycines
  SCN-specific regions: Sequence locations=1-193,215-630
aaaatgtccaactttattattatgtcgcaaattccatgggaaaaaatcaaatatttttttgtttttttattgtccttaatattcctttttattacctacaaaaactacggctttttatatgacaattcggcattattcaggtttacctatacggaaaacaatagcgttacaatatcaccagaagaatgctgcggtgaaaatatggtttacactttgaaaatgaacgactcgcgaataattcgtggcaaaaagtttaattgctcattaacatggcttttggaacgctacaaactttcagacaaatacgcaattaaagagaaaattgaagtcaaataccctggccatcccaaatttgtgtttgtgacagccgcaaataatcattattacccttatcttcggacgttcattgcaaatattaaagaaaaatttggatgcaaacaaaaaataattgcttatgatttgggaacggtgacaaaaaacaaagaatggatgaatgaattggattcggtgtgcaatttcgaatggcgaattttcgatttcggtcaaatggtggaaggacgggttcgccacccgaaaagttacgcgtggaaaatgtttgtgatggcgcatgttttattggagtatgacacc

SEQ ID NO: 92233 - DNA, 541 bp, Heterodera glycines
  SCN-specific regions: Sequence locations=1-436,479-507,529-541
ggtgatgcgctccgaagttccggcaccgcacgcgctcggccgttcgcgctcgcttgccgatgtgttccgctccaactcgcgctatgccgagtcccaattttctcccaccgttgtgcccatcggaatgccgtcgaagccgatcagtgtccatcgaccgtattttacttactccgcctattggccctatcgataccatcgaaatttcaacacttacgacaatcaaatcaccgattccttctattggcattaccctttccgcctttggacatcctacaaacacaattggtaccaatacgacagcccctattactatcgccgttaccatgacaattacaacattttctacaacactgaactgatgtcatacggaaatcggtcaaaactgatggagaatttgtaccaaggaacgccgatcacacaatgaaaagattggaacagagaagagaagaagagacagaagagagagagagagagaaagcggaaaaaaaattataagacaaagaaacaaaatgccaacatttttaaaaagattcaattgaaa

SEQ ID NO: 92234 - DNA, 380 bp, Heterodera glycines
  SCN-specific regions: Sequence locations=1-380
cggtggtgggcgtccatggaacggaacggccgcgttttgccattgtgtggagtgccgccgtccaaagggatggcacggacgcggtggaggacgtggaggcgcaggacccagcggatttggacatgggggtcgcggtggacgtggcagcttcggcaacggacaacacatgggacacatgcgccgttgaggaaccgagacaaagaattgcggagacaattctcggaggaggggaggaatgtggaatctgtttttcgtaattttaaaccatttttgtttttcgcccttttgtcccatcccaggccttctggccgtccatcatcctattcatccaaaatttcattccttttccaattacctatttttatgacatttcccccatt

SEQ ID NO: 92235 - DNA, 619 bp, Heterodera glycines
  SCN-specific regions: Sequence locations=1-189,211-395,419-619
ggaatttgtgttggtcttgctatcaacaaatctctctgtgctgggatcgttttcaatccaatcactgatgagctatacaccgcaattgaagggaaaggcgccttgaaaaatggctttccaatttcagtttcatccgcgaaagcacttgatcaatctgttatttgtcaaacttttggtcagcataacatcaaagaaaagggagaaaaatggttggacaatgcattcggcaatttgcgctccgcagttctttcgggcacccacgggtacgttagttcatttttgagtcatcaatttcacgatcactgaagttgtgcatgtttagggggtctgcgattacttacgcttaatgtgtacatttcgttgttgcaaaaaaaaccaattttccccacactaacaataaataataaaaaatagttccaaatctttcgctgtttctctattattcccgatttaccacccatcagattttgagcaagctttgctcgtttctcagatcggctctgatcgatcgtctgcccaaatgaattcattcgtttccaatttccgcactttgctgggtgaacgaaatgtgcacgggcatcgctcttttggttccgctgccatcaacatgatgttcttg

SEQ ID NO: 92236 - DNA, 235 bp, Heterodera glycines
  SCN-specific regions: Sequence locations=1-235
atctcggcattccgagatgagccaaatgaccagctgagcgcgcaacggagctaaggacttccgggccaacaccgactcggcctgtactgacttgatggactggcgaacgggcgtgaggccgccacccaacccccgagataaccccatcacctccatcttccgagccaaacttctactgcccggatgctgccagtgtgctggcctcctgcactcaagctgcccccctggtcccccc

SEQ ID NO: 92237 - DNA, 595 bp, Heterodera glycines
  SCN-specific regions: Sequence locations=1-56,96-595
ccgggttcagggcatcgggcggtttccgcaacatttaccgaggggcaccggcggtggctgtgggctcggctcccggctcggcactgtttttcatcacatattgcaatggcaaggaaatgcttgcgcaacaaattggcacatcaattccattgccattggtggacgcactgagcgcaacatttggcgaattgatcgcgtgtttggtccgtgtgccgaccgaaattgtgaagcagcgcagtcagacgagccgggccagcggactgttacaaattgtcaccgaattgtaccgaacacggggaggcatcagaggcttttacaaaggttatgtgagcaccgtggcccgagaaattccattctccttcatcgaattcccactttgggagtggctgaagcgtcgtgtggcccatcggatgggcagttgttcgccgttggcatccgccgcctgcggcagtttggccgggctgacggccgcggcactcacaacgccttttgatgtgctgaaaacgcgggtgatgttggacagggacagacgcacgcgactgctccccactgcgatacaaattctcaggaatgaaggcattgcccgtctctattc

SEQ ID NO: 92238 - DNA, 387 bp, Heterodera glycines
  SCN-specific regions: Sequence locations=1-152,182-387
atgccatccgacgaatggacactgtcgggggagtggcaattcatcccgatggaatgtgtgaggcgtgcgttagcagtggcggcattcttttgaagcgggaagggcgcatgggacattcagcccaattcggtgccgcaatttgggctgaacaatgttctgcttcttcttcttctgctgctgccaactctgactttggcctttcggtagccgtttcagtgtccggctgtggcgaggcgttaacgcgcacacatttcgctgaagcgttggcccagcaaattctgtcaatggatgtcgacgacttggcctttgtgcagtgcatcacccactttttagaccaccattttgtccgttcgcgtcgcctttgctcttttccgtccgatcgtttgc

SEQ ID NO: 92239 - DNA, 484 bp, Heterodera glycines
  SCN-specific regions: Sequence locations=1-484
tgacttgatggacgagacatggggcacgaggccgactacgaatccccccgaggacgccttcaggtccatctttcctgttaaaccgcaactgcgcggacgcagacagagggcaggactccaacagccaagctgtcgccctggcccgaccagcccgtccggaccgcctggacaacccggacaggcaggatgcgaacgactccacggacaggctgaacaccctggacaacgcgctcgctcatgcccgcgccagagcatccactgggcacattgccctgccggcccggcatgccgccccgtaggacatggaccgccccgacaacaaggagccccgggtcaagctgacacgacccaccaaggggcaggaacaggaaactgtttagctccaggagcccaagggactcccggaaaaggtcggcaccaccggaaacctggggcccaccccggacagcggagacggaccgccaacgctacccgggcacgaccc

SEQ ID NO: 92240 - DNA, 218 bp, Heterodera glycines
  SCN-specific regions: Sequence locations=1-173,195-218
cggctgttgtcccacagcatggcgccggtgggcaatccgtgcgcgaccttcgcaccgtcgaactgccattctacgaccagatcaaagtgattgtgccaataactgaactgcctccgtatccggtgcctattcgacctggcgatgcgcgtgcttcgcattcgtttagcgtacccagtgaggacatacaaaaggtgcactatcgcattgaggaacaacca

SEQ ID NO: 92241 - DNA, 635 bp, Heterodera glycines
  SCN-specific regions: Sequence locations=1-513,535-635
ttttaatttttcaccattcgctaccttcgccaatgcttgcaccaattccaataattgagccggcaactgtcactgttccgcccaatgaagacgttgtgggctcatatgatgagaatcagcaaagagaagaggaactcctggtcaatcaatttgtcatcaattcggaagcgatcaagcgcatattggacgacccgcgctacgctgacaaaaaggtgtgtgtagtcagcgtggcgggcgccttccgcaccggaaaatcgtttattttaaacttttttctgcgttatttgcgttggcgctcagcaccaagtgtcgatgagatggtgaacgattggttgaaaatggacccgaagttggaggggttcagctggcgaggcggagacgaccgggacaccaacggaattctgatttggccagagcctttcctactcgaagaccgcaacagagagcaggttgttgtcctcctcatggacacacaaggcattttcgacagtgtcagcacttttaaaaattgcgccaccgttttcgcgttgtccacgatggtttcctctgttcagattttcaacatcaacaagaccatccaggaggaccatctgcagcacttgcaactgttcacagagtacgcccgactggcgctg

SEQ ID NO: 92242 - DNA, 500 bp, Heterodera glycines
  SCN-specific regions: Sequence locations=1-500
gatcgaacacttttacgagcccgactcgggcgaagtgctgctggacggaataccggtgcgcgactacgaccaccaatttttgcacatgaaggtggcacttgttggacaagagccggtgctttacggacgatcggtggaggagaacatcggatacggttatgaaaacgcaacgcctgaggctgtgcaacggtcagcgaaacatgccaatgcgcatggctttattatggacactcagcaaggctatgagacggacgtgggagagaagggcggtcaaatgtctggaggccaaaaacagcgaattgccattgctcgagctttggtgagagagccggcggtgcttttattggacgaagcgacctcagcgttggattcggaatcagaacatcttgtccaagaagcaatccaaaaaatttgaaaggacggactgtccttttgattgcgcaccgactgagtaccgtggaaaatgcggacaaaattgtggtggttagtgcaggaagagt

SEQ ID NO: 92243 - DNA, 397 bp, Heterodera glycines
  misc_feature (354)..(354): n is a, c, g, or t
  SCN-specific regions: Sequence locations=1-357
aattgatcaatctcaccacgaagatgaatgtttcgatagcgaattgttcttcatttcgtccaataaatggtcgccctttcgctaattgctaattcccccgttaattaccccccccccccaaatgcgtcgctatttaaaattttattttaccctccaatgcaaagtgtgcctttgcttgctcagctgctcgccactcactttccccttcaaataccgtccctttcgttttcctcgtgccatttccatttgcttttcatcccatttttaccttttctatgctttttccctcttttctgctactttttctgcccaccgtttttgctcccggcccaagtcgagaaaataaattgttcntcgaaaaaaaaaaaaaaaaaaaaaaaaaaaaaaaaaaaaaaaa

SEQ ID NO: 92244 - DNA, 613 bp, Heterodera glycines
  SCN-specific regions: Sequence locations=1-8,30-51,128-129,188 -298,322-425,447-613
atgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggacagcctggacagcccggacgccccggagccgctggccaacccggacagcctggagcgaacggagttgtctcacgcccaattcctggcccgaaaggaccgcccggagcgcctggccagaacggaaaccccggaagccaaggtcagccaggacagccaggaggccaaggaccgcccggacctcctggcgcgcccgg

SEQ ID NO: 92245 - DNA, 627 bp, Heterodera glycines
  SCN-specific regions: Sequence locations=1-261,283-627
aggaaatttacaaccattggttgaatgatatgcgacaatgggatgaggaatatccttctttggaattcatcgagaaaaagtccaaagagttggtcaccgttttgtccgaacctcccagaggaccgccagtcgatgtcatcagattggctacaatcgaagcagagagagaaaattcgactaaactgctgaaaaaactaaaagaatggcaagaagaacaaaaagtgtagtcccgttaattgttttcttcccaactaactttacttatttttaggttggaaatgcaatgcatcagccttttccgccacctcgtcaacccttttaccctccctctcgtcctattcgattcccgcattggccatttcatcatgatccttcacggccaagaccgcacttgatgtatgggaggtcagtgggttaccatccatatgctaaccagtttcaccggccaatgactcaagcgagggtaagccattgttttgtattaaattggcatttcgcctatagatgcgatctccgttttgctatggcacttctcaaccgtttggcttatatcggtatcctcgtaacattccagctaattccgcatcaaatttcccaccggaagcactcaagtacaaagctactttg

SEQ ID NO: 92246 - DNA, 631 bp, Heterodera glycines
  SCN-specific regions: Sequence locations=1-255,277-631
acaaaaaaaattttgaggggggaaacggacaaaaaagcataattgcccttttaaaattccaatccattttagttcaatgtgcaggaagatcagccgccgcggagagtgccgatgatggtactgaagagcaacattcaacgggacaaagtccgtcacaacagattcaagttgcccgagcgttcacacgaagatctttttcgagaaaaagttcgcacaggtccggccatgaaaagtttgtatgaaaacgatgaactgatcgatgtgcgcgggggtgacggaacggcgttaataatgaggcactttttaatagtttattcgacaaattaagagaaataaacacaatgcaaatgttattgaactattggcactgctttttttatttagtgattttgatggttttgtgccccaactgaccaaaaatattgcggagaaaggcattgaacgaccaacgctgatccaaaaatgtgtgatgcccataatacttacgaaatcggaatttgacttgctggcgcgtgccgagacgggcaccggcaaaacggcggcgtttctctttccgatcattcatttgttggagagtgatcgtttggcaattgggacgaagccttccactggaaggaaatcgccctttgca

SEQ ID NO: 92247 - DNA, 652 bp, Heterodera glycines
  SCN-specific regions: Sequence locations=1-531,553-652
gtggcacgtcgcgacgtttggctgccggaaagccaatcgcctgacacaaaatgttcatcggcggattttgaccaatctgacgaaagcggcggcgatcaaagcggcgtaagcaatgggagtcatcgaaactgccgattttccatggacgaaaggacaaatgaccggcaaatgttcaccgactcaatcaacaacgacttggacgatcgccgattgcgccgtcaaattgccaattgcaacgagcgaaggcgcatgcagtccatcaatgctggattccaagcgctccgtcaattgttgccacggaaagacggcgacaaaatgtcaaaggctgcaattttagcagccaccgccgaattcattcaatcgttgctgcgagaaaaggataaattattggaggaaaattgtgtcgtaatggcaaagaagcgacggatggacacggaagacgcggagaaagtcattttgcgggaggaggcggtcaggccgaatgtcgtcgactgtttgcgcacaatcggcgaactgcgaaattcgctgcagaaagagacacagctcagaatggtttatgagaaggaaatggccgagttgcgctgccaattgcgtctttccccgccctcctccgccctcgtcgctcttccgccctttccttcgcctcgtcctt

SEQ ID NO: 92248 - DNA, 546 bp, Heterodera glycines
  SCN-specific regions: Sequence locations=1-128,153-161,183-284,306-546
tgatttgaatgggaaatgaaagcacataaaaggagcgaatgaatcagtgaaattattcaactttaatttgactgtgcttccgaattgtcaaaatcattaattaatttatcgcgcaaataatggccaacaaatttttaattgttgcttttattttgacaattgccatttttgtcaatggacaaagtgaggcgccaaacaattcgtcggaaatggcatcggaggagagcaattcggaagagtcgggcagtgaggagcagcagttcaacccattcaaatttcgacaatttgctggccacggcttttttggtccctcgtcgtccaacagttcggcaccgccgcccttcggcttttggcccccttttggacgaatgccgtcgccatttaaccgccccgccaaccgaccgccgtctgacaattgatcactttttgagtgatttttgtccgtcgatcagtgcgaaatgaaaccgttgatgaacaaatgatttacttgtcatttattgttcatttttgactttaaaaggaagaatacattgcataaatttattc

SEQ ID NO: 92249 - DNA, 648 bp, Heterodera glycines
  SCN-specific regions: Sequence locations=1-41,118-119,178-433,457 -612,634-648
ctcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccgctcctccttgcccgccccagaacatcccctgcccacgctgccctgctggcccgcccggccgccccggaggacagggaccgcccggacagcaaggagcccctggacaacctggtacgcccgctcaaggtggaggacctggaacgcctggcgcgcccggaccccaaggaccgcccggtcagcccggccagcctggaaactctggccagcctggacagcccggagcaccgggacagcccggcaaggacagcggctactgtccgt

SEQ ID NO: 92250 - DNA, 292 bp, Heterodera glycines
  SCN-specific regions: Sequence locations=1-292
gcggaaacgacttttttctggtgttcgccgtttggatgcccattcatcgctgccctactatgccagtggctcttccgatgggtctgttttcctatgggaatggggcgatgaacagcctgtgttcgtcgccctggctgctggctaattcgcacaagaggctaaattgccattcgctcacaacggtactcgctttgcggctgtccatggtgatgcgctggtgttcatatggcaggcgccacctgctgttccgcctaacaaacctttatgtcatcccaaagggtcactccaaatt

SEQ ID NO: 92251 - DNA, 304 bp, Heterodera glycines
  SCN-specific regions: Sequence locations=1-246,268-304
caatgaaacattgaatgtttggagcaaccagctcggcttcgcctgggacaactacctccaatggtggacccttaatgaatcgcttccgagggtgaacgcgccgattgcggaatattggacgatgggcacgcgaatgctgtgaagtcaactctgtatgcttctctcctctgcttaccatattatcagatgccattggcctcaacgacgcaaacaatggatgagggccgaccttttccgagcgtctgctgaactcaaaggactggacatgatcggactgtacacttcatggtaccattttccggag

SEQ ID NO: 92252 - DNA, 322 bp, Heterodera glycines
  SCN-specific regions: Sequence locations=1-89,111-322
aacccggggcggggcgtggcgttgggcagtggtcgcatgtgcccatatttccaatttcgccggcaactcccggacctttgttttctccgggggttccgggggtgccgggctttcccgcgtcgccggggtgtcccgggcccccgggctggtcaaaccaaccgggcagtcctggttgggcgggaacatctggggacccgttggggccgggggggccacggcggccttcccactgaggggcggaggccgttgagaccgccgggctcccgcgtctggcacacgggggggacatgccgcgtcttgcccccggacccacggggctgct

SEQ ID NO: 92253 - DNA, 358 bp, Heterodera glycines
  SCN-specific regions: Sequence locations=1-27,49-56,106-135,173 -320,344-358
tcacattgttctcgggattgcctcagtgtgctcgctgttggctaccatcccctcagtcgtcactctgccatctctgtactcggagatgagccaaatgaacagcaatttgcgcgacggagttgaggtcttccgggacaacaccgactcggcctggactgacttgatggacgtgaaattgatcatgactccgccgacgaagccccctgataaccccttcaactccatcttccgcgtctcacatcagctgtccggacactgcctctgcgctggcctccaaaagtcaagctgaccccctgggccgaccggcccgtttggacggcctggacagcctggatggtctgaatgcccaggacagtcc

SEQ ID NO: 92254 - DNA, 582 bp, Heterodera glycines
  SCN-specific regions: Sequence locations=1-582
gcgcacatccctcccggggacaacgaatgtttggagagttggtcccgcaactattaccgcattgtcacacgttttgcgagtacaatttctgcacaattctttggccacacgcacactgattccttccgtctgttcttcgaggacatgaacaactcgagttcccccgcgctttccgtgctttacgttgcgcccagcgtgaccacttttgccgggctgaaccccgcctaccgcgtgtacgtcgccagcccaagcgacggacgcattctcgacattgagaactattttctgaatttgactgcccttgatgggcccgaaaaagaggaaaagccccgctggcagttgctgtacacggccaaaaccgagtacggcatggagcagctgaatgccgaggcatggaacgcggtggcacaacgcattgagcgggagccggcgatggcgcggaaattcaatcgaaattacgcgcgaagggctgacgcggaatgcgacgcgcattgtgtcgcggaacgcgtgtgtgacattcgcgcggcgcacagtaacaaaacggcactgtgcgggggcggcagcaaaacgcgacgcaaattg

SEQ ID NO: 92255 - DNA, 629 bp, Heterodera glycines
  SCN-specific regions: Sequence locations=1-234,258-284,307-439,461 -483,505-566,599-629
cagcaccgaatgtcgaacagccagcaacgccggaaatcattgagaatatggaggtggaggttgaagcagttgcggaagctgaagccgaggaggagttggacccgaagggtcgggtgcagcaactgctggaaatgggcaagtctctggaatgggagatggccgtccaatcggacgatgagcaaatcctcgacctggatgatgatcttgagatgtttccaaggctgattttcctgcagctggccaagttcctgaagaatgcacctgatgggttgaacgaacagcaaaagaaggaactgaaaaaagtgttggtcaattggatggaagagcaaaagcagccatttacggtggatgaggaaatggcacaagtggacgaaactgtgcaaagtttgagcaccttctgtgaccaaattggcaaaagtttcaagggaactcctgccattttggacattttccttgatttccacaaaaatgaaactcttgaaactgagaaattggaattcatgtggaaaatggtgaaccgaaaggtaacgcactatgttaaaagcgttggccaattttacggcggcattaaaattgccaaggaaaatctgaagcaagtcaaaaaaattggcaaatgggcaaaaaaaaat

SEQ ID NO: 92256 - DNA, 617 bp, Heterodera glycines
  SCN-specific regions: Sequence locations=1-617
cttcgctgatggacgaacagttcaaaatttgcattgaattgcattatgagcagaaaaagaaaagggaactgatgcatcaaatccacatgaaggagaaggcttcgctggagttgagcaccaaggatctcaccgaccagacaaagcgtcgagtcgttaatgaacggtcgagcttggacagaaagcagagacaactcgaaagactgaaaagggaagcggaacggcgcggactgcgcacggggggcgactctttgcaggggacgacgcaaaacggcaaaaagaatcagtcgcaacaaaagcaatccccggcggcggaaacagcttcggttgagccgattatcgcgtagaacgaaaggattccctcacttccttcgctgcccgtttttacctccaccgaaaattcatctgggaagaaaaaggatgaatttcgaaataaaatttcggaacgctttgcatcgctcgaggcgaggaagcagcgaatgcgtttgattcaaatgaaactgaacagtttggagaaggggaaaatggacaacgcttacgacgaggcggtgaaacgcgttcagagtcttgacgaaatgcgcaaaaagcttgaggatttgaaatgtaacatggaaaacggc

SEQ ID NO: 92257 - DNA, 645 bp, Heterodera glycines
  SCN-specific regions: Sequence locations=1-29,51-57,93-340,362 -607,629-645
gcctctgttcggctgatcgaccttggctccgccaccttcgaccacgagcatcattcgaccattgtctccacgcggcactaccgggcgcccgaagtgattttagaacttggctgggctcaaccgtgcgatgtttggtcaatcggctgcataatgttcgaattgtactccgggatgacgttgttccaaacgcacgacaaccgcgagcatttggcgatgatgcagcgcattttggatggcatcccttacagaatggggcggaaaagcaaaacaaagtattttttccatggccgcctcgactggcacgaccacacaacagccggccaatacgttcgggaccactgcaaaccgctttccagatatatggtttcaaccagtgaagagcatcagcaattgttttccttaatccggagtatgcttgaatacgagccggcgtcccgcataactttgagcgaggcgctgcgccatccgtacttcaatcggttggacccgaacatgcgggcacgggtcgacggggttggcttcgacacgtcgttgaacggaaggggcagttacgcctccgcgggttcctcctcctcttgcagagattgacgcagcacagcagccgatgtttgccctcccctccccctttttggattgtgacaactc

SEQ ID NO: 92258 - DNA, 235 bp, Heterodera glycines
  SCN-specific regions: Sequence locations=1-32,56-114,136-235
tgatgtgttctgcacagtgccgcgtgaactcatggagccaattgaccaaagaatccgtgccattgttgaggacattgactccactcatcatctgttggaagcgaaaacgacggagacagacatcaaagtgttcattacgtcatcattgggacacatcttcgacgagggcaacggcattcagttgcttatccaacatttgaagtgcgacctgcgcgagggcaccattttggtgtgc

SEQ ID NO: 92259 - DNA, 160 bp, Heterodera glycines
  SCN-specific regions: Sequence locations=1-160
gattaaagtgattttagagataggtcctcccggtaggggtaaagggacgctatgccagcgcatcgaaaagaattgcggattcctccatgtgagtgctggcgatttggtgcgctaagaacgcctacgggaaggctccacctctggcgagctgatacaaccg

SEQ ID NO: 92260 - DNA, 437 bp, Heterodera glycines
  SCN-specific regions: Sequence locations=1-437
taaccatcagaaaaatgaagtactcgttcaatgtccgcgaaattcaatccctcctcaacgggttcatgtgcattttcaagccccgtgatgtgtccatttcggccattgaaaagttgctgatgcgccgcatttgtgagcaggcgaactgcttggacccgtgccgtcctttgcccaccattgaaatgccaattgttgaagcccaccccaagagtggtgcattggttgtggttggaagaaaaaaacaaattgactacagcaaacatccgttgatggtaggccagatgttcaggcccgaagacatgcgcattgaagcgcttaattatttggagccttcctgctcgggcgtatgcgtgtttggtctgaacgacggatgcgatcaattggagaaggtgcgggacagagcatgggtaaatgaatacattttgagagggcgaatt

SEQ ID NO: 92261 - DNA, 226 bp, Heterodera glycines
  SCN-specific regions: Sequence locations=1-145,167-226
gactcacattgctctcggtattgcctcggtgtgctctctgctgggtatcatccccacagtcgtgactctgccctctctgtactcagagatgacccagatgaagagcaaagtgcgcgacgaagttgaagtcttccgggacaagatcgactctgactggactgacttgatgaacgtcgaaaggattgggaccccgccttggaatctgcttgatgacgccatcaagtct

SEQ ID NO: 92262 - DNA, 371 bp, Heterodera glycines
  misc_feature (348)..(348): n is a, c, g, or t
  misc_feature (352)..(352): n is a, c, g, or t
  SCN-specific regions: Sequence locations=1-371
aattattgcacggatcattaagaagaatcttttaatttcctccctaagaatttttccaaaatgtttccgttccgttttctcttcgttttcgctttcgctttgctcactttgtgcggcttttctcacatgacattggcacagcccggaagcaatgggccaattggcgaacctaacaaaatgttgcgcatccgccgggaaaatgaacgcaaggaaaattgacgttttccatggaacgaaccaaagaggatgaaaatgaccgaagaacaaaaaacactattagcaattaaattccgttttcattgttactttttagggtggtgttttggtataaaatcaaaaggttgatcnctanaaaaaaaaaaaaaaaaaaa

SEQ ID NO: 92263 - DNA, 594 bp, Heterodera glycines
  SCN-specific regions: Sequence locations=1-436,458-594
ccgccaacttttgctcctttccgtctcctccgacaacatttcgaccgattggctgtcattttgctcaattcgcccccggcagcggtcgttccctgcggcgattttgcatttccggccgattgggccaaaatttggaacagtgccaacattcgcttgtgcaccgatggggcggcaaatcatttgatgaaactgtgcagcgatggcactgatcagctcaaagtacccgaattgatcattggcgacttctactcaatcagtgccgaggcacggcaccacttcggagggtttggcaactgcgaacagcgaaaagtaccggatcagaacagcacggatctgacgaaggcattggaagcgttgggggaaaaacatcccaatttgtccggtattcttttgctcggcggcttccatggccgctttgaccacgtcctcggcgcattgcacgctttgctgctgcacgtgcagcaatggccacaggtgccattgtttgctgtggacaatgaaaatgtcctcactgtgctgccggagggggaaatgctcgtcgaattggatgccgaacgcatcaccggcacttgcggtctcttcccgattgagcag

SEQ ID NO: 92264 - DNA, 622 bp, Heterodera glycines
  SCN-specific regions: Sequence locations=1-220,242-472,494-622
gttcccgcgagtgttggacaatcccagtctttcgggcatgttcgacttcaaagccatcccctggggattggccaaacggcgccaatccgaccaccaagtgcaatgccaccacggggccaacgaatgcaccgccaatcagttgctcagctgcgccctcaaacacccgtacagcgataagtcgaaacgccatcggctgctcaattgttttatggccaaaatgatgagcaaaagagaacccgaaaatgccatgatcagctgtttagccaaatcggggctcagtcgcaacgaaatcctaaattgcgcacgaacggacgccgtaacgcggcttcaacttgaggacgaaacggagaccgaacacattctgaactcgccccgctttgtgccatttgtgtcgctgaatgggtggagtcatttgactctgcaggcgccggcacaacttttgctgacggaaaagttggcgcattggaacgacactttaaatggcgtttccatttacaaacgtagcgcattgaagttgctgccgacgccgtaccggagctgtgcgcttccgcccgatttttggtgctcttccgattcgtcggtcactggtgcctgttttgacgagcaaaagtgccgaacattc

SEQ ID NO: 92265 - DNA, 623 bp, Heterodera glycines
  SCN-specific regions: Sequence locations=1-37,76-94,116-599,622-623
gaaaaaacaacaacgtcaacaatgtttaaactctctcaattattttttatttttattttttctataaaattaattggaaacaaatgcaccaaaaatggagttgcttctccatttgagaaagttatccaaaaagatgccaacaaatcaacaccaaaaattgcagaaaaaaatgctgagaatgaagagcaaaatccactgaaaaaagaaattgaaaatctaaaagcaagaatggaccaagagttgaacaaaatcattgagctaaagcttggcactcagctgctcaaaatgaatgaaattgccgaaagaattgaaaatgaaaagacacccttggacaaagaatttattcagaaagtgattgaagaaatacgaccattatacgttgaggcgatcagagaccatataaatatattggtcaagttgaactttttggagaatgacaaaggctttaaaaaggacgcaaaaaacatggaaaatttgaatgcacttgagaatcagcttatcgccaataaggcatgcttaatcaaggaagatgagattgtgcaaacctatcacaatgaacgcgcagaattggagcgaaaaatgaagcgaaacgaaggcaacgaaactcttgatgaatatgacca

SEQ ID NO: 92266 - DNA, 550 bp, Heterodera glycines
  SCN-specific regions: Sequence locations=1-8,46-54,80-137,169-310,340- 550
ctgtttctggccatcacttctctgttcctcaactccatctgctggtggttctttgagccctctctgaccactttcatggccactttgcgcctcgactggtccgcttcagtgatgtccggcattttgatcgctgtttttaatgccgcttacatgacatcggctcccatttggggttttgtgcaaccatatttgaccggtcaaatgaggccgatgttgttgctgacttcagtgggaatggtcattgtcatgcttctgatgggtccgtcgccgctgctcggcttgcccaatttgatgataaccgccgtagcctttgcattgcttggcattgttgctggtgctgcctatgtgcccttgtttaaatggtgcgtcgacgctgcaaacaacgcgggattggacggcacatcgtctgccatttgcgggtgtatctccggattcatacagtcggcacttgctctcagtgctttcttggccacaagtgtcgggggactgagtgcccatcatttgggcctcccgtggacggcgacactcgtggcagccattcaattggcat

SEQ ID NO: 92267 - DNA, 577 bp, Heterodera glycines
  SCN-specific regions: Sequence locations=1-221,243-577
tactcacattgatctcggtatcgccactgcgtgctcgcggtcggtgatcgttatcatcgtcgccactctgacttttctgtattcggacatgaacatgatgaacatgaacgtgcgcgagcgagatgaagtcttcggcttccacaccgactccgactggactggctttgtggacatggacgtggtcgtgaccccgacgccgacgccccatgatcacgccttcccctccatcttccttttccgaggccaactgcccctgcactgacactgcgctggccttggactgccacactgtacctgtggccctgccgggccgggcggatcgggtgcacctgcacgacccgctgaaggtgcaggaccacgacaacacgcagaacctgctgagccagccgctcccccttgtccgtgcccgaacctcaactgcccatgctgaccttgtggtgctgccgcgcgccgccgacgacgaggaccggcaccacaccgacgagcccgaggacatgcagaaactggcactcccggtggaggagcaggaactgctaggcctgccgcacccggacgacagagtggacctccacaaccc

SEQ ID NO: 92268 - DNA, 552 bp, Heterodera glycines
  SCN-specific regions: Sequence locations=1-552
gtttgagctttatttgtttgcatattttttgtttgaaatgtgacaactttttccacattaattttttttgatggctttgcggcgtcaacgtcccttttttcgcagttttgtgccattgttgatctgtctgcttccctgtttgatcgtggaactgttttccttctgggcagcgtcctttttgtggcaaataccgcccattttgaacccaaattcagtcataatccttattatttctgatccgcaattgattgggcacataaatgagcctagatggactggtattgtgtctcgttgggacgcggataggtatatgcgacgtgcttatgcattggcgagccgagcagtccgtccggatttggaagtgtttttgggcgatttatttgatgaaggcgttttgctgggaggcgatgaacaacagtttgtcgacacgcgcaaacgtttcatgaacatttttccgctcaatagatactccacaaatcgcatttatttgcctggtgacaacgatattggaggagaaatggagccggtttatgcggaattgtacgaacgttt

SEQ ID NO: 92269 - DNA, 508 bp, Heterodera glycines
  SCN-specific regions: Sequence locations=30-45,69-207,231-246,268 -283,305-412,445-508
ggcaccagcggaggcggcggcggaggctgtcaaccgtgctgtaaccctggcccgccaggcccacctggcacgtctggacgaccgggacgccccggaaagcctggctcaaacggcatgccaggaggcccaggcaagccgccgtcccagccttgcgagtccgtcacgccgcctccttgtaagccttgcccaggtggacctcctgggccgccaggaccacccggacctcctggcgacggtggaggacccggacagcccggccagcctggcagtgactcgggtgcaggttctcctggcccaaagggcccgcctggcccacctggtcagcctggacagcccggctctcctggagagcccggccaacctgcgcagtcacagcccatcattcctggcccgccaggaccaccgggtgattctggaccccctggacctcctggtcctcccggaaaccctggcactgatggaggcgctggtcagcctggccccaagggaccgcccggaccaccgggac

SEQ ID NO: 92270 - DNA, 630 bp, Heterodera glycines
  SCN-specific regions: Sequence locations=1-92,123-232,257-384,406-630
cgacaacaacaacaacaaacaatcagcaacgacgacaattgcgcaacgcttcaacacagcacatccatcgcccgtgcacacgtcgaatccgatcacttctgctgctgctgctctccaacaacacaatgggcttcctcttgtacatgttcgtggctgcggatgcgttcggcggtggagcgtactgtggcatgatttacaacgccaaaggggccaaggcatcggcgggcggcggctccaagaaggacaagaagcagaaagcgtgagccccagcggtgaacaatgatcgactcgaggatggcccccgtggatgaacgaacgaacgatggacttcgagcaacaaacgcttctccccttctaactgctgctgatccccacaatatgacgctgttcccctccccccaaattatatcatttgtaggtgctttatcaccctctgatctgttgtcagtgataagctagctatatgcgctgtccatatcagtgatcaaaccattgtaattgtgtaatgatatatgtatgtatgtcctatatattgtattgtatttgtatgtgctccaatgcaacaaccaatcattatgtgtacataaatatgttgtatgaatgtattcggacaataaaatttatgtgaaa

SEQ ID NO: 92271 - DNA, 166 bp, Heterodera glycines
  SCN-specific regions: Sequence locations=1-166
tcacattgttctcgggattgcctcggtgtgctctctgttggctatcatcggcacattcgtcgctctgccttctctgtactctgagatgtccccaatgaacagcgatgtgcgcgacgtagttgaggccttcctcgtcaacaccgactctgactggactgacattgtt

SEQ ID NO: 92272 - DNA, 533 bp, Heterodera glycines
  SCN-specific regions: Sequence locations=1-68,93-124,146-383,404 -439,461-487,510-533
gcaaaactctgagctgttcggaagaaaataatttcacatacatacgaacggagccgaacatgaacatgaacagcagtagcagcagcaacaggagatgttcagcgccaaactcgacgacacttagagcagctgcttctgctctgctcatcatcatcgctgcttctcttgtcctcccgcaatgtgccgcggtcggcggaatggccgagctgaaggcattgaccggcgacgcgccctatttgggcaccggtaatcaagagcaggcgccagaattttttggcgaagcgttgtcccgccaatactaccagaacccggcctaccggtacaacgactggtacggcacacggtttgcccaaaattactaccgaagcccttaccgagcatacggaggaggaggaggaggaggtgatttcggctgtggcccatgctgagcttttcccatttccagcaactttggcttctcccctaactcatgccaatctttggaacactaatcacttttattttattttgaaactgattacttttttaaaaaa

SEQ ID NO: 92273 - DNA, 514 bp, Heterodera glycines
  SCN-specific regions: Sequence locations=1-514
gttttatacggcgacgcgacaaaatctagaaatcaaccaaaacacgaaggtgggcggccaaggctttaccggcaaacagggcactttccacggccagcaaatgattgagtactgcacgaatgttgtggccggagtgtcaccctcaaaaacgggcactgagcacttgggatagccgatatttgcaacagtcaaagatgcccggaaaaaaactggtgccgacgcttcggcgatttatgagacggcggcctttgccgcggctgccatcgactaagcgatcgacgccgaaatccctttggttgtgtgcatgaccgatggaatctgccaattggacatggtccgtgaaaagaaccgtcttctgaagaacaatcggactcagctgctcggaccctattgtctgggaatcatggcgccgggcgaatgacagattggcataatgccggggcagatccaccaaaaacgggttattggcatcggttcgcgatcggggacactcacttatggagccgttcggcag

SEQ ID NO: 92274 - DNA, 632 bp, Heterodera glycines
  SCN-specific regions: Sequence locations=1-36,58-632
gtttgaggagtgaattcatatttatattatggatcgtttctgttcttttgcttttgtttcactctgtcggccccatacagctttttgttgtcgtttttccacttctcagcttcggtcaaattttttaaaatgggacttgcacaaccaatcccaccggaaatggatgaaatggttcaacatcgacacttatcttcaacctagaagaaaatttatccgtctaattgctaatcggtgactcatttcacccggagcgaattttccaaatggggccggattttgcgtgtttggaatggctgatgaatgcgggttccacttctgttctaatgtcggatggcacattgttaaaaagcaaaaaagaaatgcagaattttttgtctcaaaaggggttcgacctgcgaaaacttaagacggaggcccccacggcgaaattgcttaaggatattcccttggccgatgcgttgcgtccctccgccagtgacttgctttacaatgaaaaatggcgtcacatttcgcccattcacatgaaagaaattgatgcttctgattcggtgatcaccgacgaaggctttgcttattttttggaatgtcgaaacatagaaaaactgcgactgaatttctgcgattattttggg

SEQ ID NO: 92275 - DNA, 651 bp, Heterodera glycines
  SCN-specific regions: Sequence locations=1-651
aagggacactcagcttctttttatgatgaagcaggctgtccatgacaacataaacgctttcattggcttatgcgtcgaacggccgaccgacgtttgggtcatttggaggcattgcttccgcgggacgctggccgatttgctattcgtcaactgccagcacaagtggccaaaccctgcaaattccgtcgcaccttttcaaaagacaaaatttgctttagccgtcccccaccccacaattagtcgattgagtcgcgggtgaacgacatccgtgccagtgtggcatccattgtcagcgcacaccaacagcagaggggggcggagggcgacggagcggtgccacgcagggacattttggacaacaatttcaaaagtgccttcgtcagagacattgtcaagggtctcgactttctccactcgtcccccatcggttaccacggcgcgctgacttcgacgcgatgtctaattgacagtcattggattttgaaattggcaggctttggaacttctcgtcttttgtacaaatggcgacacaacggcattttgagcaatggcaatggcacagtcattcagccactgatcccaaacgaagaattgcattattatgcccccgaattgcgcttaacaattcgttcagccgttttgcggaataaa

SEQ ID NO: 92276 - DNA, 627 bp, Heterodera glycines
  SCN-specific regions: Sequence locations=1-366,389-627
accgaatgctcgtccacagaatcgctgcctttttcggcttgttgcataatgttgaccaaagtgggcaaaaagtggtggtcaccaaattgccaggcacaaaactaccggacattgagtttgaacaattgataaaacacaacgatttttacgattttcactcggcgcgaaggaacggacaaagcttcgatgagtccaaaggatatcgttttccgatgcgcgagttccgcaaccgattcaacacaaccgccagtgaaggtgccaacggcggcgaattgtcgaggaaccgacgcgcccgctctttcgaaattgacaacgatttgtacgccggttttccgcgccaacatttggcatttcatcgctattccgccacatttgacaatgctggaggggctgacatggccagtgggaattgcagcagtagtacgagcagcacggcaatttctgcccaaatgcacccgctccatttgcccatgttgcaaccgccgtatgccaattcgagcacggaggcttcactgatttctccggcgagtgcttacagcgaacctgccgcatgcgttcggcaccaaactgctcaatttgcgaacagtcaatgccaaattccgtgcaaaaatgtcactgattcgcccc

SEQ ID NO: 92277 - DNA, 547 bp, Heterodera glycines
  SCN-specific regions: Sequence locations=1-414,446-547
ttttcctcctacaccaaaaaaaagaaatgtttccatttgtccatttttgtgacactttgtcttctcattagctgcttaatccccttctcgtttgactatgatgacgacctgttcgaaattggcactgctcagtccgtagcagtcaccggaattttgacgtgcaatggacgaccaagtggcggcacaaaagtgaaactgtacgacgtggacacttttgacccgacgatttgatggccgaaggctttacggacgaaaaggaacactttctgctggagggattcgaaacggaaataagcgacatcgactcgaagtgaacatttaccataattgtaacgacgaacatatccctgtctgcagaagttctccattgagatccccgacaattacataaccgaagaaaaacgatcaccacaaaagattttttacattgggaaattgaatttggaaggcaaattctcgggccaacatcgagattgtattaatcggacattttgttgaatttatcaaatacaaattaaattttagaagtaaaataatcgataggatc

SEQ ID NO: 92278 - DNA, 385 bp, Heterodera glycines
  SCN-specific regions: Sequence locations=1-19,42-385
cagcccagtcggcactctgacatctctgtactcagagatgagacatgtgaacagcaaagtgcccgaccaattagaggccttgcttgtgaatacggactcagcctggattgacttgatggacctgcaagtggtcctgacgccgccgtagaagccccgtgataaccccttcaactccatcttccctgccatacgttaactgcctggacactgcctgggcgatctcttccaacaagcaagatggccccctatctcccccggcccgtccggaccgactggacatgccgtacatcctgtacgaccacgacagaccggagacgctgtataggctggtctacccgatgcggcttgggcgccgcttaacgtcaccagcccagtgtgccctgct

SEQ ID NO: 92279 - DNA, 648 bp, Heterodera glycines
  SCN-specific regions: Sequence locations=1-123,156-335,357-648
gccaaatggtcgttgtctcgtcaatggtcgaccaaaaccataagcgacagcagccgcaacagcagaagagcaacacgcgccaaattagtgacgccgccgaaattggccacctctccgagacggatcagcaacaacagcagcagcagaaacaacaggaagaactgtactacgcacaactgctggcagtgcaacaacaggcaattgcaatgagagaggggcaacagaaggagcgggggacggagcaacgacagaacggcgcagaaacggacggagaagcgggagacggaggggaggacgagcgggaaaagcgcgagagagaggtctcggaacggaacaccaacctgatcatcaactacttgccgcagaacatgacgcaggaagaggtgcgcgcccttttcggttcgatgggcgaagtggagtcgtgcaaattgattcgtgacaaatcctccggccaatcgcttggctacgcttttgtaaattatgagcggccggaggacgcgcgaaaggctctgacctcaatgaacggacttcggctgcagaacaaagtgctaaaggtgtccctggcaaggccctccaaagatgacattaagggcgccaatctgtacgtcagcggactgcctaagtctctgacccaatttgagctcgagt

SEQ ID NO: 92280 - DNA, 658 bp, Heterodera glycines
  SCN-specific regions: Sequence locations=1-458,481-658
attagattcagtatttgagttgtcttaattttaaaatgacgaagaaacaagtcaccatcgttggttctggaaattggggcacggcaattgctcgaattgtgggcaaaacagtgcaaatgcataactcagaatttgatgactcggcggtcaaaatgtgggtctttgaagaggtggttgaaggacgcaaacttagcgaaattatcaacgagaaacacgaaaatgtgaaatatttgcccggaaagaaacttcccactaatgttatcgctgtcactgatgttgttgaggcttcaaaaaacgcggatgttctcattttcatcatccctcaccaattcttgcacaaagtttgcgaacagctcaaaggaaacatcaaaaagagcgcaatcgcaatttcgctgattaagggcttggccacttttcacgaaaaagacattgggctgcgactgatctctaatgaaatcgcgacctctcttggcattgacacttccgtgctaatgggtgctaatctcgcgaacgaagtggcagatgaccacttttgtgaagcaactattggaaccaaaaacccacagcatggaaatgaattgaagaagttgtttcacaccgacaatttccgaataaatgtggtcgaagacgcggcaacggttgagttgtgcggtgctct

SEQ ID NO: 92281 - DNA, 644 bp, Heterodera glycines
  SCN-specific regions: Sequence locations=1-610,632-644
attatttttaatggcaccgcccgtcaaaaaaaagaaaaagttttcctccgacaatcaccgcctcatttcttctacagaaattggtgaacatgaacaacaatcgatgggttcacttacgacatcgtttggaaaacggcaaagtctttttcgacatgcaaagaaaatgaacaaccgaattttgaggaaaatctggatttgcactgatatttggatggacactttcccgttctttgaccatgcccaactcggcctcaaattggcactgatttcgccacgtttcgatgttttagtagacaaacatttcaattgccaatctgaattgacaatttggagagaaataacaattgtcaaggacacaggatcagaattaaatctaactgtactgattggtggcaaatctgtgcaatttcctttgcccgaccgttcgctgcccaacaaaattcgctttgataatcttaatattgattacattgaccattccgtcctcgtgtttctccgtgccaataagcaaatttgggacaaaggcaccaatttgagtttgtatgtgtgctggtcacacaaccagaacgacaacaacaacaatttcctgccaatttgggatgtttttgtttgtaaaatttggcccatttttgcgccaaacattc

SEQ ID NO: 92282 - DNA, 427 bp, Heterodera glycines
  SCN-specific regions: Sequence locations=1-427
tatccatttggtgggccccatttccaaccaagaccggctggaattggcgcgacaattcgaaccattgttcggagaagatgtgtcctccaaactgaagaatgcactctctggcgactctaatgaactgattttggctttgttggaaccgacatctgtataatatgcgcacccaatgcaccgcgcgatgtgcgggctccgcactctcaagggatcgggcctgattgagatgttgctctcacctcgaaagcgaccagttgatgaaatgacccgcgcgtgctagacactgtaccgccatccgctggaaaaggacatcttcggggacagctgcggcgcattcccaccactgctcccgtcggtgtgcaactatactcgcgacaagaggtggagctccgacccgatctgagcgaatatgacggcacgtgctctg

SEQ ID NO: 92283 - DNA, 252 bp, Heterodera glycines
  SCN-specific regions: Sequence locations=1-252
gaaacactgcacgattccctctccaaagaccccgttttccccgtgatcgccttcaaacattacgccgccttggaacggcgcctctacaaaatcatggagtaccttctcgaatgtatggacaaacagaatggagacctaacccaaatggttgtcaacgaatttcacaatccgacggtggcggagcctttgccgggcgaagagttggagacggaggaggacgaaacgaacgacgccccggcagggccaccagcg

SEQ ID NO: 92284 - DNA, 646 bp, Heterodera glycines
  SCN-specific regions: Sequence locations=1-199,223-646
ggtcgcatcttcgttccatcagaacgcgccgtgaggaggacagtaacccgcgctttttcatgtccggtgttcaggacagtaacggtctttgagcccttctcagcaacacatgtcccgccacccgggtcaagccaaaccgccgtttcgtccgccgcgtagacatgtgtgtagctgaaaattagtcgtttgaaaaaaaatttctcatttacctacttatttttgtgtatgagttgttgaatatataatatgatgttgatgatgatgtttttgtatgcatcgggttctttttgcgctactgttgtcggtcgacgtaaggaaaatttatgatggtgcatgaatttttccagccatccattactagcctaagagaaaaatgttcaaaaatttttcgaaattttaccgcaaaattttccatgtcttcgtaggcggcgctcattttgattgcttgcgcagcaatcatatttcgtgtcacccgcactttcttttgtcgcaattcagacacccactggaacacagcttcttcgaagttcctgtttggaactttccttccgcccccttccaaacgttttcgttttgacgattcggccctaaattaaacgaattaaaacattgtgacattacaggcatcttactctttcatcaaatt

SEQ ID NO: 92285 - DNA, 649 bp, Heterodera glycines
  SCN-specific regions: Sequence locations=1-408,532-649
gatgatgtgacgtgaaccccccaaacgcgacccatcccaattgatgagatgagatgtccattgatggaggagtgtgtgtgtctctttggttgaccaccccactcactcgcacatgacgaggagatatttggagttgttcaagagcgacggtgccgcctttgaagcgttcaaagcgcgtgccaccaacaacattgttccgctgaaggcgttagcccaggcgaccggcgacccgtacgcctcttatggatatggtccggctgcatatgggactggttatgaacagcgtgccgctggcgggcgtccgatgggacgaggcggttatggagctgggggtggtggtccggcctctcaccgatactcgccttacccgagctatcccaactacgggtacggcactccgcgacagcccggcggcgccggtggtgcgggaggaggcggttacggtgctggacgtggcggtggtgctgctgctgctgctgcagccatgggtggcggtggttacgatgacggatacggcggctatggaggtggatacaatgcaaatcccaacgctggaccgaccaaactttacatgcgcggaattcctttccgtctgacagccaatgacattgaacgtttcttttctccgctcgtttgcgtggatattcag

SEQ ID NO: 92286 - DNA, 653 bp, Heterodera glycines
  SCN-specific regions: Sequence locations=1-241,263-606,643-653
ggcgttggcattttcgaatcggacaataagctgagcccccgcccgttcttcccatggacagagatcaaatgcatttcgttcaaaaacaaaatgttcaccatttgtactgcggacaaaagcaaaatcaagttcagggcacaggacatgtccatcaatcagtcacttctcgacctctgtgtgggcacgcataacctttacctgcgcagacgacagcccgacctgctcgaggtgcaacagatgaagcagcaggcagacgagcagcgaaggcgcagaatggaggagcaggtgcggttgcaccgcgagcgtgagcagcgcgcgcaggcggagcaggagagggaccgctaccgcgcagaactgaaccatctgtcggaacagttgagcgccatgcagaatgtgatcagaagtgccgaggagacgcaagtgttgatcgcggaacgggcgcgtctttccgagcaggaggccattgagcaggcacgtcgtgccagcgaagccgaggcggaagcgcaacgcgcaaaactatcccagctgagggcggaagagaccaaaatgttgttggagcgaaaaatacgcgagactgaaatggccgcacaacgaatggctgcgcttcagcaccaacaacagcaaaaacagcagcagcaacagaatggcatcac

SEQ ID NO: 92287 - DNA, 641 bp, Heterodera glycines
  SCN-specific regions: Sequence locations=1-641
atcgacgaggccgatgtcgccgccatgtcgtcgaacggtgtcgaagaaaactgcgaggccaccactatcacttcgttggacaacgagttggcggacttgttgcgctattggcttccgcttggtgcagcgacggaccattgtctgaacgtggccatgcaatggcagcagcagaaacggcccaatgctgtccttatgtcgaccatttcgcttctgctggtcgcccgggggcacatccaacgcgcatttgagcacattttcaacgagggcgttgaacgacggttggacagcaccattagccaacctcccgccgccgacgaccgttgtgtcgcctctctgttggaattggcctccgcccatccgtcggatgcgcgacgtggcgattggttggccaaactgttccggcaccttttgaaggcattgcccgaggaaacggaagccaaaagtgatgataatgcagcggaattcactgcctccgtcgttcatgaacaaatgacgcgtccaaattcgcaactttttcgtctgctctgtgctatcattgaacagcagcaccaccacgacgacgaacaggagcaggacggactgagggacatccaaattggagcggaaaaaggcacttcggcttcagtgctcgttgccgagct

SEQ ID NO: 92288 - DNA, 627 bp, Heterodera glycines
  SCN-specific regions: Sequence locations=1-546,568-583,606-627
gttttaaataaattaaatgactgaatctgacgaaggcaccaattgggttgagtctcatccgtgccgatgtggtgccaaaaattggacagccagtcacatggagcgtgtgatggtcaaactttgctgcggtagcgaagaagtccaaaactttggcaataataataatggcgctcagaagaatggcacgccagaacgtaaaaacagtttggcgcctccggagcctagcagagttcggcgtcgctcaattaacaattggcgcccaattgccggcatttttgcagtgaacccaaaggaggaggattttaatgactgtgtcaaaagccaccaggacagtccacatgaggccatccatgttttgttcaaatgcaacaaatgtagccgcgagtttgactgcacttatgagatcattgcagatgagcgtggcaaacgacaaagttttggtcattatgagtctgtttcggaaccgatcacaattggaaactgttgcaacgaaatgcacagctatgaacacattcagcgcatttttgcggccatgtgggacaaggacaagttccaggtccattacaacaactgccgacattggagtgacggattttggtggaaagtacaccctgatgagtaccaaaa

SEQ ID NO: 92289 - DNA, 655 bp, Heterodera glycines
  SCN-specific regions: Sequence locations=1-655
gtaagctttcgttgcttgagttgatcgcgatccaattcggacaattggatcattggcatttcattcaccaagaattgaagtgcattgaggttgaagatgagtctttctccattgatgcacagaaatcccaatttgaccatgtcactgatgtatttctttggcatgcgctcaccaaagctggtcaaaaggcattcttcggtgttgacgatcggaagatcaagccgttgtgccgtatgattggacacaaatgatcgatgactgccagggtcgatgaaaattgaggcgatcatgctgaggtgcggttgtgccggattgaaaatggttgccgtcgttgtcatgagtaaggcgcgagtgtcagttgcattgacggcgtttcacattggttgggtttggattgcagcattttcgattggttgcgggcttggtattgacaaatgtggcatgattgttgccgctgcgatttggttctgcgcattaatgttgcggcaaagtgctgttgggatgaagttgtccgcatttgaaacatttttctcggttttggacagtcaaatgtacgatgtgcgaaaaggcatttgaagcataagccttttgatttgacaatttcaactcgttgttgaattgtgctgaattttcggcaatcggaattccaatggtt

SEQ ID NO: 92290 - DNA, 648 bp, Heterodera glycines
  SCN-specific regions: Sequence locations=1-23,45-648
gattcctgtgctaaacaaatggtaaaaacaacaaaactttcacatttgaaaaagtcgcgcaaacgactaaaacccttaactggtcaagcaacttcatcattagcatcttcatcatcgactatttctacaacttcagctcacaaacagccgtttgactgtgttgatgaagcgcgtgcaagtggcacgttgcccactcattctggacggactttactgcgaatcgacgaggatggaaactgcgttgagattccgatgcagcgtaaaccgacttcgcccgtcaaaaaaaattgcttggacattggaaaaccggagatggaactgctgcaagtaaatggtggtcaatgggaatttgtccaacgcatcaccaatgaatcgcaactctatttttacatcaatcgtttcaaccttgtgttcggcagcagcagcaaagcgacggggggacgacgatatttcaattgcattgaacgcggcgggtcgaccaaatgtccctatcggatgatgtacatgttggaaagacaggtactctaccaaaccggggaacataaccattcgttctcactgttacgaaggcgaaagccgaccaaaatcaacataaagggactgcttccaacacccgaaaaaggaggtgatttcgagttgctgtctctt

SEQ ID NO: 92291 - DNA, 512 bp, Heterodera glycines
  SCN-specific regions: Sequence locations=1-512
catttgttggggcatgtgccattggtgacttggtcaaaacgactttagggcctaaagggatggacaaaattctcgtcagcggtaggggcgaacaccaaaatgttcaagtgacaaacgatggtgcgacaattctgaaatcgatcggtgttgataaccctgcagcaaaagttcttgtcgatatttctctgacccaggacaaggaagtgggcgatgggacaacgtcggtgactgtctttgcggccgaattgctcagagaggcggaagttatgattggacagcgaattcatccgcaagttattgtttccggctatcgaaaggctgttcgagttgcgaaggacgcacttgaaaatgctgcccaagcatcaggagagcatttgcgcgaagatttgctgaaaattgcgaagacttcactgggttccaagattctttcccagcattccaaccattttgccaaattggcggtcgatgccgtcctccgactcggccccaacggcgctttggactccatccaa

SEQ ID NO: 92292 - DNA, 659 bp, Heterodera glycines
  misc_feature (639)..(639): n is a, c, g, or t
  SCN-specific regions: Sequence locations=1-659
gttgaattacaattcttttgtccaatatttgcttgctcaattctcgttttaaatgtgttctccaacaaagaatctgctcaaatctaatgacgattgcaataaaaaggagtcttttccacctgcggttctctcagtgccttcttcccagcgttgctgtcccaattctccctcgacttcttccggctcatcctccccttcgtcatgttgtcggcagctttccggttaccccgtaattccgcgtgagcaattggaaatcgggaagcaattgggtgctggcacatatggttctgtttttcgcggatggtggactaaaactgatggaaatttgctttgcgtggcgatgaagaaagtgtttatgctggacaaagaagtcgagattttgtcgcaaatccgtcaccggaatatcatccaattttacggcgtttcggttgccaaccctgacttttggattgtgactgaatatgccgagaatggctctctgtttgataatttgcacaataaagaacaaccacttgaattcgggcgcattatcaaatgggccgtgcaaatcgctcgaggcgtcgtttaccttcactacgaggcgccgttgacagtgatccatcgcgacttgaagtccaaaaacattgtgattggcagtangaaccaatgcaaattgtgcg

SEQ ID NO: 92293 - DNA, 637 bp, Heterodera glycines
  SCN-specific regions: Sequence locations=1-337,365-637
aaatccttttttgggatttcgaattgccaatgaatttgcgtatcggttttttttttagggcactcgtggcattatagacaaaaggagcttaaaaaatcgaatttggataccctaaaaatagttttaaaaaaatcggaaattgaggcccacgcaaattcaatcttctgctgctgatcattgcaatgaagtgagaaataattaactaattaggaccaacagaagcccgaggtaataaataattcaattggttactgtaggatttttgaaagaacgttcagattgcttactgtatgcatgctgtatactgtagccttgcccatttaaatattttcgaaccattttttaatttaatttttattaattactccttttaatcatcaaagtctgccgcgaacataagtgttattttttcaaggcttttccaccgccgcccccgcaggggaatttcacagctaatttaatgacccccaccccgcggggttttcccgccggtcgccccccggggctctaattgccaacaacttccgccactttcctcgcccctacagtatgccccatcttagtgacttcattagcaacagcagcacagttcgcaaattagtttttttcaaatgtaattttctctccccgccacgaa

SEQ ID NO: 92294 - DNA, 612 bp, Heterodera glycines
  SCN-specific regions: Sequence locations=1-612
atctgtcaaaaaaaacaaatcctgtatcaaaaaaaaagaaaaaaaaatttgatcaaaaaaagtgaaaaatttttcaaaaaaggccactttttaactagcgccgaattatccattccaagatttgttgtcaattctagagacagacgcccagaaatttgtttcaactttcctgacaaataatgcatacacaacaaaatttattccaaccaaatcttggtgtcctcattaggcataaactaacgatcaatgacagaattttttgtgccatgccaaaacggaacatgatttatttttgggtgcccaccaaaatgccaaacatacatttgtttcattcaccttggtatctctcacctgtgttgccgatgcaattcccgaacatgtccaatgaattgttcttgctccgtggttggctgtgcaatatgtgcgctgttcaaatggtccgcatattcgtcgctttcttggtagtcgcccaacatcgcctgggcaataaacgcgcccaaattggcctgggccgcgaatgagacgggcaaactgaacaaattggcaacaaaattatgtgtactcccgtttaactcggtcaaatttttctgaattttacagacatgaaccccc

SEQ ID NO: 92295 - DNA, 658 bp, Heterodera glycines
  SCN-specific regions: Sequence locations=1-173,195-282,305-422,450-658
ggcatacgcaaggaaagtaatatttcctggccaattttatcgttggcaaatattttatatgtatgtatcacactagttttattcattttttatggataagaaaatgaatatttttttaaatgaatatcagtcaaattgcgccttaggcatcgccgctttccctaagaaattttcaaagatttttccatattcaaatgcttatacaaatatttctcaaattttcttgtcttttataactgaattttgggggctttaaatgtattgaaattaagaagaaatgtattgtgcaaaaacaattattattttctcacaattgcttctaatttgtgtttatgtttcggacgcttttcattcggctaaaggaaagaatgagaagaccgacgaaaaaggaagcttcatttttaataaattgaaaggtaaggttaattaattaactaattaattaattagcatttatatttttcgattttagtccaattccaagccgccattagcgaaaatcagcaaaagtatctgcaatttaaacatatatgcttaatcaaatttaaagcaatcctttttgttttagggtagcatcagtcatggcggtaaaaagtatctgccaaatgatgattgatggtgctgaattcaacggatttgccaattcgattgctttcca

SEQ ID NO: 92296 - DNA, 477 bp, Heterodera glycines
  SCN-specific regions: Sequence locations=1-477
gtttacaacttttttttgtgatcaaaatgctccgtttgcgctgcccatcgcgccactttgcctcgtccgccgcttccgccatgaaagcgcgaccgactgttgagccggtccaacaaaaaatctcccgactgcccaccggtttctctgtttcttcggtggaacttcagatcgccaaacggactgcggaaatgcaaacattgaccaccgccaactgttcgtcatcgtttgctgctgaccaggcttgccaattgttggccaaaggcaccgcactgttgtctccccactttcaaattgggaacatcaccaacaagcgcactccacaaattgtcaactcgcgctggttgaccaaggaggcggcactgatcggcgtcaacatcgaacacgacttgcttttggactatgcgggcccaatttcccaattgatgtttgctttccgttccggcgctcgttttcaacaacatgacgaagccggactca

SEQ ID NO: 92297 - DNA, 654 bp, Heterodera glycines
  SCN-specific regions: Sequence locations=1-42,64-292,315-426,449-654
atggcacggcgttctcggcgccattgccaacgggtgaaggcactgtggacacgggctgcctgttttatcaaaagtcgccgccgcggatggccgactttgattattctctgccaatttattcgactctttcccgaattgccatccgtgaccacaacagttttccgttggctgaaatttggcgtctgttccatccgttctccgtcgacacgtggttagccatcgtcttgttcattgccctgcacagttttgtcttcatggtcatcgaaaaaatcgaatttttggtcaaccgccgcactgtcgcacaaatgccaatatttcacaatatcctttggcgccttcttcgccttcaattgctgcagccaaaatcggtccgtttggccaccgtttcggcttcgtgcattgcgtgtgcttcacttcgctgtaccgttcttggattgtcacttcgctggtacagccaaagccggccattcccatcagagatgcttcatcctttgtgaaggacgttcagcagggcaaatacacttttgtgtcccaatacagaggccattggttttatgagagtttgaacaaatccacgactttcccattcaaagaaatgcgcgaaggcggggcacaaaagaaacttttgcaggcacattcgattcaagagtcgct

SEQ ID NO: 92298 - DNA, 650 bp, Heterodera glycines
  SCN-specific regions: Sequence locations=1-140,198-541,569-650
gccccattttgaaggaactgaaaaatagatccccacagaggctcgaattcaagtaaatttggtgttttacctttggatcaggcagggtgttggaaatttttcttacatattttattcgcaaggatttttctcaaaaccaaaattattaaaacttttttatattcaaaaaaggggaattttttaattggctgataatttcacagtttgctgcttttcctcgtgtcaataaggagaatgtattgccgaaatgccaatgccgtcaccccatcagcagcagtgcctttgtttttggttgacggtgaagtgaattctctgaacaaaaacagtacgccaagaccatcagcaggagaaattcaaatatttgccgaaaatatgggtaattcacttatttatgactagggatgtaaattatattgactgaaatatggacataaaatggactaaaaaagctcaaaaatggccaaatatttactaaaaactgtcaaaatatagttttaaaacctcaaaaattcaaaaaaaggtttatatattcaatatttgcttaaataaaacttaaaaataagataaagaaccaaaagatggatttaaaactaaaaatgcaaattttgtattgtcgtccgttgaaaacacctccaagtttgtcaatttca

SEQ ID NO: 92299 - DNA, 153 bp, Heterodera glycines
  SCN-specific regions: Sequence locations=1-153
ttggaaattcgggcaaaaagagagcgaagttggcgcactgtgaaggaattgcgaatgacgtcgacggaccgtccgaattgggcggggcactttcgcatggacggattggaggcgaacgaacgctatcagttccgattgcgacccttcggcgaa

SEQ ID NO: 92300 - DNA, 640 bp, Heterodera glycines
  SCN-specific regions: Sequence locations=1-374,397-640
aaagacgaatccgatggctgttcaaacgttccaaaagaattccatcttcaccaatgttgccgaaacttcggagggcaaagtgtactgggaagggttggaggacgaaatccgcgaccgcgatgacgtcaccataaccgattggatgggcgccccgtggaaattgggcagcccaacgccggccgcccatccgaactcgcgcttctgcgcgccggccaaacagtgcccgatcatccatcccgactgggagtcgccgaatggtgttccgattgatgcgatcattttcgggggacgacgtccgcagggcgtgccgttggtgtttgaatcattctcctgggagcacggcattttcactggcgcatgtttaaagtcggagacaacagctgctgcggagcatcaaggaaagacagtgatgcacgacccgatggcaatgcgaccctttatgggctacaatttcggcaagtacctggcacattggtgcagtttgaagcagccgggccgtaaaatgccgcgaattttccacgttaattggttccgcaaatcgggggcggacggcaaatttctgtggcccgggtattgtgagaacatccgcgtcattgactggattgtgcgccgtttggacaaacagcgagcattggcattg

SEQ ID NO: 92301 - DNA, 638 bp, Heterodera glycines
  SCN-specific regions: Sequence locations=1-491,513-638
gacactgcgaatccgccgctcaattcgccaccgtcctcacaaccgcttcactcccgactagcgtttaatggcacaacttcggccaaaatcaatgacacagcacgacattggaagcagtggaattcatcagaggaaatggcacttgcatttggcgagaataaaaaggcacaaatggcggcacgggcgatgttcgacctggtgcatcaatacggggacaaccttcgagaagttctgttccttttcagtagaccgcttcgaacaggcgcacattttacagagtgtagtccgtccttttccatttagggatggatgaatgtgttggattgtcttctttacatgctcaaagctaatcttctgccgtctcctcttgtccaattggaagattttgtggagctgtccggcttcgtttcgcttaaacattgcttcaaacgccgtccgactgcaccgaaaaaggaagagagcggactcctcagttggctcggacttacgggcagttcagccaccggcggcggagaatcggggcaaagccgaccacaaaacgagcaagagaaggagttggctgctaatacagttgccgagtgtcaccctgagcaaattgtgctggacagtcgctatttggccagttcttcgctcaccga

SEQ ID NO: 92302 - DNA, 641 bp, Heterodera glycines
  SCN-specific regions: Sequence locations=1-641
gagatattaatttaaactgttcgtttttctttacgctatcatttaaatttatgaagtcgatcactttctgaaaaagaaaatgccgggccgctcaacggaggcgcatagggcgttggaacagcttgaagcataccacgcgttgctgacacaacccggggatgccgaattgcgctacggcattgagcgagtgattggcattttcaaagccaatctgttccaggcccttttggacatccaagaattttacgacaacactttgctgaacgaaagagttccgttggatatgaaaacaaccgaaactcgcaaattggccgagagatgggagcagagtccccccttcggcgccgtctcccgggcattcactccgtcctccttcgaccgtcctgtctttcccgccacaacaactgcaacacctcacacaaatggcttcaatggcgaaatggaaacagccataacacactcttctcattcatattcgtaccaggagcagagcaaacaattgaccaaggatggatggcatacgcaagagtaccggactcaaacggtggacgggccgagtgggtttcagacggagacagtgaccaacaacggactgattgacgaccagggaaaggcgtgggaggtagaggacgtggtgctgg

SEQ ID NO: 92303 - DNA, 634 bp, Heterodera glycines
  SCN-specific regions: Sequence locations=1-634
gaagatttgaatgcaatttgtgaagcggcccaagccgaagaagagcgaagagcaagaggcgaagagcgagttacgcagcttacagcgtatttcaccttcaacaaggacaatgctccactcggtctgacttatgccaaatgctacaaaaagttgtggtacgatattgcaaagaagcagtggaagccgtatgtgaacagagttgttccaaaattttgccgactcaagaccgtttcgccaaacaaccgcgaacttctggtgaatattatttaaccaattaacacattatggattataataggctattcggatgctcctattggttgtttgtgacccaactggatgggaagccctgaggacgcacaacaacattgtccacggctctttcattgaggctgctcaggcccggggtctgctcagtgacaataacctgtggatgaacaccgttatggaggcctttcaaacaaaaaagtccatccgccagagaatcagatggctcgctgtgttcttcgcgactacaaacctctcaagtccgacaacaatcttggacagcattttgaaggacgccgacaattggcttgtgaacaccagtgttgcaaaggcttcggctgaagatcagaagcaatatgtcctgcgt

SEQ ID NO: 92304 - DNA, 157 bp, Heterodera glycines
  SCN-specific regions: Sequence locations=1-157
gtttttatcaaccacaaaagctacttaaaatattttttattgtcagtggatattgtgaattgtacctgttgacgttttggcacttgacactcttttcgctgcagattttggctacaatataaagaattttgatttaacccaaggctaatctcaaaaa

SEQ ID NO: 92305 - DNA, 644 bp, Heterodera glycines
  SCN-specific regions: Sequence locations=1-152,174-455,477-572,594-644
agattatttaaccgcgttattatccaccggatttaaaggactacctaaatcgaaatatttgattatttgaatctccatccaacgaggccaacgatggcggaccaatggcaggaatatttggcgagggatcaatcggctgatgaaacattccatgcttctgtcaaaacagctgacaatgggcagcagcaacagcaggcgaacaacgtcgccaacaacaacggttcgcagcgtgtcgcacaaacaaacggcgtcggtttgccaaacggcggggacgacggagcgctgcgttttgtgccggaaaggacgcggataaagtcgcggatgaacgatgaaacggacgaatgggcggaaagagaggaaatgatggcacaggaagaccaaatgatgatgctcaaagatccgaaacacaaagattctctgctgtcgcggctggacaccttccgccgtaaccgtgccttctgtgacgttgtgctgttcgtcgacggacgtgaactgttggcccacaaggcggtgttggccgccatttccccgcctctcttcgaccttttccacagcaacagcgcctccattcccattgatgaggaaaatgaacacacccttctgccggaccaagccctcgaattggccaaggccgcttctcaagt

SEQ ID NO: 92306 - DNA, 436 bp, Heterodera glycines
  SCN-specific regions: Sequence locations=1-436
tctgctggcgcttgtgcttcataatgcctgccatgagctgcgcactcgctatgacatgactcgcgagagacttccgcgcttctcgaaaccgaggccattttgttcaatgagctcgtcagactttgccgtgcctttgattttgttcgtcatcagcacaaatgatttgtgcaagtgtttcaagattctttaccatcgctttgggccaagttgtttggacacattaaaaggtggtggtccagcggtcatttatctggtccagaatttgatgatctttttggctattgaaaagtagaggacgagcgcttatatggacacttatcgacttaaaatcctcaccacggcattctttgccgtgcttattttgaagcagaagttatccataattcaatgggtgccactgctcattttggtcgacggggctgccctcacccaatat

SEQ ID NO: 92307 - DNA, 623 bp, Heterodera glycines
  SCN-specific regions: Sequence locations=1-342,364-623
ccgatggcttctcagtgcgtttctcctcttcccgtcaaaggttctcgacggaaacatcctctcctggcaaatttgctcctcgtcctcactctgattagcgtatttattggcattggcatcgccttttttgtcagacaattccaaccttctcaaagaaccatcgacatgatcggcttcccaggcgaactgttcatgaacttgctcaagtcgttgatcctgccgctgatcgccgccagcctcgtgtccggcctcagtcagttggacacgcgtcaatcgggccgtatcggcgcgttcgccgctttgtattacgccatcacaatggtgctcgccgttacgactggcatttgccttgtgcttctcatccatcccggcgacccgagcatcaaagaacacttcgcttccgagaacgattcgcacccggcaaatgtgtccgcgttggagaaactgatggatttgctcagaaatatgttccccgacaacattgtccaggccactttccagcaaatggagaccgaatacgtcgaaattcgtccaccaacaaatgtcagcagcacaacagcaattgtacacgcggtgcacagacacatcgacggaatgaacactttggggatgatcatgttctt

SEQ ID NO: 92308 - DNA, 191 bp, Heterodera glycines
  SCN-specific regions: Sequence locations=1-17,39-191
tgttccatctgagaacattgggaaaaaaccttatgggagaaagaacgcaacctctttgatttccgtaattcgaagcatatgacgagcagcgcccatatcagcagaaatggtgatctgtcaagtcaattaaaatttattacaataatttttgcgtcagcaacatccaaattttcactattttatgcataagg

SEQ ID NO: 92309 - DNA, 649 bp, Heterodera glycines
  SCN-specific regions: Sequence locations=1-649
ctattcatttggaccaaatgattcgtaataagcttgaaagtctacaaaaaagtcgagagaagcgttaatttcagacatttcaaacacaaatgaggatgccgtgaatttgggagtggagcttggcgacccgaatgccgtgataattttcgacaacgttgacagactttgaacgaggctgaagtcttaataatgaactttgagcgcggaaaaacatattttgggggacattgcctgtggctgaatgctgaactagtgacaaaaatttcgaccatcaactcagaacacagctacgcggctactccaatacaattcggcatcggctcaccggcgccatcaacttttacatggccaaccaccgtgactccacaagaacagcttgttcaatattctttgagctcgctatcgacttcgaaacaacgccttcagttcacgtgtgggaggaagaaatctttcgggcgcccctcttcccaattccaatttggaacatgcattcgcaggccacgtctgccctcgctcatacaaacaatggactggagaaaggtctctgccaccaccctgcactctcggacttcatttgtgaaatcagtgaaagcaccgactgacgatggacgctgcccgatctgagctgctcgccatttcattcgcatgt

SEQ ID NO: 92310 - DNA, 337 bp, Heterodera glycines
  SCN-specific regions: Sequence locations=1-337
ctgctgcacctgcggctgaggcggcagcgcctgcgccagctgagcaacccgcggccgagcaaccggcgccagcgccggcagccgagcccgctaagcagcaagcatctggctactgatcacttcgtcaatgatgggatgtgcccggctgatcacggcgctgatcagtttcttctattttgattgatcagcaccaactttcattcaaacacttttcaccaccatcttgccggtgtttttttctttcaaacttttgctgtcttccaaatgattttcattgtgtcagtgtgtcttagacaacataaaattttgatcaaacaggaaaaaaaaaaaaaaaaaa

SEQ ID NO: 92311 - DNA, 641 bp, Heterodera glycines
  SCN-specific regions: Sequence locations=1-259,295-454,477-641
cgaattcgaatgatttcatgtttgttgaatttcactgtataaatcacaaaaatgtatgaagcatatacaaacgaagaaattgtttctaaattaccaatcgaagcatcatccatcggaagctatgtttcgaaaggaaaattattcattggatccagacaaggccatctcataacatgcaatcagaactcagcagacacttccaaacttcattatgaatatcaatggttgagtcgcacgatctaattatatgtttaacggatgtacatttgtcaattcatgatgctgtagaaccatttaagctcttggatgtatgttctaagtacaaatcaatttccgcattttctcattttgtgacagagagccaaactattcatattgcaatttccgcaagaaagcatttacacattttcaaatatttattgggtgaactttgtgaaattaacgactgtgcaccgattactcttcctgagaatgcccaagccgttgtgtggtgcggtgtcaacaatttaattctggcatttaaatgcgagttccaattctgggacatggaccatttcctccacagagatgatttgatcgacgaaaaagtaacaaccaatttatttttgtgagttcgtcatttagagcatgagtctcgcaaa

SEQ ID NO: 92312 - DNA, 643 bp, Heterodera glycines
  SCN-specific regions: Sequence locations=1-643
gaaaattattacctaaaacttatggcaaaagaggcgcgaaggaggcaaagaaaagacgagaggagagatgcgagaaggcggagagggcgagacaaggccgatgggccaagaaaactgctccacagccgaatctcaatgccgaagtgccacagcaggacgaagcagggccgtcaacatctgctgcaccgacagaagaagcgatggagccgcctccaccaactccaggaccagtgccaacgccagaaatggacgaggaaattttggaattcgacgacccgccgccgtcgacacctgccacaccaattggcgatttggtgccgtttccgtcaacaccaactgcgccaatggacaccggagagacgaccccgccaccgctggccattgacgagcgatcagagcgcatcgaacagctggaaaagcaactgaaggaccggtatgacaccattcaatttctgcgcgagcaggtccgaaaccgagaagcgctgatcagtgatctgcgtcgtcagctggagcaatgtgcggcaccaccaacggcgacaccaaccaccagcaaaacaacgccaaacagaggaagaccaaggaaggccatcgacgaactccaacgcagctcgcgaaaacggttgacggaacagattttggacgc

SEQ ID NO: 92313 - DNA, 268 bp, Heterodera glycines
  SCN-specific regions: Sequence locations=1-6,28-133,159-159,186-268
gcaagagactcacattgttctcgggattgcctcgatgtgctctctgttggatatcatcgccacaatcgacactctgccatctctgaactcggatatgagccaaatgaacaggaaagtgcgcgacggagttgaagccttccgcgtcaacaccgactcgggctggactgacttgatggacgagcaagtggtcgtgacgccgccgacgaagccccgagataaccccttcaactccatcttccgtgttaaacgacaactgaccgaacactgc

SEQ ID NO: 92314 - DNA, 466 bp, Heterodera glycines
  SCN-specific regions: Sequence locations=1-75,102-112,263-466
ccaatacctattctatttcaacgtcaacacccccgcagcagcacatcagcgcacttcagcagaggaggaggcagctcatcatcatcaacaacaacacaaacgatgagcgacaagaaggagaagggcggcaaggacaaggagaagaagcggcgcagcaaaaagagcgggaaatcagcgaagaagaagacgaacgagaggaaaacccgcattatcaaaaaggaggaaaagctgagcacgggaggagagcgagaaagagaggaagcggggaggaagtcggcacgatcgcggagccctgcagaaagacgacgacgatgattataaagcgacataacaatcagcaagacccatctcatatgctcattctttgataacagaaaacgcaggacacagaaatgatacagcagcctcaattctctggaagcacaaatttgttatgtatttgcatggggaataaatatagatgccg

SEQ ID NO: 92315 - DNA, 662 bp, Heterodera glycines
  SCN-specific regions: Sequence locations=1-531,557-662
gtaaaagatggcaatcatttggggtgcccagctgatcaattgatcagtccatttgcgagtaattcgcctgcgaatgtttcccttccattctgctgctgttgtccatcactaattgattgtccttcaaccaaccagtgatcacttcctcttgcgatggtccgttctttgttcgacatttgtctggcctccgtttgccagcgcagtttggtgttcgatgccgacctttctcttctcccctgcgactgtaaacaacgtttgatggagtttttcgcatcccatgaccaattaaactccgaactgtgctttgggcttatgtcacggccaatgtttggtcggaatttgactcgcctctgcttttacctcagcgaccaattgaatgattcgattttggaagctttggccagttttaaccaaaaccttcgcattatttcgatcgtcgaatgcccccgggtcactgatacgggaattgtcagcgtcactctccgccagaataaactcgtctgcctcgagttagtcggaattccgctgctcacttccaatgcgctcaaggctgtgaattcgaaccgtctgagaagcgtcgatttgagtggatgccgaaagatcgcttcagaaggcattttctacttggtgtttaataatccgtcaattgttagcctttgttt

SEQ ID NO: 92316 - DNA, 625 bp, Heterodera glycines
  SCN-specific regions: Sequence locations=1-74,96-625
gtttctttggattcgatggaacgctcactttttgctgaaacatccgatggcaatattgggaacggcggcggcaccgccccacggcaccaccagcaggaggagggccaactttggcatgggcactcggaaagcgcaacttcgccaatggttgcaagcgtttcggcaaagctgctgcacttgccgcccttccatttgggcaacaaactgatcagtgtcaaagcgttcgtccgatgccatttggagtccaccttctacaatttgtctgtgctcgctttgcacgattgcgacagttatcgccgcatggctttgttggccctccatcgttaccatttgcggttggccgactcggggctgcccaatatgagtgttgaccaggggttggaccttctcgcggtgatggccgatgtggacacttttgtggccgattactgttacgatttgaacgaacaatttttcatcgaacgcaacgaacacggaaagacacagctgaacattttgcgtgtccatcaggtgatcaattcggtgaaaacccacggactcggcattctccactctttgatcaattcggcttacaaatttctgcgtgtgcaattccaacgcctttcgcgctgtctttttgacgaac

SEQ ID NO: 92317 - DNA, 623 bp, Heterodera glycines
  SCN-specific regions: Sequence locations=1-105,127-166,190-535,560-596
ctcaaacattggaaggaaatgtcccttatgaaaatgaccaccactttggaaatgcccaatgggccagatgaaagtctgtggcaagaatgtgccaatgattgtgccatgttcaactatttctcgcgggagtccttccaaaagtgtgtgcaaaggtacaacggcacttttgctgaggaaaaaagtatgcgtgtgagttacgaatcgatgcatgccgaggcatttttgacggcattggtaaacacgcggcagaccggacgaagttatgtgggagagttcgaagttgccaattactccaatcatgccaatgatatgtattttttcattgggttgcaccaaattccgatggaccgactcgacctgcgattgatggattggtattacccgcaaatgatcaaaaacttcgtgaaaggaaaagcgcccgacattgggtggaaaccccaaaattggaacggacgcaattactttcgcatcactttcaatgtcagcgacaacggcactctgacggattggccacacggagtggacggataccaggacgtggctgggcttgacttttggcttcacgaactgccccttgtggaacagaacgcaacgcgagagacggaggaggaaaaggaggagga

SEQ ID NO: 92318 - DNA, 601 bp, Heterodera glycines
  SCN-specific regions: Sequence locations=1-16,39-253,275-517,540-601
agaaaacgaccctaagaaaaggattattaagaggaaattgccgcaacttcctgtcactggtgttgtgttgccttttaacagcggagtgaaaccgaacatggccaggaatggcatggcacgtaaagccctcaacccacaggcgtacgaagccagcgcggtcaaacaaatgcaaagttacaaacagacaaagtcaatggaattgtttaaagagcgcgggatgaaattcacttgtgtggactcatctcaacaacagcaggaggagaacagaaacggacgggcgggggggacgagtggcgggacattgtcatcaattggcactgtttcggcatgtccagtcgacatgatggaccctagtgaccgcgaagcaattcagttctatgaaggcgagcggaacggaggccgagaaacgaaaggaagcttagcaaaaagtacggagggaggaggatttggggcttcttcgcttgagcgggccaaacgctttgggcttattccaccaaaatttgaccctcgcattccgccgccaccaatttgccaaccaccgaaacgaaaagaaatcgaacagccgaaggaaaagagggcaattaagcaggagacagaagtg

SEQ ID NO: 92319 - DNA, 660 bp, Heterodera glycines
  SCN-specific regions: Sequence locations=1-36,58-202,224-660
caaaaaatgagcacaccaccaaaagcagacgacaaaaagaaggaagtgggcggaattctgaaaatcggcaacacatgctgcatgggcgctgcactccaagcattagccaacgtgacggcactcagcaattttctgatggaaaacgaaaaccgactgcccaacatcaaactcgtcatggaatatgcaggcttgggaatatgtgcaaatgatcaaaagcattttggtgttgcgacaaccggcggcgccattcgaactgaaggaagtcatctccagccttaccaatttgttcgctgattcgttccaacatgacagccgactgcgcgacattccgctcgacaaaattgacatttggtgcttcatgcgattgttcaaggacaaggacgaagatggacagggcgaccgcctgatttgtatcagcctggcccagcgcttcactgatgaatcgcattacattatgggagcgtcggacgctggtcaactgcccatggatgtgccgctgatctccatcaaccattgtctcgcggatttcatcaaaccggaagacattgaaggctcacgctgtgcacagtgcagcaacgcaacgccatgtttgactgttgttgacaactccgttgacgaagcggtggagcaggaaaaggcggagaattgtccaactacatc

SEQ ID NO: 92320 - DNA, 654 bp, Heterodera glycines
  SCN-specific regions: Sequence locations=1-416,442-563,585-654
tttgagttagggcatttttcaccgtcagtttattcatcccattttttcaccaacaaatgcaaatgttggggattcggattccacgacatccgccatggttgttcaactgttgcgtgtcaccgccccaatcggagtttgcttgtctccgtgtcgaccgttcgttgatcagtgggcccagcaatttccgtcacattggccacatcggtgccggcgacaacctttcaacggcggacgatgaaaatgccatgggcgcgttgcttcgctccaagggcgggcccgagtttggcatggaagtgcccgctgagctgcggtcatccgacgtgccgattggtgttgagaaggagaggaatgatggtgccgccggcggcgaaggtgacggcggtgctggtgatgtttagccttcctcccggttctttgtttctcctcctcttcttctttttgtgcggtttctctccgagatgatcagatgaaacgactgaaaaatgactactgctgctgattaattgattgcttaattgattggataagtattttcctttacgggcaccgaaaatcccatcgatcgccgccccccccccccgcccaatgaattttttttacccttttttcatttcctttttgttttaacttttgtgtccccattcttccattgca

SEQ ID NO: 92321 - DNA, 639 bp, Heterodera glycines
  SCN-specific regions: Sequence locations=1-103,125-268,290-639
caggattgtaattaagtggggagttctcaggttggccaatggcgcaacgctaatcgtccattttggcggtccgcgcttcgacatgatgaatgcgtatttggagagaagcgactttttggttggaccgttttgtgagcaaatatgaaaattgaagagtgcgacttcacaaacgattcaaagttgaagggacggacagaaaaggaaatgcccgaacgatttcattcgcaaaacgctcatcagcaattttagacccacgatttggcatgatcatttggatgatatgcctggagaatacggacattctcttgtccaaaagcatttggaagcgcggagatggcgaggaatacgattgtctttactcgccttcctgcgaagcgcctgtttcttccggttcgtggaagctttgccttcatcaaattgaattggtttggagcttagatgcccatgtcccttttttgtctgctttgtggagacgattcgggccattggctcagcaaactacctcttctttttgtcaaccgcaacggaaagaacgcccgagcactgatggacaccggctcaatgatttcttttttttctttactccttactttaggctcacaaatccacattgtgtctaaggcatttgcggactcctta

SEQ ID NO: 92322 - DNA, 601 bp, Heterodera glycines
  SCN-specific regions: Sequence locations=1-601
cgttatttggcattcattccgttttctcccttcgatggaaaacattcaaagcgatgaaaagagaagcaagccttgcttgtctgtacataatgtgccaatgaatgtcacagccaatgccgtggatttttgcccgcctttcgtcgccaattctctctctctttctgtgcttaggtttgccctctctttgctgctccaatgactttccttgtctgatcgacttcaaaacgccttcgcctcccttcggttcttcgccatgtccgatttctgcgcttcttctcagcctttgatttggcgagcttcggtttccaaaatgttctccattctctcggcttcgccttcgttgtccaggagaatatttctgacttttccccccttttctttttttgtcgttttgtccattttctgttttcaattgccctttgccaccgctgttcgtaataaagaaatcgacgatgagtatcaacgactgattcccctacggaatattccccaggggtgcgaccacgccaaaggcgtacttccggggacgggggacccggcaaaagaatacggttttgttggcggtgggcttgagaaatgccaagtttggcttgagggcgac

SEQ ID NO: 92323 - DNA, 211 bp, Heterodera glycines
  SCN-specific regions: Sequence locations=1-163,185-211
tgcccgagtttacattggtcatttgccatctcgtgcaactgaacgtgatctggaacattttttccgtggttatggacgcatcagagatgtgatgctgaagaatggcttcggatttgtggaatttgatgattcgcgcgacgctgacgatgctgtttatgatttaaatggacaaaaattgttgggggagcgagtgatcgttgaattgtcgcga

SEQ ID NO: 92324 - DNA, 481 bp, Heterodera glycines
  SCN-specific regions: Sequence locations=1-481
attgtaataattcccatttttgacaatgctaaaattgggtgaacttttgtttcaattaaaatgcctttgtttcattcattctttttgattttgctctttttaaatttatttttccaatttattttcttaaaagcattgaaagtgccgcgtttcttagtaaaaaaaaatattaaacgaaacgatgcaaaacgaagcgcagacaatcactgaaaagtcgccgcccctcggcgcctccgtttcttccctcggtggcagcgctttgtcctcccttttcgcctcccctctgatcactttggcccctccgatcacttcctccgcttcgtttctcctctttttgctgacgatcaccttccttctgctgatcagtgcttttggccttttgcttttcaaatggcacatgcgcaacggaaagagcgaaaacggagggagcaaagaaaaagcgtggaacgggagaacgccaatcatttcgcagcctttgcga

SEQ ID NO: 92325 - DNA, 665 bp, Heterodera glycines
  SCN-specific regions: Sequence locations=1-129,152-263,285-665
catttctgttcaggatgccattggcaataaagcaattgtttaccgaaatattcatcttttggacgacaaatttcgcttacgttttcgctttaatgaatcgcttcatacaattggagccaatctgacaacatttattggaaagcttgaaaaacgacttcaaggcgattacaggattatgccatcattaccaatacgagacgaggaaaatccgggacaaaatttcgtcatgtgtttccatttgtggtcaccaacaaataatggtagtggtgatgcaattgttgaatttgcggaaagtgaacggttattgtccacaaatgtacaaaattcgaaagccaatgaacaattgcatagcttatactcagaatacaaagtgatcaacattgagtcatgtgctgctgctgattcgtcgacatcatcggtactgctcaattccgattcttttggctcgtcgatggtgcagccaaatgccaagcagttgctcgtctgcttcactgtttttgccatgtttgtgttgctgtccactgcatttgcttgttacatttgcgtggtgcgacggtacgcggaacgcatgcgaacaaaatgcgaccatttgctggacgagcagcggagcgcttcatacaactccaccgacaatccgtatagtgtttatgcgaaaagcaacaata

SEQ ID NO: 92326 - DNA, 510 bp, Heterodera glycines
  SCN-specific regions: Sequence locations=1-116,138-169,191-202,248 -474,502-510
ttgcagcggataaatttgctgaaatgccgtttggaggcattccatgctgaatatgaccgcgtttctcgtcgttatgaccatcttttttctcaaatgaacataagcggtgacgaatttaagcgtaaaaaacagacggctgctgcctattgcgaagcattaaaaatatttggaaggaaaattaatgaattgaaaaagtgacgacattttcaaaaatttaatccttaaaaaataatttagaattgaacaaaaagatgagttaatagaacgagacagagaagcacttcacgcaaacatagaattacaggaagaaaggatggaagaggttgagaaggctaaggaactcgtgaacaaagcaattcaaactcttggtcaaacgttggcaaaactaaacgaagaattagatgaaatcaaaccgcttttacttaaactgtacaggaagcgtgacaaatgccgagacgaaatattggcattgcccaaacaacaaaacaccacacacgcacatttggatcg

SEQ ID NO: 92327 - DNA, 475 bp, Heterodera glycines
  SCN-specific regions: Sequence locations=1-475
gactctccagcggaccgaggttgcgttcattctttacgcagaaatagccacaattattgtgcttcttttgccatgggttcggtcgacaatgtggaaaaaagtgtttaacagtcgcgttgtgcacaaactcaaacagttttccaatgtgtacgcctacgctttcatttttgtgctcattcttttgttcattgatgccacccgtgaagtgcgtaagtacagccacgtggacactactacagagatggtgggactagtggccgaggcggacgccgtcgatcacatgcgtctcttcagagctcagcgaaacctttatatgagtggcttttctctgctgatggcactgattatcagccgcatcgacactttgctcgcccgttgtgcccacctcgaattggctgctgaggcggcgatgaaacaagcggaaagggcgggcaaagcggcccatactctgctcggagaaaagggcgatgtgaat

SEQ ID NO: 92328 - DNA, 222 bp, Heterodera glycines
  SCN-specific regions: Sequence locations=1-222
aataaaaatttattaagaatgcataaaatggaataaatataataattagaacaattaattaaatgtttgtttctttgcactttctctgtttttccctcgtccttcactttttctttccaagacctccaaaaaggctgctgagtcctccgagtcccccaccgctgccgaaaccgccgccgccgcacgagggacaacactaatagcaaggaggaggaagaaggg

SEQ ID NO: 92329 - DNA, 658 bp, Heterodera glycines
  SCN-specific regions: Sequence locations=1-33,58-369,393-658
ggtgccaattaataaattgtttaattcacactaaaaataatggaaacagaaaatgatgccacggcatcgccaaatcggccattgtccgccgccagtgtggccacgtcgaccgcgctgcgcgatggcggcgaagcggacaacagtgacgcacaacagcaccagcaggcgacgcgcgagctggacgaagcggtcactttggcagcgggccgaggcgcccgcatcaccgacttggacagacaaattgaaactttaatgcgctgtgaatgcctaaccgagcaggaagtgaaagtgttgtgtgccaaagcgcgtgaaattcttctccaggaaggcaatgtgcagcgaattgatgcgccagtgacggtgtgtggtgatgtgcacggccaattccacgatttgatggaactgttccgagtgggtggccaggtgcccgacacaaattatttgtttcttggcgattttgtcgacagaggcttttactcggtggaaacatttctgctgttgttggcacttaaagttcggtatccggacagaatgatgttgatccgaggcaaccacgagtcacgccaaatcacccaagtttatggcttttacgacgaatgctttcgcaatatggctcaacggttgtttggcgttgctggacggaggtgttcgactgtct

SEQ ID NO: 92330 - DNA, 628 bp, Heterodera glycines
  SCN-specific regions: Sequence locations=1-628
gttggccttctcatgccattccgaagcgtttttggtccattctttgggttgactgtcgcgttcgttacgccgttctgacctttctttttcccaattgctccatccctctggtcgagccccacctgcacagtcttctgctcacattgcttcaccatgttttgcttgtgttcatttgccttttcttcgtaccaatgagtcggaatcgttggaaatttaacttccaatcgtttctgctcggcgtggtcatcggatggtccatcgccttcgctttggtccattcttctcgactacacacactctgacaaatgttgagtcccttcggccggattctttccttctcaaccattcgtctgcttattggacagctgccatttgttcgtggattgaattttggacgcgggcgtgggcttttccaacgttttgttcattgtatatttcgtcaatcggtgtttgttgctgtatttttggcgaattttttcgcaaattggcaatgtgtcatgcctcagttgggttcacgcaccaaatagcggttcgcaggaacaaggaccaccagttgtgtacacaaggcgtttatgcatttgtaagacacccaggttacctcggttggatggtttggtctgtcggcacc

SEQ ID NO: 92331 - DNA, 653 bp, Heterodera glycines
  SCN-specific regions: Sequence locations=1-52,74-171,213-347,408-653
cccgaacgttcgtcgacaccccaagagcattcttctcttctttccatcaccccacacccaccacccgaaaaccttccaccatgggcaaggacgccaagaagcaaatgtccaccgaggaccaaatcaagtcgttcatgctcgaccttgttgccggcggtgtctctggcggtatctccaagaccgtggtcgcccccattgagcgtgtcaagctcattctccagacccaggactccaacacccagctcgcccccgagaagcgctacaagggtatcatggatgtgttccgccgtatccccgccgagcagggcatcgcgtccttctggagggggaaccttgccaacattgtgaggtacttccccacccaggccctcaactttgccttcaaggacaagtacaagcagattttcgtgcgccacaaccccaagaccgatttctggaagttctttgccggtaacctcgcctcgggcggtgccgctggtgccacttcgctcttgttcgtctacccgctcgacttcgctcgtacccgtctcggtgccgatgtcggcaagggctctgctcgccagtacaccggtatggttgactgcatctccaagacctacaagcagaacggtctcaagggtgtgtacggtgggttcggtgtgtcggtcgttggt

SEQ ID NO: 92332 - DNA, 277 bp, Heterodera glycines
  SCN-specific regions: Sequence locations=1-110,132-277
cgattcttctaaagtccctggagggggcaaaaccaccccacgctctgctgctggcggtggcttaagacaaccgcaagctggtggggcggcaaacactggtcgtactcgaactgctggcggaggaggaggcggatgaatgaacagcggcggactgtggcgcttttatactgaggactccaacggcttgaaaaaagaacctgttcccgcgatggacatgtcgcagctgatcatcgcttctgtgaccgtcctccgcatttgggaaaaatacagccagact

SEQ ID NO: 92333 - DNA, 408 bp, Heterodera glycines
  misc_feature (386)..(387): n is a, c, g, or t
  SCN-specific regions: Sequence locations=1-289,312-312,334-352,374-387
ctcgttttcgcggcgctcatcagcacgtcgagtgagaagagaaaggagcttcagggcaagatcaatacggtggattactgttcggtgagttggcaccctctgtcggcatgttctgcaaagtgtaaaggagtcggcgatcgggtggaagactatcctacgcgctcttcttacatcgaccatgtgactggccaatgtcctgaatatttcaacaaagcgcctgaagaccttgagcagattaagtacagtgttccgtgcaatgtttgggcgtgtgaatgaacgacgaatgcttatattatacaatatttatcttaatgtttgtgttttctgtgttgctgtctaaatatctgtgttcgatatttacattgatagtaaatgttctgttgttnnaaaaaaaaaaaaaaaaaaaaa

SEQ ID NO: 92334 - DNA, 370 bp, Heterodera glycines
  SCN-specific regions: Sequence locations=1-165,187-370
cacgcagcccgccagcggaatctcccagctgtcctatcatatagcatgcgtgtacagtgggatgggtccggaagctcgactactcgcgagaaaagggcggaacattgctatggattaccgagcgctgtacggatagggacttcccgtgcctctactcgcttgccgggtggttgctgccctgcgggaatacacgcggcccggaggagatcataccgttggagttgcattgctcattggaggacgcgactctgataatggagcgcttgtttttcgagtccatctcgcgggtgcctatcatgggaggggaataacggccatcagaaacaaccaccaattgtgcaagatagtgtaggagaatcggtacaatgaa

SEQ ID NO: 92335 - DNA, 635 bp, Heterodera glycines
  SCN-specific regions: Sequence locations=1-143,165-545,567-635
cgatggcattggcattggtggcggggcggaagacggacagcagcagacgcaacagtccacggcagaaagaattttgctgccgccgctggcgccgcccccactggcggatttcaatctgttccaaatcccaacgcaaccacaactgctccaacaacagcaccaggagcggtccgccgccgtggtaatgccaccgcaccaccagcacatccatcaccatgtgccggccacgcaactgcagcaacagccggtgcaaccctatctcgtccatcaccttccccaattgcaacatcatcagcaacagcatcaccactccgtcgttgtaccaacacatgctcaacacgtacagccacaccatccgacgccgttggccgtgccccaaccgatgcgtccgtcgccgccgcccctttcaatgcccggcactggcgccgcaaagcaccactaccagtgcaccaaagtgcgggcacacaacacatttggactcaaatgccgtttccgacccgacggactcgcggtggccaccacatcagctgaccaaaccgccaaactgtggagttgcagcagcaacacgcacaagctgttgaacacttactcagtgccgggcaacaaatgggtttgggactgcgcattcaccaacg

SEQ ID NO: 92336 - DNA, 633 bp, Heterodera glycines
  SCN-specific regions: Sequence locations=1-633
aaattcactaccgagatggagtgcaaaaggccatttttgacgagacaccgcgacgcgtgccggcggactttgaggacacaaacagtgttgggggagccgccggagaattggacacgtacgatgacgtccgattggtggagccgcaacttgagcagccactgttcatccccgagatttatcgcaatgatacgcgggaaggcaccacaaaagcgccaaagggtgcgaaaggcggcgccgcggcaacaaacgcaaatcgcccattggtatcgccggaagttcagtcccgaccaccgatcactgtccgtacgaccacccctcgcccgagttccgccactgtccgtccgccccatcccttcgggcggccgcctcctccgctcgttttaccgcaacagccacgacttccccctcagcatcctcaaccgccccggccttttcccccgcctaatgcgccccttccgcagcccttccggcaaaattcgcagccgtcacctttgccccattcgccaaacgctgtgccgcgaccaatgccaaatcagcaacagcagcggccgctaaccccaaacattggaatgggtcaaatccggacgggagtgtgccatcaggccattttctatacgccgcagtcagtcagcg

SEQ ID NO: 92337 - DNA, 657 bp, Heterodera glycines
  SCN-specific regions: Sequence locations=1-163,185-484,517-608,639-657
aggaattaagtaatttgccattggtaattgataatcatgaaaatgagcaacaacaacgacatgagtggttacgaaaaattggggaaaattggtgaaggcacatatggaacgttcaaggcaagaaacaaggacaccgagcaaattgttgctcttaagatagtacgactggatgatgaagatgaaggagttccgtcttcggcactgcgcgaaatttgtttgttgcgcgaactacgacatgcaaatgttgtgcgattgcagaatgttgtgcatacaaacaagacgctgaacttagtctttgaattttgtgaccttgatttacgaaaatttttcgacactttggatgggcaaatcgaccaaaaagttgttcgttcactgatgcatcagttactgtccggtttatgctattgtcatgcgcacaatgtgcttcatcgtgatttgaagccccagaatttgttgatcaataatacagtgaaaactgcgccacaattaaaattggctgattttggccttgctagaccgttcggaatcccggtccgctgttatagtgcagaagttgtcacattgtggtatcgacctccagatgttttgttgggtgccaagctatacagcacgtccatcgacatgtggtctgcaggctgcatttttgctgaaatttct

SEQ ID NO: 92338 - DNA, 650 bp, Heterodera glycines
  SCN-specific regions: Sequence locations=1-650
gtccaattaagcaattctcaattttgtattcccacttgtccttgttacatagcaatgagcaatcgccgtggcaatgattcaataaacttcgacgaacttcactctctcaaggtggataatcttccgtatgacgcgagtgtgcatgaattacgtcgaatgtttgaccgatatggagacataggcgatgtttacataccgcgagatcgctacaacaaccacaaccgtggattcggcttcgttcgtttttattcgaaaagggatgcagattacgccgtgtcccgcgtagatggcagaatgctcagtggtagggagctacgagtttcaattgcaaagtatggccgtccaattgatgaggaacgcgaccgtggaaggttcttatttgccattttctcaatccaaatactaattcattacctgttttataattttgttttgagcacaaaacctgaaagaagggtttgccttgggctgtttcccagaggctgttttctggctgccgcttgagatggcggtgatcgcctcatccgagatcgatttataagattgcagggcattgggcggtcatttcggttaaaaaaagaatgccgtgtcaatgagggtcaaaattacattcttcccgcttgcattgggctctgttttgtcaatttttc

SEQ ID NO: 92339 - DNA, 615 bp, Heterodera glycines
  SCN-specific regions: Sequence locations=1-304,326-615
agaattagtgccattctttttattcggaatgacctctctttcttaattgcttttcataatgaccaatgtgttgtcgcggcttgccgccaacacttttgggctgcgaattctgacggccgaatgccacgagttcagccacacatggcacccccactgtttctggtctctccgcgaccctttccttcccgcgtggttgttctgtctgaggacttatggcacattgtacgcgctcaaagcgttggtggaccggcggggccgagtccatcgcgtcaattggctccgcgttctgttcaacactctccgctcctccttctttttgactaccaccgagattctgttcttggtttggctgtgcatttttcgacgtttgctcggcttcgccacttggcccaccgtttccgtgctcaatgctttcgccgcctgttcaatgtccgtttggattgaaagcaaagcgcgccgtggcattttggtgccgtatctgctcaatttggcctccgaagcactttttcgccaggcccaaaatcgccgatggatttgccgttctccgccaccttttccccattttcaatcgttgcttttcggcatttccgtcgcttctgccgttgctcttttgtc

SEQ ID NO: 92340 - DNA, 499 bp, Heterodera glycines
  SCN-specific regions: Sequence locations=1-65,87-478
cttaacgaaacacctcaacaacttttggaaaccaaacattcgttcattcattcatcgttcataatggccagacccaggggcagtggaagagacccattcaaagcacgcagtgccagggcaagacgtcgcgcgggcaacaaaagaaaggcggccgcagggactgctgcaaacgtgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacaacgatggacacgttgtgctcatacctgatggtgaacaaagcaacagtggataagtgatcggcactcatctccaattgtgatcggacaaaagcgatatctaattttgtattgtacataaat

SEQ ID NO: 92341 - DNA, 549 bp, Heterodera glycines
  SCN-specific regions: Sequence locations=1-25,47-68,145-146,205 -483,505-549
caagtttgagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccgctcctcctggcgcgcccggtcagcccggccagcctggaaactctggccagcctggacagcccggagcaccgggacagcccggcaaggacagcggctactgtccgtgcccgccccgctcttccgtgttggcagtca

SEQ ID NO: 92342 - DNA, 427 bp, Heterodera glycines
  SCN-specific regions: Sequence locations=1-6,28-66,126-128,159 -159,186-427
gcaagagactcacattgttctcgggattgcctcggtgtgctctctgttggctatcatcgccacaggcgtcactctgccatctctgtactcggagatgagccaaatgaacagcaaagtgcgcgacggaattgaggccttccgcgtcaacaccgactcggactggactgacttgatggacgtgcaagtggtcgtgacgccgccggcgaagccccgtgataaccccttcaactccatcttccttgccaaacgtcgactgcccggacactgccagagcgctggactccaacaaacaaggtggccccctggtccgaccaggccgcgcggaccgactggacagcccggacagactggaagcgcaggacagcacccatattgaggacattgtggacaacgcgatcaaccttgtgagagaaataacatacaatgc

SEQ ID NO: 92343 - DNA, 475 bp, Heterodera glycines
  misc_feature (459)..(462): n is a, c, g, or t
  SCN-specific regions: Sequence locations=1-149,171-303,335-475
ccataaaatgcacggggcaatccgactcaatgagcttattttggaacactcgcgctgcagtcaattggtgcttttttctcttccgaagccgcctttctttgaggacgaagtggacgactacattcagtatttggaggtgatttcggacaatttgcaaaaagtgctttttgtccgggggacgggcgcagaagtaatcacaaccagctcctgataaggggtctctgtgataattgttttagtttttgatttctcaaagtccgttcgttcctttcgcacttttccattttcaatttaattgactctcattttcctctttcctttccttttattttatacggatatttcgagttctgttattcttgacagttttctatgtgtatttctgtgatggaaagttttattctgtttgtcttttttacttctaactaaacaaataagtaaaatgcgatctgtcaaaannnnaaaaaaaaaaaaa

SEQ ID NO: 92344 - DNA, 463 bp, Heterodera glycines
  SCN-specific regions: Sequence locations=1-296,319-463
gttttcttaaaatattttgagtgattgtttgctgtcgcttatgctttttgtaagaaaaattaggggattaaaaatattttttggttttaatttttggccttttcctttttaggctgagactcgcgcggaattcgctgaacgttcggtacaaaagctgcagaaggaagtggacagactggaggatgaattgctcgtggagaaggaacgcgtgcgcaatttgacagcagaaattgaacagactgtgcaggagattcagggctcttgaactgttttggcttcttcagaatttgtgacgatgtcaaagtgtggccatttgtcattttcgtccgttctctttttggcattttgtccgttttttggccgactgtcctatgtccaaattttcgttaagactttcattgtccatcattcgttatgagcttatctagctttttgctttcttttgcgtaaaatttacactatc

SEQ ID NO: 92345 - DNA, 91 bp, Heterodera glycines
  SCN-specific regions: Sequence locations=1-91
gacgacaggaacttcatcgtttggcaagccccacaacaaaacccacacgctgtgcccccgttgtggtcgaacctcataccacattcaaaag

SEQ ID NO: 92346 - DNA, 565 bp, Heterodera glycines
  SCN-specific regions: Sequence locations=1-67,89-136,168-401,424-565
atgggaaaaattgaaatttgtttttgttttgccgtctttgatgtttctttctgttatttataaaaattacagtttttcatatgacaattcgacgttattcagctttgcctatttgcaaaacaatagcggtgaattatcatcagaagaatgctttggagaaaagatggtttacactttgaaaatgaacgactcgcgaataattcgtggcaaaaagtttaattgctcattaacatggcttttggagcgctacaaactttcagacaaatacgcaattaaagagaaaattgaagtcaaataccctggccatcccaaatttgtgttcgtgacagccgcaaataataattatttcccttatcttcggacgttcattgcaaatattaaagaaatatttggatgccaacagaaaatcattgcttatgatttggaaacggtgacaaaaaacaaagaatggatgaatgaattggattcggtgtgcaatttcgaatggcgaattttcgatttcggtcaaatggtggaaggacgggttcgccaccccaaatgacactgtcggttggattgacacttc

SEQ ID NO: 92347 - DNA, 553 bp, Heterodera glycines
  SCN-specific regions: Sequence locations=1-21,53-553
tttcgttatggtgcgtcccatttccttctcctcctttcccccctttcttcttttgctttttgtcgctgtctttccgcttttgctgggcgctatgaccactgattaccatggctttttcggcactcgcaatgcgccgcttcgccacgaacggcgccattttctgccctcggcattcgtttcttcggccgatgaaatgtcgtcgtccaattctcggcaccgttacacgggccgcgttttcattgcgcgcgacgaattgcgcgccgcgcgtccgtcgccgcaggcggaacagatcagcggacaatcgctggtcgattatgtgaatcgtcggcagagattgtggagggccgagctcagcccaaagttccaatcgtacgacgaagccatcaaatggcgaatgatgggcgtaaaccacgtccgccattcgaccaaagccaaaaaagtgttggggaagacgcgctttttggacttggatttgcccgaatctttcgacgcccgccagcgatggaatttctgtccgtccatttccctcatccgcgaccagtccagctgcggc

SEQ ID NO: 92348 - DNA, 325 bp, Heterodera glycines
  SCN-specific regions: Sequence locations=1-33,55-69,91-325
aacgatcgccacaaaaagtgaccacaactaatggaacaacaacaaaagcagccaaaggaaatgccaagtcccagcggtgcctccgccgccgcccctccgttgcccaaactttcggttcattccggcaatggcaaattgcgtggcggtggagttcgcgcagtgcgcgaacagtcggcgctgcagcgactattctcgcggttggagcgtcgcttgggcctggcgatggccctttgcatggccaccattttgtgcgcgttggccatcaacggactgttccacgacaagtccgcgccacaatggtgcaactcatcggcacaattgagca

SEQ ID NO: 92349 - DNA, 75 bp, Heterodera glycines
  SCN-specific regions: Sequence locations=1-75
agataatggcaatggacgctgtgtatcagccggcaaagtttgcctaatgtcgacgactttcactgattgactaca

SEQ ID NO: 92350 - DNA, 540 bp, Heterodera glycines
  misc_feature (402)..(402): n is a, c, g, or t
  SCN-specific regions: Sequence locations=1-106,128-540
tcgttcggcgaattaatggcgaaaatgcggcggaagggcaacgcctcccattgtcaacagaagcaacggagtgtttgttctgcgcttttccatgattattctctcatctttgccttcattctcttcttcattccctccattggttcgatttcaattgacaaaatcgaaaatgccaacggaaaatgacggtacaaagtataccaaatcataccaaattcggaagcacaattgatcgagctgaaccgaatggagcagcaagggacgattgatttttggcgtccgccgcccttcgtcaattcctctggcgatgttatggtcgatgttttgcgcaacggaagacattttttggactttttacgcaaattccaagtcgaattcaaagtgttggtagaagatttatcnaaacttattgaagaaaaggaaattgggccttctccgtacgccaaattgtccaaagatgggccaattctccgcgacactttcgatcgttttgagggggtcggccctcccatgggcgactatcacagcttcccccaattg

SEQ ID NO: 92351 - DNA, 259 bp, Heterodera glycines
  misc_feature (254)..(254): n is a, c, g, or t
  SCN-specific regions: Sequence locations=1-259
agagctctgcaatgggttaataaagactaaaccggttgtgatcttctcgaaggagcattgtcctttttgggtaaaggcgaatgatgccattaattcgttcaaactgagatggggcggacttgaaattggcgagctaaaccaccgcaatgactgtgaccaaatccaagactttcttaaggaactcaccgggacccgatcggttcctcgcgagttcatcagtggaactttcgtgtggggcggaaataaacagtcgnagggc

SEQ ID NO: 92352 - DNA, 268 bp, Heterodera glycines
  SCN-specific regions: Sequence locations=1-268
acaggacagattgcttccaattgcaaatatttcacgcataatgagaagagatttgccaacggaaagaaaactttcaaaacacaacacaaaatgcgttcaagaatgtattactgaattcgttttgcttattacatcccaggttagcgaaagatgctcattgcaaaaaccaaaaaaaattatggatgaacacttgctgctggcatttcgaactctgtggtatgacaaagattagcaaccattgaaatagatcctgagactgtatagagag

SEQ ID NO: 92353 - DNA, 612 bp, Heterodera glycines
  SCN-specific regions: Sequence locations=1-22,56-612
tcctcctcctccctcatggacatccctccgtttatttttcttctctttctcgtcccaacactttctgtccaattgaccattgacgatgaagagttcggactgaatttgcaactgatcaagcatcagccatgtccgttcaaaagcgacaaaagcaaatgggaccgaaagttggaatttgaagcaggcaacgaacaagaagggcccaagttggtgcaacggccgaacgagccaaattgctacagtatcggagggaaggttacggtgttctccgaattcaagggcgagttcagcatttacttggaactgcgcagctcggccaacaaaaagcaggtgccagaaccgtgccacaatcgcaaagacgacggatgcggcggcttcggctcgtgtttgtattgcgacgcatgccaaacattggaagagaacagaggactgaaggcacaactgctggtggacggaaagtcgatcagttgcgggcaggaactgagcccagggacatacgaaaacatggaattggtcttttgcctgccgaacgcggaggaaatgctcaagagccaaaggctgaccaaagaaacgttccaaagcctaattcagacagaagacggcacaaatctc

SEQ ID NO: 92354 - DNA, 629 bp, Heterodera glycines
  SCN-specific regions: Sequence locations=1-515,538-629
aaaaaactatcggtgattggctcgggtttgatgggcgcgggcattgcccaagtcagtgcccaggcaaacgtaaaaggtgcgctggtcgacctgattcagtcaatcgttgagaagggcaaaagaggaattgaaaaaaccatctaacgggtggcgaagaaacaattcgaacacccggggaaacacaatgaactcgtcacccaatgtctttccaatatttccctggagacggatatttcgcaggtcgtgtcgtgcgccgatttggtcattgaggcaatttctgataatttggacgtaaaacggaaactgttcgcacaagtggagtcggctttgccacaaaatgggaaaatggccacaaacacttcttctctgacattggccgacattgcggtcaatttgaagcgcaaagattcctttggggggctgcactttttcaaccccgtcccaattatgaaacttctcgaggttgtccgctttgatggcaccagcgaagagacattcaacgttctgatggactttggcaaaaccattggcaaaacgaccgtcgtttgcaaggacaccccggggttcatagttaaccgtttgctggttccttttatgctggaagcaatgcgaatgttcgaccgcggcga

SEQ ID NO: 92355 - DNA, 309 bp, Heterodera glycines
  SCN-specific regions: Sequence locations=1-231,268-309
aactgcctgatgtgtgttattcttggtgggtgcttgcatcattggccatcataaaacgattacattggattgatggcgaatctctcacccacttcataatcgccagtcaagatgatgaaaagggagggatcgccgatcggcctggagatgaatctgaccctttccatactgtttttggcctttacggccttagtcttttgggacataaagggttggaggctgttgatcctgtattttgtatgacaaagaaatctctggtgaattttgcttttgcgtgatgatatgccagctaaataaaaatattttttc

SEQ ID NO: 92356 - DNA, 292 bp, Heterodera glycines
  SCN-specific regions: Sequence locations=1-49,120-133,157-292
gcgagagactcacattgttctcagtattgcctcggggtgctctctgttggctatcatcgccacagtcgtcactctgccatctctgtactcggagatgagccaaatgaacagcaaagtgcacgacggagttgacgccttccgcgtcaacaccgactcaggctgtactgacttgaaggaccagcaagtggtcgtgacgccgccgtagaactcccgtgataaccccttcaactccatcttccgtgcccaacgtcaactgcccggatactgccggtgcgatgggctccaacaatca

SEQ ID NO: 92357 - DNA, 265 bp, Heterodera glycines
  SCN-specific regions: Sequence locations=1-265
cagcaaaccattgcgaaagactccaaccaccaacgacaactcaaagttgctctactgcatagactgcaacattatattcagcagttcttcttcgaatgacgcgacgaccaagaaattcaacattttgaataacgggcccatccaatcgccgacgaatccgaccgaaatttcagcatatgtggacaaatatgtggttggacaacaacaagcaaaataggcgctgcctgtcggcattgaccagcattatcaacgcttggaaaacaat

SEQ ID NO: 92358 - DNA, 568 bp, Heterodera glycines
  SCN-specific regions: Sequence locations=1-124,146-215,238-338,360-568
gagggaaagggcgacgcagacgcactcggaacacagcaggacgacggcatttgaggaatctctctaaacattttgctctttctctgcttccgcccttctgagaagtgcctcaaactcctgctcccagccgagcattttgaaaatgttggcatttctctccggtgttatgctgatcaaaacccgaccgaatgttgtcgggttcagtataacgtaacaaatcggtgcccgcgggttggagattgatcagcagccggggagtgtcggagggcacttggtcgaccagcgaagcgaacggatggacgaccaacgaagtgcccattacgatgaggagaccgcacttggggaaatcctgaacagacggaggtggaaaaagtttaaaaatggacacaggggaaaaacaacagacgcacgcaccaccaaagaggaactgaagaaacgggagggcaaactctcgccgaagaaaacgatgtccggctttaccacgccctttttgcagccgacgcaacgcggcactttgacggcattcatttgcgctaaataagcggcgaaagggaaaggcacgtgctgg

SEQ ID NO: 92359 - DNA, 634 bp, Heterodera glycines
  SCN-specific regions: Sequence locations=40-40,101-208,241-258,353 -375,407-507,529-634
cgtgcttttggtgctgaaatatgtcacagctaaagatgtgttcatgcgttatcataagacgcacttgagccgaagactgattctcgagttggtggccgaccaagaaaaggaggaaatgctcgtgggcaaatttagagaggcggggatgccagtcgacttcgtcaacaaactcttcagaatgttgcaggacatcgaagtgaacaaagacctcaacttggccctaaggaaatcgctggaaaagggcaactgcagccaaatgattgtgtaagcgtcaaaattctgaatgccggagcatggtcgaggagtcgagaccgttcgcacctgactttgccacgggaattggaggatttgatcccggaagttgaggacttctacaaaaagcagcactgcggacgaaagctgaattgggcccaccattggtccacggggacggtttcgttcaccagcaaagcgggaaggttcgacttggaagtgaccactcatcagatggccattttgttctgttggaacgacagacccaacgacaaactttcctttgcgacgattcgtctcgcgactgaattgtccgagggcgaattggcgagaagtcttttgactttggtgaatttccccaaagtccgaatgcgactgatcc

SEQ ID NO: 92360 - DNA, 505 bp, Heterodera glycines
  SCN-specific regions: Sequence locations=1-70,92-505
tacgacctctgatgacacggattcgcggggaagctgttcgtcacttttgatctgcttttcctattgttcttcaatcatatgtttcccttgcgccatttgactttccatccgggtcattcatcagtatgagcgcgctgtgattttccgtcttgggaaagtgatgcgcgaggtggcagggcccggcctgatcttcattttgccatgcattgatgatttccgttgcattgatatgcgcactacttccttcgacgttccgccgcaagaatttctgtccaaagactccgtctccgtcactgtggacgaactgatttatttccgcgtggacgatgccaacaaagctgtcttcaatgttgagaatgcaacaatggcaacacagcttttgagacacacaatctttcccaacatattggcgaccaaaactttgtccaaattgcttaacaacaggaaccagaatcatttcgaaatgcagccagtgttggaaagactaaccgacgtttggggagta

SEQ ID NO: 92361 - DNA, 474 bp, Heterodera glycines
  SCN-specific regions: Sequence locations=1-325,350-474
caacaaaattaggcttcttcaccgagacaaactgaagccatgcatgtggctcaacaaacacattcagtcgcactatcgtccgcttgaattgccctggacactttgcatcgttcaattttccaatggaacaatgaaacagtgaatgtttggagccacctgctcggcttcgtctggttcgtctacctccaatggtgggccctcaatgaatcgcttccgtcggtgaacgcgccgattgcggactattgggtgatgggcacggcaatgctgtgcagtcagctctgtatgcttctctcctctgcttaccatattttcgggtgccattcgcctcagcgccgcaaacaatggcttcgggccgaccttttcggcgtgtcggctggactcagtggactgtacatgaccggactgtacacttcattttaccattttcccgagcttcaaaaattttacggcactctgatcggtgccatggtggtt

SEQ ID NO: 92362 - DNA, 209 bp, Heterodera glycines
  SCN-specific regions: Sequence locations=1-118,142-209
gataaaagccgaagtgtcgctctgttatttgtcctcatcgacaaatgccgccgacttcttggccaaatgcctttgtaagcaccgcaaacgaaagaaatgaacggcggattgcgccaacccaaagcagcagcaccagcagcattattttaggcaggcacagaagggttgcatcgtcaccagcagtatcgatcatttcggccggggcttct

SEQ ID NO: 92363 - DNA, 354 bp, Heterodera glycines
  misc_feature (325)..(325): n is a, c, g, or t
  misc_feature (327)..(327): n is a, c, g, or t
  SCN-specific regions: Sequence locations=1-245,267-328
gaactagttccagctgtatttggagcggaagaagcagctgaagcacgaacggaaacaggaagaggcgaagcgacggaaacggcggagaggggacgagcaccatcgcccgacgccgcccaagtgcaaagcgatgagcgattttctgcctttttcgtggacagtgcttttgccattgatcggacttcttcgcattacaaaggcggaaatttggcggacagacaagcgaaagaaaggcaaaagcgacgtcttcttaaaaacaatacagacgcagattagactctgttaacagatttgtcatcaattttcactgatttaaataaatacncngaaaaaaaaaaaaaaaaaaaaaaaaaa

SEQ ID NO: 92364 - DNA, 557 bp, Heterodera glycines
  SCN-specific regions: Sequence locations=1-53,89-557
ccctatgatcgctgcggcgaagcaaccttgctggacaaggcgtccgcatcgctacagaagggcagagggagaagaaggaggaagagagggacgaaagccgagatcattttaaaacccacagacattgttggacaaactgttccccagagagctctgttgaaaaagaaaagatttgatttccttggttattattaatcggcatgttgtataaaaaagttgatgctgcgagtgcagaggtggtcaatagcggattggacttcttcagtacaccgccaacaaactgtgcggtgtccaactccagctatcgggagtacttgacgctgaacccgatcagctcaaggcctttccattttaaggcaattgtttggcaatgtgtaactcttatcagtgtttgttcagattcatccgatcaccagctacatagacctcagcaaagtgtttgtgtgcacggaattcaagctcaagaaaatcgcagaagacggagtgtagttgacgtaccagccaacgcggctgttggccttatacaaatgcccggtgcaactttcatccgcaatctg

SEQ ID NO: 92365 - DNA, 229 bp, Heterodera glycines
  SCN-specific regions: Sequence locations=1-16,64-229
cgattgatgacaaatcttaataaaaaaattttacaatttaagtttaaaataattgtataaaaaccgtttttcctttctgtttctccgcttcctttgtctccaaattcgaataatttgatattataaatttgaaagaataaaaataaatgcttacaagggaacattccgagctgtgagtgggaaaatgcatataagctatataccattggatagagcggggtcgacttgt

SEQ ID NO: 92366 - DNA, 511 bp, Heterodera glycines
  SCN-specific regions: Sequence locations=1-93,119-164,192-511
caagtttgagtaattaattaatttacctacaaatgtcgccaattctttgtcagcaatttatccgaaacaaagacactgattgaattcgttcataccttttccttttttaaaaaatggaggagggcggattaccgcccgagaccgcccccggctcagccaccgccgaacaacagcagcaacaacaacaggcaactcaaccgagtggaaacgaagcaccgcttgacgatgggttggccatgttgcatgagctttaccaacgacgtcatgctgaactgctcgcgcagttccagcagtctcagagcattgcccagcaggactacctgctcaacctgcagttgctccagtccgcactgcctgccgctgctgcgatggttgtgttgcagcagcaacaaattgccgtgatgccttccgccgcttcgcagcaccgtccgctgctcggttcgttggcgcacacgagcagtgagcagtccaccgaagagtttgatgtctcggcacagcaaaccgcgcagca

SEQ ID NO: 92367 - DNA, 633 bp, Heterodera glycines
  SCN-specific regions: Sequence locations=1-8,35-70,144-239,340 -437,469-633
tgaccatttcattagaaagaaaacaaaaaataaatttttttagctattttaaataaaagattttactattaaaatagaaagacagtgaaaaggaaaaaaaggttagaaaatgaaaaaaggaaagatgaaaaaaatggcagaaaatacttctgctttcataaagaaaataatgcaaaatggtacataataatttctttaatacataactgaaattaaaattaggcagtatttactatttgtatttataattattatcttatttaaattaataacttgtaaaaaaattgaattaatttaaaaaaatcattcaaaaaaaaataataaaataatgaataaaaacagctagaattggtgggacccgaaccctcgaccaccaccaccaaaggcaagcacactaaacactccaccactgggtcgcttgactcaagcccatttaattcccttttccctttccttcttttttggaagaaatcccgaccaaaagtgcttgtcctccctttttagagcacttcccggacccggtccaaaacaaccctggtatcattcgaaagccaagagtttgttgatgtgcacaaacatattaaagttttgatttgacccatttaaggtatgcaaaaagcattcaaaaatgag

SEQ ID NO: 92368 - DNA, 479 bp, Heterodera glycines
  SCN-specific regions: Sequence locations=1-208,252-479
ctatttttgcctttcgccgcctcttttgtcatcattttgctttgggcctttaactcctccagtgtttattgttttttccaattcaaaatgcctgtgggtggcaaaatgcgcgaagtgatttcgctgcacatgggccaagcgggggttcaaattggcaatgtgagtgacttttgatgggtggccaattgagcagcggtcgtcggttaaggcgtgctgggagttgtattgccttgagcatggcattcttgtgaaagggaagtgccgcgggttaattaggctaattaattagccatccgtcgattgaattgcgtttagcccgacgggcgaatgccgaccgacgaaaggtgaaaaggaaatgggggccgattgcttttgattcaaaaaaacgaatgtttggcgtagtgttggcgtcgaggaccattcgtacaacactttcttctccgagacgccctcaggaaagcacgtgccacggtcgattt

SEQ ID NO: 92369 - DNA, 617 bp, Heterodera glycines
  SCN-specific regions: Sequence locations=1-342,364-526,548-617
aaaaggttaaaaaaccgtcgttggtctccgcccccgcggggacattctctgctgcggacaatcactgctcatccgacgagggagcgcccaaagcgaaaagtggccgttcctgctcctcctccaccacttcgtccgcctccgtcccatgctttccgaaactggatgctcagcggtcggacaaaaaggtgaacagttgcagtaaaaacatcggcggagacgagaaaatgttaatgggccaacaacatttgttcgccggagggcattcgataaaagttgatcaggacggagtgttctttgtggggatgacagccgctgaatcgggcggatcactggccaatacggaacagcaacaacagcagaatgtttgcgattttgcaccctccggcgtcgtcggcgactgtgccgtgccttccttctccgccgccgtctacgcgccgatgataagtgccatcagtgacatttaccagcagacaatggagcggggcgaagcggcgcacaacaacggcattggcacggcgacaaggacgcgtgacgatgagcaggaacattcgcccgagtcgggcttctccgacgagtcgtcctcgctgatgatgatgcaaggattgttgacgacggtc

SEQ ID NO: 92370 - DNA, 325 bp, Heterodera glycines
  SCN-specific regions: Sequence locations=1-325
tatccatgtgctgaggaccagttgcaaccaacagcggaaggaattggcgcgcgaattcaaacaattgttcggcgaggatttgtccgccaaactgaagaaggcactctctggcgactttgaggaactgattttggctttgatggaaccgccagctgatgacgatgcgcagcaaatgcaccgcgcgatgcccggcctcggaactcacgaatcagctctgattgagattgtggtcacgcatagcagccgacaaattgatgagatgaaccgcgtgtacgagcagctgtacggacatccgctggagaacgacatcgtcggggacaccagc

SEQ ID NO: 92371 - DNA, 578 bp, Heterodera glycines
  SCN-specific regions: Sequence locations=1-578
gaaaaatgtaatgattaacaatgtttgactatgatcgacatttgaaccttgcccaccaggtggctggaaatgttgacgcttcaaatggccagaaaaaggcaatcactcggactctgactgatgatgacgacactttgccctttatgggcccgttggacagctcgccatccgaagacgatgggaaaaaaactgatgacaatgccatcgttcatggccttgaaggcttgctcagacgctgttcgtctcctaacaacggtttccatattggccaatttcgtcaaaaatctgcaagtgtcggctctgaccatttgtactccatgcaatttctgtcgaagcgtccgccattccatctgctcgacacacagcggcataagttcgccagcaatggcacttccttggacatgcaacacacgtttcgtcgtctgagcggtggatcgtcgggagcattggcggacggttatgaatgcgacaccagttcgggatacggaagtcctggtgcgctcggcacgccgttggcgagtccggcgatgggttcggcccaattccatgccgcccaattgcacaaactgttcatggac

SEQ ID NO: 92372 - DNA, 566 bp, Heterodera glycines
  SCN-specific regions: Sequence locations=1-295,317-566
accaatcaatcctttttggattttgcccattgtttcgtccccccttagaattgtaccaccccggcttggtgctgtttgttatcgctttgccatgccatctctttcttgccatgatccccgtctcggtgttctttctcactttcgaccgtatctgcatcatttactatggccctgggtacagtgaccgattgcgcaagttcatactgtacgcgtatcagctgctcctgttggtgtgtgttgtgtacaatctgctcggattccatgcggcattgccaatgcctgaaaaaacatgtaaaagattttcttctgcttccttttttggcatggcttttggacttatttattcccatgcgaatgaatgctttttcagtgtgcgagatcaatggctgcattttgggcgaggctgtccagtattatttggcatggcgtgccgtttgtgcccttttcaacgtgtccgtcggtgcaattttcttcataatgctttaccgctccagcaaacagcggttggcccaaacgggaactatgaacaaccattggcttaagacacatcgaaaagtgagacagaa

SEQ ID NO: 92373 - DNA, 595 bp, Heterodera glycines
  SCN-specific regions: Sequence locations=1-135,157-212,251-405,429-561
ataaaagtcaacgtagaagcctcaaaccaagtggaaaatgcgttttttatgcttaatatatcgaaactagtgcgcagaaaaaaaggcatatgcctcaaaattcggtctctagctctgacgttactcaaaaaaccatcaaaataaaatatttttgatataaatttgctcaaaagcaatcaaatttttaattcttgatagaattcgatagcaataagtgttttctattagcatataaaatttcaaaaagtttcgttaagtttctagaaagttatgaccaaaaatgttcaaaaaaaaaattgtgtttttgagtttctcgggtcataacttttttggaacttaacgaatttttttgaaattttgagatgataatagaaaacaattagggctatcgaaagttattaagattataaaatttgattcattttgggcgaagttataaatgattttctgtcaacattttttattctgatgagtgtggaaccaatgattaataggttcctaattttattaattctctaagcaaagctaatgataattaaatgtttaaaaccaatattgtttacgaaaacaaattttaaaaaatttcactgatctt

SEQ ID NO: 92374 - DNA, 494 bp, Heterodera glycines
  SCN-specific regions: Sequence locations=1-202,225-257,279-379,408 -416,438-494
ccgaatgaatgcatagtaaaataaatatttgtttttgagggaaataatgggaggataaagacaaatgtttgaaggcgggattaagcggatttaaggataattgatgataatgcatattttgacattttaacggttttagggattcgaaaaaattttaaattttacgaggaatttcaattagatttcacttatatgtgcccccattcttcaatataaaaataattatcattaaatgacccgtccttaaattcacttatttttaattattcttttcataaggggaaaaagatattaggaaaattaaaaatgcaaaataatttattcctttaaatttatggattttagaaaaaattttttaatcctcttcaaaatcaagtgcaaaatattaaatttcaatttttttattaggaagcaaatatttttaaatgcatatttaagggcaattgaaaatcctaaagtgtttatttgaacgttttggcgcactttacaaaaaa

SEQ ID NO: 92375 - DNA, 435 bp, Heterodera glycines
  SCN-specific regions: Sequence locations=1-435
gattggttgacccaataaatttgtcaaataccggatactttcggtagcaatgcacactgatcactctgatcgtttaccattccgaccactaatgaaggtttattaactcataatttgccaaaaaaaaaacgattactttcggtagcaaatgcacattggtgctctgatcattgatcatttaccattccgttccgatcacttccccccccccctcctcaattatgcgtcggttatccctttccattgtttgttacgcttaagaaaaggtatcattagcgcagcagttgcccaggttactttgaaaattggtgccattaaacacaatgccaatattgtattttccttcgacacgcgaaaaaaaggcacaaaaaatgggacccacgcgtttcggcgctcgcgtttcggcgctcccgtttccgcgccagctcgtttttc

SEQ ID NO: 92376 - DNA, 339 bp, Heterodera glycines
  SCN-specific regions: Sequence locations=1-246,269-339
cttgaggaagagcaccgattggtgaacactgttcgctcgttgatccgcattaagaatccgaatgatcgactttgtttggccagagctgtgttgcttggtcttcacgattggcgttcacggtcaccaggcggaggcggaccgacagcattcaaaagtttcgcaaatcgccagcacacccacgggcctgaggcacgtaacttattgagacgtgccgcaattccccgcaataaacataggtacacaattgatgacgtccaaaaaggacaagattggattgatcaacgatacgggccagtataaattcgaattgcagtttttgagaaggaacgtgtggattag

SEQ ID NO: 92377 - DNA, 262 bp, Heterodera glycines
  SCN-specific regions: Sequence locations=1-147,173-262
agtaagcactgctgatcagtgatcaccagcagggggaatttttatattttacttacatatgtaggtatttttttttattcagattgcattttaaaagagaaatcataaaattcacattttggcgttacttccaaataggccgtttgatttttcttaaaaaccaaaggggaaaccgtttggtttccaaattacctaaacttaaaaaaatcgatttgtgctcgagtttggattagggtttagaaatttgttaaaactagcgggg

SEQ ID NO: 92378 - DNA, 596 bp, Heterodera glycines
  SCN-specific regions: Sequence locations=1-596
ccgttttgcccggaaaaatgcgcattaatggggcgatttctaatacttcggctgccaattcgctgctaatcaccgatcggatggaaatgatttcgcacgacttgagcctttttctgagtcggaacggatccaccgactccgaccaaagggcaaaggccgacgacgacgaccaatcagtgctgatcgatgccgttaattcacaccttcggctggtccattccaatcacacaatggcttcattgactgccgcaaaacatttcgtagaaattctcgggggacggccattgctgcaaattttggcgggaaatggttctgaggagatcgaactggttaaagaaacgaaaacggtggccgaactgaacactgacattgtgccgaaagagctgatgaggactgaaaatgccggggactcttttggcagcggaccctttgctattcggactaatgtcacccatcccatcgtgctcaattggactcattctccgcccaatccgtcccaactcggctcttccgtttccgcttcgtccccccttccgtcgtccgttgcgcccgctttgaatttgtcttccctttcttcggcatcgacgccctcccgc

SEQ ID NO: 92379 - DNA, 347 bp, Heterodera glycines
  SCN-specific regions: Sequence locations=1-347
caaaagcaaccttcatcaaagctgcgctcaaaaaagtcgcgtcgcgcattgcggacacagctgaccaagcgcacagagacaacgcaattgttgtggtgttgttcatgtgttcgaccattctcatcttagttcaagtagaaaccaatttgtgctccaccatgtttcaaaatgtcaaaattgaagttgaagtgctgcgtcaaattgtgttcgacccaattgggcgtgtgcttgcccaaacgcagaaagttgttgacgcatacgaaggcaatttcgctgctttgcttccgctcatcaaatttcttgtccgtcatgccaatcaatttgccgctttgtcagagaatgttggc

SEQ ID NO: 92380 - DNA, 622 bp, Heterodera glycines
  SCN-specific regions: Sequence locations=1-591
caaaaacggctgaatggggtcgaatccgtcggacaatgcctccgccgcttgcactttcatttgcaacaagcggaacatcgaacggaaaggcactttgaacggaatcgacggcggtatccggcgattgatcgcgaaattcgcaaattggggcgagaatccgttgcaaaaagggtgtcgaagtggcggatggaggcggaaaatcgacggactgtgccgttgaagaagtcgagggagggagggatgccatagcgtcgtcttccgactgggattgactttggtcggtggaggaagtcggcttctgttgttcgtccgcctcaacttcgtcctccaaaatggccgatggacccggcgcaaaactgtcgttgctattcgctcggctggtggccaacaaattggaacgggcggaagcgtcgcgaggctttgcactgacagcaacgccagcagacgacgggacgacattgaaaaacctagaaattgttggtttaattcgattcccggaaagtattccgtcggtgggcagcgttaaccccgcacacttttcacccccccccactgacctggacgattgccgcgacgaggaacgcaagttgtaccaagacaactcctcctcgctctcctcctt

SEQ ID NO: 92381 - DNA, 567 bp, Heterodera glycines
  misc_feature (368)..(368): n is a, c, g, or t
  SCN-specific regions: Sequence locations=1-42,65-304,326-567
tgcctttttcttcggttctggcggtggctgttcgtgccccgtttgtcctcctccccctcctcaatccaattgcggttgttgtaacacaaatgggaatggtgccggattcagtggagggtgcggcggtggaaacggagggtgtgttttttttatcggcaaacagagcctaaaaagagaaaagggcttttggcatttacaggaaacggtggtgcgaattgcggttgcaacggatgcgccggtggaagcggaggaggtggcgggagcggagcatgccacggcccacggcgggtggctgcggatttgctgctccaagtttccgatgctgcggcggaaattgccgggggccaaactgcaccacaacaggacanaacgggacgacgagcggctcacgccactgccttggtataaagacccgactcccctgcgccagacccggctagacgcttgttctcctcccacaaatccgctccaaactttctgcgctcgctgttctgcctgagaactgcgcgcaccgcaagtatgcgaacggcgaaaccccaatactcgctggacagacaaaccgtggcc

SEQ ID NO: 92382 - DNA, 507 bp, Heterodera glycines
  misc_feature (499)..(499): n is a, c, g, or t
  SCN-specific regions: Sequence locations=1-144,166-485
ccacaatatggggtgtgagatgaacacaaacccaagaactgagctttcaattggcgttggaccagctggcggtggtgcggtgtccgcaaatattttctcaatttcccttagactagccaatttttcagaagtcgtcagttccaaattttcaaacaaattcaaaaaatcatcagaattttcgttatcctccgttctcattaattcatttccatttccggccatattttctgtttcttgcccgcaggctaaggggataggagaattgttggaattaatgcttcctgacatctaagagggagaaaaaaatgatagttaatgtgcaggatgggagacagaaaatgaaaaaggaatggttatgaggagaagaacttattgaccgattggaggaggaggcggggcaatgtacaagcgcctgctttaaactaaggggctgatgttagcataaatgagtataagggcaatgttagagaaacatgcagtgtaacaaaaaaaaaaaaanaaaaaaaa

SEQ ID NO: 92383 - DNA, 648 bp, Heterodera glycines
  SCN-specific regions: Sequence locations=1-96,118-648
atcacctgtgccaaaatgtcccgtcattagcggcagaaaatttttttcctccgatgcattcaatgttgaccgaaattgcacgcgccacggcggcgaattggtggccaatgtgctgaaggcccacgacgtgcgcgaagtgttcacattgtgcggtgggcacatttcgccaattttggtcgcctgtgaacagttgggcattaacattttcgacactcggcatgaggtgaacgcggtgtttgctgctgatgcagtttctcgccttcggcaaaacattggcgtggcggcagtcacttcggggccaggagtcaccaacacaattacggcattgaaaaatgcgcagatggccgagtcacccgtcattttgctatccggtgccgccccgactctgatgaaaggccgcggggcgctgcaggacattgaccaattgtccattgtcaaatcgatgtgcaaattcacggccaatgtgcaaaatgtcggagacatcgtcccaacacttcgcgaagcgattgccgccgcccgctcggacacgcccgggcccgccttcgtcgagttgccattggacgtgttgcaaccgtacggcaaagtgctggccgagaccaacttcgttgtgcacgcggacaccgcggaaaaaaaagcgttcaacgaccg

SEQ ID NO: 92384 - DNA, 592 bp, Heterodera glycines
  SCN-specific regions: Sequence locations=1-48,136-303,325-592
ccaccgtatgctcttccaccgtatccctcttccccatcgctgatgcgccttcttctctctctcctcctcctcttcctttccccattcatttctcttcctctcttcgtccctttttccctcgcccttccgtccccccaaaagcgttgtccctcccctctcttccgtcagtcgcgaagttcgcctccgcccaacggcacatcgcctcactattcaactccaattcacttcttcgccatcactcaggattgccaattcgttctcgctcgtcccgaccaacttggccaattgccctctctctccgtctctttgtccgtctccgattgtgcgccctcgcgaattaatttgctgtggtctttgaactcgcccgtcccctctctgctgctgctccaacaaagggcccacaaactttgccttctcccaatcgaagtgccattttcggtgatcgctcacagcacggaactgttcaggtattcgttgcgaaatgccctccgtcacttcgccctttgtcattcctccaattcgtcctcacttttgactctcaatccgaatttggcctttgctgactctctttactccgacattttatactttt

SEQ ID NO: 92385 - DNA, 613 bp, Heterodera glycines
  SCN-specific regions: Sequence locations=1-19,41-204,226-226,293 -300,323-336,424-613
ccaaatttaatatctaagcaaaataataaatttattgaaaaacaatttttcgaatttataaaccatttttaatatttatacattagagtgcctttaacgtgtaataattaaaatttggtgcgattttattaataatagaaagagttaagttcaaaattaattaattactgaaaatttttttttcaaattttcatgatttttctatgaattttcaacatttttacaattttttttgtcatttattttttgtttttctttttttatttgtcaaaactttttaatttttttctttgataaataaaaataatagttggaataatttcattttttgtcgtcttaaaatgattttatttttttattcaaatttttcaaaaaatttctaaacttttattttcatattttcaaatattttttcttatttttcttctcttccaaactgtttcttccattttcggaggctattttgatgaatttgtaatgtttttgcaatttccctttcactcattttcggattttttcttttcatttgccaataaatttttattttttccattttttctttctccgttattttactgcgaatgccaaaatgtttcttccatttcttaattac

SEQ ID NO: 92386 - DNA, 648 bp, Heterodera glycines
  SCN-specific regions: Sequence locations=1-36,58-144,210-648
ctgagattgcacattccacgcaaagcattggagcggccgttgaagaaaaagaaatcgctgaaaagtgcaggcaaaaaaacgatggcattgatgccaacggcagaaacaacgacagcgaatttgggcactccaacggaacaaaatcagccgcaggagcagcagcaaaaggcagggacagcagcggggacaacgacgacagctgcagcaactgacgctgcttctgctgcggttgtaatggaagaacagactgttcccctgaagctccgcgtcccactcactctgagcatttccatctcaaatgtcgcttccgcttcttccattggtcccctctccgccatttcgaccacttcgtccgccagcggtgtgccgccgagttcggcaggtccaaccaaacgccgtggcaccattgaggagactgactatctgatgggaccgctcaaatcggtccatcgccggagggcggacccacgcgtttcgatgggaagcgtactgatggagatactgaacgagctgaagaacatcgccggctccgaacacttcactttccctgtcaacaccaaaaaggtgcccgactatttggaggtgatcaaaaagccgatggatttgcagcaaattcgtaaaaatgtgtcggagaacaaatacgaattg

SEQ ID NO: 92387 - DNA, 651 bp, Heterodera glycines
  SCN-specific regions: Sequence locations=1-651
aaacattttaataattcgccaattctcaatggaatcttaaaaaatgctgaaataattgaccacctatcgaagaaattacaattcgatgaatcagaaaaagcacttctttccattgtcaagcgcaatgttgaccgtcttcatcaattatgcaatgaatggataaataccggacacttctcatctattcccgaccattaccggttattgtacgcattttgctgtgccgttcgtgccaaactcagttatttacttaaggattatttcttgtctctccgacattgtgacgatgtgttgctgaagggcaatgatttggaggatgaaagtctgtccaaattcgcttctttcttgtgccgcaaatttcttcctccgccctcagaagtgccggaacatcagaccgattcaaaaaaagcgcctaatttactgccgaattctgtccaaatttcgtcttcagaattgccttcgctcgaatatttcttcaacaatttttataagcttcaagtccccgtcatcattcgtggaatggtgaatgggcggccggcatttgaaaaatggagcttttcttatttgaactcgatttgtgggcatcgtttggtccctgatgaattgggtagtaaatacacggatgacgactggcgccagcagatgatgagt

SEQ ID NO: 92388 - DNA, 556 bp, Heterodera glycines
  SCN-specific regions: Sequence locations=1-556
actcgtgtcggtgattcattagccattcagaatttgtgtctttatgacaatttgaatttgcctttacgtgaaaattcactttttgcgagttgtcaatacggaggacctttggccattggattgcctggggcatctcctaattcgtggacaattggaatttacatgcaaaatggggcccaaattgcatcgattgaggccagcggagtcttccgacttttttggacaaagtgtcaaaagctaatcgtcgtaaaccaaaatggccgtgtgcttttgtacaatcctttgggtgtccatttggccaccttcgccatgggcaatgaatcgttagcacttggacttgccggggccatggccttttcctatgtcaatgagacggggctggcggtgatcaacgaggccaaacacatcttcgcggtcaattcggtgaacagccgagtgccgtggcgcattcaaaatcagcaaagtgaaattgtttttattaacatttccggatcatccaaaaaggggagtccatccaatcgttgacttgttgggccgtgttgaccagtgctgttaa

SEQ ID NO: 92389 - DNA, 551 bp, Heterodera glycines
  SCN-specific regions: Sequence locations=1-418,457-551
cttaagactcccttaagagagactcttctcttctcatgtacctttaactaaaatgttgttggcacaaaaagtaaagggggaaaaagaatacaaatcatccgatcaagggctaagtctcaacagatcgcagtgtaaaagctgctctactgctaacaaccccctgaccagtagtcaagtcgtataaaagtgattttgcgccccgacgttccaccatggcacacgagtgctacggctttggcaatgtgcgagcaattaagcacgcacatcgggccagatgctggggcatttgggctgcaccgcaagcggcgcataagtagtgccccccgacaccggggagcaagaatattgctatctcgcttgagcgggatttcaatagcttcacatcattggtctatcgaccaaacacatgaaccaaatacctgaacctgcggttcctctcgtacttagcaggattactatcatagcatcaggtctttggtagggtaaaattaaccagtctcgcgacggtttaagcctagctcacgttccctattcattggcttaacattcag

SEQ ID NO: 92390 - DNA, 648 bp, Heterodera glycines
  SCN-specific regions: Sequence locations=1-167,189-195,219-315,345 -355,377-405,462-484,506-648
gattactttcaacactcacatgtccaccaattttgtccagcaccgactcgggcccatttctgtgcacttcgtccatcagttgttgctggtcggcggcgaacagtttgttcagcgactgtttggccgcgttggatgaaagaccgtggagcagcgcgtcgatgagcacggacacagagttggaggaggagtcaactgagggggaaaattttaaaaaatccaaggggtgaccgaacaagcgccaaaaaccctaaatcacaggacatcgctagtagagaagtgaaattaacgcaaaaaagatttattgttttaaaaaccaaaaaaaaatagttaaaaattttaattatgtctgtctttcccgtccccgtgtcgtccccacacaccccgattttttaaaatttactgtagaaaatttaaaaaaatattgggtttttttataataaaatttcagaaattttttattaccgatttttctaaatttaacgaactgctcccgctttgcccttcccttccgtcacacacctttgccattgtgcagcacagccaggcgcatcgcgttgctcttcttcatgcccttcagcgcatttgccaccaatttgcgcccgtcagcgctgtccaaatcggcgactgtccaaacggtgagccaacagg

SEQ ID NO: 92391 - DNA, 625 bp, Heterodera glycines
  SCN-specific regions: Sequence locations=1-625
gtttgaggaattaatttcttctcctaaacatgtcccgtccaactccttccgaattaacagtcgaaatgttgaaaaagcgtatcagtggcggacggatggacctcagttccttgcgattgaacaaagtaccaattgagctgatgtgtcgttctcttgcaggacaacgaattacttgtgtggacctgtcggacaatttgctgacttctttttctgctcaattcctccaatttttcccagacatacaagaactcgacttacactccaacaaaattaaacgattacccgaaaattttggtgttttgagtagcctgcgccggttggacctgtctgaaaatcaaataaagaaactaccgatcagttttgctgaactcgataatttgcggtggctaaatttggtcaataatccactcgaaaatgatttggcggaggttatcgggagttgctcaaacgatgaagaatgctcattcgctgctaaaagtgcagtgcaatacgtccaattcttttccacggtttcctccgaatcgacggcaattgcggacacagcatttttgcaaaatgagacttcgtcaacttctaacaattcagacaacataaatgtatcggcacttcgacaagcggacaatgc

SEQ ID NO: 92392 - DNA, 582 bp, Heterodera glycines
  SCN-specific regions: Sequence locations=1-166,189-465,492-582
attgagaagctttgcgggaaatttgctgagccaaagtgtttctatccaacggaagcttgcgacaacttcactatcttcaaacaaaacgcagaaaccactgaactcaacgcggacaatgaaacaaaatggatccagctgaacgacctcccgaccggcgagggctgtctcccaatcaatatttccattgtctccactcttcgaaatggttacaattgcggtgtatcgaatcaattgaaggacactgcggatgcgttggcccgtgtgctttacctgtgcttactgtttctgttcgctctcgttttccacactttggctcagcaaccttcggaagagtatgacctgttcggttatttgtgtgccgcttacagcgtcttggttttgggtttttcgaccgtgacaacgattttggagtcagtgaattggaccactctttgggaatgcaccaatttccgaccctatcagtcctttctgttgttccttttgcttcccagtgtcattctgttctgctcagggatttacgaaaccttctccaactgttctctgcttaaagaaagcgatgccgagaacgcgcaaaagcaaacc

SEQ ID NO: 92393 - DNA, 621 bp, Heterodera glycines
  SCN-specific regions: Sequence locations=1-327,349-524,546-584,606-621
tgtaaagttatgttgaatgatgaaaatatgtgtgacgatttgttgatggctaatgttgcaatcacaacataaattctcaccacatctccttcggacattattattatttttcgtgcccccccccccccccaaaaaaatggtatttactccggaaatgacttctcgactgcttgagcttgttcaagcacgaaaagacaacttgtttcctggttctcgtcatgccgaagctggacgaatccaaaaagaggcttggtcgactgttactgaaactttgaattccgaatttccgatcgacgttcccgcgggtggtctgaaggtacaacaagtgcaaacaagatggaaaaatcttcgtcaggccggaaaagaagaagcgcaaaaaataaaaaagtaaaatcattttgaattattcttatgtgcatcggaacactaggcaccgccttggaacggggggaggaccgcaatcatcggtttctgacacttcgaaaaaagttattgacatgtttggcacatctgctgcttttgccggagtgccaggcggcggggagactagcactgcccgtggtgatattttgcaaatggaaagtgattacctcggtgccgaccagtttgttcccggaaaaa

SEQ ID NO: 92394 - DNA, 622 bp, Heterodera glycines
  SCN-specific regions: Sequence locations=1-70,110-195,217-253,490 -499,521-577,619-622
ataagaataaaactgctcatatgtttatacatggcataacggtaatttttctcactaaaatctttcgttcaattttctatgatataattttttaaattcctattttcgatatctaatattccggcggttttcatttttcggttccccctttttcggggccgtttatctaactaatcgatattctcgccgcgtggtgggttttcatcttgccacaagatttgtccggcaaacacactaattaccactccaactctcttcttctgttgctgtctctccctcccctctcctaatccattttttcttcttcttttgtctcttctttttccccctaatccccctttccgctctcttcttctaccttgtctctccttcctctaactccgcactttcttcttctcttgtctctcccttttctctaattgcctcgccattctctctccttatcttgtctctcccctccctctaactgcctccccactctcttcttctgccattggctctcctcagccccacccccattacgaaggtgaatgatgcttctcctcgcgtcctcgctgcgttccctccctcctcggctttttccttatttttccaacacttttcaaaaggctttttccaacgc

SEQ ID NO: 92395 - DNA, 631 bp, Heterodera glycines
  SCN-specific regions: Sequence locations=1-631
attttcgaaccgcttcgttgagtacgtctcggaactttgtcgtgttccagcgtgccgggtcttctcccttttttgtgaggattgtgcgcaggaatccgggagtgagcttcttttcaagcatgaggaaggttggcggaccttcgatgtcttctcctgagttgttgagttcgcgtgtgagcctttcgagttgcaggaggaattctttggtgtcgcgcaggttcttgcagggcttgaggtttgccaattcgaagtgcagtgccctgatgtgttcgtccggtgcgccgtatgtgtccttcagcaattggagggccgtgtcgtaattgttgtcctccagtcgaaagccggccacgagttcacgggcctctcctccgagcaggttgcgcaggagattgaacttctccgctttgctgagtgcgtgtgtgccgattgctgatttgaatgagctgcttgagcgtcccgctcttctttgtccgccttgctgcggtagagtcgggattgaactgtgagtgtgcttatgaggtcgcgcaagtcgcgcagcttcagtgctgcttcgtcgactttgtctgttgttcgctcctttttctcgaacttgttgaaatctgctctgctggatcgcgttccgttgcaggca

SEQ ID NO: 92396 - DNA, 585 bp, Heterodera glycines
  misc_feature (556)..(556): n is a, c, g, or t
  SCN-specific regions: Sequence locations=1-585
aaatccggagggttctgcttgactatgcacatcaaaaggttggagaacgtgtaaaaaacatgaaacatattatttattgattatttttttcccttataatttatgatgtggctatggcaaacaaattgaacttgacaactctctgcaaacaggtgtacaacactttgtgtacaaaaaattcgatgtcaacaaattggtacagaaactagcatctacaatgacccaggcgctgctgatccataccaaataaggcaaaaaaattgtgcaccgagggaccaaaatgtcccatgttgacctgaaggtgggcgcagggccaatgctgggaaaattgtcaaaaattacaatgacttctggttcaagctataaataagcactgtttcacttttggcagattgagagacggcctggcaacaaagtggtcactttggtctccaatttggcttcttttggcattgacgcgagcgcgttggacagcgaaatccgcggcaccggcacatcgattctcgcaacggcacccgcctgtgaaggaccccaactgttggtccaaggcaacgangtgtattcgagaatagtgttgtgcttcga

SEQ ID NO: 92397 - DNA, 638 bp, Heterodera glycines
  SCN-specific regions: Sequence locations=1-638
attaatctaaggcaaataagcagcgaacagcaccgaacggcgagaagttttactatttggcgctcctggacagaacacaaggtaacaacgacatcggttcaaatttttggaggatttcggcattttatcgatctctgggggagacgataaacttttcgacttttgatattgttctctgggggagacaatcaacatcaacaatcgttctctgggggagacgaaacaaaaacgcttaaaaagaacaaacaaaaaccaattgtttgttaagttctctgggggagacaaattcggaaatttttcgacactcaagtcacctggggggtgcaaatagtcgattttgaaatggaaaacttggaacggacactcaatcatactcgtttgactagacagcgagctcaaaatgaagggatattgctcgacagagatggaaatgttttttttcgggagaatccaccaaatagaactttaggcgtgatgaaccaaaacgtggtggtggcggatcccaatttggagaattcggagcagctggactcgatggaaatgagacggcgccttttgaacccgaacaatgacagcgcacttggacagttgcgacaaaatgaacgtgccagccttgacgaaaacgaagaagaggaggc

SEQ ID NO: 92398 - DNA, 610 bp, Heterodera glycines
  SCN-specific regions: Sequence locations=1-261,286-341,369-462,493-610
gaagtttgcttctcagcgaaggcgagcattccactgcgtctgggtctcttgttaacgtccgaatgccgaacataaaagtcttttctgggtcttcacatagcgatttggcacaacgaatttgcgacagacttcagcttgaagttgcaaaagccgctttaaagaaattcagcaataaggaaacaaatgtcgaaataatcgaatctgttagaggcgaagatgtctacataattcagagcgggtgtggagaaatcaacgaccacctgatggagctgttgatcatgatcagtgcatgtaaaattgcttcagcttgccgcgtcactgccgtcattccgtgctttccatatgccaggcaggacaagaaggacaagtcacgggccccaatcacagcaaaattggttcggttatttgcctttttatgcggagctgttctgtcaggtggctaatatgctttccatctccggtgctgaccacatcatcaccatggacctacacgcttcgcagatccaagggtttttcgatattcctgtggacaatttgtatgctgagccggccatcctgaagtacatacgggagacaatcccgcactggcaggaatcggtcattgtgtcgc

SEQ ID NO: 92399 - DNA, 612 bp, Heterodera glycines
  SCN-specific regions: Sequence locations=1-45,71-532,554-612
tgttgcttttccgttttcaattgtttctcatcagcctttcctccgttctgccttttctttctcttctcatcaactctcttcccacattcgtagccgcctccttctctgctcatcgttctccacaaaaacgaacaaaatgcagaatccgttggaaatgggcacctatcgcgtcgggtccgagacgtaccggcgcaactgtccgttggaaaaggcgtccaccgctgcgccagccgctggcgccgcttttggcgtgacgacggcggagaacgacgacggttccgcggacgaacagaccctgagtccttcttcgtccggccgctgttcgtcctccgaagttcgtcaagcggattttgctgagtcggattatggaagtccgggaaaaagggcatgcatttcaactgagaaaagaacggcgacgacgattttaacagcgaaagcagcgcaagaaattggcgaagtatcgtcggccggagaaaatgcgccgttaattgtgcagcgaaaaactgtcgaggtggtgtcggcacaggacggatgggtgtacacggagcaaatggtggaggacaaatctttggttggaactgtgaaatatgacggggcgaagcagtgctttta

SEQ ID NO: 92400 - DNA, 454 bp, Heterodera glycines
  SCN-specific regions: Sequence locations=1-454
cattaccgcggctgccactttggcttccgctttccttgccagcggggcttctgctcgattcaacctcgttcgccagaacaacactggggtgtactggggacagaacgcgggctatgacactttcggtaccgggcatcaaaaagatctctacaccacatgccgcgaccgggccatcgatgtcgttgatgtctccttcgtcaccaacttccgcggaaaggacggatggccaattctcaatctttccgaccaatgctggactttcatgaccaacaagaccaccggtctacagatggatgtcctcgagtgcccaaccattggtgaccacatcaagaagtgccaggctttgggaaagaaagtcctcttgtctcttggaggtgccacctatcgaagcccaggatgggctaccgtcgccgaagctcgttctgccggcaatgatatctttgccatgtttgct

SEQ ID NO: 92401 - DNA, 536 bp, Heterodera glycines
  SCN-specific regions: Sequence locations=1-536
gcgacattctgatcaagcgcggctatgctttcgttgagttggacgatcctcgtgatgctgatgacgcggtgtatgaccttaacggtcgctcaatgatgggaatgagagttgtggtcgaaatcgccaaaagtcgtccatggcgcagtggcgattcttggagttcacgccgtcgctcgcgttctcgttcgcgctctcgtggcaaacgctcgcgttcgcgaagtcgctctcgtgatcgcaaacgccgcagtcgtagtcgctcgctccgccgtcgctcacgttcgccaaaacggtctcgctcgcgctctgttgcgtcgcgctctgcaagcccgccggaaccaaaaaaagcgcgccacacgccctcacgtagtcgttcgcccgacaacaaacgtcttcgttcggcctctccccgtcgatcgcggtccatcacgcccaatgaccgtggcagtcgtcgtcgcagtgttgccaaggagcgcggtagccgctctccaaaagatcgccgcggtggcagccgttcgccggctcgtcgcacaagtcga

SEQ ID NO: 92402 - DNA, 660 bp, Heterodera glycines
  SCN-specific regions: Sequence locations=1-238,260-660
gtttgagctcaatccaaagctcgactttacactttgtatgtaattgaaattttgcatcaatttttaattgaaattggaatggactgttgatcaggcaattttttcacgtgcatacataaatacttgggtaaattgtgtgtcgatggattcatcaaaacaatattacatgcccagtggcagtaactttgataaaaataaagcattgggtcaggttaatgtcccccatcattcgcaaatgtcgcagcaacaacaacaacccaacccggcaacacttctcactcagggtcaaatcttgaatccacaaaacattgtggtggtgtcggcaaatactcccgctttgataaacacagatttgtcagcgttgattgacattgcgcacaaggaataccaagcccaaaactacgccaaggcagagcagcattgtttagcccttttacaacaaaacccacacaacatcagcgttcttttattactttcttccatcgctttccaacaaaagagttatgaaaggtccatgcaattctcgaatatggccatccgaataaatcccgaatgtgccgaagcatacagcaaccttggcaacgcgcacaaagagaggggcgaactaaccgaagcactcaagaattaccatatggccgtgagattaaaacccgacttcat

SEQ ID NO: 92403 - DNA, 551 bp, Heterodera glycines
  SCN-specific regions: Sequence locations=1-33,55-517,540-551
cttgaaatgggcctttcgttgctcttccgaagcgaaacccaacgggcagagaaagtcgcgataacagcacagctcattcagtggcacagcttctgcacaattattaattgcaaatgacgcgccaattcgacggccaatccgtggcccagcaaatagcaactgtccgtcaacaccaactcctcccccccttcgctttggcattccaaaattgcattttctctgcgaatttcctccgccgtcggtttttgcagcactctctgtgctgtttggtgggcaatgtttcttaaaatggaaaaaccttcaacttttggctttgtccgttgctgtgatttgaatttccgtcgagtaaataaacgccgtgcccttcggccacttcgaccggcgattggtgcgcgatcagcaaaagatcgccaggaaaagaggggacggaaacggcgggaggaaagtgttcgagcacatcggcagaagcgacgaaaacgaagccgagcgacgaatggacggagagaaggagaggcccaaaaacaaaagaatggcattttggccaatttttg

SEQ ID NO: 92404 - DNA, 644 bp, Heterodera glycines
  SCN-specific regions: Sequence locations=1-329,361-594,616-644
attgggacggaagtccaaattttgagatcggatggccgcgttcatgcggcactcgtcacagcaatcaatgaacgaggtgtcagtgttgaatggatggaagaaggcgaaaccaagggcaaacagttggacattgaagtgattgtcaggaacaacccatctctctttccttcccgtgttcacaaaccggagaaatcatgcgccgacccgaaaactgcgtcaaatggagttgtctcgaacaaaaatcggcactctatcgccgcttcatcaagcatgcaaacggttgttggccgacaaattgattgtggcccttccgtgggttatatcagcaagtcgccgccaccaccaccaccactgcagcctatagcacccgtcaaggacatcaagagaatttgtgccggaatgagcgtcaaaattgagcgaagcaacggacgcgttcaaaccgccctcgtaacgacaatttttcccgagaaaaatggtgctgctgtggaatggcaagaacagggtgagactaaagggaaggaagtcgacattgaaatgctggtgcgcaacaacccagaagtcttcaggaccagcccgtcttcgatgcacaacaagaatttcccatttttggcccaagtgatgaacaatgtgccattgtcaatgga

SEQ ID NO: 92405 - DNA, 107 bp, Heterodera glycines
  SCN-specific regions: Sequence locations=1-87
gagaccagttgccagagtggtagtgtgttgggtttggtggcagagcgaaagttcgagtccactagtctgcggcagaatttttcgagtaaaaaaaaaaaaaaaaaaaa

SEQ ID NO: 92406 - DNA, 617 bp, Heterodera glycines
  SCN-specific regions: Sequence locations=1-617
aaagtgccatctttgagcgcagaccactcaaatgccaagatttaactgattgccaatatgtcaacgtttccgtcggtgcccaccgatgcttggcaattggttttgtggatggttcagcacccgttttggagctgttagcaccgtccgttgaagaacgtgctcaatgggtggacattctccgaatgacacttcggcggctgaactttctgaacacggagagttttgacaatgagcaacagagggaacgcactgacaatgggccgtcgcaatggccacgtgcggcaaacgaatacgtcaccttggccggcactgctaacagtgatgccaactcatcgacgagttcgcctcctccgcaacagactctccccagggcaaatggaagaagggaagtaacgcagtcgccacgggtgccaatgatacaaattccgtcgacgcatttgcgcacactttcgacggaaacggcgcaaagcagcgaaaggagccaaacgcaacttcggaaaggtttggacgattcattgccaccgatgcgccaacactccgagcaacaaacgaatggcgaaaggaaagggacgaggaaaaccgacggaatgacaagcggaggggaaagcgaagagcat

SEQ ID NO: 92407 - DNA, 538 bp, Heterodera glycines
  SCN-specific regions: Sequence locations=1-463,485-502,524-538
aatttgggtaattttggaagctcggggaagggttaaatgtgtgaagaaaattttcgattttcacatttttggtctaaaaatggctcaaatgatcttttattgaagcaatgttgaatttcagttcgtttccgtgtatttaaacaaagttgaagcaaaaatgtgaaaatcgaaaatttatattttcgactttttgttcgaattcgggtccgggattaggaattggtctaaatgggcgtcggattcgtgatcagcgaccccgaaaaccccataaaaagtgtttttatgacttttgaaaacataaaaaaatttcgaaaaggggggggggacaaactgaactattaccaaaaaaacaaccgccattgctatttttagtatcatatttcgccagagtcatatttttaactttaattggctaatcataatgatgtatttgtatgtacaattgtcactggaacataaaatgaattttgttacatgcatacataggatattggttaaaaacaaatggaagaaaatgcaaaaattaactttgtatagt

SEQ ID NO: 92408 - DNA, 127 bp, Heterodera glycines
  SCN-specific regions: Sequence locations=1-9,32-127
gggagtgccctgcttcttctccctcctcctccgcacctccgtccgaccttctgcttctgttagacatgcctcggccgtcgcgactccctccgccgccggtccatctccgccccgggaaattccccgg

SEQ ID NO: 92409 - DNA, 645 bp, Heterodera glycines
  SCN-specific regions: Sequence locations=1-403,425-645
ctcaaattggcacttctttcgccacgtttcaatgcgttggtggacaaacatttcaatggcaaaagcgaattgacaatttggagaacgatcgaaattcgtcgcaaggacaaaggaccagaaccgaagctgtttgtacaaatggatgacaaatttgtggaatttccattgccggaccgtccgttgcccagcaaaatccttttaagcgccttcagattgattacattgatcattccgtcatcgcttttcttcgttccaatcaccaaattttcgacaaaagcggcaccaatttagagttgtggatttcttgtgtacgtatcacggatgagcagccgatttgggacatttttgttcgtgaaatttggcccatttttcctacaaacattcgccatttgggctttaacggttgtgatgctttggatattttttgtcgtcgcacttcgccaacaattctcaccgatctcaaccaattgatttcaatcaaatcatttggtcggttgcccgaggcgattggtgatgattttgatgtgccaaatgcaacaatttctgctggccaagcattgtccaaatggttgcactctccgagaaaagatggacaacccaagcgattgcgttgttggcaagggaactttggatggatcaacaatt

SEQ ID NO: 92410 - DNA, 637 bp, Heterodera glycines
  SCN-specific regions: Sequence locations=1-181,204-637
gtcgcccgcttcacattttgatgccaacttcgtccgtttgtctccttgacgactgtccccccccccgcccaccaattccctttctgtgccattattcacttctgccggtcgtcagatgatcctccacctgtggtcgtacacttttgtccctttggtctttcgcccttcccaattgaatttccttttccctccatttttctttgacattgattttccgtctcattttgttttctgcctttcttcgctggtaatggacaacctcagcgacccctccgccgttcttccgtcgtcgccttcccccggcgattcttccgttccttcgtcccccttcgatgttgccgcttcgtcttccttctccacacttattcccggcttcaaccactcttctcatcttcaaattgtcgatgtcaaagttcaaaaagcggccgacgccgccttcaccgatttccccgcttacattaccgttctgatgagcattctgatcgcggtcagcttcttcctcaacttgggttgtgtgggcaccattctgtgcaggttggcaggtcaaggaaaagcattccgttgccttttgcccttccccagtcggaagttgcgttgctccatgctttatctgatgttcgcactgctcgctctcctc

SEQ ID NO: 92411 - DNA, 636 bp, Heterodera glycines
  SCN-specific regions: Sequence locations=1-636
cgcacaattgctcggggtgtataggaataagtcgatggaacatgccgtccaactcttcgctctggctaaggacattcagtccgctcggctttctttgctttccgccggcagttcctcctcgtctaattatatccctgcggcgtttgctaccagtaattctttaagttcgaccgatgagagtatgaacagcactgacgacgaagctttgacaaccgacgaaagtgaggaagtgtcgcgcatgagcacctcagacccaattgaactgcaacagaacgccacttcgatggattgctctgccgaagacgcaaatgccaacgaatcttcggcattctctttgccacagacggaggccaacgaaattacacttgaacgatgtcaaagctttgtaaaaagcgcatcgcgaattgccattcaatacggaacttcgttgagttatgaattcaatgccaatttaaagtccattttcgaccaaattgaaccttcggatgtgcgtgcagtgccccctcgtgtccaccccctctgttggtacgcaatttggcgtgcaacagatcgtttccgtgcattgaatgggcgattccccggaagcattgcttcttctcagaagggagatgcaaaggaattgaaggaaatcgtcgg

SEQ ID NO: 92412 - DNA, 634 bp, Heterodera glycines
  SCN-specific regions: Sequence locations=1-104,126-292,315-634
cgtcttcgttaccaaaagaaacagcaggaaaagggcatcatgccccgacgacagcgaaagcccaaaattgaataccgagcaagttccggagagccgagtttgggtggctgtgcacttgggtagctaatgatgccatttgcttattattgcagaccgaatattggacacaattgaacgtgacgtaatgcgaaagaccaccgaagcacgccaagctttggtacgtaagcaacaagttgagcctaagaaggaggaacttggcgagcatgagcaagtactgttcacttccgtggacgacggcggcggtggcagcgccagcactttgcccgcccaactgatccaaacgacaacatcggctgtcggtctgaacgtaccgcacagtgggcaaaacgtggtccaatatgttcagattcccgctcatggcgttcagaatgggctaatcctcgcagagagcaaatttgttccggcggaatcttctgatgcacaatcccactacgcgttggagcacacttctccccaaaagtttgagcgggggacgagcgggtcggccaacagcagcaactattaccccgtgtccatcatccaacatgaatggcctcagcggacttctgttgtcggctctcaccaccaattgcag

SEQ ID NO: 92413 - DNA, 588 bp, Heterodera glycines
  SCN-specific regions: Sequence locations=1-464,487-588
gttttatgtgcagtgggctgtttctatttagtatgggcatacggtgagtactcgacgcagattcccgatctggagcggcagggagttgtcccccacgcaggtgccccgtctgacgagatgctgaaaaagctgccaaagccttgtctgattgtttacgacgacttgatgggtgacattgaggccaagaagttggccgatctgtacaccaaaaagtcccaccataacaatttttccgtgattttcctcacgcaaaacctgttcgataaatcaatgcgggtgccaaggtccaacgcccagtacatcttcctgatgcgggctcccaacgacatgcttagcattcgtaatttggccagccagatgttccctcgcgagcagggattcctgatggatgcctaccgacagacatgtgccctaccgtacggctacctgttggtgactctccacgcgaacaacattatacgcctaaggacaaacattttcccagacgacgaggagagaatcatttttgcccccaaaaatggttaagcgggaacagaagatcggtgagcgggttgtgcacaactacgactatttgaagaagttgggaaa

SEQ ID NO: 92414 - DNA, 638 bp, Heterodera glycines
  SCN-specific regions: Sequence locations=1-16,38-321,344-638
cgatgaattcgaattcaaaggcttcttctcccctcggcactgccattgctttggccaccgccggaggcgaggtgaccattcaaagcgcaatcattgccattctctacaggaaatgtgccaaactgactcaaatcattcacaatttacagaccgaaaattcgaacacttcgcattctgtgaggaacgaattggtccttttgcgccgcactgtccttttgttggagaggcgaattgcccaaagtgaggccaatcgtaccgaaatgccaaaaactgaaaaggacgacggattgggtcggcacgaaatgtgcgaagaacgaaaagccattggccgagtggcgtcggcaaacagtgcgtcggagggggaatatgcggacgcggtggacgacgaccccgacttttttaaaatgagcagcaaaacgaatgggactaaagtgtgttctgcggttgcggactcaaaatttctggaacaaattgaccgattgcacgagacgggcaaacacagcgaagcgtatgccgaattaatgaaagccaacagagaagagcccgaagtgttgtggcgattggcgcgagtgtgccaccaaatggcgtcttcgttggaactgaaagacccgaggaaaagggaactcctcgacgaagcc

SEQ ID NO: 92415 - DNA, 236 bp, Heterodera glycines
  SCN-specific regions: Sequence locations=1-147,168-236
gttttacacagtccccacaaaatttagtttaattttgggggttaaaaataaatttccaaaaataaaaatgaaattgaaaatgctcttcaaattttttatttttgaatgagtcgccgaaagggaaaacatttgatcaatcagaagcaattatttatttatttatttatatttgttaatgggttggccattgccatcggacaatcggagaagcatttgaacagcagcagaagaaaagg

SEQ ID NO: 92416 - DNA, 328 bp, Heterodera glycines
  SCN-specific regions: Sequence locations=1-328
agtccgggactccgccgaccgcttctctttcaatggcgcactcgtcggagccacgcaaaatgcggaagaatccgtcctcgccccagtccgtgttccatgagttggcaaccagccaatacggaatgccattgtccgcgccccatccgagcagtttcaccgcgtgggccccgcccaattttccggcgacatggtaataaacgccgcccttggaattcagaaagtcctcatacacttcgaaaggcacttcaattggtccgttgacgaacaattcgttttggaagggtttcccccaaatggcaatggcaaaggcaccttttgccataaaatt

SEQ ID NO: 92417 - DNA, 648 bp, Heterodera glycines
  SCN-specific regions: Sequence locations=1-36,65-152,186-623,645-648
attggccataaaatccgggccctattcataattaggtaattaattttttaatttttaatttaatcgaataaaaatgcaaaacttccgactgcagaacagagagcccccaacagaaattgaatacataatgtgataaggggaagaaaggaatctaatcgaacttttcaaataaacaattgaaaaaagagatgagagaaaaaaagggaggaaatgtgcggtgaaatgaattgaagcagaagagattcatcggattgttcgaattgcactccgacagttcgaacacggtgattttgcttcccaagaaaattgaaatggagtgaaaactcgaaacgaaaaaccaacttttaccatcttatttttaatcctcggcttaactttgcacaagttacgcccctctctaacaaagcatttgcctacattaaactcttcgttcaaataagttcgtctttctttgttaaatgataagcatgaagaaaaggataatgataatttcgttctacgaatttttttcggaaacattccggtttctaaaatttttattttcttttcattttcaaacttatttttatgtatgttttcgcgcaactctactggggatggacggccaaaaatcgctgcttttatacacttttttacattgcatttgcc

SEQ ID NO: 92418 - DNA, 650 bp, Heterodera glycines
  SCN-specific regions: Sequence locations=1-24,46-313,337-403,429-650
cagacattgtgcccataattcaccggcattttacacgcctttggtctgaagccgacatctgatcacggcaccacaataaaatgtgtcactgttaagcggcaatacgggaactgatcagattaccgtaactgcgggacgaactaatgcaaaacattgataattttggacacgatcacggaaaaaatcaatcctaagtgatcagaaaatgttccgccgatttcggtactttgacgaattctcgtacatcaatgcttctgtggattaccataacgcgccgatcagtagtgatcagatgtattcggtgatcagcaacatttcctttttaaaaatgccgtgatcagacgcgcagaccgtgccggaaataccggcaactctatcatcatcagaggggccaaatgccaacaattaaattaaaaatataaaaaaatcgacgaaaaatcacttcaaagctaggaaacaaaattatttctgatcagtgaggaagtgtgttggcgatggacaaactgattaataaaaaaatgtacaacaacttaaacagaagttgaacagaagaagagggggaggtgattagtgattaaaaagggaggaatcgaacaaaattcaaatgttcacagaggaaaattggcgaaatgccaaattaacaaaaaaaa
